United States Patent 9,012,723 (ISOLATED NOVEL ACID AND PROTEIN MOLECULES FROM SOY AND METHODS OF USING THOSE MOLECULES TO GENERATE TRANSGENE PLANTS WITH ENHANCED AGRONOMIC TRAITS) - sequence listing, part 26

SEQ ID NO: 143023 - protein, 80 aa, Glycine max
  Coding DNA Sequence Number=SeqID_51338
LRESISSVPIYYETQSDIRVKRYCRLNLFRASTFNFEHLDILRDSIRHPSKKLLSFEFAQSFGFAFRASRYITGLNPTSE

SEQ ID NO: 143024 - protein, 130 aa, Glycine max
  Coding DNA Sequence Number=SeqID_51339
HGLEIYPKAHENPRAFPWISGPIYLESFIQCPCGVGLHQDAHAKVEYVKRLYDQAKVQIAKKNESYAKQANKKRKEVVLEPGDDPGHLRANVFQEGGNDENPENGQIQTKGPSGEGRRPKWRRTKPPSGE

SEQ ID NO: 143025 - protein, 101 aa, Glycine max
  Coding DNA Sequence Number=SeqID_51340
MQQGQADILIARFPDPNYGVKMVNFIITPLTYRELPVSSSLRHLEIPLSFALVDSTQVSITPKRKEFNMDFKNKVKGFFKGIVKTPYYSTQHIRDTKRNSN

SEQ ID NO: 143026 - protein, 73 aa, Glycine max
  Coding DNA Sequence Number=SeqID_51341
  Subcellular localization annotation: CTP_CleavageSite=34; ConfidenceScore=5.05e-01
MTLIIGKPFGGGHTWKSLPVTVPQVGPNIKTNPLASHGGASINAIEKDRPSGSKRLENVATSRRFIYQSLQAA

SEQ ID NO: 143027 - protein, 131 aa, Glycine max
  Coding DNA Sequence Number=SeqID_51342
MLLSSNVIYICVRVVMLVRLIRTRLFAAARVKSCPSMHSSSVIASLSSCARIVGAPPISGGGPGTVKRKLLVWIWSPLKVRTRSPLKVRACSPLKFRTCRLSKARECSPMMARTCNPLKVRACPPLKMGNM

SEQ ID NO: 143028 - protein, 74 aa, Glycine max
  Coding DNA Sequence Number=SeqID_51343
MNIEESIHVSFDESNVISPRKDVLDDVSDFLEEIHTHERDSKGKEMKAMRILKTTKLKQTMIFQKSGKLPEIIL

SEQ ID NO: 143029 - protein, 84 aa, Glycine max
  Coding DNA Sequence Number=SeqID_51344
MADVNSAPEEVHRLFNYYLDKINNVYPLSQRALRGRARARLTGALPKGGKMRGVATNVYLWKTSGKPKETGQKENSKFGSCIYA

SEQ ID NO: 143030 - protein, 170 aa, Glycine max
  Coding DNA Sequence Number=SeqID_51345
MPAIDSRGSPFYQFMGHPPDIGGRPTVQAQPEREAITQLLCIPGDRDHKAPSGPGGVQRGPGVSSFGYGPLSVLQGGRSPLARSRHCDIGIAPAGHPVDPETSNRVLGFPALITGLCQFYGVPATPSKVISPLLIEFSSRGIAPPGRRKAKHHSSLGMASNRQQMHRRHL

SEQ ID NO: 143031 - protein, 86 aa, Glycine max
  Coding DNA Sequence Number=SeqID_51346
MTKSKGKDPLEGLGGPMTRARARKAKEALQQVLSILFEYKPKFQGEKSKVGTKAGPGPPLEVAGIDKLDEDFTGHKGTIGPGSCSG

SEQ ID NO: 143032 - protein, 207 aa, Glycine max
  Coding DNA Sequence Number=SeqID_51347
KGHALRRPYRTRARARVMGEVEEIQEKMKADMEAIKEKMAHNDGGHDEREEDNGKPMRLQLPATSVVAKVNPTSPSGLKQMNHPTSNMVGKDLGSTGGPHDVQIQNEHAFPSYGLPLNYTPSNVAYTPNKNTHEIPHHNLADFEPWLGYTTEGQAVGGIPLQNPLEGPQYHPQLHLLHSTAVKNPHDYGRNGKVGSSRGKAQLPLKE

SEQ ID NO: 143033 - protein, 99 aa, Glycine max
  Coding DNA Sequence Number=SeqID_51348
LRWWSREVFEDLVVPCSVFEVLLVAVVPISSEVRIYFVFRPIPEEVLPETTSGIGLSNFRKTFFWKLLRPIPEEGLPEVFSGSTSSGIGLSNFRIPSFG

SEQ ID NO: 143034 - protein, 147 aa, Glycine max
  Coding DNA Sequence Number=SeqID_51349
MAPTRHPLDPDKSNRALEFPALITGLCQSFGVPVAPTKVIRPPITRAFIEKYCTQRQAQGNAPQAAGAPPPPHQAGPARSFDMDQYLRHLVRQQAANHRAHVQTHDCLYQLSLSMQSQGFTSFSCPTPDQFRAEVAWPEDWPEAQAG

SEQ ID NO: 143035 - protein, 222 aa, Glycine max
  Coding DNA Sequence Number=SeqID_51350
  Homolog annotation: Hit_ID=A5BSR3; Match level="QueryCoverage=54%, HitCoverage=39%, E-value=8e-11, Identity=36%"; Hit description =Putative uncharacterized protein
GYDYLEQKLLAEKTKKKLEEAEQSGSVDGIINPSSPVRRHVKWKMACTKKTGEMTTEVAKEIAEKIDSFEEQATQGSFVPHGRQDDLAVAIGHPEHPGRVRAVGADVTIKQYFGSAPRTSHSASSLPLDKLQQLTQQIRDQLKESITEKVTRQVMASFSHMQPQLQSQMQSQGLAVSPEPLVGPSGPRVSTKGSCVDPSGNDPETGDSDKCGLYIEADPARL

SEQ ID NO: 143036 - protein, 131 aa, Glycine max
  Coding DNA Sequence Number=SeqID_51351
  Homolog annotation: Hit_ID=Q1RSH0; Match level="QueryCoverage=52%, HitCoverage=33%, E-value=5e-07, Identity=40%"; Hit description=H+ -transporting two-sector ATPase, alpha/beta subunit, central region, related
MGGGQHCRMAKFIAGILTGGKTLGDYISTMISRLSIRIWHGRLQNDFISTMGSFSQNIWRWDLKWRRHLFEHEEGVAVAFMEDITAYTLQNHLKDKLLWKADPSGLYSTRSAYRLLSSQNSTALDGINFQL

SEQ ID NO: 143037 - protein, 280 aa, Glycine max
  Coding DNA Sequence Number=SeqID_51352
  Homolog annotation: Hit_ID=A5BSR3; Match level="QueryCoverage=50%, HitCoverage=44%, E-value=4e-08, Identity=32%"; Hit description =Putative uncharacterized protein
DVRMKAQAIQKQNTAPHVLSRGGYDYLEQKLLAEKTKKKLQEAAQSGSVDGVIDPPLPGEMTTEAAKEIAEKIDLFEEQATQGSFVPHGRQDVLAAAIGRPEHPGRVRAVGAGVTIKQYFGPAPRTSRSVSSLPPDELQQLTQQIRDQLEESITKKVTRQAPPEPLVGPGPSGPRVSTKGSCVGPSGNDPEMGDSDRCGLYIEADPSRLVAMARVYEGSTLVHSTPLFPGQVKVSVDEVKDVDAPVPIPNAEGSTLVHSTPLLPGQVKVSVDEVKDVDAP

SEQ ID NO: 143038 - protein, 47 aa, Glycine max
  Coding DNA Sequence Number=SeqID_51353
MDVRSNVLRQRILRRGKRKNQKNSQVVSPMNSFGKRVKEESKEFSGG

SEQ ID NO: 143039 - protein, 148 aa, Glycine max
  Coding DNA Sequence Number=SeqID_51354
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=35%, HitCoverage=50%, E-value=3e-23, Identity=98%"; Hit description=LacZ protein
MHEQQRNSCGSERRGKEWKIALSKSNSCSPGDPLVLERPPPRWSSNSPYSESYYNSLAVVLQRPDWENPGVTQLNRLAAHPPFASWRNSEEARTDRPSQQLRSLNGEWDAPCSGALSAAGVVVTRSVTATLASADVRRCFCRYAPPRQ

SEQ ID NO: 143040 - protein, 307 aa, Glycine max
  Coding DNA Sequence Number=SeqID_51355
  Gene Ontology: Mol. function=oxidoreductase activity; Biological process=electron transport
  Homolog annotation: Hit_ID=A9I170; Match level="QueryCoverage=99%, HitCoverage=26%, E-value=1e-118, Identity=64%"; Hit description =Putative indolepyruvate ferredoxin oxidoreductase chain alpha
MARFSDGLDEILVVEEKRQVLEYQLKEELFSWIGSGKKIPRVVGKFDDKDGGEWAVPQGNWLLPAHYEFSPAMVAKAIAARLLRFELPADVRAGIEARLAFIADREQERTRPRVVEDRKPWFCSGCPHNYLDAGVTWAGQAPFTDTPHVFQNLGDGTYFHSGSLAIRQAVAAGVNITYKILYNDAVAMTGGQPVDGPLSVPDIAKQMRAEGIHTIVVLSDNIGKWTGQREHFPSDVEFHDRSELDEVQKRLREVKGVSILIYEQTCATEKRRRRKRGKLEDPQKRVLINSLVCEGCGDCGKKSFCVS

SEQ ID NO: 143041 - protein, 124 aa, Glycine max
  Coding DNA Sequence Number=SeqID_51356
MAEPSKKRKGTSSRKIHEGTLMSEVYGIKMVIDQSLFYDLTKLPSEGVPFEGALIDDWKFDFSVHDVRWLVCTNQADMTGRLLAGSLAFESRILHYLIVRILLPRSSNLAQVFEEDLIVMWGLS

SEQ ID NO: 143042 - protein, 175 aa, Glycine max
  Coding DNA Sequence Number=SeqID_51357
MLESFKQQEQMSVLELYIEKDVAGGSMFHSANSLTSCGNYLSNDETQPTINMSNLHIDEDDDGDDDDYLVSNSYVEESLDEDDSVDGISDTDDEVTNIPQPVRIVHPTKGAQRIENPFWNDAMHYNNINRSYPDEEDICGLELSSTFNIDQELYVGMEFDSKDAVKNAVKQYVMK

SEQ ID NO: 143043 - protein, 108 aa, Glycine max
  Coding DNA Sequence Number=SeqID_51358
MVGYTPSSFADLVFAGEMIEVGLKRGKSDHHALINAKKTGANEEGENEGETHAATAVPTWPSFPPTQQCHYSSNNNPSPYPPPSYPQRPSLNQPQNPHTTQPMPKHHL

SEQ ID NO: 143044 - protein, 194 aa, Glycine max
  Coding DNA Sequence Number=SeqID_51359
  Subcellular localization annotation: CTP_CleavageSite=20; ConfidenceScore=5.22e-01
SPEGAFWRKQPNSPGRAGFRQGVRRAVRGLFAVLQLFMYGWFRTFFAKRKNYPMRGAPLEEELALVISRGFNKNNMETLQKVCKAWEVLQKKDKELRGSNNGPIGGYRKWLKAHVQGLDWIPSLRTDKREEVEAPEEDEEVQALRTELEQAQTVKERKPRGLVGKSTAGTSSEGLCGAATARLSFGERKGTNHE

SEQ ID NO: 143045 - protein, 41 aa, Glycine max
  Coding DNA Sequence Number=SeqID_51360
MGSKIYPKVHENPKAFFINSSPILLEPLAHGSVRHFSVLLP

SEQ ID NO: 143046 - protein, 423 aa, Glycine max
  Coding DNA Sequence Number=SeqID_51361
  Gene Ontology: Mol. function=kinase activity; Cellular component =cytoplasm; Biological process=carbohydrate metabolic process
  Homolog annotation: Hit_ID=A0QQ14; Match level="QueryCoverage=33%, HitCoverage=29%, E-value=3e-24, Identity=46%"; Hit description =Rhamnulokinase
TAARRELLAQAEAAPAAGSVVDTGDPRLLRPGQMTARIAELVAESGGRMPADRPAIIRLVLESLGAFVAHQVEQAAALSGVDVRVVHLVGGGSESPILAQAVADRTGRPVVAGPAEATSMGNILRCTVGSGICAGSFARPRSCVATNRPDADERVRAARSGRHLEQAPRECGVGHQRVDDAGAQCGSDGSGLRWPAGDGDHLGDVPQLFGGHGEGALRDGTDDRAVLVDERGADLGLHARGEQFVERAGTAGVVVELRVRRTPGPDRDDRLGHGVEAAERLQDPRLTPQGRCRGGGLDEQRCEDRPRPATGDAAHLTDHLHPVLGRGGGDAGELHHLAGRQGAQVARHRCERSTRREPEDVAVGHDLAEQFRGSAPQPVLDQFGCRAWRDHGKRPGEAEPGAQLHRQVEVEGVGGLDRDLHQP

SEQ ID NO: 143047 - protein, 234 aa, Glycine max
  Coding DNA Sequence Number=SeqID_51362
MVIRTPSRHPETIESDGKMRQIMVILHLLSSRGGELDGMRRQIMLIRTPFCHPETIESDGTQRQIMVILHLLSSRGGEPYDMRRQIMVIRTPFWHPRTIDSDGTQRQIMVILHLLSSRGGEPDDMRRQLMVIRTRFRHLETIESDDSQRQIMVIMHLFSSRGVELDDMRRQIMVIRTPFRHPETIESDGTQRQIMVILHLLSSRGGEPDGMRRQIMVILHLLSSRGDEPHYMRR

SEQ ID NO: 143048 - protein, 217 aa, Glycine max
  Coding DNA Sequence Number=SeqID_51363
  Homolog annotation: Hit_ID=UPI00006A2D9E; Match level="QueryCoverage =77%, HitCoverage=86%, E-value=6e-08, Identity=15%"; Hit description =UPI00006A2D9E related cluster
MSKSCGFGMTGPLDESISCFLIRVDPWVLVPIAFRGLHILAFRGLHVLTLRGLHVLALRGLHVLALRGLHVLTIRGLHALTSRGLHVLTLRGLPALALGLHALTFRGPHVLTFRGLHALAIRGLHVLIFVGLHALTFRGLHVLANRRLHAFTFRGLHVLANRGLHALTLRGLHALTSRGLYILALRGLHALTFRGLRVLIFSVLHIRTLREFKVLYP

SEQ ID NO: 143049 - protein, 57 aa, Glycine max
  Coding DNA Sequence Number=SeqID_51364
MDPKLAKRAVATNPSAGGRRVTRECVFQERTTRGAATNVYLRKTSEKPEKTWSTNFK

SEQ ID NO: 143050 - protein, 93 aa, Glycine max
  Coding DNA Sequence Number=SeqID_51365
MTTLTQIWMTLLLSNIQPSDHNSDLPLPKCMAPTRHPLDLDKSNRALGFPALITGLCQSFGVPIAPSKVIRSSITRAFIEKYCTQRQAQGDAQ

SEQ ID NO: 143051 - protein, 193 aa, Glycine max
  Coding DNA Sequence Number=SeqID_51366
  Gene Ontology: Biological process=transposition, DNA-mediated
  Homolog annotation: Hit_ID=Q1J7G7; Match level="QueryCoverage=21%, HitCoverage=71%, E-value=4e-12, Identity=74%"; Hit description =Transposase
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGIRSRAMRSDCLVQFSILHFYSEPQELIVVHASSTNESGATRSDCLVQFSILHFYSEPHDLIVVHASTANGSGATPSDCLV

SEQ ID NO: 143052 - protein, 93 aa, Glycine max
  Coding DNA Sequence Number=SeqID_51367
  Pfam annotation: Domain name=zf-CCHC; Domain location=77-93; Score =17.4; E_value=0.0036; Accession=PF00098.14; Description=Zinc knuckle
MELQRLNQNEENDKKKKSIALKASSSMQEENEEEDSDDEGDFSFFVKKFLKFIKKRRIDRHLNFNNRRKSQDDSQVLRCYKCNQIGHIKTNCP

SEQ ID NO: 143053 - protein, 88 aa, Glycine max
  Coding DNA Sequence Number=SeqID_51368
MNVLSGATLFCKITRASNIFMICVHRDSLGSDQGVPMNPKRIKVIPEWPTPPTPLIELVRNHVPSWEDAQEIGFQTLPYFNIPNTTNT

SEQ ID NO: 143054 - protein, 95 aa, Glycine max
  Coding DNA Sequence Number=SeqID_51369
MILETPVIRGPSENWSVERYKARLVAKGHPNTMVLHIKDLVLQLQNLLHHTRPVVLLPLGCKFRLANSATLTKEHCPFLNGDLRGGSTPWTRLLD

SEQ ID NO: 143055 - protein, 45 aa, Glycine max
  Coding DNA Sequence Number=SeqID_51370
MTSSGESTSGSGLMQSYPARALGRRLQVDWARDPREGPRVLMSLR

SEQ ID NO: 143056 - protein, 102 aa, Glycine max
  Coding DNA Sequence Number=SeqID_51371
  Gene Ontology: Mol. function=aspartic-type endopeptidase activity; Biological process=DNA integration
  Homolog annotation: Hit_ID=A5B7I8; Match level="QueryCoverage=99%, HitCoverage=15%, E-value=7e-19, Identity=35%"; Hit description =Putative uncharacterized protein
MEKWSLNEFISYCAQEEKSKPGHVKKKCTKYHVWRAKKDSSVTTNISVSIKGCLSYWKPIDSERWIYIGDGKLAKVEAIASYGESFNAELCGTKRRIHSTNS

SEQ ID NO: 143057 - protein, 78 aa, Glycine max
  Coding DNA Sequence Number=SeqID_51372
MHETQCGPLRVHRMNRKAWFEQNREMLAAQLAQASSARPGELSSPGEQSCFLQKQQPFWRNLLEGPNGPGCYLHPHFY

SEQ ID NO: 143058 - protein, 108 aa, Glycine max
  Coding DNA Sequence Number=SeqID_51373
  Homolog annotation: Hit_ID=UPI0000ECBAF8; Match level="QueryCoverage =37%, HitCoverage=48%, E-value=1e-16, Identity=100%"; Hit description= UPI0000ECBAF8 related cluster
MEEGIEKNEEEGRVRGPPSWAIDYVTGEGLLDEDGLNAMIMLTEDDPFTFEQVVKSMQAWHWPSFYNVVTGKTLALPNLIALQHIPLSPAGVIAKRPAPIALPNSCAA

SEQ ID NO: 143059 - protein, 107 aa, Glycine max
  Coding DNA Sequence Number=SeqID_51374
MRGRTASGDVVPINLEIEATCRCNNAARRSREQDIKGSSYTLPPLSPNHTQMDGEPTRRVTLEDFSNIATPQFFTSIAKSEVQASQHLLPVFSYLVNSREPLPWSCK

SEQ ID NO: 143060 - protein, 199 aa, Glycine max
  Coding DNA Sequence Number=SeqID_51375
  Gene Ontology: Mol. function=motor activity; Cellular component=cell projection
  Homolog annotation: Hit_ID=UPI00016621D1; Match level="QueryCoverage =84%, HitCoverage=45%, E-value=8e-12, Identity=33%"; Hit description =UPI00016621D1 related cluster
GLHVLTFRGLHALTFVGLHVLAIRGLHVLAFIGLHVLTFRGLHILTFRGLHVLAFIGLHVVTFKGLHVLAFRRGQQILSLKGLHVLAFRWLHVLDFRGLHVLAFRELHVLAFRGLHALAFRGLHVLAFRGLHICAFGGLKGGYRATTMHTRARLHPAATKRRVRIMRTNMTTLTQIWMTLLLSNTLPSDQFADLHLQKY

SEQ ID NO: 143061 - protein, 68 aa, Glycine max
  Coding DNA Sequence Number=SeqID_51376
MRLSLKLMEDVPTSSTPNVSVPDVDKDVPTSSAPNAEALPSPSEEESTEEDDQATEETPAPKAPEPAP

SEQ ID NO: 143062 - protein, 86 aa, Glycine max
  Coding DNA Sequence Number=SeqID_51377
MSEATKEITDRIDSLEKQALQGSFAAHEHQDVVTATIGQPEHPGCVRAAGVDVMIKHYFGPASRGSCTSSSMVPDDLEQLIQKIRD

SEQ ID NO: 143063 - protein, 84 aa, Glycine max
  Coding DNA Sequence Number=SeqID_51378
MYKDNWTKPWPMGSEIYPKVHENPRAFFSSSSPILLEPLAHGSSDWSLPREDYITRDVLKDQGRARYLEWVANIVPVPKKDGKV

SEQ ID NO: 143064 - protein, 205 aa, Glycine max
  Coding DNA Sequence Number=SeqID_51379
  Pfam annotation: Domain name=Retrotrans_gag; Domain location=48-136; Score=-1.9; E_value=0.082; Accession=PF03732.8; Description =Retrotransposon gag protein
  Pfam annotation: Domain name=Syntaxin-6_N; Domain location=97-190; Score=-13.8; E_value=0.077; Accession=PF09177.2; Description =Syntaxin 6, N-terminal
  Pfam module annotation: Pfam domain module=Retrotrans_gag::Syntaxin-6_ N; Domain location=48-136::97-190
LLQDRTIASIIEEEAQSSDSTSSDSLASRESAIYLSEASVMADEHQQRITLEDYSSSSVSQFFTSISRPEEEVVEKFLKKFFPESKTVEGKVVISSFHQFPEESLSEALERFRETLAQFMQVTMSKHKSTESTLKNLEIQVGQLAKQLAEKSSNSFGENTEKNPKEDCKAFVTRSRKLVAAEDEDVVALKEQVALKDTTVKKKNE

SEQ ID NO: 143065 - protein, 75 aa, Glycine max
  Coding DNA Sequence Number=SeqID_51380
MGTIGHQIPKISDMMNVLSVATLFCKITHAPNIIMIHVHRDSFAPLIELVRNHVPSWEDAQEIGVEGRNLEYEEP

SEQ ID NO: 143066 - protein, 148 aa, Glycine max
  Coding DNA Sequence Number=SeqID_51381
MAPRKLSTKRSRRDAAAEGTSATPEFDSHCFRSAEHQQRCKAIKGWSFHRERRVQLRDNEYTDFQEEIARRRWTSLVTLMAKFDPDIWISFDADALSQFLGDPLVLEEGQECEFSQRRYMADGFDEEAIAHLLCMPGQDFAQTAVGRR

SEQ ID NO: 143067 - protein, 138 aa, Glycine max
  Coding DNA Sequence Number=SeqID_51382
  Homolog annotation: Hit_ID=A4BFS3; Match level="QueryCoverage=45%, HitCoverage=83%, E-value=4e-10, Identity=60%"; Hit description =Putative uncharacterized protein
  Subcellular localization annotation: CTP_CleavageSite=48; ConfidenceScore=5.30e-01
ILEWVRNFNARLTVRKRRSRPISRVLSWTVIPVGVTSPQRSSNLPGSNAGRAKGSLFGLAPGGVCRAGLLPDSRCALTAPFHPYRPSEEDVGGIFVWHFPSACADQALPGTLPYGARTFLGIPEGMTRLSGRLRQRTF

SEQ ID NO: 143068 - protein, 130 aa, Glycine max
  Coding DNA Sequence Number=SeqID_51383
MILRGRLLLLMMTDLIEDAGVRAWRQGEQKQKADVMIHDVGYNVQDILPENTGIAKSIEAAGSTMSDTMSRTSCPKILELLKALKLQDPRCRIRCPGHLARKYWTYKSVISLTDYCAVSKRLDDLSLGTN

SEQ ID NO: 143069 - protein, 92 aa, Glycine max
  Coding DNA Sequence Number=SeqID_51384
MEIYVSDRLGKSVSCHHQKGGDCRSKLHDESRPIQRVLMITKMMTKSKAQKSRTLHDNKDDDLQESKNEFKIESRTLQGSRGNLISRIKNQV

SEQ ID NO: 143070 - protein, 152 aa, Glycine max
  Coding DNA Sequence Number=SeqID_51385
LQVVPFVVVFMNPAIVFLLKKKRRKLVTWEINKGKDTTNEDSQVSSKVPTISKDNKDHTLRTTNLEETLAQFMQVTMSNHKSTESALKNLEILVGQLTKKLAEKTSNSFGANTEKNPKEECKVVVTRNRKLVAAEDEDVVAIEASFMMLNQD

SEQ ID NO: 143071 - protein, 39 aa, Glycine max
  Coding DNA Sequence Number=SeqID_51386
TTPFRFFRRFPQINVGGDSAHFPFLEDAPVSPASPSHRK

SEQ ID NO: 143072 - protein, 108 aa, Glycine max
  Coding DNA Sequence Number=SeqID_51387
  Homolog annotation: Hit_ID=Q51617; Match level="QueryCoverage=37%, HitCoverage=59%, E-value=1e-14, Identity=95%"; Hit description =Putative uncharacterized protein
MTVKTSDTCSSRRRSQLVCKRMPGADKPVRARQRVLAGVGAGLNYAASEQIMRKEKIPHQAPFAIQAAQLLGRAIGAGLFAITPAGERGMCCKAIKLGNARVFPVTTL

SEQ ID NO: 143073 - protein, 127 aa, Glycine max
  Coding DNA Sequence Number=SeqID_51388
  Homolog annotation: Hit_ID=A7PBE0; Match level="QueryCoverage=74%, HitCoverage=10%, E-value=5e-07, Identity=40%"; Hit description =Chromosome chr16 scaffold_10, whole genome shotgun sequence
MDWRKALRYENPPPSIKSNEICEMNLLQVLDVAQNNLSGNICSCFSNLSAMTLINQNTDPRIYSQAPNGTDSSSTYSIVSELLLLKGRADEHRNFLDLGKMPTGTQLQTFDAPALLAQSMLSPLPIV

SEQ ID NO: 143074 - protein, 147 aa, Glycine max
  Coding DNA Sequence Number=SeqID_51389
MLGFTSDSPQFSANPHQLDFAPYASRPYNAQWNAPGLLHDKHAWGLRKPSRGFFAAKFISWLVFWFMLKVVFSIGCVEKGCYWLSDDVVELVGDFPCRNDSRSMGFSFILTLFICPNFLIRPSKMIKLASFQTRFDPFVGKDQIRKA

SEQ ID NO: 143075 - protein, 83 aa, Glycine max
  Coding DNA Sequence Number=SeqID_51390
MSCNGSLSAPLHLFKHTALVHLLSEKDLQRQELEAGACLRAGDEFVSDCEILEMKETSSPLVFLQSFILFFSLLLRRLPGMES

SEQ ID NO: 143076 - protein, 757 aa, Glycine max
  Coding DNA Sequence Number=SeqID_51391
  Gene Ontology: Mol. function=oxidoreductase activity; Cellular component=chloroplast thylakoid membrane; Biological process =metabolic process
  Homolog annotation: Hit_ID=UPI00005F9B62; Match level="QueryCoverage =41%, HitCoverage=99%, E-value=1e-138, Identity=77%"; Hit description= COG0667: Predicted oxidoreductases (related to aryl-alcohol dehydrogenases)
  Pfam annotation: Domain name=Aldo_ket_red; Domain location=206-507; Score=157.6; E_value=3.3e-44; Accession=PF00248.12; Description =Aldoketo reductase family
  Pfam annotation: Domain name=Amidohydro_2; Domain location=583-756; Score=-8.3; E_value=0.0022; Accession=PF04909.5; Description =Amidohydrolase
  Pfam annotation: Domain name=DJ-1_PfpI; Domain location=31-212; Score= 48.7; E_value=2e-11; Accession=PF01965.15; Description=DJ-1PfpI family
  Pfam module annotation: Pfam domain module=Aldo_ket_red::Amidohydro _2::DJ-1_PfpI; Domain location=206-507::583-756::31-212
HPIKGASGVPTGFFLAELTHPLKVLEDAGLKTMIASIRGGQPPVDGFDLSDPVNAWYWNETNFQQRLATTPALSKLNGTDYSTVFFAGGHGTMWDFRDSQDAQRIIREVYESDGIVAAVCHGPAALVDAKLSSGEYLVKGKNVAAFTNKEEEEVHTTDVVPYLLETALREHGALHHEAPNWSENVVTDGRLITGQNPASAHGVGELNMKTLPSVALGTWSWGTGFAGGDTVFGNHLSDTQMADVFTTAMSKGLNLWDTAAVYGMGSSEAALGALVRQFPREDMILSTKFTPQIANEQSAQPVSDMLEASLGRLGVDAIDIYWIHNPLDVEKWTPGLIPLLQSGKVKRVGVSNHNLVQIRRANEILNASGYSLSAVQNHYSLLYRASEEAGILDYCRQNNITFFAYMVLEQGALSGRYDSNHPMPAGSGRAESYNAVLPQIERLTAAMKKMGAERNASVAQIAIAWAIAKGTLPLVGATKVHHVLDAACASDIQLRDEEIILLEQLAAETRVDTRGAWEKPMNMKIICLEEHYLDSELGRACMPVALEQAPFLGDWGKTVADGHNPDRSRPQIEKNALINAKGADLGSRRLRDMDEAGITLQILSVGGFPQLAPEDEAVTLNTAANDRLAGAVRNHPDRFAAFATLPWAQPKDAENELVRAVEKLGFKGALLNGRPSSCFLDHPDYDSLLSRFNKLNVPLYLHPGLPFKSVQQAYFTGFSAEVNARLSMFGWGWHHEAGIHLLRLMLSGAFDKYPHLQ

SEQ ID NO: 143077 - protein, 232 aa, Glycine max
  Coding DNA Sequence Number=SeqID_51392
  Gene Ontology: Mol. function=chloramphenicol O-acetyltransferase activity; Biological process=response to antibiotic
  Homolog annotation: Hit_ID=P62577; Match level="QueryCoverage=92%, HitCoverage=97%, E-value=1e-127, Identity=100%"; Hit description =Chloramphenicol acetyltransferase
  Pfam annotation: Domain name=CAT; Domain location=6-209; Score=528.7; E_value=6.6e-156; Accession=PF00302.9; Description=Chloramphenicol acetyltransferase
MEKKITGYTTVDISQWHRKEHFEAFQSVAQCTYNQTVQLDITAFLKTVKKNKHKFYPAFIHILARLMNAHPEFRMAMKDGELVIWDSVHPCYTVFHEQTETFSSLWSEYHDDFRQFLHIYSQDVACYGENLAYFPKGFIENMFFVSANPWVSFTSFDLNVANMDNFFAPVFTMGKYYTQGDKVLMPLAIQVHHAVCDGFHVGRMLNELQQYCDECRRRNFLSSYVPRNILSD

SEQ ID NO: 143078 - protein, 268 aa, Glycine max
  Coding DNA Sequence Number=SeqID_51393
  Gene Ontology: Mol. function=nucleotide binding; Cellular component =intrinsic to membrane; Biological process=defense response
  Homolog annotation: Hit_ID=Q2YE88; Match level="QueryCoverage=100%, HitCoverage=22%, E-value=1e-150, Identity=95%"; Hit description=NBS -LRR type disease resistance protein Rps1-k-1
  Pfam annotation: Domain name=NB-ARC; Domain location=1-156; Score= -93.0; E_value=0.00024; Accession=PF00931.13; Description=NB-ARC domain
RSKILLTTRSEKTASVVQTVQTYHLNQLSNEDCWSVFANHACLSLESNENTTLEKIGKEIVKKCDGLPLAAQSLGGMLRRKHDIGDWYNILNSDIWELCESECKVIPALRLSYHYLPPHLKRCFVYCSLYPQDYEFDKNELILLWMAEDLLKKPRKGRTLEEIGHEYFDDLVSRSFFQRSSSWPHVKCFVMHDLMHDLATSVGGDFYFRSEELGKETKINTKTRHLSFAKFNSSVLDNFDVVGRAKFLRTFLSIINFEAAPFNNEEAQ

SEQ ID NO: 143079 - protein, 107 aa, Glycine max
  Coding DNA Sequence Number=SeqID_51394
MSLVTLFGKLQEHEMELMRLNQHEDNDKKKKGIALKASSFIHEESDKEDMNEQNNLEEDDDFSHFVKRFNKFLRNKGNKRRSNFNSKKKEKIPPQFQNAMNAINLGT

SEQ ID NO: 143080 - protein, 121 aa, Glycine max
  Coding DNA Sequence Number=SeqID_51395
MTDPLNESISCFLIRVDPWVLVPSPSKGYTSSPSEDYTSTPSEDYTSSPSEDYMSSPSEDYMSSPSEGYTSSPSEDYTSSPSEGYTPSPLGGYTPSPLEGLRPRLQRAARPHLHRATHPRL

SEQ ID NO: 143081 - protein, 72 aa, Glycine max
  Coding DNA Sequence Number=SeqID_51396
MDKSLKVGENEWRERERRGTKFCASNEISQHTSCPAICRPFEPNVNFLVITLTWDGNFQPYPRKREHKDLPR

SEQ ID NO: 143082 - protein, 130 aa, Glycine max
  Coding DNA Sequence Number=SeqID_51397
METLQKVCKAWEVLQKKDKELRGSNNGPIGGYCKWLKAHVQGLVWLLSLRTAKREEVEAPEEDEEVQALRAELEQAQTVKERFKSATLKIRKENAELRDVNVATTKALERETKRACREEHGRNKFRGALW

SEQ ID NO: 143083 - protein, 72 aa, Glycine max
  Coding DNA Sequence Number=SeqID_51398
TNGLHPIPVKVENPGVMATIALSSRYGSKLAYDTGIWGGLRHWKCGRTGFVVDLGMAFVDNWVWVRRRFVID

SEQ ID NO: 143084 - protein, 131 aa, Glycine max
  Coding DNA Sequence Number=SeqID_51399
MARTRGLGRAIGRLVGRDRHDDHDVADVPERRRPTASARRQRVHQMTTDVRDLAEDVADKTEDVPDLAEEAPEMRADERPDLKLVSHGRKVTLIGRPVPEIEGLVGATGLRPLIDCSVVTGDPGLIFTFME

SEQ ID NO: 143085 - protein, 162 aa, Glycine max
  Coding DNA Sequence Number=SeqID_51400
GPGIPALITGLCQSFGVPVAPTKVIRPPITRDFIEKYCTQRQAQGDAPQVADVPPPHQAGQTGSFDMEWYLRHLVRQQAANHQAHVQTHDCLYQLSLSMQSQGFASFSCPTPDQFRAEVAWPGEWPEAQAGEAPEAPDDGEEAHEDEEMADLLDFLGGSGAT

SEQ ID NO: 143086 - protein, 85 aa, Glycine max
  Coding DNA Sequence Number=SeqID_51401
  Subcellular localization annotation: CTP_CleavageSite=35; ConfidenceScore=5.20e-01
MRKEKIPHQAPFAIQAAQLLGRAIGFSQSRRCKTTASAKLACLQVDSRGSPAEATTVDAFALDDTMYFVKLPYFGQLLDDECTHV

SEQ ID NO: 143087 - protein, 163 aa, Glycine max
  Coding DNA Sequence Number=SeqID_51402
  Homolog annotation: Hit_ID=Q6UUU1; Match level="QueryCoverage=52%, HitCoverage=55%, E-value=8e-19, Identity=61%"; Hit description =Putative uncharacterized protein
GKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTGKTIKIPGVSPWRLPRALSFRSKLDCMHEPPVQSDRCALSGNYRLESNPERHAKHHWQQPL

SEQ ID NO: 143088 - protein, 67 aa, Glycine max
  Coding DNA Sequence Number=SeqID_51403
RSQQGESSTLFVCPTPEQFAAEVAWPGDWPDAQAGEEPAGSPGRMDVPRMDEDMTDLFDFLGGSRAT

SEQ ID NO: 143089 - protein, 137 aa, Glycine max
  Coding DNA Sequence Number=SeqID_51404
  Gene Ontology: Mol. function=RNA-directed DNA polymerase activity; Biological process=RNA-dependent DNA replication
  Homolog annotation: Hit_ID=A5BWK7; Match level="QueryCoverage=91%, HitCoverage=7%, E-value=1e-11, Identity=35%"; Hit description =Putative uncharacterized protein
MEEHKQLLAPKPTLEPVFDFVELEEINEEMRRGKSEANTEKKKDTTPNEGKEVPYPLVPSQKEKERHLARFLDIFKKVEITLPFGEALQQMPLYAKFLKDMLIKKNRYIHSDKIMVEGKALIDLGASINLMSLSMCR

SEQ ID NO: 143090 - protein, 71 aa, Glycine max
  Coding DNA Sequence Number=SeqID_51405
  Subcellular localization annotation: CTP_CleavageSite=37; ConfidenceScore=5.24e-01
MDHVVAKVLIDNGSSLNVMPKTTLEKLPFSASRLKPSSMVVRAFDGINEAFGLNLALGLNLELGLDLKRAD

SEQ ID NO: 143091 - protein, 59 aa, Glycine max
  Coding DNA Sequence Number=SeqID_51406
  Subcellular localization annotation: CTP_CleavageSite=53; ConfidenceScore=5.10e-01
MNTHPLDKYLWLSEADSPSPSNTAKYGSGRAKRTSLRQVLGLAGSIGRQAGIVFSVKTR

SEQ ID NO: 143092 - protein, 148 aa, Glycine max
  Coding DNA Sequence Number=SeqID_51407
  Homolog annotation: Hit_ID=A6FJQ2; Match level="QueryCoverage=25%, HitCoverage=84%, E-value=3e-11, Identity=92%"; Hit description=50S ribosomal protein L5
DAGSRQARQGASAGVGGCRGWLNYAASEQIVLRVHHMRCEIPAQMRKEKIPHQAPFAIQAAQLLGRAIGAGLFAITPAGERGMCCKAIKLGNARVFPVTTLVVETQEVATTSKKSLEATSEPSEPVADTASIQQLADPSTPEDQTTAV

SEQ ID NO: 143093 - protein, 115 aa, Glycine max
  Coding DNA Sequence Number=SeqID_51408
  Homolog annotation: Hit_ID=UPI0000ECBAF8; Match level="QueryCoverage =35%, HitCoverage=48%, E-value=1e-16, Identity=100%"; Hit description= UPI0000ECBAF8 related cluster
  Subcellular localization annotation: CTP_CleavageSite=20; ConfidenceScore=5.20e-01
KRKSAQYANRLSPRVGRFINAAGTTADNNFTQETAMTMITNSSSVPPEKGSSGRTQIVLPEEGMQAWHWPSFYNVVTGKTLALPNLIALQHIPLSPAGVIAKRPAPIALPNSCAA

SEQ ID NO: 143094 - protein, 54 aa, Glycine max
  Coding DNA Sequence Number=SeqID_51409
MSCHKLSDWPPGVMAGRNDRAIADALQALAQTIGNPNRGEAGGAIEYQGLDRFQ

SEQ ID NO: 143095 - protein, 69 aa, Glycine max
  Coding DNA Sequence Number=SeqID_51410
MWTIIDQYKEKLSLAATHEQRLEDEYAKMDRFAFTLNGSQELLRLLAKAKAMMDVYSAPEEVHGLLDYR

SEQ ID NO: 143096 - protein, 81 aa, Glycine max
  Coding DNA Sequence Number=SeqID_51411
MDLPASRDKRRDQHIAAVGTTNNNMLSNRKTLDVGSLLSSKSETQHGHRFTSIPYVPMDPGIGPLFNSPCVQMVLVFVCIK

SEQ ID NO: 143097 - protein, 257 aa, Glycine max
  Coding DNA Sequence Number=SeqID_51412
  Homolog annotation: Hit_ID=A5AWV0; Match level="QueryCoverage=63%, HitCoverage=11%, E-value=1e-11, Identity=26%"; Hit description =Putative uncharacterized protein
VAVSPPKPPPKPDPKVDDPLYLMTLTIPELFLRPYQVRWDATVFGVVNPDFPLYIKHEDLSEIAHGGQCLSISVLQLWILHLTETCMRAGNSDIYGFLEPQSIQRSGQSQFESESYIKSWMQSSQRDVYLGAYLNGGHWQMVVILPKEHLIVWFCSSLNRPNNYLKGIINSALKGLDDAPQPKSKAPARWIIVKCNRQKGSTECDYYVMNWMSTIILGTFRNNLEAYFKDPRPLEPERLKALRIQWTQFYLRVRDQT

SEQ ID NO: 143098 - protein, 170 aa, Glycine max
  Coding DNA Sequence Number=SeqID_51413
MLNIQNLIYGYEKISSAYSPSPVDALFFTQKTCLHFSGENTETFSSLTSYPELRRSEFLIGGYVGARASLLSTTPPFVVMTQELVARGDTLRLSAPRHSVTPSVIDEQRPMWSSAPFPEMSASSDGDFSSLTSYQELRRSEFLIGGYVGARASLLSATFTRSVILTFESC

SEQ ID NO: 143099 - protein, 83 aa, Glycine max
  Coding DNA Sequence Number=SeqID_51414
  Homolog annotation: Hit_ID=UPI0000ECBAF8; Match level="QueryCoverage =49%, HitCoverage=48%, E-value=1e-16, Identity=100%"; Hit description= UPI0000ECBAF8 related cluster
VEARGFIFGSSIALGIGAKFAPLCKPGKLPGMQAWHWPSFYNVVTGKTLALPNLIALQHIPLSPAGVIAKRPAPIALPNSCAA

SEQ ID NO: 143100 - protein, 184 aa, Glycine max
  Coding DNA Sequence Number=SeqID_51415
MQFMLSPYRRRVSNLDDLAPCLDKMTLLTEEEDKIIEAREEAPSLVPQFERQQFDMLGRSVETQGLGQRRESVDAEAHVIPAMPERQHGMYYTPDQFTQEPSQMSSLYPYPYQSGTSSDAYFIGTQPPLQPGYVMADLFGSLSPAGTPSFAHGCQISTPNAPMGPPWTVSGNIPNITDLLGIDF

SEQ ID NO: 143101 - protein, 143 aa, Glycine max
  Coding DNA Sequence Number=SeqID_51416
ELGKAKLAKEKFKLAATHVRKECAGLREENAITARALEQETKRARKEEYGRNKFRGALWGSNSELKLRKEERDQSRAHSMVLKEELVASSRSKRSLSQRLCETETNMLAIIAKYQEELGLAAAHEHRIADEYTQVYAKRLEEG

SEQ ID NO: 143102 - protein, 256 aa, Glycine max
  Coding DNA Sequence Number=SeqID_51417
  Homolog annotation: Hit_ID=A6EGC8; Match level="QueryCoverage=88%, HitCoverage=93%, E-value=2e-45, Identity=44%"; Hit description =Putative uncharacterized protein
  Pfam annotation: Domain name=SusD_RagB; Domain location=62-255; Score= 85.9; E_value=1.3e-22; Accession=PF07980.2; Description=RagB, SusD and hypothetical proteins
MKQTVSARPRKQPVHLLARFYLYQKNWSEAIKYASYILDDNTNYGLVTPYRSFYANNTSNTKESVFELVYDINNTSGQASQWLSGSNGGTAWIRPSQDIYDLLIDPAVGGDRSALVSKTSSSTDPNILIGNLYYRTDRTDPVFLIRTAELFLIRAEALAQRNGSGDLTASLADLNAIRVRAGVKPVQRLGATDLLQAIEQENRVEFALENHRWYDLLRTGRAQQVLNITSVNRLLLPIPYAQVSIDPDLQQNPGLD

SEQ ID NO: 143103 - protein, 95 aa, Glycine max
  Coding DNA Sequence Number=SeqID_51418
  Homolog annotation: Hit_ID=A6FJQ2; Match level="QueryCoverage=40%, HitCoverage=84%, E-value=2e-11, Identity=92%"; Hit description=50S ribosomal protein L5
MTLTYKNRRITRPFRLARFGDDGENSDTCSSGDGHSLSMRKEKIPHQAPFAIQAAQLLGRAIGAGLFAITPAGERGMCCKAIKLGNARVFPVTTL

SEQ ID NO: 143104 - protein, 123 aa, Glycine max
  Coding DNA Sequence Number=SeqID_51419
MQLPQKPLNKKPRGLARKSTAVTNSVEHCGAATRLCETETNMLAIITKYQEELSLATTHEHRVADEYAQVYAEKEARGRVIDSLHQEATMWMDRFALTLNGSQELPRLLAKAKAMADTYSSPE

SEQ ID NO: 143105 - protein, 152 aa, Glycine max
  Coding DNA Sequence Number=SeqID_51420
MNILTTHDQGWEQELSPYNQYEEEEKTPNLESVFEEFMAYHASSTANQNSMKNHEIHFGKNYSIENFQGGQELQPYYQNEAERGSNLDKLLMQFMETTKSTQQALQSVEIQVGELAEAITQFKSRQEKSFIEAEAQEKSPVKEHESREKDEE

SEQ ID NO: 143106 - protein, 37 aa, Glycine max
  Coding DNA Sequence Number=SeqID_51421
MGEGWRQMEDRIPTDQLSPLPGAGPAENVVARQPSIL

SEQ ID NO: 143107 - protein, 145 aa, Glycine max
  Coding DNA Sequence Number=SeqID_51422
MPGADKPVRARQRVLAGVGAGLTECGIRADCTGRVHICGCASVVRLRASGISLTQGYYGYPRIRGCELQGIKIAKLAAQVFPRGSPPDEHHRKSTLKSEVAKPDRTIKIPGVSPWKLPRALSCSDPAAYRIPVRLSPFGKRGAFS

SEQ ID NO: 143108 - protein, 51 aa, Glycine max
  Coding DNA Sequence Number=SeqID_51423
MDKSLKVGKDEWRERERRSMKFCASKEGSTMKVTYPRNVGFFSPCILGHLD

SEQ ID NO: 143109 - protein, 86 aa, Glycine max
  Coding DNA Sequence Number=SeqID_51424
  Homolog annotation: Hit_ID=A5BK23; Match level="QueryCoverage=44%, HitCoverage=5%, E-value=6e-10, Identity=68%"; Hit description =Putative uncharacterized protein
MDKILKEKGKEAMKILQKKPNQMMNFQENGKLQKIIPLTTLLVISQKGNMAFVSMIEPKNLNEAIIDDHWIVAMQEELNQFERNNV

SEQ ID NO: 143110 - protein, 73 aa, Glycine max
  Coding DNA Sequence Number=SeqID_51425
  Subcellular localization annotation: CTP_CleavageSite=28; ConfidenceScore=5.16e-01
MVVRTSVILGFKSPFAKHKPRAKGIFVHALSRKSQALSTQPLHLRLIWSAKLAKAELSQLQFDLNSAKRQPNR

SEQ ID NO: 143111 - protein, 52 aa, Glycine max
  Coding DNA Sequence Number=SeqID_51426
MSFWYHLDSHIIVNQVVVVIIKKGENVNHEDFDDVKEESNKAASNDKHLLQE

SEQ ID NO: 143112 - protein, 180 aa, Glycine max
  Coding DNA Sequence Number=SeqID_51427
  Homolog annotation: Hit_ID=Q5NRP4; Match level="QueryCoverage=52%, HitCoverage=6%, E-value=3e-08, Identity=36%"; Hit description =Putative gag-pol polyprotein, identical
  Pfam annotation: Domain name=zf-CCHC; Domain location=128-145; Score =21.1; E_value=0.00097; Accession=PF00098.14; Description=Zinc knuckle
MKREKHASYSSHNSCKSLSEELRDYYEGRHRPHSHRREKERKPQKANINLSYFHGKDNVEANLVWEIRVEQQLKKKSTSKSYGSHSYPKKDQGQGILGVTPSKPKDDKGKTIEKQAPKASMQEKTSSIKCFKCLGGGHITSQCPTTKTMIMRGQDIYSSQDKATTSPSSSESEEAKGEEP

SEQ ID NO: 143113 - protein, 98 aa, Glycine max
  Coding DNA Sequence Number=SeqID_51428
TAIPLELEVIPQVKELLDEGLVCMSLNPCALLVPKIGLPMDPKRIKVIPEWPTPPTPLIELVRNYTFLWEDGQEKGVEERINEFQEPLDLRSNPFQGG

SEQ ID NO: 143114 - protein, 169 aa, Glycine max
  Coding DNA Sequence Number=SeqID_51429
MAVVSLGKVYQPPFPRWYNPNAICSYHGGIPGHSIKQCVAFKHKIPRGFQPSIAKTSTPFPYKSDKAVPWKYGVQCLDERKNASVIRVGRGMPTAKITNISSTSGMTHSGHIFSPSELPARSKDKGKAKADMGEREKMGLTANDEAPVGKFAEEGDARGRYRLRRQLNL

SEQ ID NO: 143115 - protein, 217 aa, Glycine max
  Coding DNA Sequence Number=SeqID_51430
  Homolog annotation: Hit_ID=Q6WAY6; Match level="QueryCoverage=38%, HitCoverage=14%, E-value=2e-07, Identity=37%"; Hit description =Putative uncharacterized protein
ILALLIFGGVLFPNVDGLVDLAAINAFLAYHDHKENPVVAMLADLYDTFDRRGCISYNPVLAIRQLGYPMRGAPLEEEITPVISRGFNKTNVETLQKVCKAWEVVRKKDKELRGSKNRPIGGYRKWLRAHVQGLDWLPRLRTAKREEVKALEEDEEVQALRIELEQAQTVKEMFKLAALKIRKENAELRDINTATTKALEQETKRARREEHGRNKFR

SEQ ID NO: 143116 - protein, 107 aa, Glycine max
  Coding DNA Sequence Number=SeqID_51431
MDEYFRVSNCKSAKDMWDTLQEHKMELMRLNQHEENDKKKKGITLKASSSIQEGSDKEDLNEIDEDDDFSFFVKRFNKFLRNKGNQRKEQKIHPLFQNVMNAINQDI

SEQ ID NO: 143117 - protein, 149 aa, Glycine max
  Coding DNA Sequence Number=SeqID_51432
  Homolog annotation: Hit_ID=UPI0000ECBAF8; Match level="QueryCoverage =27%, HitCoverage=48%, E-value=1e-16, Identity=100%"; Hit description= UPI0000ECBAF8 related cluster
RTTERSESVSEEAEERQYANRLSPRVGRFINAAGTTGFPTGKRAVSATQLMNNKELLKERVQCSKMKTTKGGKVMNPTDAYRKEIRKKELKRSRPAGMQAWHWPSFYNVVTGKTLALPNLIALQHIPLSPAGVIAKRPAPIALPNSCAA

SEQ ID NO: 143118 - protein, 91 aa, Glycine max
  Coding DNA Sequence Number=SeqID_51433
  Homolog annotation: Hit_ID=A5B0A4; Match level="QueryCoverage=96%, HitCoverage=6%, E-value=9e-09, Identity=34%"; Hit description =Putative uncharacterized protein
MRWKVGDGEKIGFWKDKWINQQESLAERYPRLFIISSQQNHTIRQMGIHNDKDWEWKFSWRRLLFDNKIDTSISFLREVEGQSIEQQQTDI

SEQ ID NO: 143119 - protein, 34 aa, Glycine max
  Coding DNA Sequence Number=SeqID_51434
MADQQATKSKAKAQDVKDALLGGNLVTFKSLLVI

SEQ ID NO: 143120 - protein, 41 aa, Glycine max
  Coding DNA Sequence Number=SeqID_51435
DNSNDAVQRRQDLPWVATTMAVRVLGQKIKSESETDEEKKK

SEQ ID NO: 143121 - protein, 70 aa, Glycine max
  Coding DNA Sequence Number=SeqID_51436
MSIRFVLSNLIAKAVWTARSMSGANKKMIEALAARKKEEYLKKEEYLQQFKMNCHKFHFQSFHPIYACFQ

SEQ ID NO: 143122 - protein, 140 aa, Glycine max
  Coding DNA Sequence Number=SeqID_51437
MGDQEKTQEQMKADMSALKEQMASMMEAMLGMSSVAEADPTLLATAHHPPSNIVGRGRDTLGHDGNPHLGYNRAAYPYGLPPNYSPPVLQDDAGPIASPVLEREPLQQPDEVHKDPQDYARRDVEFYTPIPEGPAPSTLP

SEQ ID NO: 143123 - protein, 155 aa, Glycine max
  Coding DNA Sequence Number=SeqID_51438
MVIDQSLFHDLTQLSSDGVPFEGTLNGDWKFDFSAHDARQLVCTNHADMTGRLLAGSLAFESHILHYLIVRILLPRSSNLAQRSFLIGAAVIASFGYRKEHDGSWVKKGAQPADEEGNLPVEDNSTLLRRLMDKFDGFQTFVGDKFDAMELQVDM

SEQ ID NO: 143124 - protein, 54 aa, Glycine max
  Coding DNA Sequence Number=SeqID_51439
MLLGIDGDSALRGTKIRATWEYMSSVGGGQQGMVGFYVICGCGEIVLHHRPTAT

SEQ ID NO: 143125 - protein, 126 aa, Glycine max
  Coding DNA Sequence Number=SeqID_51440
  Homolog annotation: Hit_ID=UPI00016621D1; Match level="QueryCoverage =78%, HitCoverage=33%, E-value=9e-07, Identity=34%"; Hit description =UPI00016621D1 related cluster
MTVSLDESISSFLIRVDPWVLVPIAFRGLHVLTFRGLHALAFRELHVLTFRGLHALAFRGLHVLAFRGLRVLTFRGLHVLAIRGLDVLAFKGQHVLAIRGLHALTFRGLRILAIRGLHALTFRGLH

SEQ ID NO: 143126 - protein, 131 aa, Glycine max
  Coding DNA Sequence Number=SeqID_51441
RVLPGWTQDDSYRDKAQRATLPEGRKADRYPVSGRVGTGERTRELPGGNACLWKNASNAAFLRFLAFCWPFAHMFFPALSPDSVDNRITAFEKRKSAQYANRLSPRVGRFINAAGTTGFPTGKRAVSATQL

SEQ ID NO: 143127 - protein, 91 aa, Glycine max
  Coding DNA Sequence Number=SeqID_51442
MSGFTRNSPQISVSPHQLDLAPYASEPYHAQWNAPGLLRDKHTLRSSRILEEMEVDEPWLGLWLPLNYQVDMGASQHRTLELGWCSSLEVR

SEQ ID NO: 143128 - protein, 86 aa, Glycine max
  Coding DNA Sequence Number=SeqID_51443
MLLGVLLPLPYFSGFVMSMMIGCGITWMLLEAWDGLMGPDVERERGVKGYVESDDELSWRWATGDGGLYVICGCGESFVHHHPTTT

SEQ ID NO: 143129 - protein, 129 aa, Glycine max
  Coding DNA Sequence Number=SeqID_51444
MVEHMSPVVVFPKKKHHMKSTTWGTSQDKISMQVDILNFNMANHIIHSRDSGGITLKISSNKDQGGPSNRPQQQGPSLYDRTTKLEETLAQFMQVSMSNHKSTESAIKNLEVQVGQLAKQLADRPSCSF

SEQ ID NO: 143130 - protein, 158 aa, Glycine max
  Coding DNA Sequence Number=SeqID_51445
  Homolog annotation: Hit_ID=UPI00016621D1; Match level="QueryCoverage =93%, HitCoverage=40%, E-value=9e-17, Identity=37%"; Hit description =UPI00016621D1 related cluster
MVKGLHVLTFRGLHALALRGLQVLAFKGQHVLAIRGLHVLTFRGLHALTFTGLHVLTFKELHVLTFRGLHALIFRGLHVLAFRGLNTLAFRGLHVRAFRGLDALAFRGLHVLTFRGLHVLTFRRLHALTFRGLSALAFRGLHVLAIKGLYVLAFRGLH

SEQ ID NO: 143131 - protein, 28 aa, Glycine max
  Coding DNA Sequence Number=SeqID_51446
MESKVKLRLKSTRKVKLVRKKITKKDFK

SEQ ID NO: 143132 - protein, 251 aa, Glycine max
  Coding DNA Sequence Number=SeqID_51447
  Gene Ontology: Mol. function=transferase activity, transferring nitrogenous groups; Cellular component=cytoplasm; Biological process= aromatic amino acid family biosynthetic process
  Homolog annotation: Hit_ID=A7MPM3; Match level="QueryCoverage=93%, HitCoverage=58%, E-value=1e-113, Identity=88%"; Hit description =Putative uncharacterized protein
  Pfam annotation: Domain name=Aminotran_1_2; Domain location=1-231; Score=105.6; E_value=1.5e-28; Accession=PF00155.12; Description =Aminotransferase class I and II
FLAKLQTLPERDIVLLHPCCHNPTGADLSNAHWDEVVKVLKARNLIPFLDIADQGFGAGMEDDAYAIRAIASAGLPMLVSNSFSKIFSLYGERVGGLSIVCDDAETAGRVLGQLKATVRRNYSSPPNFGAQVVAAVLNDPALKASWLAEVEAMRTRILAMRQTLVDALKEAVPGKNFDYLLKQRGMFSYTGLSAAQVDRLREEFGVYLIASGRMCVAGLNSRNVQRVAQAFAAVMLPLSGLAHEGHRDKYA

SEQ ID NO: 143133 - protein, 136 aa, Glycine max
  Coding DNA Sequence Number=SeqID_51448
  Homolog annotation: Hit_ID=A5C3F1; Match level="QueryCoverage=65%, HitCoverage=8%, E-value=9e-09, Identity=39%"; Hit description =Putative uncharacterized protein
MTRGNPSNSQPFDSEIDRTFHRLFRHSVHPTFPEHFVPFEHPEHPVTDESVHSVVGDFEHPNFEHSDFEHSKNMAQPPPREDPHKHLKEFHIVCSTMKPPEVQEDHIFLKAFPHSLEGVAKDWLYYLAPRSITSWG

SEQ ID NO: 143134 - protein, 187 aa, Glycine max
  Coding DNA Sequence Number=SeqID_51449
MASRKRKSIGARPTAQYDTRRFHSLDAWNRYTDNVLGRSILPERKVEIYHTEFDDFKIELERRNLHKCLTNLADGTIDVALVKEFYANLYRSEDPSPKQARVRGHLVKIDAYSLNTFLETPVVLEEGETLPTYSRYCRLPSDHREIEAALCIPGMGFILNVEGHPRRILKKDLTTLAQVWSVSRTPT

SEQ ID NO: 143135 - protein, 19 aa, Glycine max
  Coding DNA Sequence Number=SeqID_51450
MELTPLKEISRTAGRLGTG

SEQ ID NO: 143136 - protein, 68 aa, Glycine max
  Coding DNA Sequence Number=SeqID_51451
MKKQQWRSHGVAAEVKEKRHYPLGNKPWKKKLHHQESVLDKKLREEASMEEENERERERESGMGLKER

SEQ ID NO: 143137 - protein, 156 aa, Glycine max
  Coding DNA Sequence Number=SeqID_51452
  Gene Ontology: Mol. function=transcription regulator activity; Cellular component=nucleus; Biological process=regulation of transcription
  Homolog annotation: Hit_ID=Q84JL1; Match level="QueryCoverage=78%, HitCoverage=48%, E-value=1e-17, Identity=45%"; Hit description =Putative bHLH protein
  Pfam annotation: Domain name=HLH; Domain location=89-131; Score=10.2; E_value=0.013; Accession=PF00010.17; Description=Helix-loop-helix DNA- binding domain
MFCENAPTIWDQHRLKGALKPDDPQGLHSEESVKASPSSFRGQKSDKVDVTLLPQELDAMENVLSAKYEDAREEKKLRNKCEDSSDMVAEARREKISERMKILQDLVPGFNKVIGKALVLDEIINYIKSLQRQVEMPFMSSECFICKYFTISMIIL

SEQ ID NO: 143138 - protein, 96 aa, Glycine max
  Coding DNA Sequence Number=SeqID_51453
MKTPRELNFINQFTSGHQYWFPNVREKEKGLKPPFHCLRSMSISPSTDGFLQISMVKEKEKVLGGGKGKTKLRGRGDVESIVIDVKKAQQWQQSFV

SEQ ID NO: 143139 - protein, 122 aa, Glycine max
  Coding DNA Sequence Number=SeqID_51454
MECLEGVWETLEGNARCQFRGTIRFTATSLVHPEEPARTLQRTVEWILPTPTPYRLVESVQVIEVTSSEEDPEEDPEELPLEPDVDALSFPEGDEDVMSASEADSTEESGPEGIATSGGSSS

SEQ ID NO: 143140 - protein, 103 aa, Glycine max
  Coding DNA Sequence Number=SeqID_51455
  Subcellular localization annotation: CTP_CleavageSite=55; ConfidenceScore=5.25e-01
MSPPPLEPHNHSQTHLKLSGRLPLQARFSTGGLDGACTLSATLDRLARISEFRLSARLLAQWMDSSGALSGMGPRSANMHSSSFFQILPHAQPREWCTEWMAR

SEQ ID NO: 143141 - protein, 214 aa, Glycine max
  Coding DNA Sequence Number=SeqID_51456
MAAGNMHPQPKEKLVAQEYGDLSQLAPKANWIEQFIHEKELKRANKGRGSHLISLVNVDEENGEVFEEEVEIMATEILRGKPYSCPALKPRKNKVVQRALKEGCFKLADKGATEREVDTCPFPKLDINMVSYEHPTTKRKKMKQIRQSVFDRLEPQIKGTFNGSTYQIIGPKLVDMRQAMRRKEEPMKFEKLRQQIHGNMKVAHVPEIDNSPIP

SEQ ID NO: 143142 - protein, 141 aa, Glycine max
  Coding DNA Sequence Number=SeqID_51457
MKVFSPLLKVKDQDKFVWGEEQQQEFEQIKQVLAKPSVLVSPILGKCHTLISSGDLCSMTCDHSLVLVRCLAPIIRQFVKFQDMPKNQKNIDAQSHPGPLGPSGIFLQKAVASGGSNPARLGELSSPGRAGRQPPPLFCYK

SEQ ID NO: 143143 - protein, 204 aa, Glycine max
  Coding DNA Sequence Number=SeqID_51458
  Homolog annotation: Hit_ID=Q1SL03; Match level="QueryCoverage=57%, HitCoverage=39%, E-value=9e-08, Identity=26%"; Hit description =Ribosomal protein S2; Nucleic acid-binding, OB-fold
MSRKENLISELHTRKGTWKIAMRITDLWQARKQNMFQGSKIGATLWQELFTELRDKLQCGSSYLIQNLRIVDNQSEYRVSPAPYLVYLLKTTSVKEIHHPEIPSNVYLITPFTDIISGLAPCHTLVDIVGVVVDLIDVKTVNPPHRMTVRLRDNNNCDILITVWEDNAIQLHDAIDKNLLFQEPLVVMLTLGKIKDATGVSGVG

SEQ ID NO: 143144 - protein, 235 aa, Glycine max
  Coding DNA Sequence Number=SeqID_51459
  Homolog annotation: Hit_ID=A5B6K0; Match level="QueryCoverage=97%, HitCoverage=29%, E-value=1e-20, Identity=29%"; Hit description =Putative uncharacterized protein
  Pfam annotation: Domain name=zf-C2HC_plant; Domain location=18-73; Score=42.0; E_value=2.2e-09; Accession=PF07567.3; Description =Protein of unknown function, DUF1544
MLNSEGSSLFKPTGDRVDAFWKWNSLKDKNNRKSVTCDFCHKTTTRGISRAKRHQLQIKGDVGSCKKVPEDVKLEMIAAYEKKIAETAAYMEAMQEEDEEEEDGILEIARLKSGKKHPTTSNEASSTASNKRITTKKGPIDFLFSKAPEESIKLGKTMRQSSVNETYNKATRDRAVQYIARFFFRNGIPFNVAKSKSFKLMIEAIGTYGPHLKPPSYHELRVPLLKIELDTRRAY

SEQ ID NO: 143145 - protein, 347 aa, Glycine max
  Coding DNA Sequence Number=SeqID_51460
  Gene Ontology: Mol. function=RNA-directed RNA polymerase activity
  Homolog annotation: Hit_ID=A7P3W5; Match level="QueryCoverage=66%, HitCoverage=19%, E-value=2e-72, Identity=56%"; Hit description =Chromosome chr1 scaffold_5, whole genome shotgun sequence
  Subcellular localization annotation: CTP_CleavageSite=51; ConfidenceScore=5.06e-01
MAEIVPQFFIVDSTLCYTEPQTPKRPRPNSKRPRPNSKDEDSSGCSFVGCRVVAGVAGRDRRSRWTESSESQVEVAAQLQWRKGFSSRLDNRSGRELQWPAATAATLNCPASPAFVALLGAPRVFENDVPTSANIFDDPLFNYYRDVLDEQWIRAIDFTSDSRIGQSSAICLELPNGRQFPNFSENFAYYEESERQYTLQTGVPFSQNWGLVPIVAPPQGGQIPYDILFKVNSLVQHACLAEPSLDGDFYRLVDPCRMPLEFIEHASEKIYHSKQFCDEPTKWLTDQYKTYLKSKNHPRSPAISLDTRLLYVLWVQITPCKVYFCVPEINISNRVLRHFHEHIDNVG

SEQ ID NO: 143146 - protein, 142 aa, Glycine max
  Coding DNA Sequence Number=SeqID_51461
MVKTVITMMVVTVSVMTTTTIMLVVVAVMATTTIMLVVATMIDDHDDDYSDDHDNYGGNSHNGSGGHSDDRGSVLQWMPPPAIAIPLILPSAVARMVLTWLGAASTNSDTAHAANTNGGTCANVDSPAIGSCVTNVDVNLRE

SEQ ID NO: 143147 - protein, 31 aa, Glycine max
  Coding DNA Sequence Number=SeqID_51462
MSRLNNLYVKVAVKEELEDDGDEDGGGGGDI

SEQ ID NO: 143148 - protein, 272 aa, Glycine max
  Coding DNA Sequence Number=SeqID_51463
  Gene Ontology: Mol. function=aspartic-type endopeptidase activity; Biological process=RNA-dependent DNA replication
  Homolog annotation: Hit_ID=Q69F85; Match level="QueryCoverage=50%, HitCoverage=7%, E-value=4e-12, Identity=34%"; Hit description=Gag -pol polyprotein
MSRFKNEVRQAGQKCDKQEGSTKTDSHKSNKRHKLDTCHLLPKGPRYECYTPLTANHTIILEEAFNLEVPIKIPPMLSPRMGLDKTTYYEDHHSYGHNTKDCCALKDKIEELIQTRYLAKFVKRLENHQARERPEGNQEDQHKIEEDRDTINRDMIDNLHKNRSPPNKSESVSQASPPCHLGHRHQLCRYTITMKSPSYHFHWQRLQGSSSTWVAPLTSYCRNVPFCGRARARLTGVLSKGGKVDKSGAFAPTYPPLERKSDLRSSFLCVNQ

SEQ ID NO: 143149 - protein, 86 aa, Glycine max
  Coding DNA Sequence Number=SeqID_51464
MVCTKKIGQMTSEAAKEIADKIFQDSMDKQTSQGSFVAHGHHDVMIAAIGRLEHLGHVHAAGADVKIKKILWTGSKDLLHVFVHGS

SEQ ID NO: 143150 - protein, 274 aa, Glycine max
  Coding DNA Sequence Number=SeqID_51465
  Pfam annotation: Domain name=Transposase_23; Domain location=90-160; Score=-7.0; E_value=0.0069; Accession=PF03017.5; Description =TNP1ENSPM transposase
MVCTKKIGQMTSEAAKEIADKIGSFVAHGHHDVMIAAIGRLEHLGHVHAAGADMQSQGLTLPLEPEVGPSATRVSTKDCCVDPSGNDLGMGGLEKCGLYVKENPSRQVALGRIYEGLTTIHNISLRNDQVKVGVEEVRDADAPIHVPTQEVQLVGQALNTFVAWPTNLGPVRPAKPADRPDYDVDDPIYLMTWIIPQLFLKPLQVTWDATVFGLFNENFPLHIKHKDLSEIGYDGQYLSISVILCGFYKYASGEFRCVWIPRATVYTEIWAIAI

SEQ ID NO: 143151 - protein, 92 aa, Glycine max
  Coding DNA Sequence Number=SeqID_51466
MRVTGFGSILGRIDSLLKGNPSLAQEGMDLFRFWRGSITMPIGWTSQKSGAAIEEEELTDLRSNPLQGVGDDAILPRKGPFTRAMSKRLQED

SEQ ID NO: 143152 - protein, 584 aa, Glycine max
  Coding DNA Sequence Number=SeqID_51467
  Gene Ontology: Mol. function=transcription regulator activity; Cellular component=nucleus; Biological process=transcription
  Homolog annotation: Hit_ID=A7QWL4; Match level="QueryCoverage=16%, HitCoverage=33%, E-value=6e-11, Identity=36%"; Hit description =Chromosome chr4 scaffold_205, whole genome shotgun sequence
MLERTWFRRTMKREAESEWYVNDDSGDDGHSDDNMDRDDDGDKRLGLERLRGAAPPTWEASPQSVLVKSPQRSLAVCATDTTSQQWSANIDVWAFMDPAITVASVDHADEVTHKRDGIGERLYTTSSSLLQCRNCNAGDDREIRTQSSPSMKEENDLYKGLFDDEQRKILDIKEQLEDPHQAAEVLLIKTSIPGIMGLNQAHVFKERFIKSRKERALWHPYRTRARARVMGGIKEVQERMKANMEAMKKQMATMMEAIMSMKKIMQVNAVVVAATSAVVEVDPTPPSSFNQINHPTSDRVGQGDKELGSTGGPHFVQVQNQHAFPPYGLPPNYAPPMWCIFPMRIYATEGQAVGVPLPNTLEEERLKAIEGGGDYAFADIEELFLVLDVVIPPKFKENGSIFAKDEKLLMHFFKESLTGAAVTCYRTCAKKSTNLSKDMPKGGGIWQLKIEVGLRRGKFDHPALLNKKPGANGEDEKEEGTHAMAAIPTWPNFPPAPQYQYSANISPSYYPPPNQPQRPPLSQPQGPPTTHPIPNTTLNTNQDTNQGGSFPGKKPIEFTPIPVSYDNLLSYLLDNSMVAITPAK

SEQ ID NO: 143153 - protein, 256 aa, Glycine max
  Coding DNA Sequence Number=SeqID_51468
  Homolog annotation: Hit_ID=A5B3J3; Match level="QueryCoverage=16%, HitCoverage=11%, E-value=6e-07, Identity=52%"; Hit description =Putative uncharacterized protein
MRNLLKQLGGTRRARRVAARGVTERGERAGRQGRGGTAEGLREGDMRGWVERILNVTRVERGIERETCGGCGGARFVPCFDYAGNCKIVWRGDERVAAKGGMKEGERQARRSNIPFHSILRDVLDTPQELIEYFLDTKAQETVMFLQPKLELGQLQFAEQNTGYFYSNLSSMPLLEMVEENEINRSLLELLDENIASAQKGNQVFVQLAIMFMGMFNYVVKIMMIKSEFLDLCGVPTVNLDELLGRYMDLLYSSGE

SEQ ID NO: 143154 - protein, 297 aa, Glycine max
  Coding DNA Sequence Number=SeqID_51469
MVVQCWFLLSWERWATGDGVLMPGLVEMGCLFCAIARSPPSTTYDRVVPGDMSRGSGDFGDARWNAIAQNQAWPITTQPGHSQSVRTCDVPKQTSSWQSTNKRTKVHEARRLVWRLASYLSCVLSEKYPLGSKIENRTLSSFWFQCAKAVVIRFLGTGNRLLTLITMAAQLIDDRVVMECLEGVWETLEGNERCRFRGTIQLTATSLPVEWILPTPTPYRLVEPVQLIEVSSSEEDLEEDPEELPPEPAMDAPDLPEDDEDPLPDVDSLEDIMSASEADSTEESGLGGTANSDDSSS

SEQ ID NO: 143155 - protein, 186 aa, Glycine max
  Coding DNA Sequence Number=SeqID_51470
MVNGLDKYNGVGHGSMDIGIPCIESLPSKATIRYSSIEYGFRSMGRLPCERDSYLREKLLKYKYEECAGWLSPKSGWYFSRDEGDDQRIQATIWASSSAYLESSYLANSLVDPHESDLHDIRGSDDKRVIFDVDVGRKGALSIVYFDDVQDFSGSEVGNEEVRDGEFDGEIGDEIGGEVLADTEYD

SEQ ID NO: 143156 - protein, 44 aa, Glycine max
  Coding DNA Sequence Number=SeqID_51471
ENEGGACHPARPGELGCFLQKAPPCGELPGRPKWAWLLFAPPFN

SEQ ID NO: 143157 - protein, 334 aa, Glycine max
  Coding DNA Sequence Number=SeqID_51472
  Gene Ontology: Mol. function=unfolded protein binding; Cellular component=cytoplasm; Biological process=cellular protein metabolic process
  Homolog annotation: Hit_ID=A7PD22; Match level="QueryCoverage=94%, HitCoverage=75%, E-value=4e-91, Identity=62%"; Hit description =Chromosome chr17 scaffold_12, whole genome shotgun sequence
  Pfam annotation: Domain name=Cpn60_TCP1; Domain location=1-306; Score= -92.7; E_value=2.9e-11; Accession=PF00118.15; Description=TCP-1cpn60 chaperonin family
MEEEYIEQLCMHILKFKPDLVILDKVDAQDRGIMLGLVKSCIGTKFTGQFGDLIADLAIEATTTVGVEIGQGLTDVDMHAEDWILLLKIEEEYIEELCMQILKFKPDLVILDQGLTDLATHYLSKHGVSAMRRLSKTRPDELQESDVGTGAGLFEVNKIGEEYFSYIVNCKEPKACTILLRGASKDLLNEVERNPQDAMSVARNIIKNPKLVPRGGAIELTVLAGLKQKSSSIEGIEKCPYEAAAVAFEAIPRTLAQNCGVNVIRTMTGLQGKHANRENYEGWQGSEGTKSSCMLLRIHDIVSGMKKKQAPGAPPSKLKVETEADADSEQILAD

SEQ ID NO: 143158 - protein, 251 aa, Glycine max
  Coding DNA Sequence Number=SeqID_51473
  Homolog annotation: Hit_ID=A5AT31; Match level="QueryCoverage=28%, HitCoverage=8%, E-value=8e-08, Identity=37%"; Hit description =Putative uncharacterized protein
MGMEGCLKNSSLEASLEFKEFFKSLYEEVASSSSKKNEEDVSSPFNLCPKIPVFMEKYEGWPFFNLYDNVVKKVVLWVRIPMFLIELYNKEFLWEVGNMLGMMLKVDENTSIHSRGNFSQFCVELDLSKELVPSFMVIGMIIVPTNALKLVPTLYLKNKKSFSRGGGVQPSQTNPKDKPDIPFSNADVGDEDKARNKDKETLEGLGGPMERARTKKAKEALQQVLSMLLEFWPTLQVEKLRIVNCTMFQEE

SEQ ID NO: 143159 - protein, 182 aa, Glycine max
  Coding DNA Sequence Number=SeqID_51474
  Homolog annotation: Hit_ID=A5BU47; Match level="QueryCoverage=58%, HitCoverage=5%, E-value=6e-09, Identity=33%"; Hit description =Putative uncharacterized protein
  Subcellular localization annotation: CTP_CleavageSite=40; ConfidenceScore=5.29e-01
MATPLRSPPQSDGQSEATSKRSRTMTRLRRLTLRTMDQPRPAIYVDPATGRASGPMREKFHSYIGVVAREKVPIIHNNWKDVPETLKEIVWNDILVSPHFDIPEAAKEKTKVMPTVATRWRQFKSTLTSKFVFGNTKGQQTQDVVTKYGLDPEAWKQFEATRVTPNWEANFNVDSVKDPHEL

SEQ ID NO: 143160 - protein, 197 aa, Glycine max
  Coding DNA Sequence Number=SeqID_51475
  Pfam annotation: Domain name=Retrotrans_gag; Domain location=130-195; Score=1.3; E_value=0.04; Accession=PF03732.8; Description =Retrotransposon gag protein
MCLLVFYMHRSPTGNLVPQNLEIEATLRRNRPRGEGNFCKTEQLHPFLRKKLIFLNHYHLIHHYQGNPLLNCLKPLAWQTSSTRGSPLRSIQAAQYHNSLLALHVLKCKGIYSNDYLMKTLMHIWQRSLKYATLLRLPAKRWLHSFKGNSLKTWEEVVEKFLKKYFLESKTVEGKAAISSFHQFPDESLSEALERFR

SEQ ID NO: 143161 - protein, 248 aa, Glycine max
  Coding DNA Sequence Number=SeqID_51476
  Homolog annotation: Hit_ID=A5AWV0; Match level="QueryCoverage=79%, HitCoverage=13%, E-value=2e-07, Identity=26%"; Hit description =Putative uncharacterized protein
MEEAAQSESTEALIDPLSPIRRHVKWKRARTKKIGQMTYEATKEILEKIESQGSFVPHGRQDVLIAAIGQPEHPGRVHAAGTGVTMKQYFESAPRTSRTSSSMDSKELEQLTQQIRDQLEESIIEKGLALPPEPEFGPSAAHVSTKESCIDPSGNDPDMGDSDKYGLYIEENPPCLVALGRVYEGSITVHNIPLLHDQVKVDVEEVKNANAPVPVVHTPGYYLFVWMQNLLASASGHQAFATRNHDCE

SEQ ID NO: 143162 - protein, 191 aa, Glycine max
  Coding DNA Sequence Number=SeqID_51477
MASRKRKSIGTRPIEQYDTRRFHSFEAWNRYMDSVLGRHILPERKVEIYHTELDEFKAKLEWHPSPKQVKVRGHLVRIDADSLNTFLETPVILAKGETLPAYSRYCRLPIDYKEIEDALCIPGRGFVLNSEGHPGKILKKDLTTLAQVWSVLSYSNLAPTSHTSDLTVDRARLVFGLVSQMDMNVGALISG

SEQ ID NO: 143163 - protein, 156 aa, Glycine max
  Coding DNA Sequence Number=SeqID_51478
  Subcellular localization annotation: CTP_CleavageSite=43; ConfidenceScore=5.66e-01
MATPPSSPPPPSPPPPTEAASQFPSTLKRTRKATRLRSLATRPAGADRSVVHVDPTIGKADGPHKKKLRTYLGIVARDKAEFDIPEASDVRTKKKILQTVGPTRTIWMTLFTKNTTLAKRNGPNFVRAAETPRGRMCRKRCSLLASAPDRTSSIKR

SEQ ID NO: 143164 - protein, 114 aa, Glycine max
  Coding DNA Sequence Number=SeqID_51479
MICLQPNLITSLVKVLRIQVCVFLTVWLSVRLTLSSNSLTRAKHDVEIRKPFLSLICIELKGEENGSLLRGLKSVNFRGHRVEQGAKFSSFREISEFLSDCEIPRGGGDIPTPL

SEQ ID NO: 143165 - protein, 46 aa, Glycine max
  Coding DNA Sequence Number=SeqID_51480
MAPFLMGGGGAAEGGGGEERREKNKLKRRSRKSPPTAANGVGEKGG

SEQ ID NO: 143166 - protein, 71 aa, Glycine max
  Coding DNA Sequence Number=SeqID_51481
MATVQHLLMDNKMKRLNIYKTKPNLNKNFKEATKAIGVAQVILTTLMEVLQIKVHNNNKLNQTDCPRWKIL

SEQ ID NO: 143167 - protein, 130 aa, Glycine max
  Coding DNA Sequence Number=SeqID_51482
MVYRLKLVCTNQVDMTERLLAKSLAFECRIMHYLIVHILLPRSSNLAQPFVKVKRSFSIGASAVSSFGYRKKRDGSWVKKDALAQATEDRSPSPPPQRDDSSPLMQSILDRLDGPLIINSTPLLNYSEAT

SEQ ID NO: 143168 - protein, 265 aa, Glycine max
  Coding DNA Sequence Number=SeqID_51483
  Subcellular localization annotation: CTP_CleavageSite=49; ConfidenceScore=5.81e-01
MSIAQASQFIVMTSCILQMTTPPSSPPPPPPTTTGATSQSPSTLKCIINATRLRSLATRPVGAERPLVHVDPATGKADGPHSKKLRTYLGIVTRDKVNVTYENWKQVHAAQNDLIWEDIQAEFDIFKKKHRIFRDVDAPIPIPTEEGVVGLAKPADRPDHKVDDPLYLMTLTISQLFLKPLQVMWDATVFRVFNEDFPLYIKHEDLSEITHGGQCLSNFVIQLWILHMIETSMRAGNSDVYGFLEPQSIQRSGQSQFESESYMKN

SEQ ID NO: 143169 - protein, 92 aa, Glycine max
  Coding DNA Sequence Number=SeqID_51484
  Homolog annotation: Hit_ID=A7PM27; Match level="QueryCoverage=75%, HitCoverage=17%, E-value=5e-15, Identity=53%"; Hit description =Chromosome chr14 scaffold_21, whole genome shotgun sequence
MLFSPALDDAKHGFSWPEMYKENLAGTLEAYDRHVFLCYKSHLAWPPRLEAFDADALPLRVATVWRARKNDITVKSVVSRRPSAQYSLKQFT

SEQ ID NO: 143170 - protein, 224 aa, Glycine max
  Coding DNA Sequence Number=SeqID_51485
  Gene Ontology: Mol. function=RNA-directed DNA polymerase activity; Biological process=regulation of transcription, DNA-dependent
  Homolog annotation: Hit_ID=A7QWT6; Match level="QueryCoverage=67%, HitCoverage=48%, E-value=1e-26, Identity=37%"; Hit description =Chromosome chr4 scaffold_208, whole genome shotgun sequence
FRWYRDTFLTRVYTREDSQQPFCKEKFLAGLPRSLGDKVRDKIRSQSGNGDIPYENLSYGQLISYVQKVGLKICQDDKIQRQLAKEKAQTKKDLGSFCEQFGLPACPKQKKKQTSRKEIQDHKPANRRRFPKRRYSHKPSTTKPTTIQDLQTEINNLKKEVKELRQQQEIHQIILSQLEEESDSESTKDSEENQAENLEDDMFMRIINKIKSKYLHMSVRTYVN

SEQ ID NO: 143171 - protein, 58 aa, Glycine max
  Coding DNA Sequence Number=SeqID_51486
GGAGRDTIIAWGWPAAGNRCTTATSKAPQLIYKSWSVAYDLWSTRRRPSPKPKVVKIP

SEQ ID NO: 143172 - protein, 277 aa, Glycine max
  Coding DNA Sequence Number=SeqID_51487
MGRISEWGYGVSRRLVRPQTHCLRSWSPFPFMVSKANARMETCMKAVEKAIEENHRARELGLTSIKLVSMKMVKGTMLEVDQGFNVEVKRVEEEKTREAVYGLVAQEGTRIPNLRPYKYPNHQKDEIEKMGVKADPSKLAVMTEWPKPKDEVCEGLWENCTTIECITQERCISLGEEATSAFEELKATMQKLPIDVAPCGVCRPWIFFINGVLCFLKFNDSGMEKEERCLETSLQGEDESRTSSPPYEVMDKSLKIGEDEWREKEKRSTKFYASNED

SEQ ID NO: 143173 - protein, 52 aa, Glycine max
  Coding DNA Sequence Number=SeqID_51488
MAMQDFGPARRVRTNVLSLCKSARQSGPSATIVGLCRARRPAYPHLILTVDG

SEQ ID NO: 143174 - protein, 305 aa, Glycine max
  Coding DNA Sequence Number=SeqID_51489
  Homolog annotation: Hit_ID=A9NAI1; Match level="QueryCoverage=20%, HitCoverage=100%, E-value=5e-24, Identity=84%"; Hit description =Putative uncharacterized protein
PRILPADRMAPNSRTKPGVVGADQGGIAHGNSAGAVPRRRAHGRGLLPAACAGGPQCQEPGGGGTRAAQYPVWRVRLPGQRAGGDGAHRRRWGLPPAGLRYRRVAAPAGAGPGQGSDASPGGLDAGKPAAVGIRQPSGRWLRPAMRGSGLPRNHRQRKTPAEAGVLKNWRPHGDSNPGRHRERVIGGAKRDRTADLLRAMQALSQLSYGPVVICTKLMHRLLQGIKQFVWELISRLMSSIKEVIQPQVPLRLPCYDFTPVMNHTVVTVLPKVRLATSGATHSHGVTGGVYKARERIHRDILIRDY

SEQ ID NO: 143175 - protein, 50 aa, Glycine max
  Coding DNA Sequence Number=SeqID_51490
MTKARQKGVWKEKEGDACHPARPGELGCFLQKQPPSGGTSWKAQVGLVAI

SEQ ID NO: 143176 - protein, 86 aa, Glycine max
  Coding DNA Sequence Number=SeqID_51491
MRTLCNSRRRHQRVIIAIFVGNLDTSRIAQSVRLGSKTKGSLTIQTINPNEKFVFMGNRVKASVEAVGTYRLKLDTEHYLDLLKTL

SEQ ID NO: 143177 - protein, 148 aa, Glycine max
  Coding DNA Sequence Number=SeqID_51492
SNRALGFPSLITGLCQSFGVPVAPTKAQGDAPQAAGAPPPPHQAGQAGAFDMEQYLRHLVRQQAANHRAHVQTHDCLYQMSLSMQSQGFASFSCPTPDQFRAEVAWPGDCPEAQAGEAPPEAPGGGEEAHEDEEMADLLDFLGGSGDT

SEQ ID NO: 143178 - protein, 196 aa, Glycine max
  Coding DNA Sequence Number=SeqID_51493
  Gene Ontology: Mol. function=sugar:hydrogen symporter activity; Cellular component=periplasmic space; Biological process=transport
  Homolog annotation: Hit_ID=P39325; Match level="QueryCoverage=100%, HitCoverage=61%, E-value=1e-101, Identity=93%"; Hit description=ABC transporter periplasmic-binding protein ytfQ precursor
MTTVTANNVLEGQLIGDWLVKTVDGKPCNVVELQGTVGASVAIDRKKGFAEAIAKASNIKIIRSQSGDFTRSKGKEVMESFIKAENNGKNICMVYAHNDDMVIGAIQAIKEAGLKPGKDILTGSIDGVPDIYKAMIAGEANASVELTPNMAGPAFDALEKYKKDGTLPEKLTITKSTLYLPDTAKEELEKKKNMGY

SEQ ID NO: 143179 - protein, 69 aa, Glycine max
  Coding DNA Sequence Number=SeqID_51494
  Homolog annotation: Hit_ID=UPI0000ECBAF8; Match level="QueryCoverage =59%, HitCoverage=48%, E-value=1e-16, Identity=100%"; Hit description= UPI0000ECBAF8 related cluster
MEVADPTRITARTCSGSMQAWHWPSFYNVVTGKTLALPNLIALQHIPLSPAGVIAKRPAPIALPNSCAA

SEQ ID NO: 143180 - protein, 49 aa, Glycine max
  Coding DNA Sequence Number=SeqID_51495
MPSLVRLARSAHDIMFVHAKQWAIPYISRMQEYTSLMSFKTHYVDLNED

SEQ ID NO: 143181 - protein, 140 aa, Glycine max
  Coding DNA Sequence Number=SeqID_51496
  Homolog annotation: Hit_ID=P03851; Match level="QueryCoverage=60%, HitCoverage=100%, E-value=4e-44, Identity=98%"; Hit description =Uncharacterized 9.4 kDa protein
STLEDSPQQKARNRKKAALLATIKIPGVSPWKLPRALSCSDPAAYRIPVVRSKLGCVHEPPVQPDRCALSGNYRLESNPVRHDLSPLAAATGNRISRARYVGGATEFLKWWPNYGYTRRTVFGICALLKPVTFGKRVGSS

SEQ ID NO: 143182 - protein, 350 aa, Glycine max
  Coding DNA Sequence Number=SeqID_51497
  Homolog annotation: Hit_ID=Q6WAY6; Match level="QueryCoverage=72%, HitCoverage=47%, E-value=1e-12, Identity=25%"; Hit description =Putative uncharacterized protein
MDWDQLLAGIGGRTISWFPRWKEGKEGVLFSCGGYPNILLIGTRGCINYNPALAIRQLGYPMRGAPMEESMSPFIVRDFSTQNFKAIQRIHKAWETPLRKDKEIRGIRNGIIGGYHEWLKVHTRGLDWLAKLKVVSEESFEAPEEDEEVQALKNELGKVRLAKEKFKLAATDIRKECAGLREENATTARALGQETKKARKEEYGRNKFRRALWGSNSELKLRREERDQSRAHGMVLKEELVACSRSKRNLSQRLCETETYMLAIIAKYQEELSLAMAHEHRVADEYAQVYAEKEARGRVIDSLHQEATMWMDRFALTLNGSQELPRLLAKAKAMADTYSAPEEIHGLLGY

SEQ ID NO: 143183 - protein, 207 aa, Glycine max
  Coding DNA Sequence Number=SeqID_51498
MLYGVLHRTRARARVMGEAEEVQEKMKADMEAIKEKMATMMEAMMSANAVAIAATSVVAKVNPMSPSGINQMNHPTSDMVGKDLGSTGGPHDVQIQNEHAFPPYGLPLNYTPPNVAYTPNKNTHEIPHHNLADFEPWLGHATEGQEVGGIPLENTLEGPQAIEGGEDYSFANLEELFPIPNIITPPKFKVLDFDKYKGTTCPKNHLK

SEQ ID NO: 143184 - protein, 47 aa, Glycine max
  Coding DNA Sequence Number=SeqID_51499
MKESIGHILDLTHIGENRERKPQEANINLPYFHGKDNIEAYLDWKIR

SEQ ID NO: 143185 - protein, 139 aa, Glycine max
  Coding DNA Sequence Number=SeqID_51500
  Homolog annotation: Hit_ID=Q2HVE9; Match level="QueryCoverage=51%, HitCoverage=17%, E-value=2e-07, Identity=37%"; Hit description =Polynucleotidyl transferase, Ribonuclease H fold
MVAAFMDEIDGVQIHSSRMDHLTWRAEPSGSYSTKSAYIFLMEDGSSEYEDNASRFMWNLKIPPRAAAFSWRIFKDRLPTKANLRRRQNFSNQTFDGNKLMEDAIFTLWTWLKNFDKDFAFTYSYWSSNIASGFVFSGG

SEQ ID NO: 143186 - protein, 115 aa, Glycine max
  Coding DNA Sequence Number=SeqID_51501
MSNQKSTESAIKNLEVQVGQLAKQLADRSSSNFIANVEKNSKEDCKVVTTRSRMAIHVDESEAEKKMEEHKQQLAPKPALEPVSDFVELDEINEEAEDDKEEETPIKEKEKERIK

SEQ ID NO: 143187 - protein, 82 aa, Glycine max
  Coding DNA Sequence Number=SeqID_51502
MALRKLASKRSRKDKTAEGTSSAPEYDSHRFRSVEHQQRFEAIKGWSWVRSRHSPRILCQCLAYRGGRARYEVLREVSVDPV

SEQ ID NO: 143188 - protein, 53 aa, Glycine max
  Coding DNA Sequence Number=SeqID_51503
MEYLLVGDEQKRKTESKNAKKDDPRAANSSIPWVWLLKGGEKRFLNGWLAQAS

SEQ ID NO: 143189 - protein, 269 aa, Glycine max
  Coding DNA Sequence Number=SeqID_51504
  Gene Ontology: Mol. function=nucleoside-triphosphatase activity; Cellular component=membrane; Biological process=defense response
  Homolog annotation: Hit_ID=Q19PL1; Match level="QueryCoverage=94%, HitCoverage=59%, E-value=2e-36, Identity=35%"; Hit description=NBS -NBS-LRR type disease resistance protein
  Pfam annotation: Domain name=LRR_1; Domain location=15-36; Score=8.2; E_value=9.3; Accession=PF00560.24; Description=Leucine Rich Repeat
  Pfam annotation: Domain name=LRR_1; Domain location=212-234; Score =5.1; E_value=35; Accession=PF00560.24; Description=Leucine Rich Repeat
  Pfam annotation: Domain name=LRR_1; Domain location=38-59; Score =10.9; E_value=2.9; Accession=PF00560.24; Description=Leucine Rich Repeat
  Pfam module annotation: Pfam domain module=LRR_1::LRR_1::LRR_1; Domain location=15-36::212-234::38-59
SGLRYVPENLGNLCHLKYLSFRYTWIESLPKSVGKLQNLETLDIRDTYVFEIPEEIMKLKKLRHLLSNYISSIQWKDIGGMASLQEIPPVIIDDDGVVIGEVGKLKQLRELTVRDFEGKHKETLCSLINEMPLLEKLLIDAADWYEEIDLYITSPMSTLRKLVLWGTSTRDNAYEGETLHFQCGGFQKLKQLNLGSLDQLKCILIDRGALCSVEEIVLEGLSQLKTVPSGIQHLEKLKDLYINCMPTEFEQRIAPDGGEDHWIIQDVPR

SEQ ID NO: 143190 - protein, 143 aa, Glycine max
  Coding DNA Sequence Number=SeqID_51505
  Gene Ontology: Cellular component=membrane; Biological process =embryonic development ending in birth or egg hatching
  Homolog annotation: Hit_ID=Q45Q23; Match level="QueryCoverage=35%, HitCoverage=17%, E-value=1e-19, Identity=82%"; Hit description=PHB2
MALSVMSVHEHHLLQVITQIFIQKGVDVEVLPPSESVWSSCALTNLRRITSVLSSFKRGTPQMETSSNSSFRSFFSSSMEFFSESKTLLLFGSAVGVKDKVYPEGTHFLIPWFKRPVIYDIRARPHLVESTSGSRDLQMDFLH

SEQ ID NO: 143191 - protein, 39 aa, Glycine max
  Coding DNA Sequence Number=SeqID_51506
MCFREENPSQGASVIDSVEILHRSSPFFVRSSSFFGLQP

SEQ ID NO: 143192 - protein, 119 aa, Glycine max
  Coding DNA Sequence Number=SeqID_51507
MGEVEEVQEQMKADKEATKEQMATMMEAMMSMKNIMEANAVTVAVTNTVAKVNLMPPSDLNQMNHPTSDTVGKDLGNFDKYKGTACPKNHLKMYCRKMGAYTKDEGTANTFSSKKSPLG

SEQ ID NO: 143193 - protein, 98 aa, Glycine max
  Coding DNA Sequence Number=SeqID_51508
  Subcellular localization annotation: CTP_CleavageSite=67; ConfidenceScore=5.32e-01
MASSAIYLSTIDASGQCRFLVYPFKIFMYLSTGSSNLTGSRTLLHMALKKKHRRVMANLTLLGKMSRMAMANNCCINTANTDKNLSSPFWTKYDKLEA

SEQ ID NO: 143194 - protein, 66 aa, Glycine max
  Coding DNA Sequence Number=SeqID_51509
VANLDDGGSTDLRINPLQEGGDDAILPRRGSITRAMARRLQKDWYRDAGEGHSILMSLRVDFGPMG

SEQ ID NO: 143195 - protein, 142 aa, Glycine max
  Coding DNA Sequence Number=SeqID_51510
  Gene Ontology: Mol. function=transaldolase activity; Cellular component=cytoplasm; Biological process=carbohydrate metabolic process
  Homolog annotation: Hit_ID=A7QT89; Match level="QueryCoverage=98%, HitCoverage=36%, E-value=2e-46, Identity=60%"; Hit description =Chromosome chr1 scaffold_166, whole genome shotgun sequence
ARKDIESAYWELVVKDIQDTCKLLEPIYNETDGEDGHVSLAVSPKLANDTKGTIEAAKWLHNMVGSPNRLIVCVFEQLIFYLPKYEAVIDAYLDGLESCGMTDLSKVSSAAAFYISRMDVTLDKKLEQIGTTEALDLKGKVM

SEQ ID NO: 143196 - protein, 62 aa, Glycine max
  Coding DNA Sequence Number=SeqID_51511
MMAHQRCLPPSSPRQRIKLKVLMMPKDYMMMMPKDYMNHMLLKDLLKTKQLELIKMDDQDSL

SEQ ID NO: 143197 - protein, 20 aa, Glycine max
  Coding DNA Sequence Number=SeqID_51512
RIPEHKGRVVPVCIINPKRE

SEQ ID NO: 143198 - protein, 86 aa, Glycine max
  Coding DNA Sequence Number=SeqID_51513
MLYVEERSRLLAVITSLLGNVPWKPAWRTRKNVPSRVAQTDATVAPSRASEGEAHGCAFQRRKDAESPSQRLFVENVGKTEGNRSK

SEQ ID NO: 143199 - protein, 172 aa, Glycine max
  Coding DNA Sequence Number=SeqID_51514
MTLTYKNRRITRPFRLARFGDDADAGSRQARQGASAGVGGCRGWLNYAASEQIVLRVHHMRCEIPHRCVRRKYRIRRHSPFRLRNCWEGRSVRASSLLRQLAKGGCAARRLSWVTPGFSQSRRCKTTASAKLACLQVDSRGSLPSPNLNIHSSRSTSPSKGVSLAPTYPQLQ

SEQ ID NO: 143200 - protein, 92 aa, Glycine max
  Coding DNA Sequence Number=SeqID_51515
MCITLRLPRRAVLLDEGPGDRRSDYFTGGDGNSKGLAEAHDQRRKPQGPVGLIWVQRVPGRRHTCKQINGVGNHLGQRGRSSVSGWHTPTGT

SEQ ID NO: 143201 - protein, 100 aa, Glycine max
  Coding DNA Sequence Number=SeqID_51516
  Subcellular localization annotation: CTP_CleavageSite=35; ConfidenceScore=5.37e-01
MHTQSFTIPQFAKIGLTHKNSLQWSRQLSQPALLRASEVGLTGACPKKGIRAESPPTFICGKRRKNRRKPVMKNIPDSGVVFTFEECISTSHVCPKGQQP

SEQ ID NO: 143202 - protein, 150 aa, Glycine max
  Coding DNA Sequence Number=SeqID_51517
  Homolog annotation: Hit_ID=A0ST23; Match level="QueryCoverage=30%, HitCoverage=91%, E-value=1e-11, Identity=73%"; Hit description =Putative reverse transcriptase
MTVKTSDTCSSRRRSQLVCKRMPGADKPVRARQRMRKEKIPHQAPFAIQAAQLLGRAIGAGLFAITPAGERGMCCKAIKLGNARVFPVFLNAWELENTWSCPPWGTELEFVIMVIAVSFGKPVVPAALMNRPTRGERRFAYWALFRFLAH

SEQ ID NO: 143203 - protein, 177 aa, Glycine max
  Coding DNA Sequence Number=SeqID_51518
  Gene Ontology: Mol. function=nucleoside-triphosphatase activity; Cellular component=membrane; Biological process=defense response
  Homolog annotation: Hit_ID=Q19PL1; Match level="QueryCoverage=80%, HitCoverage=8%, E-value=3e-20, Identity=39%"; Hit description=NBS -NBS-LRR type disease resistance protein
MPLLEKLAIGAADESEVIDLYLMSPMSTLRKLVLRSKLTNDALKSLKDMPRLMFLCFAHNAYEGQTLHFERGWFQKVKTLHVICLDKLKSILIDRGALCSLEEIVLRDLSQLKTVPSGIQHLEKLKDLYIVDMPTGFEQRIAPDGGQDYWIIQDVPHVGIWSRDAEEPLHIFGRSHH

SEQ ID NO: 143204 - protein, 74 aa, Glycine max
  Coding DNA Sequence Number=SeqID_51519
MAYPRCLPHGLRDMCMTRLGLLDLNKYGSRVVDILIGHMYNIGWCIVGRQAIWWERDACSGPAQNGGCPYFPML

SEQ ID NO: 143205 - protein, 83 aa, Glycine max
  Coding DNA Sequence Number=SeqID_51520
MEVEEPWQGLWLLLHYQVDMGASKHMTPEFGVNPTGFLLQNSFLDCTIGGVWALGVWNDSHSKGFSLIFILFIAPVFAFIKAG

SEQ ID NO: 143206 - protein, 145 aa, Glycine max
  Coding DNA Sequence Number=SeqID_51521
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=61%, HitCoverage=75%, E-value=1e-24, Identity=66%"; Hit description=LacZ protein
MSRARTKKTKEALQQVLTMLSEFRPNPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 143207 - protein, 180 aa, Glycine max
  Coding DNA Sequence Number=SeqID_51522
  Pfam annotation: Domain name=G-patch; Domain location=1-42; Score =18.2; E_value=0.0012; Accession=PF01585.14; Description=G-patch domain
MVARVMLRNGFEPGMGLGKDCLRNADVVDIKGNPYKYGLGYEPRMPGKRNVPSRFQADRVWPGRISQCFTSAGMVSEEEVAAIEEEFPQDPPSFVQPCHPDSQVGNWCMISQSEVYTADSICEGRFFKEPNNEGLTINFDRDISQTINEEEEEDVLSPELERLVAQEEREMKPHQEETEL

SEQ ID NO: 143208 - protein, 197 aa, Glycine max
  Coding DNA Sequence Number=SeqID_51523
MLIPRIPSLLLLREKKFMTRRPSTFTRHCSESGPCLSPSVPDHPLGPATDHRLGKLLPHQLANQTRAPPRADSSFCSSAYGVLAAVSSCCSPPKGRFLRVTHPSATGNTTSRPTCMYKADSEFSSIPRHNLYPGASYSTGVRSQKYSPPTPRVIPRASYPFSIIIRSRHTNRKTYIGFRDNQARTDNFHHVKVTLYR

SEQ ID NO: 143209 - protein, 202 aa, Glycine max
  Coding DNA Sequence Number=SeqID_51524
  Homolog annotation: Hit_ID=Q6Z8F0; Match level="QueryCoverage=24%, HitCoverage=44%, E-value=5e-11, Identity=67%"; Hit description =Putative uncharacterized protein P0459B01.18
  Subcellular localization annotation: CTP_CleavageSite=23; ConfidenceScore=5.11e-01
LDGIYRPIGTAFPNNPTSPTAPRGATGSGHDGALRVSGAPFQGTWARSATEDASPDYYSDAEADRFSWWAFPGLVGSVRARKGSSMGPELTGSHVIGLRAWLIHHFITAKSPMNPDFNQPRGGCSPGGQHTPPPSNIVTCLRLGKRCVTPSQACPRPNGFGRNLRSKTRWFTGFCNSHQVSHFATFFIDARADDTPLPRVIV

SEQ ID NO: 143210 - protein, 84 aa, Glycine max
  Coding DNA Sequence Number=SeqID_51525
MKMLLIPHDVSSIGACKPRIFFINGFLCFLEDKWQRNGEGRDRRRCHFKEKMSLEEAHHHRRPWIRAWRKKEMNEGRQREEHGI

SEQ ID NO: 143211 - protein, 306 aa, Glycine max
  Coding DNA Sequence Number=SeqID_51526
  Homolog annotation: Hit_ID=Q6WAY6; Match level="QueryCoverage=44%, HitCoverage=29%, E-value=2e-17, Identity=32%"; Hit description =Putative uncharacterized protein
MANQGDWVPFMDVLALLIFGVVLFPNVDGLVDLAAIGAFLAYHHSKESPVVAVLSHRSCTEKRRIDWGQLLAGIRGRTINWFPRWKEGKEGVLFSCGGYPNIPLIGTRGCINYNPALAIRQLGYPMRGAPTEESMSPVLLKVVSEESFEAPEEDEEVQALKSELGKAKLAKKKFKLATTHIRKECAGLREENATTARALEQETKRARKEEYGRNKFRGALWGSNSELKLRREERDQSRAHSMVLKEELVAYSRSKRSLSQHLCETEANMLANIAKYQEELGLATAHEHRVADEYAQVYVEKEARGR

SEQ ID NO: 143212 - protein, 205 aa, Glycine max
  Coding DNA Sequence Number=SeqID_51527
MDEIEKVQEQMKADTEALKEKMATMVEAMMSIKEIVEVSAAYQTRAGARVMGEVEKVQEQMKTDMEATKEQMATMMEAIISMKKIREVDTVAVAATSAVAKVNPMPPSGLNQMNHPTSNMVGKDLESTDDPMMCKFKTSMPSRHIACLPMWRTLPMRMSITPLLYSLRANKPKTDHAHVSQTMGEAHEIPKHNLADFEPCLGYAH

SEQ ID NO: 143213 - protein, 62 aa, Glycine max
  Coding DNA Sequence Number=SeqID_51528
MTHTHDALLYYNERWNMPCQGDFVGYSFMEKNPKIFDIPSGCSIDGHKDVIKQVAPQGIPPN

SEQ ID NO: 143214 - protein, 170 aa, Glycine max
  Coding DNA Sequence Number=SeqID_51529
  Pfam annotation: Domain name=Transposase_23; Domain location=4-75; Score=3.4; E_value=0.0005; Accession=PF03017.5; Description =TNP1ENSPM transposase
NDPKTGDSDRYILYIKANLDRLVALGRVYEGSTVVHNTPLLPGQVKVGVEEVKDADALVPVPTDEVSLVGQTIHTFLAWPTHLVKSLSQQAVVSLAKPPQKSDSEVDDPLYLMTLTILELFLRPYPVTWDATVFRVFNPDFPLYIKHEDHFEIAHGGQCLSISVLQLWIL

SEQ ID NO: 143215 - protein, 88 aa, Glycine max
  Coding DNA Sequence Number=SeqID_51530
  Gene Ontology: Mol. function=hydrogen ion transporting ATP synthase activity, rotational mechanism; Cellular component=proton -transporting two-sector ATPase complex; Biological process=ATP synthesis coupled proton transport
  Homolog annotation: Hit_ID=Q9THV9; Match level="QueryCoverage=100%, HitCoverage=23%, E-value=1e-36, Identity=72%"; Hit description=Atp synthase beta subunit
VAMSATEGLMRGMEVIDTGAALSVPVGGATLGRIFNVLGEPIDNLGIKVVDLLAPYRRGGKIGLFGGAGVGKTVLIMELINNIAKAHG

SEQ ID NO: 143216 - protein, 130 aa, Glycine max
  Coding DNA Sequence Number=SeqID_51531
  Gene Ontology: Mol. function=catalytic activity; Biological process =cellular metabolic process
  Homolog annotation: Hit_ID=A7Q5D6; Match level="QueryCoverage=30%, HitCoverage=24%, E-value=4e-09, Identity=74%"; Hit description =Chromosome undetermined scaffold_53, whole genome shotgun sequence
VCHSLEGNAGALTNFEVLDFCRAKGASKDPTRVIAKVAQSEYKVRFDFSNKWEYFRSYVAYHERECDEDMTKSKGKDPLEGLGGPMTRARARKAKEALQQVLSILFEYKPKFQGEKSKVVSCIMVQMEED

SEQ ID NO: 143217 - protein, 105 aa, Glycine max
  Coding DNA Sequence Number=SeqID_51532
  Homolog annotation: Hit_ID=A5AZT3; Match level="QueryCoverage=98%, HitCoverage=16%, E-value=1e-14, Identity=39%"; Hit description =Putative uncharacterized protein
MGIEEDEEIPLILGRPFMMTTKCMVDIGNGNLELSVDDQKEDVEDLKKDSPPENPKLELKTLPTHLKYAFLEEKEVKPIVNSSDISSKEEAQLMEILRKHKEAIG

SEQ ID NO: 143218 - protein, 177 aa, Glycine max
  Coding DNA Sequence Number=SeqID_51533
  Gene Ontology: Mol. function=motor activity; Cellular component=cell projection
  Homolog annotation: Hit_ID=UPI00016621D1; Match level="QueryCoverage =92%, HitCoverage=40%, E-value=1e-13, Identity=31%"; Hit description =UPI00016621D1 related cluster
MLYLVFLNHCLDFRGLHVLALRGLHILTFRRLQVLSFKRLHTLAFRGLDVLTFRGVHVLDFRGLHVLALSRLHVLPLRGLHVLALKGLHVLAFRGLHILGFRGLHALAFRGLHVLAFRGLHVLAFKGLHILPYRGLHVLAFRGLHAHAFRGLHVHAFRGLHVLAIRGLHVLPFRGLH

SEQ ID NO: 143219 - protein, 122 aa, Glycine max
  Coding DNA Sequence Number=SeqID_51534
  Homolog annotation: Hit_ID=A5CB76; Match level="QueryCoverage=89%, HitCoverage=37%, E-value=4e-11, Identity=35%"; Hit description =Putative uncharacterized protein
  Pfam annotation: Domain name=zf-CCHC; Domain location=78-95; Score =12.6; E_value=0.019; Accession=PF00098.14; Description=Zinc knuckle
MVLILRSLHSDFDHVRDQILVGDQVPSMDSLITRLLCVPHALKDENVADIVETSAMIAPRGRGGRNNRGGRSGRGGRPQCIYCKRMGHTQENCYSLHGFPDKVTQVSKSDKSESRFSDEKYQ

SEQ ID NO: 143220 - protein, 58 aa, Glycine max
  Coding DNA Sequence Number=SeqID_51535
SGAFAYKEVLSSQGQEPRNHQSEKVRAVDGSAPVSTEAIASLAQYYDQPLRCFTFEDF

SEQ ID NO: 143221 - protein, 92 aa, Glycine max
  Coding DNA Sequence Number=SeqID_51536
MAAQLIHDRVEMECLEEAWETLEGNTRCRFRGTIRFTATSLVHPDEPARTLQRTVEWTAPWISFVYFLGWVYLGLTVRSRIVLGSGQMSGRV

SEQ ID NO: 143222 - protein, 307 aa, Glycine max
  Coding DNA Sequence Number=SeqID_51537
MLCYANSSILIVCKRFSEELAKRPYRAKRVHLLRMNTHPLAELPMASKKRMSIDSRPQDQNYNRRFQSEEAWNRYIDNILDRRILPERNVKLYHSEFDEFKVKLERRNLHKHLANLQEGSIDVAVVKEFYANFYSPANQAPKCARIRGHLIRIDADSLNEFLQTPVLLEEGKSLPTYSRFCRLRSDPKEMEASLCIPGKGFILNTEGQPWKLLRNDLTTLAQTWSVFSYSNLASTSRTSYLNTDRARLVYGLITRMDMNIGGLISGQMTMMAQSNSSRLGFPTLITTLCRSMWVGSDALTSYENLRP

SEQ ID NO: 143223 - protein, 415 aa, Glycine max
  Coding DNA Sequence Number=SeqID_51538
  Gene Ontology: Mol. function=4 iron, 4 sulfur cluster binding; Biological process=pyrroloquinoline quinone biosynthetic process
  Homolog annotation: Hit_ID=Q01060; Match level="QueryCoverage=66%, HitCoverage=73%, E-value=1e-151, Identity=94%"; Hit description =Coenzyme PQQ synthesis protein E
  Pfam annotation: Domain name=PqqD; Domain location=57-138; Score =136.9; E_value=5.6e-38; Accession=PF05402.3; Description=Coenzyme PQQ synthesis protein D (PqqD)
  Pfam annotation: Domain name=Radical_SAM; Domain location=123-283; Score=95.2; E_value=2e-25; Accession=PF04055.12; Description=Radical SAM superfamily
  Pfam module annotation: Pfam domain module=PqqD::Radical_SAM; Domain location=57-138::123-283
AHAGDPAVQAGHSVEHAGRHEHGLYPEPPALPQRDHRAGMAQPEAGVMTLNPEHTPVFRRGYRLQWEQVQNSHVILYPEGMAKLNDSAAAILQLVDGHTTLNGIIAQLNARFPGAEGLAEDVLEFFQRAYEQKWCPYCSNPLDFAAQEKELTTAQWIEVFRQARAMGSVQLGFSGGEPLVRKDLPELIAAARALGFYTNLITSGIGLTEKKLQTFADAGLDHIQISFQASDETLNAALAGSAKAFQQKLAMAKAVKALGYPMVLNFVLHRHNIGQIDRIIELAIQLDADDVELATCQFYGWAHLNREGLLPTREQIADAEAVVKRYRERMVTDGKLANLLFVTPDYYEERPKGCMGGWGAIFMSVTPEGMALPCHSARQLPIAFPSVLEHDLQHIWYHSFGFNRYRGYDWMPGAV

SEQ ID NO: 143224 - protein, 48 aa, Glycine max
  Coding DNA Sequence Number=SeqID_51539
  Subcellular localization annotation: CTP_CleavageSite=31; ConfidenceScore=5.09e-01
SIIVLGNGQMPGLIQRRRPVKVNGNMATVSRAMSFPAFRCLGTDASRS

SEQ ID NO: 143225 - protein, 163 aa, Glycine max
  Coding DNA Sequence Number=SeqID_51540
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=52%, HitCoverage=71%, E-value=1e-24, Identity=69%"; Hit description=LacZ protein
MWTTTAFEEVTETHGLRKNTSFRFPPHYGISRIAQTCFFLISDTSRDFIYYATSNSCSPGDPLVLERPPPRGSSNSPYSESYYNSLAVVLQRRDWENPGVTQLNRLAAHPPFASWRNSEEARTDRPSQQLRSLNGEWDAPCSGALSAAGVGGYAQRDRYTCQR

SEQ ID NO: 143226 - protein, 41 aa, Glycine max
  Coding DNA Sequence Number=SeqID_51541
MAQNSTAHHNAYFGKKTLEAVRGAAFAEMPRFLLKFCMLLV

SEQ ID NO: 143227 - protein, 139 aa, Glycine max
  Coding DNA Sequence Number=SeqID_51542
  Homolog annotation: Hit_ID=Q84VH5; Match level="QueryCoverage=54%, HitCoverage=11%, E-value=1e-23, Identity=77%"; Hit description =Envelope-like protein
MQSYIGLALQTGYPPIILPLLPQRESALSLHYKLFEGTHVPDIVSTSGKAAASGAVSKDALIAELKDTCKVLEATIKATTEKKMELERLIKRLSDSGIDDGEAAEEEEKAAEEEEDAAEEEEDAAEDTESDDDDSEATP

SEQ ID NO: 143228 - protein, 67 aa, Glycine max
  Coding DNA Sequence Number=SeqID_51543
MRKLIKERMENKVDNFVGLNKVVSGIKWMNEMGKTTRVKMKGRKESLFPARATHKGCESPLIQPRCS

SEQ ID NO: 143229 - protein, 68 aa, Glycine max
  Coding DNA Sequence Number=SeqID_51544
MGVQIATRPAWALQKIPPEGGCFWRKPPCSPGGRSEVEKGSALLVIQNHLKLVRKIGSVKKIQAEALP

SEQ ID NO: 143230 - protein, 273 aa, Glycine max
  Coding DNA Sequence Number=SeqID_51545
  Homolog annotation: Hit_ID=Q2R2K2; Match level="QueryCoverage=76%, HitCoverage=32%, E-value=1e-09, Identity=26%"; Hit description =Transposon protein, putative, CACTA, En/Spm sub-class
  Pfam annotation: Domain name=Transposase_23; Domain location=143-213; Score=9.4; E_value=0.00011; Accession=PF03017.5; Description =TNP1ENSPM transposase
QKLLAEKTKKKLQESAQSGSVDGIIDPPSPGSFVPHGRQDVLAAAIGRPEHPGRVRATGAGVTIMQYFGSAPRTSRNASSLPPDELQQLTQQIRDQLEESIIEKVTKQALAVPPEPLVGLGPSGPRVSTKGSCVDPSGNDPETSDFDRCGLYIEADPARLVAMGRVCEGSTLVHNTPLLSGQVKVSVDEVKDADAPVPVPTDEVSLVGQTLHTFLAWSTHLVKSLSQHVAVSPPNPPLKPDPEVDDLLYLMTLTIPELFLRLYQVRWDATVFG

SEQ ID NO: 143231 - protein, 238 aa, Glycine max
  Coding DNA Sequence Number=SeqID_51546
  Homolog annotation: Hit_ID=UPI00016621D1; Match level="QueryCoverage =75%, HitCoverage=40%, E-value=1e-19, Identity=36%"; Hit description =UPI00016621D1 related cluster
MTGPLDESISLFLIRVDPWVLVPIFFKGLHVLAIRGLQVLTFRGLQVLTFRGLHVLAFRGLHVLAIRRLHVLVIRGLHVLTFRGLHVLTFRGLPVLTFRGLHALTFRGSCIFTFRGLHVLTSRGLHVLAFRGLHILAFRGLHALAFRGLHVLTFRGLHVLAIRGLHVPTFRGLHVLAFKGLDALTFRGLPVLAFKGLHALIFKGATRPHLQRATRPHLQRATRPHLQRTRRSRLERTT

SEQ ID NO: 143232 - protein, 73 aa, Glycine max
  Coding DNA Sequence Number=SeqID_51547
MVIFHHGDAAEDKGEEVASLRSFLKKTSLRSFFEKTSLRSQSLATHTHLKTKLTSLRSFLEKLELSNTHPSKN

SEQ ID NO: 143233 - protein, 99 aa, Glycine max
  Coding DNA Sequence Number=SeqID_51548
GPSNWLAPIQFSATFRVSKNIIEVPLSYHRQWRPYYPTLRKYGSRYFFFDGLKQFRRTHGIDDSVIMRFFAADKNTSFEVDVIGPILRQGRPRSVLATR

SEQ ID NO: 143234 - protein, 75 aa, Glycine max
  Coding DNA Sequence Number=SeqID_51549
MRVHTITPTKLIQPPTNRSFIEKYCMPRQAQQLRQDQQQQSIADAPSPPLQQPPSLASISTHMQRMELYMQYLAD

SEQ ID NO: 143235 - protein, 124 aa, Glycine max
  Coding DNA Sequence Number=SeqID_51550
MIRGNPSDLQPFDPEIDRTFRRLVRHHFVPFEHPEHSVIGESEHSVVGNFEQPDFEHYSFEHSENMAQPPPRERTLREMAAPDFTYESLYIQYPDEDVPYVLKTGLIHLLPKFHGLASETHTNI

SEQ ID NO: 143236 - protein, 217 aa, Glycine max
  Coding DNA Sequence Number=SeqID_51551
  Pfam annotation: Domain name=Transposase_23; Domain location=51-121; Score=-10.7; E_value=0.018; Accession=PF03017.5; Description =TNP1ENSPM transposase
  Subcellular localization annotation: CTP_CleavageSite=34; ConfidenceScore=5.36e-01
MASFSQMQSQLQSQMQSQGLAVPPDPLVGPFGPRVSTKGSCVDPSGNDPETGDSDRCGLYIEADPARLVAMGRVYEGSTVVHNTYLLSGQVKVSVEEVTNADALVPVPTDEVSLVGQTLHTFLAWPTHLVAVSTPKPPLKPDPEALIRVRWDATVFGVVNPDFPLYIKHEDISEIAHGGNVSAYQCTVVDSVSISLKHVCERGILISMDSSKPQSIR

SEQ ID NO: 143237 - protein, 188 aa, Glycine max
  Coding DNA Sequence Number=SeqID_51552
MRLQLPLPAPVAKAKIWEARAGPHYAQSQNRQAFPPYGLPPNYTPPNVAYTPSENVNNSTPILIESGQPQTDHAHVSQPMGETHEMPHHNLVDFEPCLEYATEGQAIGGIPLQNPLEGPQYHPQLHLLHYTTSKNPHAMAEMGKLDHLEERLRAIEGGEDYAFANLGELFLVPNIITPPKFKVLDFDQ

SEQ ID NO: 143238 - protein, 42 aa, Glycine max
  Coding DNA Sequence Number=SeqID_51553
MADALATLASMFQLTPHGDLPYIEFWCRGKPSHCCRVEEEQD

SEQ ID NO: 143239 - protein, 68 aa, Glycine max
  Coding DNA Sequence Number=SeqID_51554
MMLSYNLRQGRWRLQFIGSGFKSINQTFSSTWVQGIIHSCTRKINENPVNNHLEQQWARHELVQACHG

SEQ ID NO: 143240 - protein, 130 aa, Glycine max
  Coding DNA Sequence Number=SeqID_51555
MKADTKALKEQMATLMEAMMSIKEIMEVNVAAIAATSTIAEHAFPSYGLPPNYTPPNVAYTLAEDTHEIPHHNLADFEPCLRYATEGQAVGGIPLQNTLEGPQFCPQPQPLHSTAGLGSLKEAEIMPLLK

SEQ ID NO: 143241 - protein, 69 aa, Glycine max
  Coding DNA Sequence Number=SeqID_51556
  Subcellular localization annotation: CTP_CleavageSite=43; ConfidenceScore=5.19e-01
MGVQIAIRPTWAFQILPPEGCCFWRKQPGSPGKSKPRRFRNVSVSNYAKILDRSSTFIVRSSFSSIFNG

SEQ ID NO: 143242 - protein, 148 aa, Glycine max
  Coding DNA Sequence Number=SeqID_51557
  Subcellular localization annotation: CTP_CleavageSite=35; ConfidenceScore=5.15e-01
MDMNIGGLISGQITMMAQSNSSRLGFPALITTLCRSRGVGSDALTSYESLRPIINLAYITRNCWNVNDQSINFLGARKTKLRAADVPSSSAPIVCIPSSSTPAPPPGSVDPSAQSSQTLDARLQSLFKGQILIMRSLQELAQQRPIMS

SEQ ID NO: 143243 - protein, 97 aa, Glycine max
  Coding DNA Sequence Number=SeqID_51558
MTKARQKGVRKENGGEACHPARPGELGCFLQKQPPSGGIFWKAKVGLGMSRNFTDCATMPCFDFWHVTKLHESPNDGCQVPRRGQTRVASQQRMIPG

SEQ ID NO: 143244 - protein, 162 aa, Glycine max
  Coding DNA Sequence Number=SeqID_51559
MWLLPSVHSVLHFVELLSKEHNCISQTFISIQVILIFFSFIIGHETDSCSSFQPYPRVLAQSDFHVKSLRQGSEDLSHQLFICYPLSQGSASIGNFKNVHVEVMNTLFLLHLQIFEFCSQELQSGNLHFGGSFMSDFQDLPCIFGHCASVDQSEDVLVNSIE

SEQ ID NO: 143245 - protein, 66 aa, Glycine max
  Coding DNA Sequence Number=SeqID_51560
MDEDQWMYDSIMSEEVDIDYQNEEECGVNEPHVDCSDAFNNSQVFDCRDDVLQWARSVAHETDLWQ

SEQ ID NO: 143246 - protein, 82 aa, Glycine max
  Coding DNA Sequence Number=SeqID_51561
MNSLSEHVALREFIHTHCMQAVSEELAKCIYCIKRVQLLRMNTHPLPELLVAKQELVPLSVAFKELSANPCGTCSTQWALSC

SEQ ID NO: 143247 - protein, 162 aa, Glycine max
  Coding DNA Sequence Number=SeqID_51562
MSVLELYIEKDVAGGFMFHSANFVASFGNNLSNNEREAPRNVSNLHGDEEDDDDDDDYLVSNSYIEESLDEDDSVDGISDTDNEVIDMIQPVRIVHPTEGVEGIQNPFWNDALHYNNINPDGEDICGLEMPSNFNVGQELYVGMNFDSKDAVKNALKQYVMK

SEQ ID NO: 143248 - protein, 59 aa, Glycine max
  Coding DNA Sequence Number=SeqID_51563
MAEKGKLDHIEEMLKDIEGGEDYAFANLEELFLVPERGHSQLLPGTLTWNLPESILGRT

SEQ ID NO: 143249 - protein, 100 aa, Glycine max
  Coding DNA Sequence Number=SeqID_51564
MWYHINEKPRRAPRGRLVKVTVFCENAPTIWDQHRLKGALKSCNPQGLHSEESVRASPSLFRDLTLTRRPKRDLASTRRPKMDLASTRRRKRDLALTRRP

SEQ ID NO: 143250 - protein, 75 aa, Glycine max
  Coding DNA Sequence Number=SeqID_51565
MRIVEIGNARFIENGEINGSIVPRNVESKKVRVKVPLTCASDSKVSVPLDVVPNNNKEEKHDNEPMIQNEPIVEE

SEQ ID NO: 143251 - protein, 228 aa, Glycine max
  Coding DNA Sequence Number=SeqID_51566
  Gene Ontology: Mol. function=helicase activity; Biological process =viral genome replication
  Homolog annotation: Hit_ID=Q2A9E0; Match level="QueryCoverage=99%, HitCoverage=15%, E-value=4e-51, Identity=46%"; Hit description =Putative uncharacterized protein
MFAFTSPGIKFDKSYNTGKGPPTFRIHVQTHHLIGSLIPMPNNPPKFAQLYIYDTDNEIINIISQNPLVFILMSHMMHDMLDEQIIIAIKDMLDHHNHYAQRFRMARDKLHSTAVPDLKMKLISQRQTDGRLYNLPTTTKVVALIVGDEHSADKRDIIIEKQSGLLKRIHELHPAYLPLQHPLLYPKGEDGYRLNTPQERVTLHEYFCYRLQSRTNEAQTILHSRRLF

SEQ ID NO: 143252 - protein, 92 aa, Glycine max
  Coding DNA Sequence Number=SeqID_51567
  Subcellular localization annotation: CTP_CleavageSite=20; ConfidenceScore=5.17e-01
KRKSAQYANRLSPRVGRFINAAGTTADNNFTQETAMTMITNSSSVPSRGGHPVWFLIFSDQNFLSIYGGGLERLPDDGLEVLDLFGAGQLGE

SEQ ID NO: 143253 - protein, 84 aa, Glycine max
  Coding DNA Sequence Number=SeqID_51568
MKFPKKPDSGGRPLRIRDIGLKREPNKDLSCIILHNLECYQFRYFRSNRKKSNDWSGRVRVEKRIPHFFLSFKTVHETFISHGS

SEQ ID NO: 143254 - protein, 116 aa, Glycine max
  Coding DNA Sequence Number=SeqID_51569
  Subcellular localization annotation: CTP_CleavageSite=34; ConfidenceScore=5.19e-01
MASFSQMQSQFQSQMQSQGLALPPEPLVGPSGPKVSTNGSCVDPSGNDPETGDLDWCGLYIEENPALSVALGRVYVGSTVVHNTPLLPGQVKVGVEEVKNPDALVPIPTNEVSLVG

SEQ ID NO: 143255 - protein, 171 aa, Glycine max
  Coding DNA Sequence Number=SeqID_51570
  Homolog annotation: Hit_ID=Q5QJQ3; Match level="QueryCoverage=18%, HitCoverage=24%, E-value=3e-11, Identity=100%"; Hit description =Putative uncharacterized protein
DAGSRQARQGASAGVGGCRGWLNYAASEQIVLRVHHMRAIGAGLFAITPAGERGMCCKAIKLGNARVFPVTTLMIVKEWRPMFRMLIHPLNGQWNRDPWFKDDDCDSDAVCVLGALPLPRSLTRCARSFGCGERYQLTQRRSFAPSWAVCTNPPFSPTAAPYPVTIVLSPT

SEQ ID NO: 143256 - protein, 246 aa, Glycine max
  Coding DNA Sequence Number=SeqID_51571
MDSTSSPLDGYMSSPSEDCTSLPLEDCMSSPSEGCTPSPSKDYTSSPSEGYTSSVSEGSTFAPSEDLRITPTRHPVDPEKSNRALGFPAPIMGLCQSYRVPVPPARSLHHDIRIAPTRHPVDPEKSNRVLGFLALITGLFQFYRVHAAPIKVIRPSINRAFIKKYCAPQASTGGDTTAAWGWPATDNRRTTATSRAPQLIYKGWSVAYDPWPTSRQPSPKPKVSKSTRSVTDKSSRVQLKTLKKRY

SEQ ID NO: 143257 - protein, 57 aa, Glycine max
  Coding DNA Sequence Number=SeqID_51572
  Subcellular localization annotation: CTP_CleavageSite=19; ConfidenceScore=5.15e-01
MGVQIAPRPTWALQKIPPKAEALPKRFRNVFREEFCKGFNRSSTFFIRSSSFFDLQR

SEQ ID NO: 143258 - protein, 179 aa, Glycine max
  Coding DNA Sequence Number=SeqID_51573
  Homolog annotation: Hit_ID=Q6WAY6; Match level="QueryCoverage=59%, HitCoverage=19%, E-value=3e-14, Identity=40%"; Hit description =Putative uncharacterized protein
MHREKRCKLGPTLSKTEGVSINWFPRWKEGKVGVLISCGGFPNVPLTGTRGCISYNLVLAIRQLGYPMRGAPLEEELAPVISRGFNKTNMETLQKVRKAWEVVREKDKELRGGNNGPIGGYRKWLRAHVQGLDWLPSLRNAKREEVEAPEEDEEVQALRTKLEQAQTVKERFKSTALKI

SEQ ID NO: 143259 - protein, 260 aa, Glycine max
  Coding DNA Sequence Number=SeqID_51574
  Homolog annotation: Hit_ID=A7R136; Match level="QueryCoverage=99%, HitCoverage=59%, E-value=2e-34, Identity=62%"; Hit description =Chromosome undetermined scaffold_336, whole genome shotgun sequence
GKEDPVKEIFPEVSQWVSGASDYTIGNASASDYVDLESTETWLADYFNDAVMDFSPEELNFSVADGVQIDDGTEVSAITPSHEQNVVQQTHVPRTTCNIIFKGQCGLAQVVKDPELILILSMDVHLISSNATEILLGWITIITLSTQGLAESLGLDKTIYGLDLSNNHLGRKSFIHMPTKLASSVAYPFAFIKPSGAHGDVTLKEINQRIQTPSPSKSNQSIDDDPSAYPKSAFSGKPVVGKTKIRTEGGKGSITITRTK

SEQ ID NO: 143260 - protein, 200 aa, Glycine max
  Coding DNA Sequence Number=SeqID_51575
  Gene Ontology: Mol. function=RNA-directed DNA polymerase activity; Biological process=regulation of transcription, DNA-dependent
  Homolog annotation: Hit_ID=A5C0V2; Match level="QueryCoverage=96%, HitCoverage=17%, E-value=1e-18, Identity=34%"; Hit description =Putative uncharacterized protein
MGRNILDSLFLNIHFHGLDMKEGSIPAALIYRIQYKVMNTCASRVLLQPQKGETTLFITDMTKANVSLKRIIKWDEVTLPEKWVMEKATPSDPRPAPIIEDIKQDNSEKVEITFNRRNSFSSRIEASRFEYESARRSFSVRTRSIPVGLARSELHNQFPTINLQGIDTTSSIPRTTYNQDQEDDQKSIQSPTYSSMEPYD

SEQ ID NO: 143261 - protein, 129 aa, Glycine max
  Coding DNA Sequence Number=SeqID_51576
  Homolog annotation: Hit_ID=A5AEB7; Match level="QueryCoverage=100%, HitCoverage=10%, E-value=5e-30, Identity=55%"; Hit description =Putative uncharacterized protein
DIAFEKDHYEAQPSSSSDRLSVIHTPQVQTSVRQPMIENPQIIGNNYTDQVIDEEYQDNVEQPVEQQVPQESDEVTLRRSTKVKRLAIPSDYVVYLQESDYNIGATNDPKMFSQAMSSKESNLWHNAIK

SEQ ID NO: 143262 - protein, 205 aa, Glycine max
  Coding DNA Sequence Number=SeqID_51577
MYVIVSLGTLLNIKDKTKDGLNTYQDIAEMGIRASLHPRYDASDIRTKKKILHTVREGWRQFKFDLTSKWTLAVEKDSVNDTGVRKKAQIFQKPDTAPRMMSRGGYEYLEKKLIDEKRKKKLEEAAQSRSIDTAIDPPSSIKQHVKWKLARTKKTGHMTSEAAKEIADKIDAFEEQASQGSFVTQLEDSFTEKVTRQLMLCFSQM

SEQ ID NO: 143263 - protein, 151 aa, Glycine max
  Coding DNA Sequence Number=SeqID_51578
GPGLPGINRDTRIYLFCEVIFLTVASVSSAVPPVQLLTGWCVTAKAPPDYQRWQAAQLLGRAIGAGLFAITPAGERGMCCKAIKLGNARVFPVTTLANWSSTAVAAALELVDPPELRNFDAFDFGAMRSDCLVQFSILKLFRSPMNCIFDS

SEQ ID NO: 143264 - protein, 124 aa, Glycine max
  Coding DNA Sequence Number=SeqID_51579
  Homolog annotation: Hit_ID=Q6WAY6; Match level="QueryCoverage=57%, HitCoverage=12%, E-value=1e-09, Identity=43%"; Hit description =Putative uncharacterized protein
MALKDGPRRKIHGQSIWLGQGAAHDRLVSSVEGIVEGRSSFLVWGYPNVPLIGTRGCINYNPALAIRQLGYPMRGAPTEESLSPFLVRDLGAQGLKVIQRIHMAWRSPLRKDKSLEASEMASSE

SEQ ID NO: 143265 - protein, 79 aa, Glycine max
  Coding DNA Sequence Number=SeqID_51580
MVEKESDKLWIWCLAPIIRQFVKFQDKPENQKILMHNPKVKSKYFRNASVSDSVEILHRSSSFFTVLHPFFVRSSFFNG

SEQ ID NO: 143266 - protein, 98 aa, Glycine max
  Coding DNA Sequence Number=SeqID_51581
MGLCQFYGVPVAPSKIIRSPTNQAFIKKYCVPKQAQGETPQQPRDGRQRATNVPPSPLEFTSAHPQKVTKSKAKGKQSTRSVIDKPSCVQLKTLKKRY

SEQ ID NO: 143267 - protein, 41 aa, Glycine max
  Coding DNA Sequence Number=SeqID_51582
MAGRKIRGEGFRERDAGTRCNRLRKYGNRLPESNIARNNYL

SEQ ID NO: 143268 - protein, 104 aa, Glycine max
  Coding DNA Sequence Number=SeqID_51583
PALASGMLRNFTDCTIMLPFDSWHVAELHGLPNDGCQVPQSGHAKVASHQTDGPRTKLGQQKRADDHDLSPRAIRPDCLWIVQKGRGTIRFPRMSSDPPSLDDK

SEQ ID NO: 143269 - protein, 125 aa, Glycine max
  Coding DNA Sequence Number=SeqID_51584
MERSMIDAASGGALGDMTPAEARNLIEKMASNSQQFSTRNDAIVLRGVHEVATDSSSSAENKKLEGKLDALVNLNNYDLSSSRYNPSWMNHPNLRWASPLQQQQPAPPFQNAAGPSKPYVPPPMQ

SEQ ID NO: 143270 - protein, 151 aa, Glycine max
  Coding DNA Sequence Number=SeqID_51585
RTTPPSPSEDYVLLPFRGLHALAIRELHILAFRGLHVLTLEDNTSSPSEATHPPLEDYTSSPLEDHTVLPKGLHTLTFRGLHVLVFRGLHVPLFRELHALPFRGLHALPIRRGYPPSPFRRTTSSSLSEGYTLPFRGIHVLTIRGLHVLSL

SEQ ID NO: 143271 - protein, 289 aa, Glycine max
  Coding DNA Sequence Number=SeqID_51586
IALRSRGPAAGDRHSHAERADPGHRASPQHAPVRPQPARSAVDLRRRGVPGGSPRCAAPIRTGRTLGRRAGRGEIGKIEIGYVGSALYAGERMADGRAPAAAAGRPGGCGVLPASDGCTRQFRRTHPGRRPVLRGPAGNPSAGAGPRAGTAGVIGPGKLRHAGAAGGRNGSRAPRRVHSTYPFPARASGGGVGRGVGRRWFGGDRAIGTATHAGAARNDLSATGRPHHRLDHRCAVPAGGDLACGATADRAGEGDAVQAHRHVAPGLSAARQVDDCYTCATCIRIRWTS

SEQ ID NO: 143272 - protein, 66 aa, Glycine max
  Coding DNA Sequence Number=SeqID_51587
MGRDLKKVPQHLNAISVIDPKSHEERRTKKAYIAWDDNDSSEGFEKEEINLLTKDYESEEDITQRD

SEQ ID NO: 143273 - protein, 116 aa, Glycine max
  Coding DNA Sequence Number=SeqID_51588
MEEAVQSRSTEVVIDPLSPIRRHVKWKMARTKKTRQMMFESTKEIAMKIDLLTAAIGRPEHLGCVRAAGAGVTIKQYFGSAPRTSHTSSSMTPEELEQLTQQIRDQLEESITEKVT

SEQ ID NO: 143274 - protein, 71 aa, Glycine max
  Coding DNA Sequence Number=SeqID_51589
  Subcellular localization annotation: CTP_CleavageSite=62; ConfidenceScore=5.31e-01
MGVQIAPRPTKALQNTPPEGCCFWRKQPSSPGRAEALPKRFRNVFREEFRKGFNRSSTFFIRSSSFFDLQR

SEQ ID NO: 143275 - protein, 164 aa, Glycine max
  Coding DNA Sequence Number=SeqID_51590
  Homolog annotation: Hit_ID=Q51617; Match level="QueryCoverage=21%, HitCoverage=50%, E-value=5e-11, Identity=91%"; Hit description =Putative uncharacterized protein
MTVKTSDTCSSRRRSQLVCKRMPGADKPVRARQRMRKEKIPHQAPFAIQAAQLLGRAIGPGLFAITPAGERGMCCKAIKLGNARVFPVTTFRETCRASCINESANARGEAVCVLGALPLPRSLTRCARSFGCGERYQLTQRRSFAPSWAVCTNPPFSPTVAPYP

SEQ ID NO: 143276 - protein, 97 aa, Glycine max
  Coding DNA Sequence Number=SeqID_51591
MTTMMETMMSMRQLMEVNMATVVAASTTTEVDPTHPSGLNQVNRPVSDMSKHSFPPYSLPPNHTPSNVAHVPDVNVDNFTTIPIESQQPQSSHAQVP

SEQ ID NO: 143277 - protein, 57 aa, Glycine max
  Coding DNA Sequence Number=SeqID_51592
MVLSSQGQGSRCHQPQGIGTIDGTSLKARINETLGLIRILVVDLKRANKAALTVVHF

SEQ ID NO: 143278 - protein, 62 aa, Glycine max
  Coding DNA Sequence Number=SeqID_51593
MSARVQPIAFLCFLRTDNNFSSCSSARETNIITGKLLLSSKLQFWCGRLDSGGRRWFSACTS

SEQ ID NO: 143279 - protein, 62 aa, Glycine max
  Coding DNA Sequence Number=SeqID_51594
MATSLVHPDEPARTLQRTVEWTAPWISFEFDDCTLVAEATTMDTFALDDTMYFVKLPYFGQL

SEQ ID NO: 143280 - protein, 190 aa, Glycine max
  Coding DNA Sequence Number=SeqID_51595
  Gene Ontology: Mol. function=hydrogen ion transporting ATP synthase activity, rotational mechanism; Cellular component=proton -transporting two-sector ATPase complex; Biological process=ATP synthesis coupled proton transport
  Homolog annotation: Hit_ID=Q6I8E6; Match level="QueryCoverage=54%, HitCoverage=31%, E-value=2e-50, Identity=100%"; Hit description =Pseudo-atpA
  Pfam annotation: Domain name=ATP-synt_ab_N; Domain location=84-152; Score=90.2; E_value=6.3e-24; Accession=PF02874.14; Description=ATP synthase alphabeta family, beta-barrel domain
  Pfam annotation: Domain name=Complex1_49kDa; Domain location=1-87; Score=-135.4; E_value=0.0018; Accession=PF00346.10; Description =Respiratory-chain NADH dehydrogenase,
  Pfam annotation: Domain name=HAS-barrel; Domain location=84-150; Score=46.4; E_value=9.7e-11; Accession=PF09378.1; Description=HAS barrel domain
  Pfam module annotation: Pfam domain module=ATP-synt_ab_N::Complex1 _49kDa::HAS-barrel; Domain location=84-152::1-87::84-150
MTTGSSVYSTSIHHFELYTEGFSVPAPSTYTAVEAPKGEFGVFLVSNGSNRPYRRKIRAPGSAHSQGLDSMSKHHMPADVVTIIVDEIGRVVSVGDGIARVYGLNEIQAGEMVEFASGVKGIALNLENENVGIVVFGSDTAIKEGDLVKRTGSIVDVPAGKAMLGRVVDALGVPIDGRGALSDHERRLSK

SEQ ID NO: 143281 - protein, 91 aa, Glycine max
  Coding DNA Sequence Number=SeqID_51596
MSKETNEEEAIHSVSFDLEGSSFATRKNIRPSKSGEKEWMISSMKEVVESLKEFVEVTKKKMENKKKDGDKRSSRNEKMCLCKKDVKEFLC

SEQ ID NO: 143282 - protein, 444 aa, Glycine max
  Coding DNA Sequence Number=SeqID_51597
  Gene Ontology: Mol. function=glycine dehydrogenase (decarboxylating) activity; Cellular component=mitochondrion; Biological process =glycine decarboxylation via glycine cleavage system
  Homolog annotation: Hit_ID=Q6D974; Match level="QueryCoverage=44%, HitCoverage=20%, E-value=4e-97, Identity=87%"; Hit description =Glycine dehydrogenase [decarboxylating]
  Pfam annotation: Domain name=Epimerase; Domain location=201-435; Score=-36.3; E_value=0.00018; Accession=PF01370.12; Description=NAD dependent epimerasedehydratase family
  Pfam annotation: Domain name=KR; Domain location=202-389; Score= -18.3; E_value=2.8e-06; Accession=PF08659.1; Description=KR domain
  Pfam annotation: Domain name=adh_short; Domain location=199-372; Score=111.7; E_value=2.3e-30; Accession=PF00106.16; Description =short chain dehydrogenase
  Pfam module annotation: Pfam domain module=Epimerase::KR::adh_short; Domain location=201-435::202-389::199-372
GAVLRAPFGSASILPISWMYIRMMGAEGLKQASSVAILNANYIASRLQSAYPILYAGRDGRVAHECILDIRPLKEQTGISELDIAKRLIDYGFHAPTMSFPVAGTLMVEPTESESKIELDRFIDAMLAIRMEIDRVADGEWPADDNPLVNAPHTQMEIVGDWTHPYSRELAVFPAGSANKYWPTVKRLDDVFGDRNHMNLALVTGGSRGIGRATSLLLAQAGYRVAINFRQREAEALQVVADIEAQGGNAFALQADIADEAQVVRMFRQLDQQPGALRVLVNNAGILFSQCRVEDLDAARIQRVLATNVTGTFICCREAVKRMSTAHGGQGGAIVNVSSAAARTGSPNEYVDYAASKGAMDTLTRGLSLEVAAQGIRVNSVRPGLIYTDMHADGGEPGRVDRLAASLPMQRGGQAEEIAAAIVWLASDAASYVTGSFIDASGGR

SEQ ID NO: 143283 - protein, 359 aa, Glycine max
  Coding DNA Sequence Number=SeqID_51598
  Gene Ontology: Mol. function=fructose-bisphosphate aldolase activity; Cellular component=cytosol; Biological process=metabolic process
  Homolog annotation: Hit_ID=A4WE70; Match level="QueryCoverage=100%, HitCoverage=92%, E-value=1e-161, Identity=78%"; Hit description =Fructose-bisphosphate aldolase
  Pfam annotation: Domain name=F_bP_aldolase; Domain location=14-359; Score=688.5; E_value=5e-204; Accession=PF01116.11; Description =Fructose-bisphosphate aldolase class-II
MSKIFDFVKPGVVTGDDVQKIFQVAKENKFALPAVNCVGTDSINAVLEAAAKVKAPVIVQFSNGGAAFIAGKGFKTDKPQGAAIFGAIAGAHHVHLMAEQYGVPVILHTDHCAKKLLPWIDGLLDAGEEHFKKTGKPLFSSHMIDLSEESLEENIEISSKYLARMAKLDMTLEIELGCTGGEEDGVDNSHMDASALYTQPEDVDYAYTELSKISPRFTIAASFGNVHGVYKPGNVKLTPTILRDSQKYVSEKHGLPHNALDFVFHGGSGSSAAEIEESISYGVIKMNIDTDTQWATWDGILQYYKTNEAYLQGQLGNPNGADSPNKKYYDPRVWLRAAQSSMVVRLEQAFKELNAVDVL

SEQ ID NO: 143284 - protein, 234 aa, Glycine max
  Coding DNA Sequence Number=SeqID_51599
  Gene Ontology: Mol. function=metalloendopeptidase activity; Cellular component=membrane; Biological process=proteolysis
  Homolog annotation: Hit_ID=A4WE74; Match level="QueryCoverage=99%, HitCoverage=97%, E-value=2e-91, Identity=69%"; Hit description =Peptidase M48, Ste24p precursor
  Pfam annotation: Domain name=Peptidase_M48; Domain location=71-230; Score=92.1; E_value=1.7e-24; Accession=PF01435.9; Description =Peptidase family M48
MVVALGMVSLLSGCEGMDNNALLQSGAQAFQAYSLNDAQVKELSDQSCAQMDKENQLAPANSSYQQRLNKIAAALGDNINGVPANYKVYLTKDVNAWAMANGCIRVYSGLMDMMSDNEVEGVLGHEMGHVALGHTRKAMQVAFATTAARNAAASLGEMGEKLVNAQFSQTQESQADDYSYDLLKKRGINPLGLATSFEKLAKLDQGRQSSMFDSHPDSESRAQHIRDRIAADGK

SEQ ID NO: 143285 - protein, 758 aa, Glycine max
  Coding DNA Sequence Number=SeqID_51600
TIADGHDAVGFRRAAQAWRAVIGDATRRNRHRRAAVVVHRCQPGDGHRRRGVDHQRGAGGGTDVTGRIGDRDVERMERFAQRRGWRQRPVTVTAHQRGTDQRGAIQYGDDAARLRPAAQHRRGIAGDAAIRDDAAADVAGDHQRGRARRNGIDGDSHRRGARAGIARRIGDRHAQRMRAVTQRRRDKAPRAAAVHERRAQQRIAVINANRGIGLGAAAQRWRGIVSRAASRYADAGNIVSDGQVGGHQRWRRINDQRHAERLAVPQRCNSSYHCCRPSARPPHRHRGECGIAVSNRHRRAAVVVAGRQRQIVRRQGINDHRRAGAGADVARRISHRNAQGVRSFTQRCRWRVAPVAAGRHGQRGQHITIVEDGDRAARFRYAAQGWRGIAAVAAVEHRLCGIIVGDDQRRSVRCDAVHSEAKRRGAVAAVTCCIADAHAQRVRPFAQCRRGQRPASPCAHHHRRDSGVAIVHRDQAARIGSAAEYRRVVIDDAAVANRHRRAAAIVADHHISGHRRRGGIHGEAEGSRWRPLITARVLRGDVVGVAAFSQRRRIAPLAVSIRRNAGRAAKRWRGVTGYRAVCQRHQRRARVVSDLQRRGSWRQIGLHVKAERRRRRADVARRIGDGHGEAVRSVVERRGRKAPGPARAGQRSAQQRGAIVDAHRAAGFCRAAQSWRVVIGRRAVIQRARRAAHVIGDHQVRNRVWHQRIDGDIHRPNRLADVASGIHHLHRESVAAILQRAGFKAPYAIGIGDHRANH

SEQ ID NO: 143286 - protein, 81 aa, Glycine max
  Coding DNA Sequence Number=SeqID_51601
MGVKYLEAVKKRLQAIKQWSPDEIRWNLSFRKKRKGIRSVNKLQCLGSDKVEKPRHFPTPLHSIIPAQQRRISRVAGLECF

SEQ ID NO: 143287 - protein, 225 aa, Glycine max
  Coding DNA Sequence Number=SeqID_51602
MRSWVRGQWIPFDAEAIGQLLGYPLVLEEGQECEYGQRRNRSDGFDEEAIAQLLCIPGQDFSRTAAGRRVRIMRTNMTTLTQIWMTLLLSNILPGDHNSDLPLPKCQLVYAILTRMSVHVAQLIADAIYIFAGMAPTRHPLDPDKSNRALGFPALITGLCQSFGVPVAPTKRQAQGDAPQAAGAPPPPHQAGQAGAFDMEQYLRHLVRQQAANHRAHEIICKVKS

SEQ ID NO: 143288 - protein, 58 aa, Glycine max
  Coding DNA Sequence Number=SeqID_51603
MCTVKKVIWTFQPPVTKDVTNIQRMRDDMMQMRKSATGGCTQHGNILNNHTAKAYMTF

SEQ ID NO: 143289 - protein, 83 aa, Glycine max
  Coding DNA Sequence Number=SeqID_51604
PLGPSGIFLQKPVASGGSNPARLGELGGNLLPYFAINRGGRQEGRAEALPKRFRNVFREEFHKDFNRSSTFFIRSSSFFDLQR

SEQ ID NO: 143290 - protein, 120 aa, Glycine max
  Coding DNA Sequence Number=SeqID_51605
MVYPADGLSSVSDVLVVVGEYLSGVQVSCPCPSISGASAHWPFESGDVVACTDSHRDWVGLQCTACVAYAKRTSKGLRRKPRSRIRLFGYKIEKNALDGCPGIEKEGRFQRRKAMGRYRL

SEQ ID NO: 143291 - protein, 499 aa, Glycine max
  Coding DNA Sequence Number=SeqID_51606
  Gene Ontology: Mol. function=nucleoside-triphosphatase activity; Cellular component=chloroplast; Biological process=cell division
  Homolog annotation: Hit_ID=Q2PMM5; Match level="QueryCoverage=100%, HitCoverage=21%, E-value=0.0, Identity=87%"; Hit description=Protein ycf2
  Pfam annotation: Domain name=AAA; Domain location=247-474; Score =22.5; E_value=1.9e-07; Accession=PF00004.20; Description=ATPase family associated with various cellular activities (AAA)
MIELRKLLDRYPTSELNSFWLKNLFLVALEQLGDSLEEIRSFAFGGNMLWGGGPTYGVKSIRSKKKYLNLIDLISIIPNPINRIAFSRNTRHLSHPSKTIYSLIRKIKNVNGDWIDDKIESWVLNSNSIDDKEREFLVQFSTLTTEKRIDQILLSLTHSHHLSKNNSGYQMIEQPGAIYLRYLVDIHKKYLMIYEFNTSCLAERRIFLANYQTITYSQTLRGANSFHFPSHGKPFSLRLALPPPSRGILVIGSIGTGRSYLVKYLATNSYVPFITVFLNKFLDNKPKGFLIDDSDDIDDSYDSDDIDRDLDMELELLTMMNTLTMDMMPEIDRFYITFQFELAKAMSPCIIWIPNIHDLDVNESNYLSLGLLVNYLSRDCERCSTRNILVIASTHIPQKVDPALIAPNKLNTCIKIRRLLISQQRKHFFTLSYTRGFHLEKKMSHTNGFGSTTMGSNVRDLVALTNEALSISIIQKKSIIDTNIIRSVLHRQTWDFRSQ

SEQ ID NO: 143292 - protein, 156 aa, Glycine max
  Coding DNA Sequence Number=SeqID_51607
  Subcellular localization annotation: CTP_CleavageSite=31; ConfidenceScore=5.53e-01
IMASPPASPPPPPPPPSDASASPSAMKRTCKASHLQSLSTRPPGADTPVVHVDPTTGKADGPHRKKLRTYLGIVARDKVDITYENWKEVPTAQKDLIWEDIQTVGKRWKQFKSDLKRKWALAVDRDGVDDTICEKYGISKEKWAQFCQTRRDPSWE

SEQ ID NO: 143293 - protein, 96 aa, Glycine max
  Coding DNA Sequence Number=SeqID_51608
MDPLFTMTVVFPFKLPLQFPFEYLTAIMTPTHDALLYYNGRWNMSRQNEFVGYSFTGKNPKKFDILTGCTMDELKDLIKQVAPRGIPLMVLMKHKW

SEQ ID NO: 143294 - protein, 158 aa, Glycine max
  Coding DNA Sequence Number=SeqID_51609
GQDHLGLPFGVKTKHERQKPVKVLKDERKRGWGHDRPIVTLLCAKQAGNEAMMSVKKIMEANAVAIAATSVVAKVNLMFPSGINQMNHPTSDMVGKDLGSTGSPHNVQIQNEHAFPPYGLPLNYTPPNVAYTPNKNVNNSTPIPIESQQRQTDHAHVS

SEQ ID NO: 143295 - protein, 85 aa, Glycine max
  Coding DNA Sequence Number=SeqID_51610
MAASKPTSWLSSFDHFLFHFPGVGKAKWGHPSPLSALPRAIDIMRSTEIDFAENQLYPILVGLSPLATSHPRILPHTWVRSSKVC

SEQ ID NO: 143296 - protein, 76 aa, Glycine max
  Coding DNA Sequence Number=SeqID_51611
MYAPLELIHKRCTLESLLRKGKKQKIYQAVSPLKSFVKREKGESKEFSGEFPLAEKQSFETKFRKLLGKEKTMGNG

SEQ ID NO: 143297 - protein, 167 aa, Glycine max
  Coding DNA Sequence Number=SeqID_51612
  Gene Ontology: Mol. function=phosphoprotein phosphatase activity; Biological process=intracellular signaling cascade
  Homolog annotation: Hit_ID=A7R8Y3; Match level="QueryCoverage=70%, HitCoverage=34%, E-value=2e-21, Identity=45%"; Hit description =Chromosome undetermined scaffold_3090, whole genome shotgun sequence
MSALPPICLIGSVAWCTVVPLICFHIVEWHQPDRVLRQFGMQQPIPECPSQPLNIHGLTLKGKHDENWFQLLASMISQWNNRAEFRVDVYPRQEGLLSFNFDYMVWRNTWTVDDLVPYVEKLTILSEKQERITEPVAHGPASEHQSPRQEFHMLQSSVETRGFDKRR

SEQ ID NO: 143298 - protein, 118 aa, Glycine max
  Coding DNA Sequence Number=SeqID_51613
PHQLDLAPYASEPYNAQWNAPGLLRDKHTLRSSRILREMEVDEPWLGLSRCKIHFLVGMAFVDIWAVGKEKVCYWLSNDIVGLVGNLAVLEWQSQHGLLLHPHPLHLPQFSHSSKQDD

SEQ ID NO: 143299 - protein, 127 aa, Glycine max
  Coding DNA Sequence Number=SeqID_51614
MARTRGLGRAIGRVVGRDRAADEDAGDVPERRRPTASARRLRVHQMTTEGRDMAEDVADMTDDVPEQPTEAPEMRADAQGADSGEGSDGDDAAEGFPGGPRDPSVLTSFAEHVAHAVWSGQERPDLN

SEQ ID NO: 143300 - protein, 15 aa, Glycine max
  Coding DNA Sequence Number=SeqID_51615
NYTRPYKQIHERGIL

SEQ ID NO: 143301 - protein, 66 aa, Glycine max
  Coding DNA Sequence Number=SeqID_51616
MIIEESTHVAFDETNLILPRKDALDDISYSLEGMHIHGEEHEGKGKGNNEDFQIDETKISADLPRE

SEQ ID NO: 143302 - protein, 134 aa, Glycine max
  Coding DNA Sequence Number=SeqID_51617
MSEIKEVKEQMKADIEAMKEQMATMMEAILSMKKIMESNVATVIAASTATEGDPTHSSGLNQVNPLVSDMVGQGEEALANTSDPHVVQSKNSFLLYGLPPSYTPPDVAQSLDENVNNSTPILIESQQPQSDHAH

SEQ ID NO: 143303 - protein, 78 aa, Glycine max
  Coding DNA Sequence Number=SeqID_51618
MENEQFPIEQTWRSTQEHRSLEQTTDELYSHSSETSPHQSDFAPYVSGSYNAQWNALEIPHDKHMLHSSCILGKMEVE

SEQ ID NO: 143304 - protein, 155 aa, Glycine max
  Coding DNA Sequence Number=SeqID_51619
MMREIRFMEDDETKQRGGIIVKPEWRMKVRWRGKLILELNSSSETLLFFIFFISTKEKLKHFPTEYFPSVFSVDKRDVRPSNSSHGEDDRYEEDEGGWRNERYRERRNHRRYGGGQREEGIEGVKVKIPTFKGTCDSEVYLEWEMKVEKVFFYTI

SEQ ID NO: 143305 - protein, 87 aa, Glycine max
  Coding DNA Sequence Number=SeqID_51620
LAPYTSEPYNAQWDTPRLLRDKHTLRSSRILGEMKVDEPWLGFSRCKIHFLVGALGMAFVDNWVVGKEEVCYWLSNDIVGLVGNLAV

SEQ ID NO: 143306 - protein, 112 aa, Glycine max
  Coding DNA Sequence Number=SeqID_51621
MILDASTGSTMRSKSLEEAIVIIDSIAASDYQSHRDRAPTQRKGRYQGYRGGSGSNQPYGWRPHNNAYSGPNNISFASPSNNSYGGSSNKGPQQQAQPDRMSKMEDTLTHFM

SEQ ID NO: 143307 - protein, 239 aa, Glycine max
  Coding DNA Sequence Number=SeqID_51622
  Subcellular localization annotation: CTP_CleavageSite=59; ConfidenceScore=5.08e-01
MWARWWTAILRMARGLFHGGRFRLWRAISSRLLRRPSPWRADRCTFRPRPFVIGWCACRCWTCGAKRVPVQLRWCLPMPGQGWPPSSVIMPRRSSRRAAPDIDLAASHLDRFALEGGEIPTRVKSRPSRRQRGWRHGARPRGVGQLSAGMARSLPRPVFLKRNDTTISSAPGFGKQRCVLRHVGEQWGRFGSCCISFSSVNAVQAAISARCAQHRAVSHLAAFQVVAHGASAPPPRRRP

SEQ ID NO: 143308 - protein, 76 aa, Glycine max
  Coding DNA Sequence Number=SeqID_51623
MSGFTRNSPQISASPHQLDLAPYASEPYNAQWNAPGLLRDKHTLRSSRILGEMEVDEPLNYQVVFVIGSAVDRLCG

SEQ ID NO: 143309 - protein, 122 aa, Glycine max
  Coding DNA Sequence Number=SeqID_51624
  Subcellular localization annotation: CTP_CleavageSite=53; ConfidenceScore=5.16e-01
MYPPLFSLNNLVDVPSTRTDPQEMYPLLFSVTTTQVDVPFTCTTKDVPSNVLRQSSQAEESKEFSDCVVLNSLTREKGDTKEFRRLVLRSFGKGRRETQKELRRLVLGKFFLAKGEGNEKDE

SEQ ID NO: 143310 - protein, 107 aa, Glycine max
  Coding DNA Sequence Number=SeqID_51625
MSKHTNEDRVDLACLFDLGEAKGHERDKRDCFPLRLYLRNFPLLFLASSFPSFILCWLAGISITGPCGVLCFKSLVYLSFNGLPSGEALTTGISGSSSPATGTSLAT

SEQ ID NO: 143311 - protein, 71 aa, Glycine max
  Coding DNA Sequence Number=SeqID_51626
MIFTLFFSKNVSQTLKPHFPSPKITDGHRRPPLLAIGPPHQEEHFNRSEILKILLKDSVEKILQSSISKFL

SEQ ID NO: 143312 - protein, 60 aa, Glycine max
  Coding DNA Sequence Number=SeqID_51627
MEKSDKMNFKGKKEKKGYITWEDNLEVGSSYWKLKVKNGSWKLEVEVTGSWKLEMKVIGS

SEQ ID NO: 143313 - protein, 174 aa, Glycine max
  Coding DNA Sequence Number=SeqID_51628
MPEASGNRLPACVIDYTEEWVTGNRLPGHIVMAAQLIRDRVEMECLEGAWETLEGNTRCRFRGTIRFTATSLVHPDEPAQTLQRTVEWILPTPTPYRLVEPVQVIEVTSSEEDPEEDLEELPPEPAVDALDFLEGDEDPLLEVDSPEEVMSASEADSTEDSGPREMAISGGSSS

SEQ ID NO: 143314 - protein, 184 aa, Glycine max
  Coding DNA Sequence Number=SeqID_51629
CTGSYRLADGTPHPHGEFNFTGTARVTAAVYRGFHSKLITLLVPTFQHRAVHREDRPPNSKFFPGSFNLVDYDNSRDYKQTRDYGRAGDRARPSQKGFDDSSKVHLRERRVRGRGGSPRPDHPIHSNRQAWFCSQSNFVTFVYPSDGSPFGDLSLLMSAFSLLISPGVVTKNLPRLTERPATDT

SEQ ID NO: 143315 - protein, 75 aa, Glycine max
  Coding DNA Sequence Number=SeqID_51630
MKLHCKNCDDESDEQNDGDSDEVYFVEAFGKRRHREAPFGGGDSDCGAKVHRQASGDSDIGKHGPMVTRSCTLCL

SEQ ID NO: 143316 - protein, 118 aa, Glycine max
  Coding DNA Sequence Number=SeqID_51631
MGAKHLTRTKERSHVIKQRMTKLGLCLSSGPPPLDDKRVRITIRMTKLGLCLSSGPPPLDDKRVRITIRMTKLGLCLSSGPPTLDDKRVRITVRYLRVSWVQNDQTWSLLVIGTDDSG

SEQ ID NO: 143317 - protein, 257 aa, Glycine max
  Coding DNA Sequence Number=SeqID_51632
  Gene Ontology: Mol. function=transcription factor activity; Cellular component=intracellular; Biological process=regulation of transcription, DNA-dependent
  Homolog annotation: Hit_ID=A4WE17; Match level="QueryCoverage=85%, HitCoverage=74%, E-value=1e-108, Identity=80%"; Hit description =Transcriptional regulator, LacI family
  Pfam annotation: Domain name=LacI; Domain location=40-65; Score=44.6; E_value=3.5e-10; Accession=PF00356.12; Description=Bacterial regulatory proteins, lacI fa
RIVTGKRDRGRSFALPASLIRRQVCVKLQGITWKQECRMATMLDVSLRAGVSKATVSRVLNGTGQVKESTRQQVFAAMEELGYRPNFLARSLANQTSNSIGLVVSTFDGFYFGRLLQQASRQTETHGKQLIVTDGHDAPEQEEQAVQMLADRQCDAIAPDRCVFFEQQDAAFKAVDYLINQGHREIACITVPIHTPTGKARLMGYRKALEKHGIRLDERRIKYGDAGMTRGYELCKELIADGVPFSALFACNDDMAL

SEQ ID NO: 143318 - protein, 64 aa, Glycine max
  Coding DNA Sequence Number=SeqID_51633
DCHHKKGGDCGSNDFQDYFDDAKESRVKQVPKIQESSFKNQDSRTIKIKIQDSRFKNQEKTQSR

SEQ ID NO: 143319 - protein, 132 aa, Glycine max
  Coding DNA Sequence Number=SeqID_51634
  Homolog annotation: Hit_ID=A5AZ88; Match level="QueryCoverage=86%, HitCoverage=15%, E-value=3e-13, Identity=27%"; Hit description =Putative uncharacterized protein
MVKGNFSAVIQCILPTKHKDPGVVTIPCSIGEVTVGKALIDLGATDFVVINNEEDANIPLILGRPFMSTASCVVDMGKKMLQMGIEDQKISFDLFHEDKEPPDWNVYFKVHVMEERRLEKKVLEVGTLMDPG

SEQ ID NO: 143320 - protein, 130 aa, Glycine max
  Coding DNA Sequence Number=SeqID_51635
MTDPLDESISCFLIKVDPWVLVPITFRGLYVLACRRLHALAFRGLRVLVFSVLHIHTLREYKVVCPEMLHRDLHSWDRAYKTPSGPEEVQQGPGVSSSGYGPLSVLQGARPPARSCHRDIGKYARDSIDF

SEQ ID NO: 143321 - protein, 241 aa, Glycine max
  Coding DNA Sequence Number=SeqID_51636
  Gene Ontology: Mol. function=glycerol-3-phosphate dehydrogenase activity; Cellular component=glycerol-3-phosphate dehydrogenase complex; Biological process=glycerol-3-phosphate metabolic process
  Homolog annotation: Hit_ID=A6TF45; Match level="QueryCoverage=100%, HitCoverage=48%, E-value=1e-132, Identity=95%"; Hit description=sn -glycerol-3-phosphate dehydrogenase
MDEFSIIGTTDVEYNGDPKEVAIDDKEINYLLNVYNAHFKKTLSRDDIVWTYSGVRPLCDDESDSPQAITRDYTLDIHDENGQAPLLSVFGGKLTTYRKLAEHALEKLTPYYQGIGPAWTKTAVLPGGDIGGDRDDYAAKLRRRFAFISESMARHYARTYGSNSEWILGEATSLADLGEDFGHEFYEAELKYLVEHEWVRSLDDAIGRRTKQGMWLNAEQQARISEWLAQHTGKSELSLAS

SEQ ID NO: 143322 - protein, 73 aa, Glycine max
  Coding DNA Sequence Number=SeqID_51637
MRSSMVISTMEMQRKIKEKSCQHQRFVSLSMEFNILLGSTFQPAIQSPKLKFTIDTIIRKPKSSRKGSQSKTL

SEQ ID NO: 143323 - protein, 132 aa, Glycine max
  Coding DNA Sequence Number=SeqID_51638
MRPDEAVFPEPIVPVIHETVEVGELQLRQEAATPERTPQTPENPPSPGIELSFAQQVADPPTPVHERPADPSTPILEIPEDPTTPALTLNTTPLAHLSFSFQMRRGDGLLLLQGCQCYISMMRSRIEMNDRI

SEQ ID NO: 143324 - protein, 81 aa, Glycine max
  Coding DNA Sequence Number=SeqID_51639
MEKSKVDTLIAISPNTWHASKFIHISPQDKGICDLWRQQTKATFLPKKSEYAIYGDNKQRPLDQQPQQVISNDTNRSLVFD

SEQ ID NO: 143325 - protein, 127 aa, Glycine max
  Coding DNA Sequence Number=SeqID_51640
  Homolog annotation: Hit_ID=A5BSR3; Match level="QueryCoverage=75%, HitCoverage=30%, E-value=3e-10, Identity=37%"; Hit description =Putative uncharacterized protein
MCGKWHRPSRRKTPPPHVLSRGGYECLKQKLMVEKTKKKLEEAAQSESTEGVIDPPSPIRRHVKWKIARTKKIGQMMSETAKEIADKIDSLEEQASQGSFVPHGHQDLLTDAIGRPKHPGCVRAAKV

SEQ ID NO: 143326 - protein, 106 aa, Glycine max
  Coding DNA Sequence Number=SeqID_51641
MARRDKNWSFCTLCHPEAAGPMTRRDKIWSFCTLVSSRGGGPDDTRRYLTIIRTLVSSRGGGPDDTWRYLTVIRTLLSSRGGGPDDTQRRPIWSFCTLVIAAGQAR

SEQ ID NO: 143327 - protein, 234 aa, Glycine max; identical to SEQ ID NO: 127833
  Coding DNA Sequence Number=SeqID_51642
  Gene Ontology: Mol. function=aspartic-type endopeptidase activity; Cellular component=intracellular; Biological process=RNA-dependent DNA replication
  Homolog annotation: Hit_ID=Q0KIL1; Match level="QueryCoverage=67%, HitCoverage=22%, E-value=3e-12, Identity=29%"; Hit description =Gag/pol polyprotein, 3'-partial, putative
  Pfam annotation: Domain name=G-patch; Domain location=101-145; Score =17.9; E_value=0.0013; Accession=PF01585.14; Description=G-patch domain

SEQ ID NO: 143328 - protein, 114 aa, Glycine max
  Coding DNA Sequence Number=SeqID_51643
  Subcellular localization annotation: CTP_CleavageSite=56; ConfidenceScore=5.60e-01
MRRNSPAYSRDTSFLPQPSFFFGRPFTGTSSFEVGIILSSYPSVIFAFPLTFAGCVGRSGGANTRPLRVTPLSLVILVTLADNEPMSVASPSFRLEAHTSTELRGCFGTGTETG

SEQ ID NO: 143329 - protein, 188 aa, Glycine max
  Coding DNA Sequence Number=SeqID_51644
  Homolog annotation: Hit_ID=Q5XM22; Match level="QueryCoverage=65%, HitCoverage=84%, E-value=5e-20, Identity=39%"; Hit description =Resistance-like protein HAAS-2
MSSFQFPVGEVTITLDDVSSLLHLPVVGDLHAFQPLHMDDAVQMLVDLLMVYAEAARAEIGQCRGSYICLEWVCDIYECRCRAGHWTAAACAYLLHLLCCTLFANKSATNVHLVFLEAHCDLSQTGRYAWGVAALVHMYDHLNDASISTNRQLGGYITLLQCWIYEHFPSVAESTADPEYDENSPGAC

SEQ ID NO: 143330 - protein, 257 aa, Glycine max
  Coding DNA Sequence Number=SeqID_51645
DKDNVDDTVCKKYGISKEKWVQFCQSRRDPSWEDVRKKAQAIQKQNTAPHVLSCGGYEYLEKKSMVEKTKEKLEETAQSRSTEVVIDPLSPIKRHVKWKMARTKKTGKMTFEVAKEIVEKVVRFIGGAGVIGFLYPPWTSRFGVTIKQYFGPAPRTSRTSSSTAPEELEQLTQQIRDQLEESITEKGLALPPEPEVGPSAACVSTKESCVDPSGNDPDTGDSDKCGLYIEENPPCLVALGKVYEGLTTIHNILLLQD

SEQ ID NO: 143331 - protein, 129 aa, Glycine max
  Coding DNA Sequence Number=SeqID_51646
MVQHQSINFQHKRFTFSSQVSETQGIGRQRVVVEAEEYSQQMAQANTRLVVLRKHMLHCSWPTMTPSQQHDAPIPTPNAPLGTQWNVPRAIPDIGDLLGVDLRHQFSVEVDQVETGRHRGRRNPDRQVQ

SEQ ID NO: 143332 - protein, 127 aa, Glycine max
  Coding DNA Sequence Number=SeqID_51647
MDNEEGVQEQMKADLSALKDQMASISEVMLKLQKTIEDKATETASSTVREAEPVLQPALNLGRDRNTTVFGRRYSPEAHPYGLPPDFAPRAAPKDLSQAPTFEGQIPTYDDYPEQDDEEGDTHFGPL

SEQ ID NO: 143333 - protein, 99 aa, Glycine max
  Coding DNA Sequence Number=SeqID_51648
MRGLDWLSKLKVINEENFEAPEEDEEVQVLKLELGKARLAKEKFKSAATHIRKECTEVQEENAATARALEQETKRARKEEHGRNKFRGGLCGSNNELKL

SEQ ID NO: 143334 - protein, 111 aa, Glycine max
  Coding DNA Sequence Number=SeqID_51649
  Subcellular localization annotation: CTP_CleavageSite=59; ConfidenceScore=5.10e-01
MTNERRTSKNGWRSSRKSPRNHITEAPRLGFSSRNQFVSLISITETYEFRNDTCFLSVMLRNLADYLIIPYLTYGMLRNLTNCATMLPFEFRHVTELFKLPDNGCQVPPNG

SEQ ID NO: 143335 - protein, 39 aa, Glycine max
  Coding DNA Sequence Number=SeqID_51650
MYEHEMAPKKPSMKRSRRDTTEEGSSAAPEFDSHRFRSG

SEQ ID NO: 143336 - protein, 84 aa, Glycine max
  Coding DNA Sequence Number=SeqID_51651
  Homolog annotation: Hit_ID=A5ANU0; Match level="QueryCoverage=82%, HitCoverage=9%, E-value=1e-09, Identity=42%"; Hit description =Putative uncharacterized protein
GDWVWLHLRKDRFPTKRKSKLSPRGDEPFQEEELTDLRSNPLQVERDDAILPRKGPVTRAMSKRLQEDLARAAEEGPGVLMNLR

SEQ ID NO: 143337 - protein, 282 aa, Glycine max
  Coding DNA Sequence Number=SeqID_51652
  Homolog annotation: Hit_ID=A1FRF9; Match level="QueryCoverage=99%, HitCoverage=45%, E-value=1e-138, Identity=84%"; Hit description =Asparagine synthase
MEDCLLLGVGDFNVDWSFLSYSLLFPFRDGLQTGFEEVTALEAGEAVTIRDGRPIGRHYQWDVVRQASEAPIEDLEEAVQLARATLLGCIGALASQHRCIQLQLSGGLDSSIVLAGLLHAPSAPEVKCVHHYDAGIGADERMFARMAVAGARESSGRSCEFVEYQRQPHCSLEEIMDFPRTARPAHCSGYLLHRRDVDVDADTVQFTGVGGDAVFLRFKGNAAAIDYAWRRGIDREFFRVAFETAQSGDSLYGVSKDAFVHGVFKKPGSINGRWGNPCEWVT

SEQ ID NO: 143338 - protein, 194 aa, Glycine max
  Coding DNA Sequence Number=SeqID_51653
MGEVEEIQEKMKADMEAIKEKMATMMEAMMSVKKIMEANAVAIAATSVVAKAKDLGSTGSPHNVQNSKRARLPAIWFASQNYTPPNVVYIPNEDVNNSTPILIKSQQPQSDHAHVSRPMEETHEIPHHDLANFEPCLGYAAEGQAVGGIPLQNTLEGPQYHPQPQPSRSTAVKNPHDYGRNGKVGSSRGKAQGH

SEQ ID NO: 143339 - protein, 228 aa, Glycine max
  Coding DNA Sequence Number=SeqID_51654
  Gene Ontology: Mol. function=RNA binding
  Homolog annotation: Hit_ID=A5C5V8; Match level="QueryCoverage=93%, HitCoverage=31%, E-value=7e-27, Identity=32%"; Hit description =Putative uncharacterized protein
  Pfam annotation: Domain name=zf-C2HC_plant; Domain location=20-75; Score=80.0; E_value=7.6e-21; Accession=PF07567.3; Description =Protein of unknown function, DUF1544
MAEPSSDAATASATRKNKADPGWKYCHSLVEGDTNTIVCNFCGKITKGGITRAKQHLIGKSGNVAACKKTPPNVIEELKEYMATKKSGTTYSTSGSGNMANIRDFEFGEPIGCDGSEEDEFADSCNAAASAKTKCGTKKGPMDKFCKNPENAINRRKMEMLRQMNIRESMDKNEVMKVHQHIARFWYQAAIGQYGPHLPIPSYHDIRVPLLKKEVEYTENLMKGHREQ

SEQ ID NO: 143340 - protein, 76 aa, Glycine max
  Coding DNA Sequence Number=SeqID_51655
MSNKAMSFPALVTCLYQFYGVQFRATVAWPGDKPIFQEEARPADAQGATHKDGGRAKEDEDMANLVDDFIGGDSAP

SEQ ID NO: 143341 - protein, 70 aa, Glycine max
  Coding DNA Sequence Number=SeqID_51656
MVGLKNDDEKKNKEGAKEQNKKNDEVVTSEKVEEKVALEQMPTYAKFMKDLHMKKKRIIDDEIVKPQPQQ

SEQ ID NO: 143342 - protein, 136 aa, Glycine max
  Coding DNA Sequence Number=SeqID_51657
RVLTGWTQDDSYRIRRSGRAERGATLPEGRKADRYPVSGRVGTGERTRELPGGNACLWKNASNAAFLRFLAFCWPFAHMFFPALSPDSVDNRITAFEKRKSAQYANRLSPRVGRFINAAGTTGFPTGKRAVSATQL

SEQ ID NO: 143343 - protein, 222 aa, Glycine max
  Coding DNA Sequence Number=SeqID_51658
  Subcellular localization annotation: CTP_CleavageSite=88; ConfidenceScore=5.61e-01
MGKNKGRQSHSAANQIMVKGTTSSSGKSQTSATSGLVGCLDVVQANQNAYTASQDNLVGKVLVKKTGTSSAKTDDVAHQVFDNLSECSAESESSPEVSCTLGDNDSTTDDDSSHSCGSKSSPQLDNNKAPTPWVNLFKDNRSPFKGFGMKFSPPPSDDEVMLEETDLQPLEEAWGHSLIGYVAGRFPGKKALLDCCQKWGVKFSYSTHESGWLVFKFESETI

SEQ ID NO: 143344 - protein, 107 aa, Glycine max
  Coding DNA Sequence Number=SeqID_51659
MDMNLGSFISSQITLIAQHDSSRLGFPTLITALYKARGVHFDSLTHESLSPAINLAYIKKNYWNLDDPTVTFRGPRKAKGKRFEATSTTPSEEPPPSSSTLPPQRSQ

SEQ ID NO: 143345 - protein, 181 aa, Glycine max
  Coding DNA Sequence Number=SeqID_51660
  Homolog annotation: Hit_ID=A6FJQ2; Match level="QueryCoverage=20%, HitCoverage=84%, E-value=4e-11, Identity=92%"; Hit description=50S ribosomal protein L5
MTVKTSDTCSSRRRSQLVCKRMPGADKPVRARQRMRKEKIPHQAPFAIQAAQLLGRAIGAGLFAITPAGERGMCCKAIKLGNARVFPVDSRGSPCNPLKVRACSPLKARTYSPLEVRARSPLKARTCSPLDVRACSPLKVRACSPTKVKAHDPLTARTCSPLKLKVHDPLKARTCSPLKVK

SEQ ID NO: 143346 - protein, 91 aa, Glycine max
  Coding DNA Sequence Number=SeqID_51661
MQLPETVTACLCVRRKYRIRRHSPFRLRNCWEGRSVRASSLLRQLAKGGCAARRLSWVTPGFSQSRRCKTTASAKLACLQVDSRGSPYSDV

SEQ ID NO: 143347 - protein, 75 aa, Glycine max
  Coding DNA Sequence Number=SeqID_51662
MDRGMTLTDAPRSSMAFSNLLFPIMQGVQIAPRPIWALQKIPPEGGCFWRKQPCSPGRAELAWASWAATTSPILL

SEQ ID NO: 143348 - protein, 54 aa, Glycine max
  Coding DNA Sequence Number=SeqID_51663
  Subcellular localization annotation: CTP_CleavageSite=41; ConfidenceScore=5.00e-01
MAMLTGALSKGGKMRGVATNVDKSGAFAPTYPPLERKSYLRSSSLSVNQVILFT

SEQ ID NO: 143349 - protein, 416 aa, Glycine max
  Coding DNA Sequence Number=SeqID_51664
  Homolog annotation: Hit_ID=Q6WAY6; Match level="QueryCoverage=81%, HitCoverage=62%, E-value=1e-21, Identity=25%"; Hit description =Putative uncharacterized protein
KIAAVVGDSAKELDRTKQTRNGVVGLPRKYLEGKARDMASQEKWGPFADILALLIFGVVLFPNVDGLVDLAAIDAFLAYHHSKESPVVAILADLFDTFDRRYTRVRFKAIAHAPKKEKSIGDQHLAGIGGSAINWFPRWKEGKEGVLFSCGDYPNIPLIGTRGCINYNPALAIRQLGYPMRGAPTEESLSPFLVRNLGAQSLKAIQRVHKVWRSPLRKDKELRGIRNGVIGGYHGWLRIHTRGLDWLSKLKVTDEEDFEAPEEDEEVRALKLELGKARLVKEKFKSAATHIRKECTELQEENAATAKALEQETKRARKEEYGREKFQGALWGSNNELKLRREERDWPRVHGMILKEELVACARSKRSLAQHLEATEQSMLTIIGQYKEELNLSVAHEQKLVEDFAQVYAEKEARGR

SEQ ID NO: 143350 - protein, 44 aa, Glycine max
  Coding DNA Sequence Number=SeqID_51665
MTKARQKGLRKEKREKLATQARPGELGYFLQKAPASGGHPGRPK

SEQ ID NO: 143351 - protein, 163 aa, Glycine max
  Coding DNA Sequence Number=SeqID_51666
  Homolog annotation: Hit_ID=Q2HW90; Match level="QueryCoverage=96%, HitCoverage=29%, E-value=5e-18, Identity=35%"; Hit description =Putative uncharacterized protein
SHPNVDGLVDLAVIDAFLAYHNHKESSVVAMLADLYDTFDRRCEKSNTRIVCCTPALYVWLVSHLFRQEVRHACPLESHHSCTEKGGANWYQLLASKEGASVNWFPRWKEGRTRVLISCGGFPNVPLMGTRGCISYNPVLAIRQLGYPMRRAPLEDELAPIIS

SEQ ID NO: 143352 - protein, 139 aa, Glycine max
  Coding DNA Sequence Number=SeqID_51667
KLLAKKTKKKLEEATQSGSVDGMTDPPSPVRRHVKWKMAHMKKTEEMKTKAAKETVEKICPFAGERGEAHGCAFQRRKDARSRHQRLFVENIGKTEGNRSKRIFQVRELYLRLRKVDKSGALAPTYPPSKRKSDLRSSF

SEQ ID NO: 143353 - protein, 107 aa, Glycine max
  Coding DNA Sequence Number=SeqID_51668
MDLIENMVASDIAILRDRAHIPNKISLLELTSQDALLAQNKLLSKQLEALTETLRCTICGGAHESRCCIPNEEQVTHEVNYMGKQPRNNFNAGGFFGFQHGQQYNLQ

SEQ ID NO: 143354 - protein, 405 aa, Glycine max
  Coding DNA Sequence Number=SeqID_51669
  Homolog annotation: Hit_ID=Q84VI1; Match level="QueryCoverage=100%, HitCoverage=59%, E-value=1e-163, Identity=74%"; Hit description =Envelope-like protein
MATSPKETSASGSPAVPSSPHQEQPEFNIQPIQIIPGQASVPEKLIPRRQQGVKIAENPSPATSPREVDTEMDKKIRGIVSSILKDASVPDAEKDVPTSSTPDVSVPDVNKDVPTSSAPNAEALPSPSEEESTEEEDQASEETPAPRAPEPAPGNLIDLEEVESDEEPIANRLAPGIAKRLQSRKGKTPIKRSGRIKTMAQKKSTPITPATSRRSKVAIPSKKRKEISSSESDDDVELDVSTSKRAKKSGRKVPGNVPDAPLDNISFHSIGNVEKWKYVYQRRLALERELGRAAMDCKEIVDLIKAAGLLKTVSKLGECYEGLVREFIVNIPSDISNRKSDDYQRVFVRGKCIRFSPAVINKYLGRPTDGVIDIDVSEHQIAKEITAKRVQHWPKKGKLSAGKLS

SEQ ID NO: 143355 - protein, 119 aa, Glycine max
  Coding DNA Sequence Number=SeqID_51670
MGSSQAPSLKKRFYQVKVKSLGVTSLKELGQLMGQLQRQAFRKAYGKIWDLAMAEVSKEVIASLAQYYDQTLRGVLFPNVDGLVDLAAIDAFLAFHDRKESPVVSILADLYDTFDRGIL

SEQ ID NO: 143356 - protein, 95 aa, Glycine max
  Coding DNA Sequence Number=SeqID_51671
MLWLHEFDLEIRDRSCRNVPFTGERGRGSRVRFPKEERCAKSPPTFICGKRRKNRRKPVKMKILSSGVVFTLEEGRQKRGSCSYVPSIKEEIRPM

SEQ ID NO: 143357 - protein, 115 aa, Glycine max
  Coding DNA Sequence Number=SeqID_51672
  Gene Ontology: Mol. function=aspartic-type endopeptidase activity; Biological process=DNA integration
  Homolog annotation: Hit_ID=A7QAT1; Match level="QueryCoverage=100%, HitCoverage=46%, E-value=6e-24, Identity=50%"; Hit description =Chromosome chr5 scaffold_72, whole genome shotgun sequence
MAFEEEKVKIKKFDDRHFNFWKMQIEDYLKMKIEDYLYQKKLLTLAKNVAFNIVNEKSAGLMKALSNMYEKSSIANKVYLMRRLFNLKMGEGISVTDHINEFNTIVAQLESVQIN

SEQ ID NO: 143358 - protein, 140 aa, Glycine max
  Coding DNA Sequence Number=SeqID_51673
  Subcellular localization annotation: CTP_CleavageSite=18; ConfidenceScore=5.10e-01
MQMNMNLGSLIQGQISLVAQHDSSRLGFPALISTLCKARGVTSDSLTFESLSPAINLAYIKKNCWNLDDPSFTFRETRKSRARGSEAPSNSAPLPQLLLHQFLLPLLSLQNQQLQFFRILLLRAPSYSFLCCRACIRASS

SEQ ID NO: 143359 - protein, 109 aa, Glycine max
  Coding DNA Sequence Number=SeqID_51674
  Subcellular localization annotation: CTP_CleavageSite=49; ConfidenceScore=5.16e-01
LIEARNQSWKPQGPVGLFRVHWVSCGGRLALRSLGRMLLSSNVIYICVRVVMLVRMIRTRLFATARVKSCPGMHSSCVIASLSGCARTVGPPPISGRGPGTVKRKLLAP

SEQ ID NO: 143360 - protein, 216 aa, Glycine max
  Coding DNA Sequence Number=SeqID_51675
  Homolog annotation: Hit_ID=Q9AVH2; Match level="QueryCoverage=21%, HitCoverage=16%, E-value=9e-20, Identity=97%"; Hit description =Putative senescence-associated protein
MCPVVGFGPWLGLGKPLVEILPPGQLRGFCPLLAWLGSAVLGYGPVLSFGLVGPLLPPVISFVARILPTLACAPLAKSVPRWWIIMSYMARHKGRIKATRAESQWIVAARPLCHLQYPVAYLSRLQRILPAARWELRFKASRRANPPHEGHQRHVPLGGRGPLLLVGKRTAGARVASSPDSDLEAFSHNPTHGSFAPLAFQPSAMTNCANQRFLSY

SEQ ID NO: 143361 - protein, 60 aa, Glycine max
  Coding DNA Sequence Number=SeqID_51676
MAYLGICLMASSRVDVPSTRTDPQEMYPLLFSVNNPSRCTLYLYHKGCTLQCVKTKISGS

SEQ ID NO: 143362 - protein, 48 aa, Glycine max
  Coding DNA Sequence Number=SeqID_51677
MVVFEFGSGVGWRLSVVVMEIWDRGPNMKSASSPKQTNTQISIHLGLE

SEQ ID NO: 143363 - protein, 661 aa, Glycine max
  Coding DNA Sequence Number=SeqID_51678
  Gene Ontology: Mol. function=metalloendopeptidase activity; Cellular component=chloroplast thylakoid membrane; Biological process =proteolysis
  Homolog annotation: Hit_ID=A7Q3E4; Match level="QueryCoverage=66%, HitCoverage=90%, E-value=1e-163, Identity=63%"; Hit description =Chromosome chr13 scaffold_48, whole genome shotgun sequence
  Pfam annotation: Domain name=Peptidase_M50; Domain location=419-600; Score=78.1; E_value=3e-20; Accession=PF02163.13; Description =Peptidase family M50
MDTAVESMHQLGFGKQLVPEMLKELLDVYGTSGWPYIEEASYKLLIEAILNKQQGSAEDKEGVINETSSAGISEVGSSGLVAEDTLILHASDVILLCKLIEEDMNNYSAFVKTPTIQSSEAFDHFLCHKGKGYYGLIGNGSQDDDVELIHFPVAPLHRQIEKMLGQYMLLRLFAGISSFPCRAAPLAWNLISVFSTPKWNSFRFPFVTDLASNADAVLNWNGSSRRRVIACSVTEPHNGSDEKEKEADKNGETLPLEDSSEQSIPPPVDAEQINEFSDENKGQSDVQNMDDSNEVASGSPLPGVKPQKLDEAIKIPKETIEILKNQVFGFDTFFVTSQDPYEGGVLFKGNLRGQAAKSYDKISKRLKDKFGDEYKLFLLVNPEDNMPVAVVVPRTTLQPETTAVPEWFAAGSFGLDGLPGALVTALILGVHELGHFLAAKDTGVKLGVPYFVPSWQIGSFGAITRIRNIVPNREDLLKVAAAGPIAGYALGLLLLLLGFILPPSDGIGVVVDASVFHESFLAGGIAKLLLGNVLKEGTAISINPLVIWAWAGLLINAINSIPAGELDGGRISFALWGRKASLRFTGVSIALLGVSSLLNDVAFYWVVLIFFLQRGPIAPLSEEITDPGEKYVAIGVTVLLLGLLVCLPYPFPFTEETLTSF

SEQ ID NO: 143364 - protein, 42 aa, Glycine max
  Coding DNA Sequence Number=SeqID_51679
CGKDHWKKEELRPLTVLKHSELEALSEQLTGGAERGGNRYAR

SEQ ID NO: 143365 - protein, 201 aa, Glycine max
  Coding DNA Sequence Number=SeqID_51680
  Homolog annotation: Hit_ID=A7Q3F2; Match level="QueryCoverage=91%, HitCoverage=27%, E-value=1e-32, Identity=48%"; Hit description =Chromosome chr13 scaffold_48, whole genome shotgun sequence
MNRSFRAVELQMQDAFNQRRHQLAALRSSSPRVMDRDDELALFLEMRNREKERNDLLLRAAEDFDAAAPLGSDPGNSPLFNVPPAASAPARKTGADDFLNSENDKNDYDWYYVALFVIGLYQQYIHGTWESYVIWTQALSYSELGLLTPPGTPLFPSLEMETSKTVMSQLGAPTVRPTPLKARMLSLASGFNSLMKLYISL

SEQ ID NO: 143366 - protein, 85 aa, Glycine max
  Coding DNA Sequence Number=SeqID_51681
MTSVTRCRSCTTSPAIGRRRAQEGRDGGDGGHFKCVHALGPPSHISKTPYIGRTTLSSHGERHGALSHARRAPSWLAIALRASLM

SEQ ID NO: 143367 - protein, 299 aa, Glycine max
  Coding DNA Sequence Number=SeqID_51682
  Gene Ontology: Mol. function=guanyl-nucleotide exchange factor activity; Cellular component=plasma membrane; Biological process =embryonic development ending in seed dormancy
  Homolog annotation: Hit_ID=A7PIJ5; Match level="QueryCoverage=97%, HitCoverage=49%, E-value=1e-101, Identity=68%"; Hit description =Chromosome chr13 scaffold_17, whole genome shotgun sequence
  Pfam annotation: Domain name=PRONE; Domain location=1-182; Score= -26.7; E_value=3.9e-12; Accession=PF03759.4; Description=PRONE (Plant- specific Rop nucleotide exchang
MAINNGALAEMEVPESYLETLPKNGRSCLGDFIYHYITSEKFSPECLLDCLDLSSEHVALEIANRVEASIYVWRRRRAHSKPPPNPNRSTTKSSWEIVKDFMADGDKRELLAERAENVLLSLKQRFPGLTQTTLDTSKIQCNKDVGKSILESYSRVLESMAFNIVARIDDLLYVDGLTKHSDRFPLVPMTVSVSGTPHKAIGGTPKSFSPAPPLISPARGERSPFLRNNHNNIKPQCRGFGVRRVLSNYLGAESKETKIVSNSTVMNGSNPSSNKAEQPERQKKSHAMNGKTKLTSEVV

SEQ ID NO: 143368 - protein, 245 aa, Glycine max
  Coding DNA Sequence Number=SeqID_51683
  Gene Ontology: Mol. function=oxidoreductase activity; Cellular component=integral to membrane; Biological process=electron transport
  Homolog annotation: Hit_ID=A4PBE6; Match level="QueryCoverage=68%, HitCoverage=35%, E-value=2e-85, Identity=89%"; Hit description =Cytochrome P450 enzyme
EEHDQIRAKKSCPEAPLEWTDYKSMAFTQCVVNETLRVANIIGAIFRRAMTDINIKGYTIPKGWRVVASFRAVHLNPDHYKDARTFNPWRWQSNSEASSPSNVYTPFGGGPRLCPGYELARVVLSVFLHRIVTRYSWFPAEEDKLVFFPTTRTQKRYPIIVKRREESRLRGYRKECLISRPWEGIGNEDVKDRTPYHPNKSVELNPPVYMILINSYKSFHVYHNKSMAKVCIKINEIGHEALVDP

SEQ ID NO: 143369 - protein, 460 aa, Glycine max
  Coding DNA Sequence Number=SeqID_51684
  Gene Ontology: Mol. function=phosphoinositide phospholipase C activity; Cellular component=endoplasmic reticulum; Biological process=intracellular signaling cascade
  Homolog annotation: Hit_ID=P93620; Match level="QueryCoverage=95%, HitCoverage=99%, E-value=3e-51, Identity=42%"; Hit description =Phosphoinositide-specific phospholipase C
  Pfam annotation: Domain name=C2; Domain location=330-411; Score=47.1; E_value=6e-11; Accession=PF00168.21; Description=C2 domain
  Pfam annotation: Domain name=efhand_like; Domain location=38-131; Score=16.6; E_value=0.0007; Accession=PF09279.2; Description =Phosphoinositide-specific phospholipas
  Pfam module annotation: Pfam domain module=C2::efhand_like; Domain location=330-411::38-131
MGYNIATYNKYKSLLFFIRNCKFTKLLTPVTELLPPQDLMEAYSKFTGGGSYMSAKQLHRFLEEHQGAKDHTLTDLEKVVEKVLQVRKTCQEIINVDQNREQQITHDELFHFLLHDDFNGPLIAKDNKDCSTLNESESSEEESKGKESLNSSRKKVETEDTLNDSDRDEGNGCLKDKLKTDGELRRQSWSETTHEKASESHGTDIVRYLPSLTFKSSLNTYTRPRYLFHDLSDSSSYSSQVHTEKYPQGVSKGNAGQILKFEATYWVDVWGSDGCIQYADKPIKFTCNLQGMFRANGGCGYVKKPQILMQKHQCGNEFDPTWILTVKKTLKVKVYTGHGWSLDFSLSSTHFDNCSPPDFYTEKKTKVMMNDSFPVWDEEFEFSLTVPELALLLIQVKDKDPGKDDFSGQTCLPVSELKHGFRSVLLYNKQGEKFKSVKLLMRFQFELIVENIDHPVPSYL

SEQ ID NO: 143370 - protein, 68 aa, Glycine max
  Coding DNA Sequence Number=SeqID_51685
  Subcellular localization annotation: CTP_CleavageSite=25; ConfidenceScore=5.46e-01
MMRATMTRAAQQSSMAAMPTTTMTRVAQRESFSGVSSLNKAELASLPKLVRVYAKSDESTSISILLPI

SEQ ID NO: 143371 - protein, 629 aa, Glycine max
  Coding DNA Sequence Number=SeqID_51686
  Gene Ontology: Mol. function=phosphoinositide phospholipase C activity; Cellular component=endoplasmic reticulum; Biological process=intracellular signaling cascade
  Homolog annotation: Hit_ID=Q43442; Match level="QueryCoverage=92%, HitCoverage=99%, E-value=0.0, Identity=94%"; Hit description =Phosphoinositide-specific phospholipase C P12
  Pfam annotation: Domain name=C2; Domain location=502-594; Score=92.7; E_value=1.2e-24; Accession=PF00168.21; Description=C2 domain
  Pfam annotation: Domain name=PI-PLC-X; Domain location=124-267; Score= 151.8; E_value=1.9e-42; Accession=PF00388.10; Description =Phosphatidylinositol-specific phospholipase C, X domain
  Pfam annotation: Domain name=PI-PLC-Y; Domain location=376-481; Score= 56.4; E_value=9.8e-14; Accession=PF00387.10; Description =Phosphatidylinositol-specific phospholipase C, Y domain
  Pfam annotation: Domain name=efhand_like; Domain location=28-121; Score=35.9; E_value=1.5e-07; Accession=PF09279.2; Description =Phosphoinositide-specific phospholipas
  Pfam module annotation: Pfam domain module=C2::PI-PLC-X::PI-PLC -Y::efhand_like; Domain location=502-594::124-267::376-481::28-121
MGTVTYSYKMFKYFNRKFAVSEQAPPPDVKEAFSAFSDAAAASMSADQLLRFLHDHQRETDCSAEDSNRILDSIIQSRKQNDTNAECDHHTDNNNNGLSLDEFFRFLFLVDFNDPLKSQVHHDMNAPLSHYFIYTGHNSYLTGNQLSSDCSDVPIIKALQRGVRVIELDLWPNSTKDDIDVVHGRTLTAPVSLIQCLKSIKEYAFVKSDYPVIITLEDHLTPFLQAKVAEMIAQVFGDMLYFPQADSLTEFPTPESLKGRILISTKPPKEYLESKQFKDSDSERESTEEGSLSPCVIPELEAVDEKLNGSDLDEEGLNARDKKSDQQSAPEYKRLITIHAGKPKGHVKHHLNNVGGVKRLSLSEQELEKASATYGSDIVRYPTQYIVVLTANIFNTFIVDNLSNKIDAFYASRFTQKNIIRVYPKGTRVTSSNYRPHIGWMYGAQMVAFNMQGHGKSLWYMQGMFRANGGCGYVKKPAFLIEKGPHNEVFDPKRALPVKKTLKVKVYMGNGWSSDFSKTHFDSFSPPDFYTKVCIVGVPADKANKKTKVIQDNWFPVWDEEFEFPLTVPELALLRIEVREYDKHEKDDFGGQTCLPISELRSGFRAVPLFDQKGEQLKSVKLLMRFQFK

SEQ ID NO: 143372 - protein, 348 aa, Glycine max
  Coding DNA Sequence Number=SeqID_51687
  Gene Ontology: Mol. function=protein binding; Biological process =protein metabolic process
  Homolog annotation: Hit_ID=A7Q3I3; Match level="QueryCoverage=89%, HitCoverage=34%, E-value=2e-69, Identity=43%"; Hit description =Chromosome chr13 scaffold_48, whole genome shotgun sequence
MGVNSSVMGENNNSLFELMRPNWQDEASSVISRTIAGCHAKRVGANQRGDVWMNFVGPDRNEMRGCNVKFRGKTTLDFIVGEFCKKRFSVVFLENVDKADVLVQNSLSQAIKTRKLIHSHREVGVNNAIFVTSFSGHQAKDPYNYSEERIAKVKVTPIKIAVEHVSGDIRSQRVSVADGSIERISNLVLVNEHTAKTAHTKSNWYLDLNLPAEDTEMEDGNLEHASTENQNLWLQDLYDQVDETVVFKPFNFDELADRVVKVMTSSFHKTIGSECALQIVSEVMDQLLAAAYVSDRGKDNENWVEEVLCGGFTEVQRRHNLTASSIVKLFTCSHQASSEYLLPSITME

SEQ ID NO: 143373 - protein, 110 aa, Glycine max
  Coding DNA Sequence Number=SeqID_51688
MTMTRVASGGGGSDDDGRVEIVATMMITVTVVVVKCDDDNSSGGDDNNGGVVVMVEVAKARCGGGGMMGATVTMTVAAMTKCGGGCGDDMDSDSNGGGGMVMVARMYFLK

SEQ ID NO: 143374 - protein, 339 aa, Glycine max
  Coding DNA Sequence Number=SeqID_51689
  Homolog annotation: Hit_ID=A7Q3J3; Match level="QueryCoverage=61%, HitCoverage=60%, E-value=4e-42, Identity=42%"; Hit description =Chromosome chr13 scaffold_48, whole genome shotgun sequence
  Subcellular localization annotation: CTP_CleavageSite=60; ConfidenceScore=5.34e-01
MASSAQVPNLFGSATSALPPTPAAHHDNIMSSSDAADALSCLLHRLPPTLSLPTRLPSPSSAAATSPPSLSLNDVFSCVSKLGYAQLTDHSVPSELANSAESEALALFDLSKEQKNSLFPKNWPLGYGGDDEDEDELAESFRFDSACSTESNELALFSLRKFARELEMLGLKIVDGLTKGLGSLSGNKSGGFYPFVIGLQYQIRNLKYSLLSDSGWVSVLPHVDSILVTVGDIAQMWSNGKLKKVRGRPMATVGDENGSRCITMSLLITLPTDSRVAPLLPKATCNKEQKEEEVDEESNDGGEELEKRVFNSFDFEDYAWRVYHERIIFKDPLDRYRVA

SEQ ID NO: 143375 - protein, 272 aa, Glycine max
  Coding DNA Sequence Number=SeqID_51690
  Gene Ontology: Mol. function=transcription regulator activity; Cellular component=nucleus; Biological process=regulation of transcription
  Homolog annotation: Hit_ID=A7Q3K4; Match level="QueryCoverage=100%, HitCoverage=100%, E-value=2e-66, Identity=54%"; Hit description =Chromosome chr13 scaffold_48, whole genome shotgun sequence
  Pfam annotation: Domain name=HLH; Domain location=73-130; Score=44.6; E_value=3.4e-10; Accession=PF00010.17; Description=Helix-loop-helix DNA-binding domain
  Subcellular localization annotation: CTP_CleavageSite=69; ConfidenceScore=5.54e-01
MESYYYSGWPLAQFNSAPNSDQLSPFSVPTTTQQTLPLVATSTSDRAAAASLQFGEFPSWPAPIAAEDRAASASKSHSQAEKRRRDRINAQLATLRKLIPMSDKTRSKKVELMDKATLLGSVVDHVKDLKRKAMDVSKAITVPTETDEVTIDYHQAQDESYTKKVNILKENIIIKASVCCDDRPELFPELIQVLKGLRLTAVKADIASVGGRIKSILVLCSKDSEENNSVCLSTLKQSLKSAVNKIASLSVATNCPTRSKRQRFFLPSHYVQ

SEQ ID NO: 143376 - protein, 49 aa, Glycine max
  Coding DNA Sequence Number=SeqID_51691
MELITASARVQKRKRVRCSVRDESQVEEEAYEEVEEEAPKDETEIQVVR

SEQ ID NO: 143377 - protein, 135 aa, Glycine max
  Coding DNA Sequence Number=SeqID_51692
  Gene Ontology: Mol. function=histone-lysine N-methyltransferase activity; Cellular component=nucleus; Biological process =multicellular organismal development
  Homolog annotation: Hit_ID=A7Q3L4; Match level="QueryCoverage=84%, HitCoverage=66%, E-value=2e-56, Identity=95%"; Hit description =Chromosome chr13 scaffold_48, whole genome shotgun sequence
  Pfam annotation: Domain name=DUF260; Domain location=11-111; Score =219.0; E_value=1.1e-62; Accession=PF03195.5; Description=Protein of unknown function DUF260
MKGYEPRSSSSCAACKFLKRRCIPNCIFAPYFRSDECKKFAKVHKVFGASNVSKILVEVPEEQREDTVNSLAYEAEARLRDPVYGCIGAIALLQRKMVELQHDLAIAKDRLARYTAAATTATATTTTSDALINGH

SEQ ID NO: 143378 - protein, 418 aa, Glycine max
  Coding DNA Sequence Number=SeqID_51693
  Gene Ontology: Mol. function=nucleotide binding; Cellular component =Golgi apparatus
  Homolog annotation: Hit_ID=A7PNZ1; Match level="QueryCoverage=87%, HitCoverage=60%, E-value=1e-148, Identity=66%"; Hit description =Chromosome chr8 scaffold_23, whole genome shotgun sequence
  Pfam annotation: Domain name=DUF246; Domain location=1-323; Score =515.0; E_value=8.5e-152; Accession=PF03138.5; Description=Plant protein family
MVAIAKIMKATLVLPTLDHDSFWTDSSDFKQIFDWKNFIEVLKDDVQIVESLPPEFATIKPVLKAPAGYYAGEVLQLLKKHKVIKFTHTDSRLVNNGLATPIQSVRCRAMYEGLKFTVPIEELGMKLVNRLRDNNTPYIALHLRYEKDMLAFTGCSHNLTKEEAVELKKMRYKVKHWKVKEIDSKSRRLRGGCPMTPREVAVFLEALGYPYDTKIYVAAGMIYGKDEMKSLRSKYRYLLTHSTLATKEELLPFKDHQNQLAALDYIIAVESDVFIYSYDGHMAKAARGHRAFEGFRKTISPDKQKFVRLIDQLDNGLISWDEFSSRVKSIHANKNGGPHHRKVNRHPKLEESFYANPYPGCICERRETMMMIAFWQLELQKPNNYFELYIKKKFIELNLNLRPQDRFKLNVDGALMRI

SEQ ID NO: 143379 - protein, 166 aa, Glycine max
  Coding DNA Sequence Number=SeqID_51694
  Gene Ontology: Cellular component=vacuole; Biological process =response to biotic stimulus
  Homolog annotation: Hit_ID=Q9M073; Match level="QueryCoverage=92%, HitCoverage=98%, E-value=3e-14, Identity=30%"; Hit description =Putative uncharacterized protein AT4g32870
MAIEVRNGKWQGSVGGIVCVPIDKVWTLVSQTKRLPEWMPMVERCSSLAGDDDEPGYVRLVSGFMFPQQDGERSWIKERLVSLDSSSHSYVYRMEASNVGLDGSVNSLKLVDYGDESTLIRWSFEINPLEDVSEDTIVDYLGFLYKSCINKIEGAIEAASRNVSPP

SEQ ID NO: 143380 - protein, 534 aa, Glycine max
  Coding DNA Sequence Number=SeqID_51695
  Gene Ontology: Cellular component=nuclear chromosome; Biological process=chromosome segregation
  Homolog annotation: Hit_ID=A7Q3M8; Match level="QueryCoverage=99%, HitCoverage=93%, E-value=1e-112, Identity=46%"; Hit description =Chromosome chr13 scaffold_48, whole genome shotgun sequence
  Pfam annotation: Domain name=Rad21_Rec8; Domain location=494-534; Score=24.7; E_value=3.8e-05; Accession=PF04824.7; Description =Conserved region of Rad21  Rec8 like protein
  Pfam annotation: Domain name=Rad21_Rec8_N; Domain location=1-97; Score=82.5; E_value=1.4e-21; Accession=PF04825.4; Description=N terminus of Rad21  Rec8 like protein
  Pfam module annotation: Pfam domain module=Rad21_Rec8::Rad21_Rec8_N; Domain location=494-534::1-97
MAATMHAKINRRKLDKLNIIKICEEILNPSIPMALRLSGILMGGVVIVYERKVKLLYEDVTRFLVEINEAWKVKTAPDPTLLPKSKSKAKKEAVTLPGTGETNMEDIEQSLQFSNTGTTTGFQHNAYFTMRLDNVDEPFTNNGAREDQDQSELLHQVDAENITLFERFETFQANTDTYNRFERFDIEEDEETQVNVTSGDQILTTLVPSPPHQDEPTKADTFQDHHPGHPDIQQPSEGMIPRQEPRRRGPNKRKRGQPSAIEMDYEQTIIPAHIYQHWLQNASDIVSRRGRRKKQNDVMSSTKIASLMKLPPVVQIDDLFTAVNDNIYYPKPILDLWIKSIQPPHDSPSDYQAPPMEKAREHILMDELTASLLRGHEATPQVSSGKAGGSVHSFPRPTSENGPASHSDFDSGRTVHRFKNKRYSSSANSSGGLEPLAEDVNFKLARLYEDGPTPDQELLVETGPTQTQVNINHPSDKITDSIQAQMKAHFDTPGAPPVESLHILAAGMTRTSAAQLFYQICVLASRDALKVDQK

SEQ ID NO: 143381 - protein, 70 aa, Glycine max
  Coding DNA Sequence Number=SeqID_51696
MMTIVGSNGNDHAITMRDENDDYNNGGVGGGNDGGDSSGSDDNNVVVLEISTTAGCDENDYGEMVAVVIW

SEQ ID NO: 143382 - protein, 653 aa, Glycine max
  Coding DNA Sequence Number=SeqID_51697
  Gene Ontology: Mol. function=mannosyl-glycoprotein endo-beta-N -acetylglucosaminidase activity; Cellular component=intracellular; Biological process=metabolic process
  Homolog annotation: Hit_ID=A7Q3P1; Match level="QueryCoverage=98%, HitCoverage=87%, E-value=0.0, Identity=65%"; Hit description =Chromosome chr13 scaffold_48, whole genome shotgun sequence
  Pfam annotation: Domain name=Glyco_hydro_85; Domain location=70-354; Score=502.0; E_value=6.9e-148; Accession=PF03644.4; Description =Glycosyl hydrolase family 85
MSHSINSEFKFDPKEPSMPISYPIKTLKELESRSYFESFHYPFNKASVPIESGYSEPLPNRRRILVCHDMAGGYLDDKWVQGGTNAEAYAIWHWHLIDVFVYFSHNLVTLPPPSWTNTAHRHGVKVLGTFITEWNEGKAACDKLLSTKESAQMYAKHLAELAANLGFDGWLLNIEVTLKPEQISNLKEFVNHLSLTMHSSVTGSLVIWYDSVTINGDLWWQNELNEYNKSFFDICDGIFTNYSWQEDYPWRSASVAGDRKFDVYMGIDVFGRGTYGGGQWNTNVALDVIRKADVSAAIFAPGWVYETKQAPDFKTAQNRWWGLVEKSWGIVRKYHGTLPFYTNFDQGHGYHISVDGDQVSDATWCNISSQSIQPLLEFADSTANSIQLIVDLKEASYSGGGNITFKGSLGEGTYLKRRIFQGQSILAKLPIHFIYSVKSDSNSSLGLVLDFTSTINKTTPVLLTSHGMDHLSSEFSKVVLTSEHKGNAPGWVIHEGTIEMNGYILTGIHALCYRPNAPSMKSRPFGPDHAVPSSTDYFAVLGHITVKTSNYKPDFPVSTSWLVNGECINWKSGPQDSRILSVKISWKLKNGQNLAFSHHNVYVEKPPKLAYGNPSTTLEPVQEYLGVAHVNCFYVSELKVPASTSSLKFIIQI

SEQ ID NO: 143383 - protein, 80 aa, Glycine max
  Coding DNA Sequence Number=SeqID_51698
MVVVSHHELYVLLHLFLGGVIATDEDRVIIAAEGNIIVREDLVDIPGFTLPEDLSGNCIVHPDGGFVMKGLEWCWGGWGC

SEQ ID NO: 143384 - protein, 28 aa, Glycine max
  Coding DNA Sequence Number=SeqID_51699
MDLNPTGTRKSICKRVEYLLLIGLGMRT

SEQ ID NO: 143385 - protein, 587 aa, Glycine max
  Coding DNA Sequence Number=SeqID_51700
  Homolog annotation: Hit_ID=A7PIC6; Match level="QueryCoverage=84%, HitCoverage=71%, E-value=1e-133, Identity=54%"; Hit description =Chromosome chr13 scaffold_17, whole genome shotgun sequence
MESLSHGCSGQADGPRPRVQLWAFFLVLEEKSNWAYSSMISELRGSKGVISSQLVHRGNLTLVLLPSSDLRLSFIGDDGRTERLFTLTNKSQCSAVVVDEIPTDSSGRSFLVRTPDSRAFYFWCSEKSKLLGIELLGKMKDLLKRKPSIVELSGISKSRLDCFATQLRAFLVGTTGGSSHDSSVCASTSANSMSCSNVASESSHPSSSKFPRSRNIGGQTAKGDTTLYQSILSPRSSSFKEVPPRNLSSHRIAAREKIKRRGDNHQPTVDTLTNDSTHILDLSSTSDHDKASEVTKTLAFSPSFLGSLGKLGGVPSSLGLSGEVPPIVSPIFSPYYCWCPPGISTCPSIAAVTQSPNSSIETLPFPSGASLLANPLSVNLLDPVQPLGTSMDFPPFLPDPLVRMSLPTSQQIPTFTPLMCDPIVHVPVIDVCSSGQGYLVSAGPAMSPSIPPLHPNLVKPLIPESDAVVKGARETLRLLLSGSSQGNQQMMRDTLPAILTNPDENQNNILVAGSRGLYTGTRDINAIANSIAAMGLVSLSGVSKVDSGVYSELCENYGNLEAVKNSNDSGGGAFLDDEGGSSLDSKQ

SEQ ID NO: 143386 - protein, 246 aa, Glycine max
  Coding DNA Sequence Number=SeqID_51701
  Gene Ontology: Mol. function=translation initiation factor activity; Cellular component=protein complex; Biological process=translation
  Homolog annotation: Hit_ID=A9PCS2; Match level="QueryCoverage=100%, HitCoverage=100%, E-value=2e-94, Identity=65%"; Hit description =Putative uncharacterized protein
  Pfam annotation: Domain name=Mov34; Domain location=14-124; Score =137.9; E_value=2.9e-38; Accession=PF01398.12; Description =Mov34MPNPAD-1 family
MAATERTVLQFSSSQSLSAKVHPLVVFNICDCYVRRLDQAERVIGTLLGSILPDGTVDVRNSYAVPHSESVDQVALDIEYHHSMLLSHQKVNPKEVIVGWYSTGLGVTGGSALIHEFYSREVPNPIHLTIDTGFTKGAVDTLKATAVDKIPSDLEGMEALMGHLLALIDDIHKYVDDVVEGRIDPDNKIGRFISDAVGSIPKLPSSAFEKLVNDSLQDHLLLLYLSSITRTQLSLAEKLNTAAQIL

SEQ ID NO: 143387 - protein, 172 aa, Glycine max
  Coding DNA Sequence Number=SeqID_51702
MEHFLEQVARPEVQLLLVRPNKAALPEPTPVQVDLEPTDPQSRVVNPPSFPEREVVPPSPPLIVISDASSDEAAAPPDSPAGETADPLASPIQKHIGAYIFCGRSRVYIYLGCNIENKRGYISYGSVQVERTSTWLFTENKGEYIPCGSFACKGFYKVIGILKNRWLLGDWM

SEQ ID NO: 143388 - protein, 26 aa, Glycine max
  Coding DNA Sequence Number=SeqID_51703
MKKDCLKFKSWMDKKGYGKPKEASVK

SEQ ID NO: 143389 - protein, 99 aa, Glycine max
  Coding DNA Sequence Number=SeqID_51704
MTTDRPPLLMVHIDLVIGPNISMCVRSSPLLSHQLSQPTLRRGCKKAKIDGPKRLSPREKMSGVATNVYSRKMLEKPKRRRSADLENEGSRVVYARGRY

SEQ ID NO: 143390 - protein, 322 aa, Glycine max
  Coding DNA Sequence Number=SeqID_51705
MGLIIPQDYAEEVANRSIEGQRAIRLTPKTLDPSSQKLFLKYMRVFLSFDKFLPQHAPFISREVGPAWFTDYFPTVDPDNEEEVNEIWSFYLNPQILSCRTGVQSNYLGLVGYQPNLVSRQFGLSQIRPKSLFEDPQDVIRGANLSEKTFKKFLKISLDENYNLHPFEFNHSHFCTMGLESGFAQPTIENIRSSLQARGKAPMTKRSAETSRADVRPKKPTGVKIQEGKQEEKEEEERPLIRKRKLPTTSTKSADQTEAGNSQAQMPKKKKKVKQVEPEPSVAVEDGEPAKKKKKKTKSSKEQGDNQPVDVQPPSTDIGGTE

SEQ ID NO: 143391 - protein, 105 aa, Glycine max
  Coding DNA Sequence Number=SeqID_51706
LGGLNGDPVLRGTRIRATWEYVSSVGGGQQGMVGLYVICGYGELFCTIARPPPSTTCDGVVPADMSRGSGDLGDIRRAPGSQQIKGTKTTKQGGLCGGWPAVKLD

SEQ ID NO: 143392 - protein, 112 aa, Glycine max
  Coding DNA Sequence Number=SeqID_51707
MGEVEEIQEKMKTDMEAMKERMATMMAMMSKRKIMEANAVAIAATNMVGKDLGSTGGPHDVQIQNERAFPPYGLPLNYTPPNMAYTPNKNVNNSTPIPIESQQPQTDHAHVS

SEQ ID NO: 143393 - protein, 261 aa, Glycine max
  Coding DNA Sequence Number=SeqID_51708
GFLNVPLMGTRGCISYYPVLAIRQLGYPMSTARGRARACTYTRGSNNGPIGGYRKWLRAHVRGLDWLPSLRTAKREEVEASEEDKEENAELRDINIATTKALEQETKRARREEHGRNKFRGALWGSNSELKLRREERDRSRVDSLILKDELKVCSRSKRNLSQRLCEIETNMLAIVSKYQEELNLATAHEHKVANEYTQVYAEKEARGRVIDALHQEATMWMDRFALTLNGSQELPRLLAKAKAMADTYSVPGEIHGLLNY

SEQ ID NO: 143394 - protein, 114 aa, Glycine max
  Coding DNA Sequence Number=SeqID_51709
MSGFTRDSPQISASPHQLDFAPYASGPYNAQWNATGLLHDKHTLRLSRILGEMEVDEPRLGLWLPLHYRVDMGASQYRTPEFGWVLWFDLGMAFMDNWVVGKEMGCYWLSNDIV

SEQ ID NO: 143395 - protein, 37 aa, Glycine max
  Coding DNA Sequence Number=SeqID_51710
MKMLLIPHDMNGSGMEKEKREDTPLQGEDESRRSSPP

SEQ ID NO: 143396 - protein, 72 aa, Glycine max
  Coding DNA Sequence Number=SeqID_51711
MACTQFRFTRDSPQISANAQWNAPGLLHDKHMLRSSRILGEMEVDEPWLGLWLPLNYQVDMGASQHRTPELG

SEQ ID NO: 143397 - protein, 83 aa, Glycine max
  Coding DNA Sequence Number=SeqID_51712
MKRCLRDARYECIYGHESSENHLSLLAHFKAQCLMCVVEVLAIKITIPQWSRQLSQRALLRASEARLTGALSKGGKMRGVATN

SEQ ID NO: 143398 - protein, 309 aa, Glycine max
  Coding DNA Sequence Number=SeqID_51713
  Gene Ontology: Mol. function=motor activity; Cellular component=cell projection
  Homolog annotation: Hit_ID=UPI00016621D1; Match level="QueryCoverage =83%, HitCoverage=40%, E-value=1e-13, Identity=29%"; Hit description =UPI00016621D1 related cluster
RIERPHLQRLHALVFRGLHVLPFRGLHILAFRGLHVLAFRALHVLAFGGLDVLAFRGLHILAFRGLHVLTFRGLQVLAIRGLNVLTFRGLHVLAIRGLNVHTFRGLHALVNRGLDVLAFKGLHVLGFRGLHVLAFGGLYTLAFRGLHVLAFRGQRVLSIRGLQSSPSEDFTPSPSEDNMTTPPRLRRVAAPSFLKTSRPRLQRTTRVSFRGMNVLTIRGIHVLPFKGLHILAFRRLHVLAFKGLHVPAFNGQHVLAFRGLHVVAFRGLHVLAIRGLHVLAFKGLHVPAFRGLHNLAFKGLHVLPFRVKF

SEQ ID NO: 143399 - protein, 69 aa, Glycine max
  Coding DNA Sequence Number=SeqID_51714
MNLLMKKILGLQALMELTSHQVGERENAPCLSNGRQVLPEDLQWQAVNIKLKSSPWDTELGCQFLRVRP

SEQ ID NO: 143400 - protein, 93 aa, Glycine max
  Coding DNA Sequence Number=SeqID_51715
  Homolog annotation: Hit_ID=Q949K7; Match level="QueryCoverage=43%, HitCoverage=45%, E-value=6e-08, Identity=62%"; Hit description =Putative gag polyprotein
MVAITLAKVHQPPFLREYDSNATVLTEKAPGPLTGGKDYAFANLEELFLVPNIITPPKFKVLDFDKYKGTTCPKNHPKMYCRKIRAYAKMRNC

SEQ ID NO: 143401 - protein, 45 aa, Glycine max
  Coding DNA Sequence Number=SeqID_51716
PKVEALCGASMVNEEEENGNDVTASTLVWVVAEQWEEPGVGEEEE

SEQ ID NO: 143402 - protein, 96 aa, Glycine max
  Coding DNA Sequence Number=SeqID_51717
MACTHILVEAKIDSPQISANQHQFDLAPYALGPYNAQWNAPGLHHDKHMLCSSRILGEMEVDEPWLGLWLPLNCIGHQNWGFVVDLGMAFLDDWVV

SEQ ID NO: 143403 - protein, 72 aa, Glycine max
  Coding DNA Sequence Number=SeqID_51718
  Subcellular localization annotation: CTP_CleavageSite=32; ConfidenceScore=5.27e-01
MRTRSPLKARACSPLQARMCSPLMARMCSPLMARTYSPLKVIGTSTQGSTFRRKQEIDSSRGPVIQKDWTRD

SEQ ID NO: 143404 - protein, 49 aa, Glycine max
  Coding DNA Sequence Number=SeqID_51719
MLNAPNNTPTRHTDEQEKAQEENESLAGMKGNKKNHQVSFPLNFWRFLA

SEQ ID NO: 143405 - protein, 75 aa, Glycine max
  Coding DNA Sequence Number=SeqID_51720
MFAGMKVLMTNMSTPYHRGGMMNASGHLHAMRDKCIYLWTQELGRPSLLTYNALGIMVHLQSLPWCPMLAIKKVI

SEQ ID NO: 143406 - protein, 401 aa, Glycine max
  Coding DNA Sequence Number=SeqID_51721
  Gene Ontology: Mol. function=5-methyltetrahydropteroyltriglutamate -homocysteine S-methyltransferase activity; Cellular component=outer membrane-bounded periplasmic space; Biological process=amino acid transport
  Homolog annotation: Hit_ID=Q6D596; Match level="QueryCoverage=43%, HitCoverage=40%, E-value=2e-80, Identity=86%"; Hit description =Putative substrate-binding periplasmic transport protein
PDELARIYARVLNKALEGKPDDLTIGLHVCRGNFRSTWISEGGYEPVAEVLFGTVNVDAFFLEYDNDRSGDFAPLRFVRPGKQQVVLGLITTKNGELENPEGVKARLEEAAKYVAKEQICLSPQCGFASTEEGNSLSEAQQWDKIRLVTQIASEVCAALCHSETFSLHPALQPLHSRFLHSGILFAPASLRHLFPRPRRNGRLRTAFFFRSENMHRRTLLKAFALSASVVAMGMSFGVQAADTIKVGIMHSLSGTMAISETPLKDVALMTIDEINAKGGVLGKKLEPVVVDPASNWPLFAEKARQLLSQDKVAVVFGCWTSVSRKSVLPVFEELNGLLFYPVQYEGEEMSPNVFYTGAAPNQQAIPAVEYLMSEDGGAAQALLPAGHGLRLPAHHQQDPAR

SEQ ID NO: 143407 - protein, 29 aa, Glycine max
  Coding DNA Sequence Number=SeqID_51722
MGSKIYPKDCITVTDKSSRVQLKMLKKRY

SEQ ID NO: 143408 - protein, 274 aa, Glycine max
  Coding DNA Sequence Number=SeqID_51723
  Homolog annotation: Hit_ID=A5B5G7; Match level="QueryCoverage=79%, HitCoverage=15%, E-value=4e-11, Identity=26%"; Hit description =Putative uncharacterized protein
MVSQKIKSLACSSSQIRYDRHKFSSPEAWDRYTNNIFGIKIIHERNVQLSFNDFEECQMELNRRNWHKKIANLVEGSIYVALVKEFYANVYDPEDKSPKQVKVRGQWIPFDLAALNSFLETPVVIEEGESLLTYEIFVFIRPNHHELVACLCIPGKGFELNSNGLRMKILRKNLTTLAQTWSVFSFSNLAPTSHTSDINLDRAKFVYALIQKMDMNLGSFISSQITLMAQHDSSRLGFPALIIALCKAQGVRSYSLTHKRLSPAINLGIYYKNY

SEQ ID NO: 143409 - protein, 102 aa, Glycine max
  Coding DNA Sequence Number=SeqID_51724
AEFEIPEVSNSRTKKEVTSDCRGEMEADGVDDTVCEKYGISKEKWAQFCQTRRDPSWEDVRKKAQAIQKQNTGPHVLSRGGYEYLEQKLLAEKTKKKLDEAA

SEQ ID NO: 143410 - protein, 129 aa, Glycine max
  Coding DNA Sequence Number=SeqID_51725
MERSVIDATSGGALGDMTPAEARNLIEKMASNSQQFSARNDAIVLRGVHKVAMDSSSSAKNKKLEGKLDALVYLVTQLAMNQKSAPVARVCGLCSFVDHHTGLCPSLQQSRVNEQPEAYAANIHNRPPQ

SEQ ID NO: 143411 - protein, 153 aa, Glycine max
  Coding DNA Sequence Number=SeqID_51726
  Homolog annotation: Hit_ID=Q6UUU1; Match level="QueryCoverage=39%, HitCoverage=40%, E-value=1e-18, Identity=78%"; Hit description =Putative uncharacterized protein
MEQPESKYHDESHQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 143412 - protein, 204 aa, Glycine max
  Coding DNA Sequence Number=SeqID_51727
MFVDPNNANTATLAEVAETLQYMVSPQGRNTWTVDDLVPYVEKITILSEEQERMTEPAAHGPTSERRFPPQQFHMLQSSVETRGFDRRREAVEAQEYEKQIEERGHGMYYTPPTFAEYPSQMYQYPFQGHHTDMSASSHSFGGVAETQPHFSWLTMTPTQQHDAPMVTPDAPLAPQWNVPGAIPDMGDLLGVDLRQEFSAEAEE

SEQ ID NO: 143413 - protein, 79 aa, Glycine max
  Coding DNA Sequence Number=SeqID_51728
GGGSASVARCWPSPDCYGVLPYACLGAQYFLMKARLVGGPDDLVRGGRHSVELTETRNQSWKPQDPVGLLRVHWVSSRV

SEQ ID NO: 143414 - protein, 325 aa, Glycine max
  Coding DNA Sequence Number=SeqID_51729
  Homolog annotation: Hit_ID=Q6WAY4; Match level="QueryCoverage=70%, HitCoverage=44%, E-value=2e-10, Identity=25%"; Hit description =Putative uncharacterized protein
MGTRGCISYNLVLAIRQLGYPMRGAPLEEEIVPVISQGFKETNVETLQKVRKAWEVLQKKDKELRGSNNGPISDYREWLKAHVQGLDWLPSLRTTKREEDEAPEEDEEVQALRTELKQAQTVKERFKSAALKIRKENVELRDVNMATSKALEQETKRARRKEHGRNKFRGALWGSNSELKLRKEERDQSRVDGLILKDELKACSRSKRSLSQRLCETETNMLAIITKYQEELSLATAHEHRVADEYAQVYAEKEARGRVIDSLHQEATMWMDRFALTLNGSQELPRLLAKAKAMADIYSAPEEIHGLLSYCHHMIDLMAHIIRNR

SEQ ID NO: 143415 - protein, 65 aa, Glycine max
  Coding DNA Sequence Number=SeqID_51730
MMLSYNLRQDKIIIKLFKKQGNKNLDPVNDLDPWHAHSGPVLVQMMNPDERADPTLVQMAQAKEI

SEQ ID NO: 143416 - protein, 153 aa, Glycine max
  Coding DNA Sequence Number=SeqID_51731
MSEVHGTSMVIDQSLFFSLTHLPSQGAPFEGTIVDDWKFDYSSHDARRMVCNDQADMTVTSFGYRKDRNGQWLKKDALPPQDERTPSPPPQREDSALMNEVLSELRGLHSYVGDRFDSLDSRFAGMDIRLTQLEEDVGYIRQSFDLPPPPPSS

SEQ ID NO: 143417 - protein, 189 aa, Glycine max
  Coding DNA Sequence Number=SeqID_51732
METCPMVEELLQRLMDWGQLEVSKGDREEPQICMQSEEKKVPPTPKALVISFTRNVTGSRPMYPPTAPKPMSFAYQINKVVPWKYTPPAFGERAATEVDSLSAKVTNITGLSGVTRSGRVFAPPHSVELSSKGKAPMIQEPTNVATPSKEVDPPMVKWVKKNEGLQGKAMTLEEAHEFLRLIQQSEFKM

SEQ ID NO: 143418 - protein, 101 aa, Glycine max
  Coding DNA Sequence Number=SeqID_51733
MLPCYVARRDALNKNLPRAHHGEPTHLDGINRSPSMIGERARHCSVEWPGVFPWYAQVALGLYHFGKGGWCLAPIIRQFVKFGAWHPSLGEHRWKKACLLS

SEQ ID NO: 143419 - protein, 204 aa, Glycine max
  Coding DNA Sequence Number=SeqID_51734
  Gene Ontology: Mol. function=phosphoprotein phosphatase activity; Biological process=intracellular signaling cascade
  Homolog annotation: Hit_ID=A5C0F5; Match level="QueryCoverage=46%, HitCoverage=15%, E-value=1e-16, Identity=45%"; Hit description =Putative uncharacterized protein
  Pfam annotation: Domain name=DUF1723; Domain location=3-49; Score =45.0; E_value=2.6e-10; Accession=PF08330.1; Description=Protein of unknown function (DUF1723)
MLQVDSRGSPSLVEAETHTFHLTCGEATITLQDVSVLLGLPVDGNPLIGSTNIDGIDMCEQYLGVRPNANALADGNTLKLSWLASEFANIQDYVDDEEHLKIWLQNRNPHMASDSVEHCRFKLDTMKRGEPDRVMRQFGLQQPIPDPPLQPSNIHGLILKGKNGHNWRRLLLPALNEWNSLYERRFQETPPQVGLLSVNSEYMK

SEQ ID NO: 143420 - protein, 61 aa, Glycine max
  Coding DNA Sequence Number=SeqID_51735
RVPFAIQAAQLLGRAIGAGLFAITPAGERGMCCKAIKLGNARVFPEFDRVHDPDARTISRI

SEQ ID NO: 143421 - protein, 320 aa, Glycine max
  Coding DNA Sequence Number=SeqID_51736
  Gene Ontology: Mol. function=transporter activity; Cellular component= integral to membrane; Biological process=response to stress
  Homolog annotation: Hit_ID=A7MEM9; Match level="QueryCoverage=99%, HitCoverage=88%, E-value=1e-123, Identity=68%"; Hit description =Putative uncharacterized protein
  Pfam annotation: Domain name=Porin_1; Domain location=1-320; Score =578.5; E_value=6.8e-171; Accession=PF00267.12; Description=Gram -negative porin
MHYFSDNAAADGDKTYIRLGFKGQTQINDLMTGYGQWEYQFQGNRAETNTDANIGNKTRLGFAGLKFGNYGSVDYGRNYGVVYDVLAWTDVLPEFGGDSAYTDTYMLGRTSGVATYRNSNFFGLVDGLRFAVQYQGKNDSTSANGRSEIPKQNGDGYGASLGYTLGDSGVSLMSAISSADRTNSQDVATRLGRGDKAEAWGAGIKYDANSIYLASTYSETRNMTPITGGVANKTQNFEVVAQYQFDFGLRPSLGYVQSKGKDIEGIGDADIVKYVDVAMTYYFNKNMSAMVDYKINQLDDNNPLGINSDDVVAVGLTYQF

SEQ ID NO: 143422 - protein, 230 aa, Glycine max
  Coding DNA Sequence Number=SeqID_51737
  Gene Ontology: Mol. function=DNA-directed DNA polymerase activity; Cellular component=intracellular; Biological process=DNA repair
  Homolog annotation: Hit_ID=A7MEN4; Match level="QueryCoverage=87%, HitCoverage=57%, E-value=2e-80, Identity=71%"; Hit description =Putative uncharacterized protein
  Pfam annotation: Domain name=IMS; Domain location=1-222; Score=-0.1; E_value=1.4e-09; Accession=PF00817.11; Description=impBmucBsamB family
MAQAIRADILRETGLTASAGIAPIKFLAKIASDMNKPDGQYVITPQAMPDFLLTLPLSKIPGVGKVATKKLEEMGLRTCADVQQADLAQLLKRFGKFGRVLWERSNGIDDRDVVVERERKSLGVERTLGEDIHHWEQCLEIIDFLYAELDRRLSAIRPDKQIARQGVKLKFNDFQLTTQEHVWPVLNKDDMIAVARQAWDERRAGRAGAPAGAGVVMAELPLEERYSTVA

SEQ ID NO: 143423 - protein, 597 aa, Glycine max
  Coding DNA Sequence Number=SeqID_51738
  Gene Ontology: Mol. function=oxidoreductase activity; Cellular component=mitochondrial matrix; Biological process=hydrogen peroxide catabolic process
  Homolog annotation: Hit_ID=P17750; Match level="QueryCoverage=100%, HitCoverage=84%, E-value=0.0, Identity=72%"; Hit description =Peroxidase/catalase HPI
  Pfam annotation: Domain name=peroxidase; Domain location=387-597; Score=96.5; E_value=8.6e-26; Accession=PF00141.14; Description =Peroxidase
  Pfam annotation: Domain name=peroxidase; Domain location=80-382; Score=248.6; E_value=1.3e-71; Accession=PF00141.14; Description =Peroxidase
  Pfam module annotation: Pfam domain module=peroxidase::peroxidase; Domain location=387-597::80-382
MSTPENNDNAAASGKCPFHHGASEEKSVLARGAGSGTTNRDWWPNMLRVDLLNQHSSRSNPLSDTFNYREEFSKLDYAALKADIRALLTDSQSWWPADWGSYIGLFIRMAWHSAGTYRTIDGRGGSGRGQQRFAPLNSWPDNVSLDKARRLLWPVKQKYGQKISWADLYILADVWEPDMDVDWGHETEWLAHRHPESLANAPLGATEMGLIYVNPEGPEASGDPRSAAPAIRATFGNMGMNDEEIVALIAGGHTLGKTHGAAAASHVGVDPEASPLEAQGLGWHSSYGSGAGADAITSGLEVVWTQTPTQWSNYFFENLFKYEWVQTHSPAGAIQFEAVDAEAIIPDPFDPEKKRKPTMLVTDLTLRFDPEFEKISRRFLNDPQAFNEAFARAWFKLTHRDMGPKARYIGPEVPKEDLLWQDPLPQATHQPTSDDITDLKAKIAASGLSVSQLVSAAWASASTFRGGDKRGGANGARLALAPQNGWAVNASVTRDVLPVLQKIQQESGKASLADVIVLAGSVGIEQAAAAAGVAVQVPFTPGRVDARQDQTDVESFNVLQPLADGFRNYRRVQGGSSTETLLLDKAQQLTLSAPELT

SEQ ID NO: 143424 - protein, 116 aa, Glycine max
  Coding DNA Sequence Number=SeqID_51739
APHLRLQRTQGPLPLMLNRGFALPGEGLVVCFYQFLGHPPNNGGRPTVQAQPEEETIAQLLCIPGQDFTQTLQGDECGSDHAYKTLSVPREVQQGPRVSRFDYEPPSVLRIARRPQ

SEQ ID NO: 143425 - protein, 143 aa, Glycine max
  Coding DNA Sequence Number=SeqID_51740
MGGQEETQEQMKADMSALKEQMASMMEAMLGMRQLMENNVATAAAVSSAAEADPTLPATTHHPLPNAVGREMSTLGHTSNPHLGYNRVAYPYGLPPNYTPPVMRDDAGHVPSPILEGEPPRQADEVHEDHREYAQGDVDFYPP

SEQ ID NO: 143426 - protein, 136 aa, Glycine max
  Coding DNA Sequence Number=SeqID_51741
MASRKRKAPSTPTQVRFDRSKFISQEAWERYNDAIVPRNLLPERNVVVYYTEFDEFKEELERHHWDEELTDFGDNNIDVAIVKEFYANLYDPKDKSPKQVHIAKCTTLVNPLSEKSRAKSKFTNRLELEEEAVLRA

SEQ ID NO: 143427 - protein, 81 aa, Glycine max
  Coding DNA Sequence Number=SeqID_51742
MLKNSRESSRNYSLKRYGSASAWIFFTEIIFLGNFERGRSAKKGRSLPPSSLRRARLLPPEGWKDLEGPSGPDCYLYPLFY

SEQ ID NO: 143428 - protein, 62 aa, Glycine max
  Coding DNA Sequence Number=SeqID_51743
MASKDWTPPLCMKSDKGGSQLICGEANGKQVKMDPTRSFNINHFLGLLSHGLDGAYAIVFRT

SEQ ID NO: 143429 - protein, 171 aa, Glycine max
  Coding DNA Sequence Number=SeqID_51744
MSHHSSTVNGEGTSHEDPLSRILDELSSLMLWKEKLERKEKGKERVKINQDEKEKIREEERRKILNELRKEKHTSYSSHDLLDFTPIEEKRNESLKRLTLTSHTSMGIDNVEAYLDWEIRVEQQLKRMATSKSFCPHSYLKKDQGQGIFGAVPSKPKDDMGKTIEKQPPKA

SEQ ID NO: 143430 - protein, 39 aa, Glycine max
  Coding DNA Sequence Number=SeqID_51745
MPCGAFSYGVFPKKPNVRGGCPPLPWPWLTIGEVLDSRQ

SEQ ID NO: 143431 - protein, 139 aa, Glycine max
  Coding DNA Sequence Number=SeqID_51746
  Homolog annotation: Hit_ID=UPI0000ECBAF8; Match level="QueryCoverage =30%, HitCoverage=50%, E-value=8e-10, Identity=72%"; Hit description =UPI0000ECBAF8 related cluster
  Subcellular localization annotation: CTP_CleavageSite=38; ConfidenceScore=5.24e-01
MLLPSAVHVSSTFEFGAMFHDCLSADPQGNPPSSPFFRSQLLRRTTIECPSFPPFLTGKTLGLPNLIALHHLPLSPAGLLANRPAPIALPNLVLPNGEWDAPCIGALSAAGVVVTRSVTATLASADVRRCFCRYAPPRQ

SEQ ID NO: 143432 - protein, 104 aa, Glycine max
  Coding DNA Sequence Number=SeqID_51747
MKLTDVKEDHIFLKGFSSFFRESGKGLAILPCSKALGNSVERAYMNTRRDLKNYVPVTLTTRYSEQLLLQYLYEGLSNMERSMIDAASGGTLGDMTPAEARNLI

SEQ ID NO: 143433 - protein, 342 aa, Glycine max
  Coding DNA Sequence Number=SeqID_51748
  Homolog annotation: Hit_ID=Q6WAY6; Match level="QueryCoverage=85%, HitCoverage=61%, E-value=8e-32, Identity=30%"; Hit description =Putative uncharacterized protein
FYQVKEKGLDTTSIKELGRLMEPLQMQALRKTYGKILDLTIAEVSIEAIASLTQYYDQPLRCFTFGDFQLVPTIEEFEEILGCPLGGRKPYLFSGCLPSLSRIATVVKDSARGLDRVKQTRNGIAGLPRKYLEDKARDMAIQGDWVPFMDVLALLIFGVVLFPNVDGLVDLAAIDAFLAYHHSKESPVEQSIGSPDGRKERRESFFSCKGYPNIPLIGTRGCIKYNPALAIRQLGYPMRGAPMEESMSPFLVRDFGVQNFKAIQRIHKAWETPLRKDQELRGIRNDIIGGYHEWLKVHIRGLDWLAKLKVVSEDSFEASEEDEEVQALKNELGKAKLAKEKF

SEQ ID NO: 143434 - protein, 64 aa, Glycine max
  Coding DNA Sequence Number=SeqID_51749
MAFQCIKSTEAIVEAKLSKFILMMPKTQVKNQESNKFQRIKELFNQESRFKKRIKRRLKICKNH

SEQ ID NO: 143435 - protein, 162 aa, Glycine max
  Coding DNA Sequence Number=SeqID_51750
MTLLLSNILPSDRNANLPLRKYQLVCAVPTWGSHPQRHPVNLKKSNRALGFPALVTGLYQSYGVPVPPRQGHVIIGIATARHLVDPKKSNRVLELSSSNYGSLQAQGETPQQHWDGRQRETDAPPSPLEFTSAHPQKGFAYTTWPTNRRPSPKPNVRKVLGQ

SEQ ID NO: 143436 - protein, 163 aa, Glycine max
  Coding DNA Sequence Number=SeqID_51751
TKFGHSAPMIRGDTLWLFAPFCHPEAAGPMTSRDQVWSFCTHDTRRYLMVIRTLLSSRGGGPDDKQRPKTKFGHSAPMIRGDTLWLFAPFCHPEAAGPMTSRDQVWSFCTHDTRRYLMVIRTLLSSRGGGPDDKQRPKTKFGHSEPLYHPEAAGPMIRGKYPS

SEQ ID NO: 143437 - protein, 98 aa, Glycine max
  Coding DNA Sequence Number=SeqID_51752
LQVTAQIREEILKSCFLSQKSQVLQRGTCHREFGIGMPVIEEWTPAPTHLKLSKGMKSGQLVDRPEGTNVIGYQVDLHETTKPNAVEEFVITRIQGQT

SEQ ID NO: 143438 - protein, 74 aa, Glycine max
  Coding DNA Sequence Number=SeqID_51753
MTDPLDESISCFLIRVNPWVLVPSPSEDYTSSPSKGHVPSPSEDYTSSPSKGHVPSPSEDYTSSPSKGHVPSPL

SEQ ID NO: 143439 - protein, 131 aa, Glycine max
  Coding DNA Sequence Number=SeqID_51754
  Subcellular localization annotation: CTP_CleavageSite=27; ConfidenceScore=5.04e-01
MLLSSNVIYICVRVVMFVRMIRTRLFAAARVKSCPGMHSSRVIASLSGCARTVGPPPISGGGPGTVKRKLLVWMWSTLKMRTRSPLKVRAWSPLKARMCSPLEVRACSPLLARTCSPLQGEGVQPSVGEDV

SEQ ID NO: 143440 - protein, 222 aa, Glycine max
  Coding DNA Sequence Number=SeqID_51755
  Gene Ontology: Biological process=transposition, DNA-mediated
  Homolog annotation: Hit_ID=Q1J7G7; Match level="QueryCoverage=14%, HitCoverage=47%, E-value=2e-11, Identity=100%"; Hit description =Transposase
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPEFDPPNTAHNFHRTVLSKEQLFSKSQKDPATGEPGTESFPRPPFFSARLFALKNTGFYGRSATPGCRRRPWGDLVVPTGEIVHQAVRKGQLDPLPQDPK

SEQ ID NO: 143441 - protein, 233 aa, Glycine max
  Coding DNA Sequence Number=SeqID_51756
  Homolog annotation: Hit_ID=Q6UUU1; Match level="QueryCoverage=25%, HitCoverage=40%, E-value=3e-18, Identity=78%"; Hit description =Putative uncharacterized protein
MKHGSKLVGGGCMNENAIHGAPKKGREWRIALSNYYAWLQTRCMNENAIHGAPRKGREWRIALSNHYTWLQTRCMNENAIHGAPKKGREWRIALSNHYAWLQTRGCRMHERKRNSWGSEKGEAGPNGPPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 143442 - protein, 143 aa, Glycine max
  Coding DNA Sequence Number=SeqID_51757
MWAFLTGRQIDWAHLVGYRMHKALRANAPLPYPQLITLFLRHFQIPLDDEPFVQVKRSFAIGAGAVISFGYRKDQNGQWLKKDALPPQDERTPSPPPQRDDSALMNEVLSELRGLRSYVGERFDSLDTRFVGMDICLTQLEED

SEQ ID NO: 143443 - protein, 64 aa, Glycine max
  Coding DNA Sequence Number=SeqID_51758
MSPEQFQYIWRKTIPHIEVGMGSGVFTSHRSARRNEVLDRKGKWNDFFDSPPVSFGPKARIPAS

SEQ ID NO: 143444 - protein, 100 aa, Glycine max
  Coding DNA Sequence Number=SeqID_51759
MGVKYLEAVKRRLHATKQWSSDEIKGLRDRGSLVVKQSEHKGRVVLVWFKTCKGLLQDSGTLKRVAWGLNIGTRVWPNQYKSEFAIVLPLNSFIVYCIII

SEQ ID NO: 143445 - protein, 107 aa, Glycine max
  Coding DNA Sequence Number=SeqID_51760
MVGYTPSSFADLVFTDERIKAGMKGGKFNYSAWTNEKTGASEEGEDEGEARAMTAIPIQPSFPPTQQCHYSANNKPSPYPQPSYPQRPSLKSTTKPTYRTSNDKHHL

SEQ ID NO: 143446 - protein, 66 aa, Glycine max
  Coding DNA Sequence Number=SeqID_51761
MLKDLEARLTGALSKGGKMRGVATNEGINTSHVDKSGALAPTYPPSKRKSDLRSSFLRMNQAILFT

SEQ ID NO: 143447 - protein, 215 aa, Glycine max
  Coding DNA Sequence Number=SeqID_51762
  Homolog annotation: Hit_ID=Q84VH5; Match level="QueryCoverage=100%, HitCoverage=28%, E-value=2e-72, Identity=69%"; Hit description =Envelope-like protein
  Subcellular localization annotation: CTP_CleavageSite=24; ConfidenceScore=5.04e-01
MATSPKETSAPGSPSVPSSPSPTKAPSNQEQPEFHIQPIQMIPGQAPAPEKLAPKRQQGVKISENPSIATSPREVDPEMDKKIRSIVSSILKNASVPDADEDVPTSSTPNVSVADADKDVPTSSTPNVSVADADKDVPTSSTPNAEILSSPSKEDSTEEEDQATEETPAPRAPEPAPGDLIDLEEVESDEEPIANKLAPGIAERLQSQKGKTPIK

SEQ ID NO: 143448 - protein, 37 aa, Glycine max
  Coding DNA Sequence Number=SeqID_51763
MEALKEQMATMMEAMMSMKKIMEVNATAVAAISPVFG

SEQ ID NO: 143449 - protein, 165 aa, Glycine max
  Coding DNA Sequence Number=SeqID_51764
  Homolog annotation: Hit_ID=Q6UUU1; Match level="QueryCoverage=36%, HitCoverage=40%, E-value=1e-18, Identity=78%"; Hit description =Putative uncharacterized protein
ANWSSTAVAAALELVDPPGCRNSIKPQASYRALIGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 143450 - protein, 213 aa, Glycine max
  Coding DNA Sequence Number=SeqID_51765
  Homolog annotation: Hit_ID=A4PP05; Match level="QueryCoverage=60%, HitCoverage=36%, E-value=1e-11, Identity=32%"; Hit description=IMP dehydrogenase/GMP reductase, putative
CWIYEHFPSVHQCLTDDTYQETSPRASRWLTSKAHMKGITGAPYRARCDGLTVTDVSWLPYTEHRGFDYIQSIPPSPVSARLSHDQIDDRWMEFADHLLPAGQPCLVPGQVSADYIEWFFRISHPFMTPTQAADQQRDAPAADLEDYIQTPSPQVPVAFDPPPYVDDYEGYEAIAQRLEHVLNLRIVTAGTELYDIMQDCLTIARGGPSVDGT

SEQ ID NO: 143451 - protein, 88 aa, Glycine max
  Coding DNA Sequence Number=SeqID_51766
MELHQVAPPMMEREMITMIVDTLPVFYYEKMVCYMPSSFADLVFVGERIEVGLRRGKFDYPALMNRKPGENGENKKEGGTHVVTVVPT

SEQ ID NO: 143452 - protein, 15 aa, Glycine max
  Coding DNA Sequence Number=SeqID_51767
MGGANSNFRIWALLE

SEQ ID NO: 143453 - protein, 293 aa, Glycine max
  Coding DNA Sequence Number=SeqID_51768
  Homolog annotation: Hit_ID=Q84VH5; Match level="QueryCoverage=100%, HitCoverage=46%, E-value=1e-117, Identity=72%"; Hit description =Envelope-like protein
VPTSSTPNAEVLSSSSKEESTEEEDQATEETPAPRAPEPAPGDLIDLEEVESDEEPIANKLAPGIAERLQSRKGKTPITRSGRIKTMAQKKSTPITPTTSRWSKVAIPSKKRKEISSSDSDDDVELDVLDIKRAKKSGKKVPGNVPDAPLDNISFHSIGNVERWKFVYQRRLAVERELGRDALDCKEIMDLIKAAGTAEKLKSDEYPKVFVRGKCVRFSPAVINKYLGRPTEGVVDLAVSEHQIAKEITAKQVQHWPKKGKLSAGKLSVKYAILHRIGAANWVPTNHTSTVAT

SEQ ID NO: 143454 - protein, 113 aa, Glycine max
  Coding DNA Sequence Number=SeqID_51769
MEELISKTQLSPKIISMLSHRLGGSTKESHFLYSAAIILLPQTKVHDHHRYQPHDTKIARAEWRRKRERRRHFKEKMSLEEAHHHRRPWIRAWRKKEMNEGRGREEHEILCSK

SEQ ID NO: 143455 - protein, 51 aa, Glycine max
  Coding DNA Sequence Number=SeqID_51770
MDWIRREKVASLWRAEWKRFGLKSECVWMENDENVHPINRNDIKLVTKVRR

SEQ ID NO: 143456 - protein, 137 aa, Glycine max
  Coding DNA Sequence Number=SeqID_51771
  Homolog annotation: Hit_ID=Q84VH5; Match level="QueryCoverage=67%, HitCoverage=17%, E-value=9e-41, Identity=74%"; Hit description =Envelope-like protein
KLSVKYAILHRIGAANWVPTNHTSTVATESFAVKLPIAFPTVLCGIMLSQHPNILNNIDSVMKRESPLSLHYKLFEGTHVPDIVSTSGKAAASDSGIDDGEAAEEEEEAAEEEEAVEEEEDAAEDTESDDDDSEATP

SEQ ID NO: 143457 - protein, 156 aa, Glycine max
  Coding DNA Sequence Number=SeqID_51772
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=55%, HitCoverage=72%, E-value=3e-24, Identity=68%"; Hit description=LacZ protein
PLVVPIPVMFLGLFTSGIQALIFATLAAAYIGSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 143458 - protein, 27 aa, Glycine max
  Coding DNA Sequence Number=SeqID_51773
MLAPMAHGRQALTFNKVELVIACLSPL

SEQ ID NO: 143459 - protein, 157 aa, Glycine max
  Coding DNA Sequence Number=SeqID_51774
  Subcellular localization annotation: CTP_CleavageSite=43; ConfidenceScore=5.21e-01
MDCRPTTHHPSCKTMRAILLLPSLKESLLNSPTRSTKTLKTMLEGMSSSIPRTPKRPATQHVPHEHESRTQYAHSIHAEKTPATEEKEEARLYLEEETMWIGSFALVPCGMSMLTSPDLFTSARLDKYRQTTTPSPKIMGYLKMLSVAYDRLATLKD

SEQ ID NO: 143460 - protein, 49 aa, Glycine max
  Coding DNA Sequence Number=SeqID_51775
MFGDLMFLEVCLKAKDSLWYLDSGCSSHMTGDKSRLTDMVSKEGGYVTF

SEQ ID NO: 143461 - protein, 149 aa, Glycine max
  Coding DNA Sequence Number=SeqID_51776
  Homolog annotation: Hit_ID=Q2HW90; Match level="QueryCoverage=91%, HitCoverage=24%, E-value=2e-12, Identity=34%"; Hit description =Putative uncharacterized protein
MASQEKWGPFADILALLIFGVVLFPNVDGLVDLAAIDAFLAYHHSKESPVVAILANLFDTFDRRCEKNNARIVCCLPAFCVWLISHLFQHDTRHPCPLQSYRSCAEKERVDWDQHLAGIGGNAINWFPRWKEGKEGVLFSCGDYPNVPR

SEQ ID NO: 143462 - protein, 135 aa, Glycine max
  Coding DNA Sequence Number=SeqID_51777
MQQQQLQSQQRQQATEAPPQPSLEELVRQMTIQNMQFQQETRASIQSLTNQMGQLAVQLNQQQSQNSDRLPSQSVQNPKNVSAITLWSGKQCESSTGNSDLQKQHIPLPFPSRAISNKKMEEAEKEILETFRKVE

SEQ ID NO: 143463 - protein, 353 aa, Glycine max
  Coding DNA Sequence Number=SeqID_51778
  Gene Ontology: Mol. function=phosphoglycerate kinase activity; Cellular component=cytoplasm; Biological process=glycolysis
  Homolog annotation: Hit_ID=A1G1W4; Match level="QueryCoverage=99%, HitCoverage=89%, E-value=1e-165, Identity=87%"; Hit description =Phosphoglycerate kinase
  Pfam annotation: Domain name=PGK; Domain location=1-353; Score=409.7; E_value=4.4e-120; Accession=PF00162.10; Description=Phosphoglycerate kinase
MSIVRMTDLDLSGKRVLIRQDLNVPIENGRITSEQRITASLPTLKRALEQGAAVMVTSHLGRPKEGVWSEAESLAPVAQRLSELLGREVPLVRDWVDGVDVQPGQLVLLENCRMNVGEGKDDEALSKKYAALCDVFVMDAFGTAHRAQASTHGVIRFAPVAAGGPLLMAELDALAQALDAPAKPLLAIVAGSKVSTKLELLANLVGKVDQLIVGGGIANTFIAAAGYNVGKSLYEPDLLDTAKKIVADAKARGADIPLPVDVVTAKQFMPDAVAEVKAVDAVAEDDLILDIGPQTAAQYAQLIEKAGTVVWNGPVGVFEFEAFSKGTEALARAIASSPAFSIAGGGDTLAAST

SEQ ID NO: 143464 - protein, 15 aa, Glycine max
  Coding DNA Sequence Number=SeqID_51779
IVARVQIIFDDAVTG

SEQ ID NO: 143465 - protein, 77 aa, Glycine max
  Coding DNA Sequence Number=SeqID_51780
  Homolog annotation: Hit_ID=A3BZ28; Match level="QueryCoverage=61%, HitCoverage=20%, E-value=5e-07, Identity=51%"; Hit description =Putative uncharacterized protein
MKREEGREIDTWTEMRRVMQKRYVPTSYNRTMRQKLQRLSQGSLIVEDKEMEMELEFKDIFPTEIPHGLPPSRSIEH

SEQ ID NO: 143466 - protein, 56 aa, Glycine max
  Coding DNA Sequence Number=SeqID_51781
METAVSSALLRKQVDYIGYRRNFDEVDEKSIMAALEYSTVNIIGVHMDQVGWIREL

SEQ ID NO: 143467 - protein, 149 aa, Glycine max
  Coding DNA Sequence Number=SeqID_51782
MNRQSNSWGLRIRMGGGMHETAQGQSNFVGATGLNGGGCHERHSISWGLRIRFDDRDCMNSALAINSWGSGLNGGGCMNNNQFMGLRIRWWRMHEQRKAINSWGSGLYVGGCMNDIQFMGLRIRFDDRECMNSAWQSIHGAPDSMVEDA

SEQ ID NO: 143468 - protein, 209 aa, Glycine max
  Coding DNA Sequence Number=SeqID_51783
  Gene Ontology: Mol. function=tetracycline:hydrogen antiporter activity; Cellular component=integral to membrane; Biological process=response to antibiotic
  Homolog annotation: Hit_ID=Q2HTC4; Match level="QueryCoverage=40%, HitCoverage=11%, E-value=5e-26, Identity=70%"; Hit description =Conserved oligomeric Golgi complex component 4, related
  Subcellular localization annotation: CTP_CleavageSite=28; ConfidenceScore=5.20e-01
AQYANRLSPRVGRFINAAGTTGFPTGKRAVSATQLISVVAVLSGASSLLGNEYHEALQHKTREPNLGAKLFFGGVGVQKTGTEIATALNNMDVSSEYVLKLKHEIEEQCAERPPPRWSSNSPYSESYYNSLAVVLQRRDWENPGVTQLNRLAAHPPFASWRNSEEARTDRPSQQLRSLNGEWDAPCSGALSAAGVVVTRSVTATLASAD

SEQ ID NO: 143469 - protein, 96 aa, Glycine max
  Coding DNA Sequence Number=SeqID_51784
MTLSLRKTRQQVSRSPCHAQVTPPHGDQPESQGSSKPSDMPPSTSIFPHEKLRVLTDKACTISMQYEVWNMSIINALKVHVRSSKHRALYIKSKII

SEQ ID NO: 143470 - protein, 118 aa, Glycine max
  Coding DNA Sequence Number=SeqID_51785
  Homolog annotation: Hit_ID=Q6WAY4; Match level="QueryCoverage=99%, HitCoverage=21%, E-value=4e-09, Identity=33%"; Hit description =Putative uncharacterized protein
MQAFHKAYGKILHLTISEIFTEAVVSLTQYYDQPLRCFTFGDFQLVPTVEEFEEILGCPLGGRKPYLFSGFLPSMSKIAIVVRDSARELDRVKQTRNGVVGLPRKNLEGKARDMANQE

SEQ ID NO: 143471 - protein, 170 aa, Glycine max
  Coding DNA Sequence Number=SeqID_51786
MVMDMADTFGEGFCVKIAVLQHFKERFSEQNPCRPTLEGIQFSSLDQRQKESLVDRFTELEIKSAVWACGGDKILGSNPKAQQSDKSKEMMRSNTKAQQTEEPFVDSNPASKGHPLSSLYEDPIQLQCDILKEMGLSYEEEDSKVKGLLLDMENKDDLVAAEKGIKSQQL

SEQ ID NO: 143472 - protein, 135 aa, Glycine max
  Coding DNA Sequence Number=SeqID_51787
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=38%, HitCoverage=50%, E-value=4e-24, Identity=100%"; Hit description=LacZ protein
MELGQKNINFGSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 143473 - protein, 51 aa, Glycine max
  Coding DNA Sequence Number=SeqID_51788
MCEVEEVQGQMKADMETMKKQMTIMMEVMMSMKKIMEANAVVVAATSVVAK

SEQ ID NO: 143474 - protein, 245 aa, Glycine max
  Coding DNA Sequence Number=SeqID_51789
  Pfam annotation: Domain name=Transposase_23; Domain location=148-214; Score=-15.0; E_value=0.052; Accession=PF03017.5; Description =TNP1ENSPM transposase
MYNCVFYVQDSFEEQVTQGSFIPHGRQDVLTATIGRPEHPRRICAAGAGITIKKYFGSAPRTSRSSSSLPSKELQQLTQQIRDQLEELITEKVTRQLMASFNQMQSQIQSQMQSQGLALPPEPLVGPSGPRVSTKGSCVDPSGNDLETGDSDRCYGLYIEANPAHLVALGRVYEGSTVVHNTPLLPGQVKVGVEEVKDADAPVPVPTDEVAVSPTKPPQKPNPEVDDPLYLMRSTIPELFLRPYQ

SEQ ID NO: 143475 - protein, 75 aa, Glycine max
  Coding DNA Sequence Number=SeqID_51790
  Subcellular localization annotation: CTP_CleavageSite=53; ConfidenceScore=5.25e-01
MHALLGSFNSGNWSDSKVLDSTGLSCRTITRNQVLVKFSPTRGICGRCLIRIRLNYHEESGFSISGDTIGTHEHC

SEQ ID NO: 143476 - protein, 67 aa, Glycine max
  Coding DNA Sequence Number=SeqID_51791
MCLSGKGEYADEIFSITINEIFDVCTSFLNDHLEETLDPTKIGKKSLKVYQSPHRARIDILTLGQGL

SEQ ID NO: 143477 - protein, 380 aa, Glycine max
  Coding DNA Sequence Number=SeqID_51792
  Homolog annotation: Hit_ID=Q6WAY6; Match level="QueryCoverage=67%, HitCoverage=53%, E-value=2e-28, Identity=29%"; Hit description =Putative uncharacterized protein
VGCDTLQMQAFRKIYGKILELTIAEISIEAIASLTQYYDQPLRCFTFGDFQLVPTIEEFEEILGCPLGGRKPYLSSGCLPSLSRIATVVKDSARGDWVPFMDVLALLIFGVVLFPNIDGLVDLAAIDAFLAYHHSKESAKRVAHGSSVACPPSVFGWFHTYSSKTQGIHVRSRAIAREVEQSIGSPDGREGKEGVLFSCGGYPNIPLIGMRGCINYNPALAIRQLGYPMRGAPMEESMSPFLVRDFGAQNFKAIQRIHKAWETPLRKDQELRGIRNGIIGGYHEWLKVHIRGLDWLAKLKVVSEESFEAPEEDEEFQALKSELGKAKLAKEKFKLAATHIRKECAGLREENATTARALEQEAKRARKEEYGRNKFRGALW

SEQ ID NO: 143478 - protein, 51 aa, Glycine max
  Coding DNA Sequence Number=SeqID_51793
  Homolog annotation: Hit_ID=A5BQ62; Match level="QueryCoverage=84%, HitCoverage=2%, E-value=1e-08, Identity=67%"; Hit description =Putative uncharacterized protein
MVTVSTMLAVATTRAWELHQMNVHNAFLPEDLEEVVYMKPPLGLSFLNNMA

SEQ ID NO: 143479 - protein, 107 aa, Glycine max
  Coding DNA Sequence Number=SeqID_51794
SPHQLDLAPYASSPYDAQWNAPGILHDKHMLHSSRILGEMEVDEPWLGLWLPLNYQVDMGARMAFVDNWAVGKEKTHIDPFTGKDQIRKALKVPLELPGLSTFGRIL

SEQ ID NO: 143480 - protein, 89 aa, Glycine max
  Coding DNA Sequence Number=SeqID_51795
  Homolog annotation: Hit_ID=Q9SWB3; Match level="QueryCoverage=73%, HitCoverage=14%, E-value=3e-27, Identity=90%"; Hit description=Seed maturation protein PM39
MEHQRILGKVTESEEVKRRLGGESVVTEKKYQEMYVNSPGKGVVDKLKGMVGTWFTNPAENQSSQVFRFSYLGRSVLRNKGNYDYVCFC

SEQ ID NO: 143481 - protein, 73 aa, Glycine max
  Coding DNA Sequence Number=SeqID_51796
MAKFHPEIVMKLYANTWPIEEGVRDKRSWVRGQWIPFDEDAINHILGHPLVLEEGQRCDGMEKEKDEWRCHFK

SEQ ID NO: 143482 - protein, 89 aa, Glycine max
  Coding DNA Sequence Number=SeqID_51797
MEGCTRRSPAESPTVATYPSAGGRRETRGMRVPRKEYARSRHQRLFEENVGKTGKDAIYELLSEKVRELYLRTGKVLAPHTSAPRDGSL

SEQ ID NO: 143483 - protein, 376 aa, Glycine max
  Coding DNA Sequence Number=SeqID_51798
MAPKKLSAKRSRRDAAAEGTSATPEFDSHRFRSAEHQQRFEAIKGWSFHRERRAQLRDNEYTDFQEEIARRHWTSLVTPMAKFDPDIVLEFYANAWPTEEGVRDMRSWVKGQWIPFDVDSLSQFLGDPLVLEEGQECEFSQRRNKANGFDEEAIAQLLCTPGQYFTRTAAGSNILPSDHNSNLPLPKCQLVYAILTRMSVHVAQLIVDAIYLFAGMPPTRHPLDLDKSNRALGFPTLIMVLYQSFGVLVTPSKVIQPPITRAFIEKYCMPKQAQGDAPQAADAPLPPHQADPAGSLGMEHYLEHLVCQQAANHRGQGFAPFACPTPEQFRAEVAWPRDWPEAHAGEAPAGSPGDAEEARMDEEMTDLLGFLGGSGA

SEQ ID NO: 143484 - protein, 149 aa, Glycine max
  Coding DNA Sequence Number=SeqID_51799
PPDISAGKCSGRVPFAIQAAQLLGRAIGAGLFAITPAGERGMCCKAIKLGNARVFPVTTFSPRLASSSPGPPNSFMVKKLARLDELTASGFQGSEVEGIERREKEEEMRPGHYQAYRYRRPRGGARYQLLFPLVRVNFELGVIMVIAVS

SEQ ID NO: 143485 - protein, 87 aa, Glycine max
  Coding DNA Sequence Number=SeqID_51800
  Homolog annotation: Hit_ID=A6FJQ2; Match level="QueryCoverage=43%, HitCoverage=84%, E-value=3e-11, Identity=92%"; Hit description=50S ribosomal protein L5
MQLPETVNSLSVSGCREQTTPSGRVTGCCRMRKEKIPHQAPFAIQAAQLLGRAIGAGLFAITPAGERGMCCKAIKLGNARVFPVTTL

SEQ ID NO: 143486 - protein, 95 aa, Glycine max
  Coding DNA Sequence Number=SeqID_51801
MGYTVPKPQVWKHEEDKTTRLITHLPIYTSNELEEAKSTRPVVGWQGDRCATSLINEGGRQASLCQTIEVDYGTLYPCSKEEVMKARSMYSDWLS

SEQ ID NO: 143487 - protein, 75 aa, Glycine max
  Coding DNA Sequence Number=SeqID_51802
MNLFLSAVHVSSTIEAGAPRIDFLEPFAYPPPSTLIQRPIAIHLSSTIEAGAPRIDCLALFAYPPPSTLIRRPMN

SEQ ID NO: 143488 - protein, 205 aa, Glycine max
  Coding DNA Sequence Number=SeqID_51803
MDKEEGVQEQMKADLSALKDQMASITEAVLKLQKTIEDNATAAASNTAREAEPVLLPAINLGQDRNTMGFNRRYSPQAYPYGLPLDFTPRTAPDDLSQAPTFEGQLPPHANYPLQEDDERDAHLGPLLPLKDPAPQKTNSLLFPWRILSCGPHYWKIIWWWPYPGRSSSHHTPSGTTQMPHAHTIVEPLDTTLTLACHSSITCNT

SEQ ID NO: 143489 - protein, 161 aa, Glycine max
  Coding DNA Sequence Number=SeqID_51804
MWAFLIGRQIDWAHLVRYRIHKALRANAPLPYPQLITLFLRHFQIPLDDEPFVQVKRSFAIGAGAVTSFGYRKDRNGQWLKKDALPPQDERTPSPLPQREDSALLNEVLTELRGLRSYVGERFDSLDTCFAGMDICLTQVEEDVSFIRTCFDPPPPPPSSS

SEQ ID NO: 143490 - protein, 224 aa, Glycine max
  Coding DNA Sequence Number=SeqID_51805
  Homolog annotation: Hit_ID=Q6UUU1; Match level="QueryCoverage=26%, HitCoverage=40%, E-value=2e-18, Identity=78%"; Hit description =Putative uncharacterized protein
VPPVQLLTGWCVTAKAPPDISAGKCSGHAARRVPFAIQAAQLLGRAIGAGLFAITPAGERGMCCKAIKLGESFQSSLIKYDVGIGICCRCPLSGYLIFPNATSMSIEIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 143491 - protein, 40 aa, Glycine max
  Coding DNA Sequence Number=SeqID_51806
PWSDVATSWQRKSTKGHDRPSSLPGTRQAEDVAARQPNIL

SEQ ID NO: 143492 - protein, 134 aa, Glycine max
  Coding DNA Sequence Number=SeqID_51807
RTKIDVYAGTLSMEFGDIVVHFNILDAMKHPSEDHSIFHAEIIDQIVDDYMFDFDYVLHDRKHPFLSDLHVCHSSCIEYEFVLNHMAEFDAESESEIDIDYMSGDVLPLEIDFLESDRTNHVSGSTHTSDFLYK

SEQ ID NO: 143493 - protein, 331 aa, Glycine max
  Coding DNA Sequence Number=SeqID_51808
LGNNFVQRIDDPFQRCRPPQQVTLHLVAAVRGQPVQLPRRFHALGDDGQAHAVAQRQQRAADRGIARIGFHVGDEAAVDLQDVQRQVLQVGHAGIAGAEIIQRHADALLVQALHGLHRLRRLAHQAALGQLHVQGTAGQAEVLLRTGELGHQVAVEELHRRYIDRDRQLAPTGLDQPALRFRRRADHPAAQRQDQPGLLAQLDELVGRDEAAVGLRPAQQRLQGGRGAIAGMPDRLEIELEFVVDGGMDAPGQAQPVGQPCGHRRIEPDHHVALGACRVRGLRGHADHLLGTVAVTGSVHGHTDARFELVQRILATHRPDTICSRSSSTRG

SEQ ID NO: 143494 - protein, 89 aa, Glycine max
  Coding DNA Sequence Number=SeqID_51809
MTQKLVARGNTLRLSAPRHLVAPSAIDEQRPIWSFCTLCHPEAAGPMTCGDKIWSFRTPLPFRHSRVRWHAEKKFGHSAPFVIQRRRAR

SEQ ID NO: 143495 - protein, 100 aa, Glycine max
  Coding DNA Sequence Number=SeqID_51810
AKGPSGEGRRPKWRRTKAQVEKDKAPEWRRMKAQTYQGNPCGVYPDLSSFIGSGVYPDLSSLTGSGVYPDLSSFTGSGVYPDLSSFTGSGVIQIFVACIK

SEQ ID NO: 143496 - protein, 147 aa, Glycine max
  Coding DNA Sequence Number=SeqID_51811
MMAHQEERDQSRAHSMVLKEELAACSRSKRSLSQCLCKTETNMLAIVSKYQEELNLATAHEHKVADEYARVYAEKEARGRVIESLHQEATIWMDRFALTLNGSQELPRLLAKAKAMADTYSAPEVIHGLLSYCQRMIDLLAHIIRNR

SEQ ID NO: 143497 - protein, 234 aa, Glycine max
  Coding DNA Sequence Number=SeqID_51812
  Gene Ontology: Mol. function=intramolecular transferase activity, phosphotransferases; Cellular component=cytoplasm; Biological process=carbohydrate metabolic process
  Homolog annotation: Hit_ID=P36938; Match level="QueryCoverage=30%, HitCoverage=13%, E-value=4e-32, Identity=94%"; Hit description =Phosphoglucomutase
  Pfam annotation: Domain name=PGM_PMM_IV; Domain location=2-78; Score =41.3; E_value=3.6e-09; Accession=PF00408.11; Description =Phosphoglucomutasephosphomannomutase
MVSADTLAGDPITARLTAAPGNGASIGGLKVMTENGWFAARPSGTEDAYKIYCESFLGAEHRQQIEKEAVEIGILHEEGRVCGLFLWHEAIADAGFCQQVRRLGGVGFQLLPQVSHIDAQHFAGVIQQQAEQAKFGRRQMHLFAAAQHASRGEIDAYFAKLHQRFRLAALMTTQRHAHARQQFADTKRLGEIVVSAGIQRLYFILLIAARRQHNHRHAAPLPHFTDEGIAIAVR

SEQ ID NO: 143498 - protein, 390 aa, Glycine max
  Coding DNA Sequence Number=SeqID_51813
  Gene Ontology: Mol. function=oxidoreductase activity, acting on the aldehyde or oxo group of donors, NAD or NADP as acceptor; Cellular component=mitochondrial matrix; Biological process=metabolic process
  Homolog annotation: Hit_ID=A6UIJ3; Match level="QueryCoverage=82%, HitCoverage=64%, E-value=1e-143, Identity=79%"; Hit description =Succinic semialdehyde dehydrogenase
  Pfam annotation: Domain name=Aldedh; Domain location=1-319; Score =303.9; E_value=3e-88; Accession=PF00171.13; Description=Aldehyde dehydrogenase family
MVARKISPALAAGCAIVLKPAEQTPLVAGAMFVLARLAGFPEGALNLIYAGHGADVGAELCTNARIRKISFTGSTEVGRLLMSQCAPQIKKLNLELGGNAPFIVFDDADIDEAVEGAIQAKFRNGGQTCVSANRIYVQSAVHDEFSEKFVARVAELKVGDGFDPEVTIGPMIDSHAIDKIEAHLADAGARGGTIRCGGKRVGNGGTFFEPTVLTGVTSAMRVAQEETFGPLAPIIRFNDAEQVVREANDTIYGLAAYFYASNLKRVWRVAEALEYGMVGINTGRMSSEAAPFGGVKQSGIGREAAGRHGFPWIIALSNICAPATLAAISLSFINEKRRPLPLGVPTWLSGHSRVAKEGQEMTTSSNMIAGPLAMRFFPFAEDCHRRIAAG

SEQ ID NO: 143499 - protein, 246 aa, Glycine max
  Coding DNA Sequence Number=SeqID_51814
  Pfam annotation: Domain name=Transposase_23; Domain location=25-97; Score=-13.5; E_value=0.036; Accession=PF03017.5; Description =TNP1ENSPM transposase
VLAARVSTKGSCAATETNALAKKPSKLNGDNVGLHVTAENSNKLVAVGKQCDSFGTIHNVPYADDVVPVSMVEVIFGDAEVPIPTSEIKFVKEALGSFVPWPTHLEAEKDVSSPLKTVEEEKVAEVIDPLGELVKNLFDIYQRPVEVSWDGAKFGINNVKDGFFIIHADVSEIILGDKCLNISILLLWLMFIHDWSASIGYGALYGFLEPQCIHNASSRRQECENYIGRWLKEAGKQIYIAPYLNQ

SEQ ID NO: 143500 - protein, 163 aa, Glycine max
  Coding DNA Sequence Number=SeqID_51815
  Homolog annotation: Hit_ID=A5AK77; Match level="QueryCoverage=47%, HitCoverage=9%, E-value=1e-08, Identity=39%"; Hit description =Putative uncharacterized protein
MTRGNPSDLQPFDPEIYRTFHRLVRHHFIPFDHSEHSITGESVHSVIGDFEHPDLEHYNFEHSDSEHSDFAHSENMAQPPPRERTLREMAVPDFTYESLCIQYPDEDVPYVLKTGLIHLLPKFHGLAGEDPHKHLKEFHIVCSTMKPPDVQEDHIFLKAFPHS

SEQ ID NO: 143501 - protein, 95 aa, Glycine max
  Coding DNA Sequence Number=SeqID_51816
MVKVGTSYVPINVSSSPKVGPGLPGINRDTWIYLFCEVIFRHSRPSCSATDGVSAQLYGRAIVAGLFAITPAGERGMCCKAIKLGNARVFPVTTL

SEQ ID NO: 143502 - protein, 103 aa, Glycine max
  Coding DNA Sequence Number=SeqID_51817
  Homolog annotation: Hit_ID=UPI00006A17C9; Match level="QueryCoverage =92%, HitCoverage=97%, E-value=9e-09, Identity=34%"; Hit description =UPI00006A17C9 related cluster
  Subcellular localization annotation: CTP_CleavageSite=60; ConfidenceScore=5.50e-01
MRACSPLKERTCSPLMVRACSPQMVRTCSPLKARTLPKVRACSPLKARTCSPLMVRACSLCGEGNYKVRTCSPLKARTCSPLEVRACNPLMVRTCSPLNGEGN

SEQ ID NO: 143503 - protein, 302 aa, Glycine max
  Coding DNA Sequence Number=SeqID_51818
  Homolog annotation: Hit_ID=Q2HW90; Match level="QueryCoverage=97%, HitCoverage=57%, E-value=3e-30, Identity=31%"; Hit description =Putative uncharacterized protein
MVPTIEEFEEILGCPLGGRKPYLFSRFLPSMSKIAVVVGDSARELDRMRQTRNGIVGLSRKYLEGKARDRASQEKWGPLADILAFLIFGVVLFLNVDGLVDLAAIDAFLAYHHSKESPVVAILADLFDTFDRRCEKNSARIVCCLPTLCVWLVSHLFQQDTRHPCPLQSYHSCAKKGRFDWDQHLAGIRGSAINWFPDWKEGKEGIFFSCGDYPNVPLIGTRGCINYNPTLAIRQLGYPMRGAPTEESLSPFLMRDLGTKSLKVIQRVHEAWRSPLKKDKELRGIRNGVIGGYHGWLRVHTR

SEQ ID NO: 143504 - protein, 174 aa, Glycine max
  Coding DNA Sequence Number=SeqID_51819
VHEVAMDSSLSTENKKLEGKLDALVNLVTQLAMNQKSAPVARVCGLCSSADHHTDLYPSLQQSGVNEQPEAYAAKIYNRPPQQQNQQQQNNYDLSSNRYNPGWRNHPNMRLPSPPQQQQQPFPPFQNTVGPSKPYVPPPMQSDNQIQVPPLVAGLAPEPVKLHSTLEKEDEIVA

SEQ ID NO: 143505 - protein, 86 aa, Glycine max
  Coding DNA Sequence Number=SeqID_51820
MAILIPSTSPQSVLRCHEACKALEGHSTKCDYAWKCQWGPRIFSLDSFASWKMNGSGMEKGMNHSLPLEEETPLQGEDESRRSSPP

SEQ ID NO: 143506 - protein, 70 aa, Glycine max
  Coding DNA Sequence Number=SeqID_51821
MLPDVYKKVFADSYQHGAPLSRGARGDFDRMNRNRFGETRSMRYAAAIFPIANYLTRWMEGPPTQARNQC

SEQ ID NO: 143507 - protein, 85 aa, Glycine max
  Coding DNA Sequence Number=SeqID_51822
MKDMHNSSDSLNSRPKNNEDLNLENKCTKISGLILSQWVQKVYPKELKRTLGLFLRRCSDTHDASVELVGLGVFYPMESFSLEGG

SEQ ID NO: 143508 - protein, 143 aa, Glycine max
  Coding DNA Sequence Number=SeqID_51823
HPLDPDKSNRALGFPALIIGLCQSFGVPVAPSKAADAPPPHQAGPAESFDTEQYLRHLVRQQAANHWAHVQTHDYLYQMSLSLQSQGFTYFPCLTPDQFRAEVAWPEARAGEAPAEAPDEADEALEDEEMTDLLDFLGGSGAT

SEQ ID NO: 143509 - protein, 115 aa, Glycine max
  Coding DNA Sequence Number=SeqID_51824
RHRPTASARRQWVHQMTADARDMAEDVADMIEDVPDLAEEAPEMTTDVQGTDGAEGSNVDDAEGFPGGPRDPSVLTSFADHVAHAVWSGQERPDLKLVSHGRKVTLIGRSAPEIE

SEQ ID NO: 143510 - protein, 72 aa, Glycine max
  Coding DNA Sequence Number=SeqID_51825
  Homolog annotation: Hit_ID=A0ST23; Match level="QueryCoverage=37%, HitCoverage=55%, E-value=2e-08, Identity=100%"; Hit description =Putative reverse transcriptase
AIMKQSSKLEGGGHMNSARQINFMDTVNRREGPVGKPVVPAALMNRPTRGERRFAYWALAVCILAYYVGTDD

SEQ ID NO: 143511 - protein, 106 aa, Glycine max
  Coding DNA Sequence Number=SeqID_51826
MKARVIGGRITLLGVTGTPNDCQRPVINARNPRALNQLSHMDAHPCQDGIHQLTLRQRKVGVMITRQDITEQQCHPYLGQGGHAGAHDPHPASCSGPDKILAQCAL

SEQ ID NO: 143512 - protein, 57 aa, Glycine max
  Coding DNA Sequence Number=SeqID_51827
MRTHSPLKARACSPLKVRACSPLKIDCPSKRGDNSCNLILSLLISPGTPLECLFCLI

SEQ ID NO: 143513 - protein, 180 aa, Glycine max
  Coding DNA Sequence Number=SeqID_51828
VSTGLSAAIDEGRRRRRLSPRAIRLFVLQIAKKNVYTDNHSGISARQHDSNVSMTDLVSAEDDVILRVSTGLSAAIDEGLVILQTAKKKVYTNNHTGISARQRDTNVSMTDLLSADDDTAKKNVYTDNHSGISARQHDSNVSMTDLVSAEDDTTKKNVYTDNQSRISARQRDSNVNMTDL

SEQ ID NO: 143514 - protein, 93 aa, Glycine max
  Coding DNA Sequence Number=SeqID_51829
  Subcellular localization annotation: CTP_CleavageSite=40; ConfidenceScore=5.10e-01
MDFILACRSDIRQIPFLSVTCSRKCAKNHDHAVNVSPSTTATARGRTPPFPSCDVAIKRVPRYLSYKCVPSTYMIGLQYLKASLHWPKVQKTL

SEQ ID NO: 143515 - protein, 213 aa, Glycine max
  Coding DNA Sequence Number=SeqID_51830
  Homolog annotation: Hit_ID=A5AZW9; Match level="QueryCoverage=67%, HitCoverage=30%, E-value=2e-17, Identity=44%"; Hit description =Putative uncharacterized protein
ESPARTTRASFPACGSSVITYSDLRELADRSLSGDAPSSMSEPFRNWLGMGVTIPALIQPEEEIAMHLAQLARRSLEWECSVGAGGPPVPRQHLEVHLVVLHETRDIPHSMAWHLSLIHSARPDAAPFFIIIYRPFFPPGYSRMKIVVCMLDFGCRISHPGKPTLLQEELCYALPIPIERKSCLVIPRLQHVRSLTPRAAAAVSRTDRRLACT

SEQ ID NO: 143516 - protein, 76 aa, Glycine max
  Coding DNA Sequence Number=SeqID_51831
QGEQPQQLGDDRQRATDALPPPLEFTSAHPQKVRALPMTHGRPIGDQVQGQRTHLVAHDPGNLNKTSASSEGSKIP

SEQ ID NO: 143517 - protein, 66 aa, Glycine max
  Coding DNA Sequence Number=SeqID_51832
MVEINQGKTMTGQDWSRIFVSYLQVSSPGRVELAWASNPCTQIIKNEGGERFGIQKLPPPPPSFKR

SEQ ID NO: 143518 - protein, 124 aa, Glycine max
  Coding DNA Sequence Number=SeqID_51833
MCPPEKVKTNGVQKKPMTKHQRSTKRDSSYWENVDALHFVQNSNSLVKHSALSSKQAIPRRTLPILDQFHPCIHDSIENIVDVKADDNCGYRAIVVLLAICFKNLPNDLMSISTCLVAWTYLRN

SEQ ID NO: 143519 - protein, 190 aa, Glycine max
  Coding DNA Sequence Number=SeqID_51834
MATMMEAMMSMKKIMEANVIAVAATGVVAKVNPTPPSGLNQMNHPTSDMVGKDLGSTGGPHYVQIQNKHAFPPYGLPPNYTPPNVAYTPSENVNNSTTILIKSQQPQSNHAHVSQPMRETHEIPYHNLADFEPCLGLPLKGKQLVVYPYKILWRGLNFAPNHNPFMEKWWVTHLHALRIWYLSAKGSQRV

SEQ ID NO: 143520 - protein, 78 aa, Glycine max
  Coding DNA Sequence Number=SeqID_51835
YIKQKGNKNEEKEGVLKQAQPNTRAKRASGAKQAKKTGAKRGVELEDVESVTRAKPQLRAKRAIQQKHRLSLQGALSA

SEQ ID NO: 143521 - protein, 334 aa, Glycine max
  Coding DNA Sequence Number=SeqID_51836
  Gene Ontology: Mol. function=4 iron, 4 sulfur cluster binding; Biological process=pyrroloquinoline quinone biosynthetic process
  Homolog annotation: Hit_ID=P27507; Match level="QueryCoverage=55%, HitCoverage=48%, E-value=4e-91, Identity=84%"; Hit description =Coenzyme PQQ synthesis protein E
  Pfam annotation: Domain name=Peptidase_M16; Domain location=173-281; Score=0.6; E_value=0.00031; Accession=PF00675.11; Description =Insulinase (Peptidase family M16)
ADDVELATCQFYGWAHLNRQGLLPTREQIARAEAVVARYRERMGSSGNLTNLLFVTPDYYEERPKPCMGGWGSIFLSVTPEGTALPCHSARQLPVQFPSVLEQSLEDIWYNSFGFNRYRGFDWMPEPCRSCDEKEKDFGGCRCQAYMLTGDADNTDPVCSKSPHHGKILEARREASCSDIKIAQLHAGFTGDERLMPWLQQQGGQVNATTQLSRSAWFFQLPAQALAAGVARLADMLAAPLLTGTAITQEAAVIEAEFQLLRHHAETLSEAALLDAAGGALRRFRVGSAACFGDNVTELQQALRLFHQQHFVAANQQLWLSGPQSLDELQQLAE

SEQ ID NO: 143522 - protein, 282 aa, Glycine max
  Coding DNA Sequence Number=SeqID_51837
  Gene Ontology: Biological process=transposition, DNA-mediated
  Homolog annotation: Hit_ID=Q6UUU1; Match level="QueryCoverage=21%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPVTTLNSMLAQPAATGAPGADAAGAGLPGPGPGRGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 143523 - protein, 170 aa, Glycine max
  Coding DNA Sequence Number=SeqID_51838
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=30%, HitCoverage=50%, E-value=6e-24, Identity=100%"; Hit description=LacZ protein
MVVIQHFQVVVQNAAGAEEHGQAQAQAGQHRPRQRLARQLQPAVPASNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 143524 - protein, 115 aa, Glycine max
  Coding DNA Sequence Number=SeqID_51839
DCARKTPSGPEEGQQGLGIANSKYGSLSVIGSVCRPQQGHQAPYQSSFHQEVLRPQAGAGRNTTAALGWPVAGNRHTATTSKVHLNSSIKWLERCLRHMADQQATQSKAKDKQKY

SEQ ID NO: 143525 - protein, 32 aa, Glycine max
  Coding DNA Sequence Number=SeqID_51840
EVQEQIKADMEAMKEQMVTMMEAMMSMKKMLE

SEQ ID NO: 143526 - protein, 222 aa, Glycine max
  Coding DNA Sequence Number=SeqID_51841
MTHEHKVADEYARVYAEKETRGRVIDSLHQEATMWMDRFALTLNGSQELPRLLAKAKAMVDAYSAPEEIHGLLSYSQHMIDLMAHIIRSRWGVYIVAQILTKNQCASDHFHISSLAYIHFSLRTPLTFDLFRKDAITKCAPRHPYRTRSKSRMMGDLEEVQEQMKVDMSALKEQMSSMMDAMLGMKQLMESNAATAATVSSTAEADPTLPTVAHHPIPNMVG

SEQ ID NO: 143527 - protein, 47 aa, Glycine max
  Coding DNA Sequence Number=SeqID_51842
MWTTMGEMLAAQLAQASRVASSRSNNLLEEYSGGPSGPGCYLHPHFY

SEQ ID NO: 143528 - protein, 200 aa, Glycine max
  Coding DNA Sequence Number=SeqID_51843
  Homolog annotation: Hit_ID=UPI00006A2D9E; Match level="QueryCoverage =86%, HitCoverage=85%, E-value=2e-12, Identity=16%"; Hit description =UPI00006A2D9E related cluster
MRGTVHEPQVNIGADQKGLHVLANRGLHALTLRGLYVLTFRGLHVLTFRGLHALAIRGLRVLTFRGLHALAIRGLHVLTFRGLHALTFRGLHVLANRGLHALTLRGLHILANVGLHALTFRGLHILTNRGLHALTFRGLHILAFRGLHVLTLRGLHVLALRGLHVLALRGLHVLTIRGLHALTSRGLHVLALRGLPALAL

SEQ ID NO: 143529 - protein, 261 aa, Glycine max
  Coding DNA Sequence Number=SeqID_51844
  Gene Ontology: Biological process=transposition, DNA-mediated
  Homolog annotation: Hit_ID=Q6UUU1; Match level="QueryCoverage=22%, HitCoverage=40%, E-value=3e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPVTTLNSIKKSQEPVGSLGTGLRHRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 143530 - protein, 91 aa, Glycine max
  Coding DNA Sequence Number=SeqID_51845
  Subcellular localization annotation: CTP_CleavageSite=59; ConfidenceScore=5.41e-01
MVRTCSPLKARTCSPLKVRACNPLLARTCSPLKAWTCSPLKVRTCSPLKAIGTSTQGSTLMRKQEIDSSRGPVIPNPQDLDIRCRKSMQLT

SEQ ID NO: 143531 - protein, 144 aa, Glycine max
  Coding DNA Sequence Number=SeqID_51846
  Subcellular localization annotation: CTP_CleavageSite=61; ConfidenceScore=5.30e-01
MHMNVGYHISHQISLIAQHDTSRLGFPALITASLTFRGPKKARGKRFEAPSTSASEAPTPSSSTVPPSSSTQIPVIPPAPTQIPLPAPLSAEPTDFIFTPQMLHSMLQSIHKGQSIIMQSLQGLGLPSIMSMKEFETQVAWPGD

SEQ ID NO: 143532 - protein, 67 aa, Glycine max
  Coding DNA Sequence Number=SeqID_51847
MKMLFIPHDVAPCGACRPWIFFINGVLCFLKFDGSRMEKEKYDWRCHLKDKMSLEEAYHHRKPWIRA

SEQ ID NO: 143533 - protein, 100 aa, Glycine max
  Coding DNA Sequence Number=SeqID_51848
  Subcellular localization annotation: CTP_CleavageSite=17; ConfidenceScore=5.73e-01
MLCKKAVSSFGPPIVVRSKLAAVLSLMVMAALHNSLTVMPSVRCFSVTGVSRGPFVSRVSVMTVKTSDTSAPETSQLSVSDAGADKPVRRVSGVGGVGLA

SEQ ID NO: 143534 - protein, 211 aa, Glycine max
  Coding DNA Sequence Number=SeqID_51849
  Homolog annotation: Hit_ID=A5C6C3; Match level="QueryCoverage=97%, HitCoverage=59%, E-value=2e-50, Identity=42%"; Hit description =Putative uncharacterized protein
  Pfam annotation: Domain name=DUF821; Domain location=1-205; Score= -4.1; E_value=4.3e-19; Accession=PF05686.3; Description=Arabidopsis thaliana protein of unknown function (DUF821)
AEINIKPWHILLGGLKEGTTRIPWLNREPYAYWKGNPAVAQTRQDLMKCNVYENQDWNARLFAQDWFREYKRGSTNQTCQVNALIDIRCTLKVLLGQSVKNTFCHVTLPLYVYDYMFHLLNSYAKLFRYKPSISANATELCVESMVCGAEGSVKKFMMESLVKVPANTDPCTMPAPFDPPTLYATLERKESSIQQVESWERSYWDNQTITS

SEQ ID NO: 143535 - protein, 174 aa, Glycine max
  Coding DNA Sequence Number=SeqID_51850
  Homolog annotation: Hit_ID=A1FT33; Match level="QueryCoverage=18%, HitCoverage=9%, E-value=1e-08, Identity=96%"; Hit description =Luciferase-like
MVKVGTSYVPINVSFSPKVGPGLPGINRDTRIYLFCEVIFRHSCPSCSATDGVGFPSHDVVKRRPVNCNTTHYRANWSSTAVAAALELVDPPGCRNSIRTDPGRTERVARHSRGPPLSEDATVSYQISVLDKSPVAEGASPEQALRNSLQLAQRIKLIDTVDLEGGPGTSFCSL

SEQ ID NO: 143536 - protein, 203 aa, Glycine max
  Coding DNA Sequence Number=SeqID_51851
MTGPLNESISCFLKRVDPWVLVPSPSEDYMSSPSEGCTPSPSQDYTSLPSEDCTSSPSEGYMHALKGLRVLTFRGLHALAFKGLLALILRGLRVLTFRGLHALAFRGLLALILRGLRVLTFRGLHALAFRGLHALTFRGLHVLTFRGLHVLSIRGLHVLAFRGIHVLTFRGLHVLAFRGLHALSFSGLHTLTFRGLEALAFKG

SEQ ID NO: 143537 - protein, 177 aa, Glycine max
  Coding DNA Sequence Number=SeqID_51852
  Gene Ontology: Mol. function=protein binding; Biological process =xylan catabolic process
  Homolog annotation: Hit_ID=Q9SDM7; Match level="QueryCoverage=96%, HitCoverage=29%, E-value=2e-53, Identity=66%"; Hit description =Putative uncharacterized protein
  Pfam annotation: Domain name=LRR_1; Domain location=101-120; Score =10.8; E_value=3; Accession=PF00560.24; Description=Leucine Rich Repeat
  Pfam annotation: Domain name=LRR_1; Domain location=129-150; Score =7.0; E_value=15; Accession=PF00560.24; Description=Leucine Rich Repeat
  Pfam annotation: Domain name=LRR_1; Domain location=34-56; Score=1.7; E_value=1.5e+02; Accession=PF00560.24; Description=Leucine Rich Repeat
  Pfam annotation: Domain name=LRR_1; Domain location=59-81; Score=9.7; E_value=4.9; Accession=PF00560.24; Description=Leucine Rich Repeat
  Pfam module annotation: Pfam domain module=LRR_1::LRR_1::LRR_1::LRR _1; Domain location=101-120::129-150::34-56::59-81
VNSGWVTPFQLEYVLLSSFGIGPKFPEWLKRQSSVKVLTMSKAGIADLVPSWFWNWTLQTEFLDLSNNLLSGDLSNIFLNSSLINLSSNLFKGTLPSVSANVEVLNVANNSISGTISPFLCGKENATNKLSVLDFSNNVLSGDLVTVGASPGAAVKLCLGDLLVMGSNPETASLHMQ

SEQ ID NO: 143538 - protein, 57 aa, Glycine max
  Coding DNA Sequence Number=SeqID_51853
MDQIRHTSCPFEAHYDENHETGLIQANHETGLIQAKGPSGEGRRPKWRRTKPPSGEG

SEQ ID NO: 143539 - protein, 137 aa, Glycine max
  Coding DNA Sequence Number=SeqID_51854
MVAGNTTIEKPREEWSEEEKRLVQYNLKAKNIITSALGMDEYFREHEMELQRLNQHEENDKKKKGIALKVSSSIQEESDIEDSIDLDEDEDLSLFVKRFNKFIRMKGNQRRKTSNLKEELKSHLKSQNALSAINPNI

SEQ ID NO: 143540 - protein, 262 aa, Glycine max
  Coding DNA Sequence Number=SeqID_51855
  Gene Ontology: Mol. function=serine-type endopeptidase activity; Biological process=proteolysis
  Homolog annotation: Hit_ID=UPI0000E87AF7; Match level="QueryCoverage =93%, HitCoverage=72%, E-value=3e-43, Identity=34%"; Hit description =Sel1-like repeat
  Pfam annotation: Domain name=TPR_1; Domain location=183-216; Score =17.0; E_value=0.049; Accession=PF00515.19; Description =Tetratricopeptide repeat
  Pfam annotation: Domain name=TPR_1; Domain location=217-250; Score =2.7; E_value=2.6; Accession=PF00515.19; Description=Tetratricopeptide repeat
  Pfam annotation: Domain name=TPR_2; Domain location=183-216; Score =20.5; E_value=0.0061; Accession=PF07719.8; Description =Tetratricopeptide repeat
  Pfam annotation: Domain name=TPR_2; Domain location=217-250; Score =14.8; E_value=0.33; Accession=PF07719.8; Description=Tetratricopeptid e repeat
  Pfam module annotation: Pfam domain module=TPR_1::TPR_1::TPR_2::TPR _2; Domain location=183-216::217-250::183-216::217-250
MSGGAAYHAVGVKPDWEHDVCMLQMEDLPLTPVTMKSSRELKYEQPVFTIGYPSFVPAPVSTSGVVKGLFTMDDSVIVRATSTFRQGASGGGLFDDSGALVGLITLKSPGKDAYYYYMSVDWIQALISKPAGPIVVKSELPFWGKPAAEWPYFMKVVYPYLHKDWKGLKVIAEQWAAKEPQNTEAWFYLAAAEYETQDFTIAEQHLHRVLSMNDQHSQAFYYLGMIAEASGKHGEAMASVDALKQLDAEAAEALTVAMKSLP

SEQ ID NO: 143541 - protein, 111 aa, Glycine max
  Coding DNA Sequence Number=SeqID_51856
MALKRSLVTSLEDFFFVPACRFHGSSWCGVSTENNGILWWLLVAVGDGERAWNVGNGFGRKKEKEMAFFQSYLDYKAQNAQVTKALGNGSVTHTPDVFPKIPTVRSWKIVL

SEQ ID NO: 143542 - protein, 40 aa, Glycine max
  Coding DNA Sequence Number=SeqID_51857
MEVGSWKLEVGSWNENYWKLKVENGGWKLEVGRGKIIVHS

SEQ ID NO: 143543 - protein, 163 aa, Glycine max
  Coding DNA Sequence Number=SeqID_51858
  Subcellular localization annotation: CTP_CleavageSite=80; ConfidenceScore=5.25e-01
GSHPQRHPVDLKKSNRALGFPTLVMGLCRPYRAAVPPSKFISSWHRDRARKTLLWTRRSPTGSWSCQALITGLCQFYEVPVTSSKGIRPPTNRAFIKKYCVSRQAQGETPQQPGDGRQRATDAPPSPLEFTSAHPQKGLSIAYTTWPTNRRPSPKPKDAPSCS

SEQ ID NO: 143544 - protein, 170 aa, Glycine max
  Coding DNA Sequence Number=SeqID_51859
RDSKVSMTDLVSAEDEGAKDDVNLCVLSGFSSYRQQKVYTDNHSGISARQRDSKVSMTDLVSAEDDGAEDDGSLCVLLGFSSYRQQKVCTDNHSGISARQRDSKVNMTDLVSAEDDAFRLTDSKKFIRIATQGAEDDASLCVLSGFSSYRQLKVYTDNHSGISARQRDSK

SEQ ID NO: 143545 - protein, 48 aa, Glycine max
  Coding DNA Sequence Number=SeqID_51860
GVSSLSSFFIPLPFIFQEAKESIDEEYSRPTSANGAYITSCGIKSIFI

SEQ ID NO: 143546 - protein, 141 aa, Glycine max
  Coding DNA Sequence Number=SeqID_51861
MTTLTQIWMKLLLSNILPSDHNANLPLRKYQLGSRQQGTQWTQRCPTGPGGFQLWLQASVIPIGCPSPPPPTRSCHRDIGVGRDTTTAWRWPAAGNRCTATTSKAPQLIYKGWSVAYDSWSTSKRPSPKSKVARYLGYACI

SEQ ID NO: 143547 - protein, 91 aa, Glycine max
  Coding DNA Sequence Number=SeqID_51862
MHMRIKRSLKVVMGPGARKRNIGSKGLSKELIQGRLIWLEAYKSKMPKSSPNMHVNQEVSTRVKPRLLCKQSMGQNTPNKIDDDGSKSHQG

SEQ ID NO: 143548 - protein, 161 aa, Glycine max
  Coding DNA Sequence Number=SeqID_51863
  Homolog annotation: Hit_ID=UPI00016621D1; Match level="QueryCoverage =92%, HitCoverage=28%, E-value=1e-08, Identity=28%"; Hit description =UPI00016621D1 related cluster
AQDALTFRGLHILPFRRLHVLAFRGLHALAFRGLHVLPFRGLHVLTFRGQHVLAFIGLHVLPFSGVHVLTFQGLHILAHQRTTRAHLQRTTHPRLQRATHRHLQRTTRPHLQRATRSTFRGLHVLAFRGLHVLAFRGLHVLTFRGLHALPFKRTHASPLED

SEQ ID NO: 143549 - protein, 26 aa, Glycine max
  Coding DNA Sequence Number=SeqID_51864
MTKPNDASSVPNTPLDARRFSRASNP

SEQ ID NO: 143550 - protein, 114 aa, Glycine max
  Coding DNA Sequence Number=SeqID_51865
MGACGWLKDNDEKKNKERVEKEMRKMMKWRLVKKWKKKCGASATTISSNLKDVKEALLGGNPVFLNFVLIFVTLILCLICLKLTLIIAWPRDRPIFQEEDEDMADPVDYFIGGD

SEQ ID NO: 143551 - protein, 44 aa, Glycine max
  Coding DNA Sequence Number=SeqID_51866
MGAKYLEVVKRGSHPNNEWSPDEIRMFTQSPPNLTVLAVVHAAM

SEQ ID NO: 143552 - protein, 88 aa, Glycine max
  Coding DNA Sequence Number=SeqID_51867
RVPFAIQAAQLLGRAIGAGLFAITPAGERGMCCKAIKLGNARVFPVTTLNSISPRRCASSANACDGSSRPAMPRSIKLIDTVDLEGGP

SEQ ID NO: 143553 - protein, 169 aa, Glycine max
  Coding DNA Sequence Number=SeqID_51868
MTFLGETSSQTIVNSRLAFIFPNGSIIHNDTGVYFQTSTPMLIQVPNSCDFASLKTRIHNTLQLSDKQFLDEIHYRKPFTDTGKNSKKFQIPSTCTIDELKNLIKQVAPKGIPPLGIHESQTLRTNEELLKVLVQPNYWKKYGPIEILAVFTKYVVKIEDEVTGTLLNN

SEQ ID NO: 143554 - protein, 168 aa, Glycine max
  Coding DNA Sequence Number=SeqID_51869
  Homolog annotation: Hit_ID=Q6WAY6; Match level="QueryCoverage=96%, HitCoverage=29%, E-value=1e-07, Identity=27%"; Hit description =Putative uncharacterized protein
MGTRGCISYNPVLAIRQLGYPMRGAPLEEELAPVISRGFNKTNGETLQKVRKAWDVVQKRDKELRSSNNGPIGGYRRWLKAYVQGLDWLPSLRTARREEVKAPEEDEEVQALRLELEQAQIVKKKFKSAALKIQKENAELRDINIATTKAMEQDTKRARREEHGRNKF

SEQ ID NO: 143555 - protein, 45 aa, Glycine max
  Coding DNA Sequence Number=SeqID_51870
LMRSSDVIDSSFAPFYDTEPVSAIVALANTSKQWEVLTLPPSVVQ

SEQ ID NO: 143556 - protein, 70 aa, Glycine max
  Coding DNA Sequence Number=SeqID_51871
  Subcellular localization annotation: CTP_CleavageSite=49; ConfidenceScore=5.51e-01
MAYSLVDGASSHLFSFVFHCISMVLLSSSGNIQARRRARFFSGGQGRSSAMAYGSVMVVQLCHFQDTEVC

SEQ ID NO: 143557 - protein, 224 aa, Glycine max
  Coding DNA Sequence Number=SeqID_51872
MCKRTRLLSRSKLYGHTESSRIPGLQPGKFIQIPSRGNRIQSRATEIQSRKKLHARLRVERNQGNQYKEQRNQPPYQPPYQHPSQGPNLQEKPTNIEELLLQFIQETISHQKSTDATIRNLEVQMGQLAQDKAERSTRTFGANTEKNPKEECKAVLTRGQRRAQEEGKVEEEDRPEEERTETPEKERTEEEEKVASPPKTKSQRAREAKKEEPPALPQDLPYPM

SEQ ID NO: 143558 - protein, 293 aa, Glycine max
  Coding DNA Sequence Number=SeqID_51873
MERSMIDAASGGALGDMTPAEARNLIEKMASNSQQFSARNDAIVIRGVHELALNQKSVPVARFVVCAPLLTTIQTFALPCSNLEQLSNPKLMLQIFTIDLPQPQQKNQPQQNNYDLSSHRYNPGWRNHPNLRWSSPQQQQQQPAPSFQNVAGPSRPYIPPPIQQQQQPQKQPTVAAPPQPSLEELVRKMTMQNMQFQQETRASIQSLTNQMGQLATQLNQQQSHNSDKLPSQAVQNPKNVSAISLRSGKQCQGPQPVAPSSSANESAKLHSTPEKGDDKNLPNNFYAGESSST

SEQ ID NO: 143559 - protein, 277 aa, Glycine max
  Coding DNA Sequence Number=SeqID_51874
  Gene Ontology: Mol. function=helicase activity; Biological process =viral genome replication
  Homolog annotation: Hit_ID=Q2A9E0; Match level="QueryCoverage=99%, HitCoverage=19%, E-value=7e-67, Identity=47%"; Hit description =Putative uncharacterized protein
MKRISKDKNIASPKFSLCCGDGKVELPLLQNPPKHLERLLFDDNATDSKNYQHNIRTYNMMFAFTSAGIKLDKSINETRGPPTISIQGQPCHRIGSLLPMPGKQPKFAQLYIFDTQNEVENRIDTVSQMLDDHNVHAKSFRMVMDRLSDSQLDNLKLRLIAGREKDGRTYNLPNVYEVVALIVGDLDADSIRDIIVKTQNGELQRIHELHSSYLGLQYPLLFPYGEDGYRPDILHRSTSGSKKRKRNRLTMRDWFAYRLQSRSNEAQTLLHSRKLFQ

SEQ ID NO: 143560 - protein, 81 aa, Glycine max
  Coding DNA Sequence Number=SeqID_51875
MTRKQPGRLGPSRIFLQKAVASGGSNLARLGELGGKLLPYFAINRGRSEEEKGSTLLALPNHLKLVRKIVSVKKIQVEALP

SEQ ID NO: 143561 - protein, 96 aa, Glycine max
  Coding DNA Sequence Number=SeqID_51876
MTETSMRAGNANVYGFLEPQSIQRSGQSQFESESYIKNWMHNYKRDMYLGAYLNGALKELDNTPQSKSKDAAKWIVVKYFNDARPLEPERLKALHI

SEQ ID NO: 143562 - protein, 84 aa, Glycine max
  Coding DNA Sequence Number=SeqID_51877
MHSKTEALEHTKKRDTGHQSVSLENKTGDSTMLKMGDSTKVVIKQDMKGIRHKYGFNNNKREKAQKKRVVDDEIGDKHQLDEVL

SEQ ID NO: 143563 - protein, 47 aa, Glycine max
  Coding DNA Sequence Number=SeqID_51878
GCLGTGRRHKGVVGDGLRPRVHAEAMGHATLPPLSCYSCLNMRPPSA

SEQ ID NO: 143564 - protein, 46 aa, Glycine max
  Coding DNA Sequence Number=SeqID_51879
MKGNQQRVPSGVANYRNLPFGGRATRDSRDACSTKGIRAESPPMFI

SEQ ID NO: 143565 - protein, 152 aa, Glycine max
  Coding DNA Sequence Number=SeqID_51880
METFQVSQVIQNYVGHVTCTLVSSKGGGPDDTRRYLTVIRTLLSSRGGGPDDKQRQNLVILHPCIIQRGGGPDDTRRYLTVIRTLLSSRGGGPDDKQRPKAAGPMTSRDHVWSFYTLVSSRGGGPDDTWRYLTVIRTLLSSRGGGPDDKQRP

SEQ ID NO: 143566 - protein, 294 aa, Glycine max
  Coding DNA Sequence Number=SeqID_51881
MVGFTPFPPRDETCLPARRPSLMHREKRGKLGPTLSKRRRSVYQLVPRMERRKTHGSYFVQRISKCSLDGDKGLHQLQSRPRYKTTWLPYERAPLGEELAPIIAQGFNSTNAEALQKVRKAWEMVQKKDEELRGSSNGPIGGYRRWLKAYIQGLDWLPSLRTTKGVEVEALEEDEEVQALRAELENAQTVKEKFKSAALKIRKENAELRDVNIATTKALEQETKRARKEEHDRNKFRGALWDSNNELKLRREERDQSRVDCLILKDELRICLRFKRSLSQRLCETETNMLAIIN

SEQ ID NO: 143567 - protein, 118 aa, Glycine max
  Coding DNA Sequence Number=SeqID_51882
  Subcellular localization annotation: CTP_CleavageSite=50; ConfidenceScore=5.61e-01
MGQLATQLNQQQSQNSDKLPSQSVQNPKNVSVISLRSGKQCQGPEPVAPSSSANEPAKLHSTPEKGDDKNLPNNFCAGESSTGPLQSTDVEIHLANRSVAYPVGFIEDVLVRVGELPC

SEQ ID NO: 143568 - protein, 84 aa, Glycine max
  Coding DNA Sequence Number=SeqID_51883
MLITPLLYSLRANNLNLIMHMSLDPWGRHMNAHHNLADFEPCLGYATKGQAVGELCLVPYVIIPPKFKVSEFDKYKELLAPRTI

SEQ ID NO: 143569 - protein, 18 aa, Glycine max
  Coding DNA Sequence Number=SeqID_51884
MRLLSFETNVRGANTFLK

SEQ ID NO: 143570 - protein, 203 aa, Glycine max
  Coding DNA Sequence Number=SeqID_51885
  Gene Ontology: Mol. function=(2,3-dihydroxybenzoyl)adenylate synthase activity; Cellular component=integral to membrane; Biological process= siderophore biosynthetic process
  Homolog annotation: Hit_ID=A4W7X7; Match level="QueryCoverage=99%, HitCoverage=37%, E-value=4e-88, Identity=77%"; Hit description=2,3 -dihydroxybenzoate-AMP ligase
MAEGLVNYTRFGDDEQTILTTQGRPISEDDEVWVADENGNPLPPGQVGRLMTRGPYTFRGYYNSPEHNAASFDADGFYCSGDLIEINAQGYITVQGREKDQINRGGEKIAAEEIENLLLRHPDVIHAALVSMHDELMGEKSCAFIVARQPVKPVALRRHLRELGIAEFKLPDRITCVDALPLTPVGKVDKKRLRQQLAEQTQA

SEQ ID NO: 143571 - protein, 111 aa, Glycine max
  Coding DNA Sequence Number=SeqID_51886
MEKQLRKKKKQLRKRKKQLRKKMMQQRKRKKQQRILNQMMMILKPPHDHQTSTVAFTGYDVCMIHDFEGELYVYDFEGETAAADDDWCKLLVADKRCNSKSMETGGAADVT

SEQ ID NO: 143572 - protein, 122 aa, Glycine max
  Coding DNA Sequence Number=SeqID_51887
  Gene Ontology: Mol. function=aspartic-type endopeptidase activity; Biological process=DNA integration
  Homolog annotation: Hit_ID=A5B4Z9; Match level="QueryCoverage=47%, HitCoverage=14%, E-value=3e-12, Identity=58%"; Hit description =Putative uncharacterized protein
MGRGDVEDSYNGDATKPINNVDASNPTLSLKIQVGKKVLQQVPKQCLSRQTRYKTNHLIRALLEKVGVKISFEFDKTIMTKNNVFVGKGYYDQGFFMLNVYEVINDNASSSSSILLIDSYDI

SEQ ID NO: 143573 - protein, 328 aa, Glycine max
  Coding DNA Sequence Number=SeqID_51888
  Gene Ontology: Mol. function=metalloendopeptidase activity; Cellular component=proteinaceous extracellular matrix; Biological process =metabolic process
  Homolog annotation: Hit_ID=A4Q3U3; Match level="QueryCoverage=99%, HitCoverage=99%, E-value=2e-80, Identity=49%"; Hit description =Peptidase, metallopeptidases
  Pfam annotation: Domain name=PG_binding_1; Domain location=50-114; Score=50.8; E_value=4.8e-12; Accession=PF01471.9; Description =Putative peptidoglycan binding domain
  Pfam annotation: Domain name=Peptidase_M10; Domain location=145-325; Score=253.3; E_value=5.4e-73; Accession=PF00413.15; Description =Matrixin
  Pfam module annotation: Pfam domain module=PG_binding_1::Peptidase _M10; Domain location=50-114::145-325
MALNLLISIPFFLLFVVNPFHFVEPRTLEVSEHPFTRTLRKLKDINKGQRVRGVGELKSYLKKFGYLTTNDNSSNNNHFDKNVEFALKEYQVFHHLRPTGRVDAETIKRMGLPRCGVPDIITPQNHKLKGLVILANYSFFSGSPKWEESKRALTYTFVSSANVLRMYDVRLATRNAFQSWARASNFTFMEMPSEYNNLANIVLGFHRGDHGDGYPFDGPGQVLAHTFAPQDGRLHFDADEPWSIESTSWNVGPGWNVGWDWRRWVRPRWQSRRTIDLQTVALHEIGHLLGLGHSNVPGSIMYPSYEGVKRDLTQDDVDGIRALYRLPN

SEQ ID NO: 143574 - protein, 667 aa, Glycine max
  Coding DNA Sequence Number=SeqID_51889
  Gene Ontology: Mol. function=RNA binding; Cellular component =ribonucleoprotein complex; Biological process=regulation of translation
  Homolog annotation: Hit_ID=A7PMG5; Match level="QueryCoverage=91%, HitCoverage=61%, E-value=0.0, Identity=58%"; Hit description =Chromosome chr14 scaffold_21, whole genome shotgun sequence
  Pfam annotation: Domain name=CRS1_YhbY; Domain location=130-213; Score=105.5; E_value=1.6e-28; Accession=PF01985.12; Description=CRS1 YhbY domain
  Pfam annotation: Domain name=CRS1_YhbY; Domain location=349-433; Score=56.8; E_value=7.6e-14; Accession=PF01985.12; Description=CRS1 YhbY domain
  Pfam annotation: Domain name=CRS1_YhbY; Domain location=543-631; Score=131.6; E_value=2.3e-36; Accession=PF01985.12; Description=CRS1 YhbY domain
  Pfam module annotation: Pfam domain module=CRS1_YhbY::CRS1_YhbY::CRS1_ YhbY; Domain location=130-213::349-433::543-631
  Subcellular localization annotation: CTP_CleavageSite=48; ConfidenceScore=5.69e-01
MLLPATHFHYFHTFPSSSSSSSSSSSSSSTLHIFPLQFPKPKPKFLIRCSDTETLPDSAIQRIADKLRSLGIADQPSTATPGPSDSDAGEIFVPLPQQLPTRRVGHTIDPTWAKRERREDKVPTLAELSLSDAEIRRLTTAGLAMRQKLRVGKAGLTEGIVNGIHERWRSFEVVRIVCEDLSRFNMKRTHDLLERKTGGLVVWRSGSKIILYRGTDYKYPYFLSDKVSRDDNTGDAMQHMDEDAKNFDKRESHSSEKNSVTYAGKSSNVKTAKPALIQGVGSPNKVRFQLPGEAELAKDADSLLTGIGPRFIDWWGYDPLPVDADLLPAVIPGYRKPFRLLPYGVKPKLTDDEMTTMRRLGKHLPCHFALGRNKKLHGLAAAIIKLWERCEIVKIAIKRGVLNTNGELMAEEIKYLTGGTLIARDKEFIVFYRGKDFLPTAVSSAIEQRRSIGMYKLKTRNSLSVTDDPDLKDGTIECDSEVKGMNFKKDTKQGMLTEAEAAIKSTSIKLSMALEEKAKAEKLLSELENAESPQEEEINKEGITEEEKYMLRRIGLKMSPFLLLGRRGVFDGTVENMHLHWKYRELVKIICNKQMSLEDVQQIAQTLEAESGGILIAVERVNKSYAIIVYRGKNYSRPASLRPRTLLNKKQALKRSIEAQRCEVKVY

SEQ ID NO: 143575 - protein, 466 aa, Glycine max
  Coding DNA Sequence Number=SeqID_51890
  Gene Ontology: Mol. function=triacylglycerol lipase activity; Biological process=lipid metabolic process
  Homolog annotation: Hit_ID=A7Q8I2; Match level="QueryCoverage=97%, HitCoverage=76%, E-value=2e-91, Identity=44%"; Hit description =Chromosome chr5 scaffold_64, whole genome shotgun sequence
  Pfam annotation: Domain name=Lipase_3; Domain location=2-86; Score= -24.3; E_value=0.044; Accession=PF01764.16; Description=Lipase (class 3)
  Subcellular localization annotation: CTP_CleavageSite=59; ConfidenceScore=5.04e-01
MQINSSTKLIVTGHGLGGAVASLFTISLLNSIGSGKNRPLCITFGSPLIGDKKLQQAISRSSNWNSCFLHVVSLKDPLPTLFITNYSSSPAVLTPETSGYMPFGTFFLCSDANSTCFENPDSILELLIAMGSIHTQNQGFQSSDYGNIVEKLNDKVICKFFSTRVENMAHAGSALESSISLQLQALALTPHLQQQNIDTNTLETKIKIQEQKFILHRRIKNFDPAKKLNVVKLCMSQLEWYKKETKNQRIGYYDSYKNMNSPWDYDVIQFHKRLTNYWEKMVEEVEMKPQKEGAAFRTRWLYAGTNYRRMVEPLAVAQYYREGGIDYVTQNRSKHFVRLEEWLNEGTKKATSDLSSTSKKNVEALLTFDSCFWAHVEEALLSCKELKVVREKEETLKKLVIFEEYVYGLVKNYAVSPEIFLAQSSYMCWWNEYKAIKGTFYNSALSNFMSDARKREQYALGVYDFP

SEQ ID NO: 143576 - protein, 30 aa, Glycine max
  Coding DNA Sequence Number=SeqID_51891
MVYHDSLTIIVLGRAYGGTPPQELVSSVFA

SEQ ID NO: 143577 - protein, 275 aa, Glycine max
  Coding DNA Sequence Number=SeqID_51892
  Homolog annotation: Hit_ID=A7PME5; Match level="QueryCoverage=98%, HitCoverage=96%, E-value=4e-99, Identity=58%"; Hit description =Chromosome chr14 scaffold_21, whole genome shotgun sequence
  Pfam annotation: Domain name=DUF231; Domain location=83-266; Score =71.3; E_value=3.3e-18; Accession=PF03005.6; Description=Arabidopsis proteins of unknown function
MQDEIPKDVYKDSEDRFRKWYFPIHDFTLTMLWSRFLIVGEERMVNGTGTSIFDMHLDKVDKDWAKELPNLDYAIISAGHWFFRVMHLHEAGKQVGCVYCNEENITSYNPDFTIRKAFRTAFRHINACKECGRKKMVTVLRTFAPAHFENGVWNTGGYCNRTGPVSESEVDFGKFDWEVRGIQMEEFERARREGTMGKLGHNNNNNNNNNNNRFEMVDVARAMLMRPDGHPGEHWGNKWMKGYNDCTHWCLPGPVDVWSELLLAVLKREAGMVVA

SEQ ID NO: 143578 - protein, 142 aa, Glycine max
  Coding DNA Sequence Number=SeqID_51893
  Gene Ontology: Mol. function=oxidoreductase activity, acting on single donors with incorporation of molecular oxygen, incorporation of two atoms of oxygen; Biological process=response to oxidative stress
  Homolog annotation: Hit_ID=Q5GQ66; Match level="QueryCoverage=81%, HitCoverage=18%, E-value=5e-54, Identity=81%"; Hit description=Alpha- dioxygenase
MACLEIKHVMCFKGTSPNFIELIAPREVASQCPLKSFKFYKTKEIPTGFFEIKSGSSNIRTPWWDGSVIYGSNREVLEKVRTFKDGKIKISKDGHLLHNENGTAISGDVRNSWAGVSTLQALFTQEHNAVCDALKVRVEAFE

SEQ ID NO: 143579 - protein, 68 aa, Glycine max
  Coding DNA Sequence Number=SeqID_51894
MKRKASIIVILATASWKSLWMSWCITLAARALMRSVTRDHMILLSCEIDDTTGLILARAKFDEIVYGV

SEQ ID NO: 143580 - protein, 23 aa, Glycine max
  Coding DNA Sequence Number=SeqID_51895
MGNLKPRNYLLGGHTRILESNLM

SEQ ID NO: 143581 - protein, 291 aa, Glycine max
  Coding DNA Sequence Number=SeqID_51896
  Gene Ontology: Mol. function=molecular_function; Cellular component =membrane; Biological process=auxin mediated signaling pathway
  Homolog annotation: Hit_ID=A7PMD8; Match level="QueryCoverage=51%, HitCoverage=52%, E-value=6e-32, Identity=40%"; Hit description =Chromosome chr14 scaffold_21, whole genome shotgun sequence
MEKIAVKRRTTQAKILGSIISVLGAFVVTFYKGQSVIIADNSPSIQLPQSNGILTSVDRNWVIGGLLLTACNILLTVWFVYQVEILKEFPDELSMGIFNKFLSSAIYAWGIHLKGPVYVAMFKPLSIVIAVAMGVMFLGDSLYVGRIATSTETEHVKTPGWAPQQLSLKMPANFVPTMQQSSPSVQMNRPSSSRHVFNADQLQLMGANVNEHLSLNDSQIPTWITNQTFIIGATIISIGFYTVMWGKATEQKEEEGEEENVGSQESSITENVPLLQSYITVNSTKKIDGSV

SEQ ID NO: 143582 - protein, 204 aa, Glycine max
  Coding DNA Sequence Number=SeqID_51897
  Gene Ontology: Mol. function=molecular_function; Cellular component =membrane; Biological process=auxin mediated signaling pathway
  Homolog annotation: Hit_ID=A7PMD8; Match level="QueryCoverage=100%, HitCoverage=65%, E-value=1e-45, Identity=40%"; Hit description =Chromosome chr14 scaffold_21, whole genome shotgun sequence
MEKIAAKSRSSQAKVVGSIISITGAFVLTLYKGHSIIKAHSHDLSIPLQHPFSFLKSGDADWVIAGILLTAECLIGSLCYIVQADVLKVFPDEVTIVLFYNVTSTVMSTLVALFAVPNANAWKGPVYLASFSPLQIVFSIAMGVIFLGDSLHVGSIVGAAIVSFGFYAVLWGKATEEIEEEVDYPESPATENVPLLQSYGTENL

SEQ ID NO: 143583 - protein, 122 aa, Glycine max
  Coding DNA Sequence Number=SeqID_51898
MGSLANSHCQWRVCCAKPRGIKTATRSGELLCRFKSPPVLARGLDVGGRRAVQLRCCRLQQQEQKAKSPVMVAIWLCCLLPKKFLAYKAMQEVLPCFVFESSLFTSLHCFFLLLPLLFASFQ

SEQ ID NO: 143584 - protein, 134 aa, Glycine max
  Coding DNA Sequence Number=SeqID_51899
  Homolog annotation: Hit_ID=A9P2E7; Match level="QueryCoverage=40%, HitCoverage=40%, E-value=5e-10, Identity=50%"; Hit description =Putative uncharacterized protein
  Subcellular localization annotation: CTP_CleavageSite=44; ConfidenceScore=5.03e-01
MTVLPAATTDAVDVDAQIAFFCIPCFPSETTSSSSWWWQSLRSPANNKGRYWWRRRWNAVIRRFKSNNNYKKHCSFRYDPLSYALNFDDGIAEEDGCGYKGFSARFVSVPPPEKAVDGEESRGEHVPPVSKIQI

SEQ ID NO: 143585 - protein, 57 aa, Glycine max
  Coding DNA Sequence Number=SeqID_51900
MLMVSGVHGGCSDCAIEALGNDGSKEEDAKPETVKELLEWKGETTIGHEVRVKREML

SEQ ID NO: 143586 - protein, 766 aa, Glycine max
  Coding DNA Sequence Number=SeqID_51901
  Gene Ontology: Mol. function=potassium ion transmembrane transporter activity; Cellular component=membrane; Biological process=potassium ion transport
  Homolog annotation: Hit_ID=A7Q2E3; Match level="QueryCoverage=94%, HitCoverage=89%, E-value=0.0, Identity=76%"; Hit description =Chromosome chr1 scaffold_46, whole genome shotgun sequence
  Pfam annotation: Domain name=K_trans; Domain location=35-766; Score =1442.3; E_value=0; Accession=PF02705.7; Description=K+ potassium transporter
MDLESVIHRNTIKHDHGGGDVMIAGRIMEDGVDFGLSKLGDTNEEIYGVLSFVFWTLTLIPLLKYVFIVLRADDNGEGGTFALYSLLCRHARVSLLPNTQLADEDLTEYTMDNGTVPVDKKNVGLGLKNLLEKHRVLQRVLLVLALIGTCMVIGDGVLTPAISVFSAVSGLELSMSKEQHRYVEVPVACVILIFLFALQHYGTHRVGSLFAPVVLTWLLCISAIGVYNIFHWNPHVYEALSPYYMFKFLKKTQKGGWMSLGGILLCITGSEAMYADLGHFSQLSIKIAFTFLVYPSLILAYMGQAAYLSRHHSLESDYRIGFYVSVPVKLRWPVLAIAILQAVVGSQAVITGTFSIIKQCSAMGCFPKVKIIHTSSKMHGQIYIPEINWSLMLLCLAITVGFRDTKRMGNAAGLAVITVMLVTTCLMSLVIVLCWHKNILLAVCFILFFGSIEALYFSASLIKFLEGAWVPIALSLIFLISMYVWHYGTLKKYEFDVQNKVPINWLLSLGPSLGIVRVKGIGLIHTELVSGIPAIFSHFVTNLPAFHQVVIFLCIKSVQVPHVRPEERFLVGRVGPKEYRLYRCIARYGYRDIHKDDIEFERDLICSIAEFIRSDASEYGLGFGSFEEDTKMTVVGTSASNLEGSIRMTEDDDQQDSQMEEGPSELMEVKSSPEKVRKRVRFVVPDSPQIDLDAREELLELMDAKEAGMAFILSHSYVRAKSGSSWLKKVVINYGYDFLRRNSRGPAYALSIPHASTLEVGMIYHV

SEQ ID NO: 143587 - protein, 91 aa, Glycine max
  Coding DNA Sequence Number=SeqID_51902
MGYILPKPNTEKGKVKRKGKEDEEEQEDNYARAYYKTQNRDHWLNWNTSCCQLIYMFGAKSVDNDSYCNSGVNICWICVPGPTSCLFFRES

SEQ ID NO: 143588 - protein, 68 aa, Glycine max
  Coding DNA Sequence Number=SeqID_51903
MTVGGEGVLSASGTWRGASMGEGGGIRLSRYAWTMSMWRQHVEVVVTVVKSDSSMIIGESALSDMEAS

SEQ ID NO: 143589 - protein, 79 aa, Glycine max
  Coding DNA Sequence Number=SeqID_51904
  Gene Ontology: Mol. function=protein serine/threonine kinase activity; Biological process=protein amino acid phosphorylation
  Homolog annotation: Hit_ID=A5AKP8; Match level="QueryCoverage=69%, HitCoverage=17%, E-value=6e-21, Identity=83%"; Hit description =Putative uncharacterized protein
NLRPEIPRCCPSALANVMKRCWDANPDKRPEMDEVVTMLEAIDTSKGGVIEDLERFFTAKEIDYGGMIYSVLEISLHFI

SEQ ID NO: 143590 - protein, 307 aa, Glycine max
  Coding DNA Sequence Number=SeqID_51905
  Gene Ontology: Biological process=rRNA processing
  Homolog annotation: Hit_ID=A7Q5T8; Match level="QueryCoverage=60%, HitCoverage=90%, E-value=2e-45, Identity=53%"; Hit description =Chromosome chr14 scaffold_54, whole genome shotgun sequence
MERGRIKGVRPWWRRVMWEYKNNGVHKTIFLVLLQHVRYTNTALNPGPNQDVVLLLSSLESIRNPKPLIPNQSQVRIPNFNLFFLNVRRERVKVKGMLDAGKDKAIMDGSRRLLGQSVGVFNEGICLVLSRWSALRSAVENEWGGRESRLKADQLAGDILTWFTQSKEPLYIDDLEDILDQGMLSLNVEVEDGSVEEVAEKLMVMHEEFLEGNFSSFEDLRKANLEQATLPHVTQIVNEDDSDEDGDHDEKMIVDDNSSNMNPEISTSDSNMNSVNRPVNEPLPKVSGKADDGWVVVSNKRNKGRKN

SEQ ID NO: 143591 - protein, 320 aa, Glycine max
  Coding DNA Sequence Number=SeqID_51906
  Gene Ontology: Mol. function=oxidoreductase activity; Cellular component=chloroplast; Biological process=metabolic process
  Homolog annotation: Hit_ID=Q43677; Match level="QueryCoverage=99%, HitCoverage=100%, E-value=1e-113, Identity=64%"; Hit description =Auxin-induced protein
  Pfam annotation: Domain name=ADH_N; Domain location=39-130; Score =61.8; E_value=2.4e-15; Accession=PF08240.3; Description=Alcohol dehydrogenase GroES-like domai
  Pfam annotation: Domain name=ADH_zinc_N; Domain location=160-280; Score=62.4; E_value=1.5e-15; Accession=PF00107.17; Description=Zinc -binding dehydrogenase
  Pfam annotation: Domain name=DUF683; Domain location=174-245; Score= -5.3; E_value=0.055; Accession=PF05082.4; Description=Protein of unknown function (DUF683)
  Pfam annotation: Domain name=DapB_N; Domain location=162-255; Score= -34.0; E_value=0.032; Accession=PF01113.11; Description =Dihydrodipicolinate reductase, N-terminus
  Pfam annotation: Domain name=ThiF; Domain location=160-264; Score= -50.2; E_value=0.037; Accession=PF00899.12; Description=ThiF family
  Pfam module annotation: Pfam domain module=ADH_N::ADH_zinc _N::DUF683::DapB_N::ThiF; Domain location=39-130::160-280::174 -245::162-255::160-264
MASISSIPSHIKTWVYSEYGNTEEILKFDPNVPIPDIKEDQVLIKVVATALNPVDYKRALGYFKNTDSPLPSVPGYDVAGVVVRVGSKVRKFKVGDEVYGDINEYAVNNPKTIGTLAEYTATEEKLLAHKPSNLSFIEAASLPLAIITAYQGLERVDFSAGKSILVLGGAGGVGSLVIQLAKHVFGASKVAATASSAKLDLLRNLGADFPIDYTKENFEELAEKFDVVYDTIGQSDKALKAIKEGGKVVTIAPPATPPAIPFFLTSDGAVLEKLQPHLESGKVKPVLDPKSPFPFSQIVEAYSYLKTNRAIGKVVIHPIP

SEQ ID NO: 143592 - protein, 168 aa, Glycine max
  Coding DNA Sequence Number=SeqID_51907
  Homolog annotation: Hit_ID=A7PM96; Match level="QueryCoverage=73%, HitCoverage=29%, E-value=5e-50, Identity=78%"; Hit description =Chromosome chr14 scaffold_21, whole genome shotgun sequence
MGYGVGSGSPLCPSFNFNLELVKSSQFIASFYQHMVVQRRVKNPLEENSVVGITNYIDFGFELQTCVDDAIAENNMLDPTFRIGASWQANKNFLLKAKVGPRSSSMALAFKSWWKPSFTFSISGGSRGIFLFNLASVLYTPLPIPFFSVTGTFLFLCMCIRRPTLIWS

SEQ ID NO: 143593 - protein, 64 aa, Glycine max
  Coding DNA Sequence Number=SeqID_51908
MFEILTVGNVYPKRLDGPSQAPYPCICKEAVSGFEPMTNKSPRHNFTATPGLALRVALPLISLN

SEQ ID NO: 143594 - protein, 48 aa, Glycine max
  Coding DNA Sequence Number=SeqID_51909
MEKMNKKEMEEKQNNGIEHTFSAKIGHFGQSSRDPKLTESSRRRNCEN

SEQ ID NO: 143595 - protein, 21 aa, Glycine max
  Coding DNA Sequence Number=SeqID_51910
SITLAQLPEEREKEYQIIGIL

SEQ ID NO: 143596 - protein, 48 aa, Glycine max
  Coding DNA Sequence Number=SeqID_51911
MATMMEAMMSVKKIMEANAVAIAATSVVAKVNPTNGKVGSSKGKAQGH

SEQ ID NO: 143597 - protein, 142 aa, Glycine max
  Coding DNA Sequence Number=SeqID_51912
MSFALLRALVFNRASRYIPGLNRTSELKILSFDFVRASVFNYERLDILSGHNRTSDIQSYCRLNGSELQFSITTSRYITGLIRTSEASVFNYKRLDILWDTIGHPIQKLLSFEFAQSFSFQLRASRYITGLNRTSELKVIVV

SEQ ID NO: 143598 - protein, 28 aa, Glycine max
  Coding DNA Sequence Number=SeqID_51913
MECLEGAWETVEDEPARTLQRTVEWTTP

SEQ ID NO: 143599 - protein, 280 aa, Glycine max
  Coding DNA Sequence Number=SeqID_51914
  Homolog annotation: Hit_ID=UPI00006A2D9E; Match level="QueryCoverage =59%, HitCoverage=92%, E-value=2e-08, Identity=16%"; Hit description =UPI00006A2D9E related cluster
LHALTFKGLYALIFKGLHALTFRGLHVLAFKGLHVLAIRGLHALTFRGLHVLTFRGSSDYLFSPSKGYTPSSKGLHALTSRGLHALTFKGLHALIFKGLHALTFRGLDVLALRGLHVLAFGGLHALVFRGLYVLPLRGLHVLAFGGLHALAFRGLHVPLLRRLHALAFRGNFPSTIVFPGPPLDLKGGPTVRAQPEEGYRQLLCILGQGIAPTRHQVDPEKSNKALGFPTLVTGLYQSYRVPVPPGKVMPSRHRGHACRTPSGPKEVQQGPGVSNSDYGP

SEQ ID NO: 143600 - protein, 166 aa, Glycine max
  Coding DNA Sequence Number=SeqID_51915
MVGDLHAFQPLHVDDAVPMLMNLLMVSAEASRAETGQCRGPYVRLQWVCYIYERRCQDHLNDASISSNRQLGGYITLLQVDCHEEDREEHMYTGVQGAPGPTPDFGCLLDPIWGASTSLGLPYDFMLFRSPAMETRCCVLPTREGHAVVWIHPDHFFSAFRFMGVV

SEQ ID NO: 143601 - protein, 126 aa, Glycine max
  Coding DNA Sequence Number=SeqID_51916
IMVRTRGLGRALGQVTGRGVGRGDHDDSDDVPQRQQPTASARRQRVAVTAAHNETNVQDDPMEAPAVVEEIVADIPADTGAEAAEDEDEGFPGGPSNPSVLIQYADHIAYSIWTGELFILFIFSYL

SEQ ID NO: 143602 - protein, 51 aa, Glycine max
  Coding DNA Sequence Number=SeqID_51917
MGGGGVWLFGKTARKPHYKRNLKESWASSSKGNNTRKSSLPWIQTENAIET

SEQ ID NO: 143603 - protein, 192 aa, Glycine max
  Coding DNA Sequence Number=SeqID_51918
  Homolog annotation: Hit_ID=A7UQU7; Match level="QueryCoverage=92%, HitCoverage=30%, E-value=4e-16, Identity=32%"; Hit description=IMP dehydrogenase/GMP reductase, putative
  Pfam annotation: Domain name=DUF1723; Domain location=42-91; Score =58.2; E_value=2.7e-14; Accession=PF08330.1; Description=Protein of unknown function (DUF1723)
HPELKLSSHGRKVQKLGRPVPTIEGLVVGTGLSPLIACSVDTGDRRLISSFVERWHGETSSFHLPVGEVTITLDDMAPLLHLPIIGNFHTFQPLHVDEAVLMLVYLLLVSADATRVETGHCHGPYVRLSWLRDIYQCKCQAKHWTAATRAYLLLLLLGCTLFANKSETHVRVVFLDALRDCSKSDKCIGSRK

SEQ ID NO: 143604 - protein, 30 aa, Glycine max
  Coding DNA Sequence Number=SeqID_51919
MWVSLQASWETSAWGARFHIDKNVKANVNP

SEQ ID NO: 143605 - protein, 99 aa, Glycine max
  Coding DNA Sequence Number=SeqID_51920
MARNVFAPCPYLKGPIWEGTKRAFSDNSQGGHISLDGKPNKGVSHGKTLHKIKWPNSLKIVPSGVANCRNLPFGGRATRDSRDACSTKGIRAESPPTFI

SEQ ID NO: 143606 - protein, 122 aa, Glycine max
  Coding DNA Sequence Number=SeqID_51921
AQGDALQAADAPPPPHQADLAGSLGMERYLQHLVRQQAANHRGQVQIHDCLYQLSLSQQGQGFIPFVCPTPDQFRAEVAWPGDWPEAQAGEAPAEAPGDAEEARIDEEMTDLLNFLGGSGAT

SEQ ID NO: 143607 - protein, 205 aa, Glycine max
  Coding DNA Sequence Number=SeqID_51922
MGVPNNCSFDTLKRRMHNTLQLTNDQLLDEIYYQQPFIDAELLCTIIRTPDAILNLLQSTITPTHDAIMYYNGKWNIPRQGEFLGYSFAGTNLIIRFGIPPGCGMKKLKDLIKQVAPIGVSPNGIHGSQLVRRLFFRQSGHSKYSENLIEYEITELKNDEDVLKVLAQSNYWKRFCSIKILAIFSKPVIQIEEDIYSAQHILDPH

SEQ ID NO: 143608 - protein, 42 aa, Glycine max
  Coding DNA Sequence Number=SeqID_51923
MDESLKVGEDEWRERERRSTKFCASNEPINPRSSPRFSTKFA

SEQ ID NO: 143609 - protein, 402 aa, Glycine max
  Coding DNA Sequence Number=SeqID_51924
QHSPVDHHALAGRQAREDLGLAVLLRADLHVARLEAPAALVHEDARADLALQQGRGRHHHGLARRGVEAHARKHAGAQPPFGVVHGHAHLDAARGGVHQLAHVLHAALQLQVGIGGQRDVGLLAHVHMGQVALADAGAEPDLAQVGHGHDGGIHIVPVAALRARHLDHAAADGRLDHVAAARAFLHGRTQLGQMIGGGARIGTCCGQRLLRGLVILARGDLGIEQQLLAVEFLARVQQRGLGLGVLGTHAGDLGGVHGDQRIAGLHRIAQLVVQAHQAARHGRRDADQLFRLGLDGGGGRQAGLQRLQGDLGHLQALAQRRAFGHHDEVAFAAHGSRLRGGGGGGCCCSRGFGRAVAGGHGHADQQPAHRPGGRQQGMALVQAMGVGHGVGLVVQKRESGSS

SEQ ID NO: 143610 - protein, 182 aa, Glycine max
  Coding DNA Sequence Number=SeqID_51925
  Homolog annotation: Hit_ID=Q2HW90; Match level="QueryCoverage=41%, HitCoverage=14%, E-value=2e-11, Identity=45%"; Hit description =Putative uncharacterized protein
MAILKHSKPLVINYKPCVIDYMLSKIFKTFSESILATGNRLHPLHLILWHHQNILLLHGVPRKCLEAKVRTLASQDEWAPFIDVLALLIFGVVLFPNMDGLVDLAAIDAFLAFHDRKESPVVAILADLYDTFDRRCEKNSAMIVCCTPALYVWLVSHLFRQEERHVCPLEGHRSCTEKKEAN

SEQ ID NO: 143611 - protein, 87 aa, Glycine max
  Coding DNA Sequence Number=SeqID_51926
ETQVRQEAATPERSPQISPNPSSPMVDQSSLQQPADLPTPVHEMPADPSTPVLGLTTTPSATPVLHLTDEEDTQDEDTQSQDLSQEF

SEQ ID NO: 143612 - protein, 152 aa, Glycine max
  Coding DNA Sequence Number=SeqID_51927
MQFRATFHNDRGIIKVSFFYHIQWAPEYPEYVRFKYNGVVYQIRVRLHKGKIFFVEGLKQFRKELAIYESTIIHLFAIDHISIFDIHFSPPLEQQTSVRLWMISRQHIWTLEITQSMIDAPHPLNLPSCVTRHLNVSDQHMTILRKLGPSLQ

SEQ ID NO: 143613 - protein, 107 aa, Glycine max
  Coding DNA Sequence Number=SeqID_51928
MNVLSGATLLCKITNASNIFMIHIQRDSLGRKKPRVQEPDLRSNPFQGEGMIPHDNDERKREKRHHFKEKMSLEEAHHHRRPWIRAWRKKEMNEGRGREEHEILCSK

SEQ ID NO: 143614 - protein, 65 aa, Glycine max
  Coding DNA Sequence Number=SeqID_51929
MGCTHGPEIYPKAHENPRAFSCISGPIFLECSIQCPCGVGLHQIVCTTSALSQPTLRRGCEKRPK

SEQ ID NO: 143615 - protein, 176 aa, Glycine max
  Coding DNA Sequence Number=SeqID_51930
MPPTRHPLDPDKSNRALGFPALITGLCQSFGVPVTPSKVIRALITRAFIEKYCTARQAQGGEPQAPDAPPPPPQADPAGSFDTERYLLHLVRQQAANHRAHVQTHDSLYQLSLSLQSQGFASFPCPTPDQFKAEVAWPGDWLEAQAGEAPAEAPAEVPGEADEARVDEEMTDLFDF

SEQ ID NO: 143616 - protein, 183 aa, Glycine max
  Coding DNA Sequence Number=SeqID_51931
MASISEVMLKLQKTIEDKATATASSIVREAEPVLQPALNPGLDRNTTVFGRRYSPQAYPYGLPPDFTPRATPEELSQAPTFEGQLPPYGDYPGQDDGEGDTHLGPLLHLKDPSPHELPQPNIVRHTPAPPTPVKESVPFAEDKGKIEALEERLRAVEGLDNYSFSDLADLCLVPNMVIPPKFK

SEQ ID NO: 143617 - protein, 47 aa, Glycine max
  Coding DNA Sequence Number=SeqID_51932
MTEARQKGGRSLPPSSSSRAQLAQVSNHPSSRSYSLPEEESGRPKWA

SEQ ID NO: 143618 - protein, 357 aa, Glycine max
  Coding DNA Sequence Number=SeqID_51933
  Homolog annotation: Hit_ID=Q6WAY6; Match level="QueryCoverage=83%, HitCoverage=64%, E-value=1e-15, Identity=33%"; Hit description =Putative uncharacterized protein
MGSSQMPSLKKRFYQVKVKSLGTTSLKELGQLMGQLQRQAFRKAYGKIWDLAMVEVSTEAIASLAQYYNLPLRCFTFGDFQLSPMVEEFEEVLGCPIGGRKPYLFSWFYPSLARISKIVQISVQELDHRKQVKNGVVGIPRKYLEAKARILAVSHLFRQEVRHACPLESRRSCTEKGGANWDQLLASKEGASVNWFPRWKEGRTEVLISCGGFPNVPLMGTRGCINYNPVLAIRQLGYPMRGAPLEDELTPIISRGFNKTNVETLQKVRKEWEVLQKKDKELRGSNNGPIGGYRKWLKAHVQGLDWLPSLRTAKREEVEAPEDDEEVQALRAELEQAQTVKERFKSAALKSERRIPN

SEQ ID NO: 143619 - protein, 295 aa, Glycine max
  Coding DNA Sequence Number=SeqID_51934
  Gene Ontology: Mol. function=transferase activity, transferring glycosyl groups; Biological process=lipopolysaccharide biosynthetic process
  Homolog annotation: Hit_ID=Q936B7; Match level="QueryCoverage=61%, HitCoverage=52%, E-value=8e-89, Identity=90%"; Hit description =Heptosyltransferase II WaaF
  Pfam annotation: Domain name=Glyco_transf_9; Domain location=1-178; Score=159.6; E_value=8.4e-45; Accession=PF01075.8; Description =Glycosyltransferase family 9 (heptosyltransferase)
RADDLPQPLLWPQLQVSDEEIADTTAAFNLTDSRPIVGFCPGAEFGPAKRWPHYHYATLAQRLIENGYQIALFGSAKDHEAGEQIRAALQEDARDFCLNLAGKTQLEQAVILIAACRAVVSNDSGLMHVAAALNKPLIALYGPSSPDFTPPLSDKARVIRLISGYHKVRKGDAEQGYHQSVNCKNLLNGGRTAYAARPDRRAAGHSRYPLRLGGGRRFQPNPDLAPGGGSRDPGGHSPLAQELGLIKSAALITRIAKGNKHGLDCKSAREPFASWFYNVRHEIDKQQHAVERTRE

SEQ ID NO: 143620 - protein, 86 aa, Glycine max
  Coding DNA Sequence Number=SeqID_51935
MSLDPYQTDCNLFLYVRIPPERLLLLIGHELDQNYSQRVRVETKGLERPIRQTTQKPFLSDRKGSHDPEPILPEIGNPKFVYEEQI

SEQ ID NO: 143621 - protein, 258 aa, Glycine max
  Coding DNA Sequence Number=SeqID_51936
  Homolog annotation: Hit_ID=A5B939; Match level="QueryCoverage=15%, HitCoverage=26%, E-value=2e-08, Identity=70%"; Hit description =Putative uncharacterized protein
RCGCSVEPRHGIESSKWAIFGKQNCRCGMNRKLGYGAQLRANLDPTKGVGRLRQQDGGHGSRNPLRRRGGRCKTQGASPGGAVVGADLGGTGEARLIALCARTPKGNRVKFLNRDVAADGNVRESGDVGGGPGKTSGRWNNVGKGSRQNGSVTSGKGLALRAGHGGPSPEPVGCRWTARAASAARAGRRVPVGGRIGNGPFGASSPGVEQSTQNCALNVKVKKFNQARVNGGSNYDSLKRNHSQGNGLGGISGERRPC

SEQ ID NO: 143622 - protein, 386 aa, Glycine max
  Coding DNA Sequence Number=SeqID_51937
  Gene Ontology: Mol. function=carbohydrate binding; Cellular component= integral to membrane; Biological process=carbohydrate metabolic process
  Homolog annotation: Hit_ID=A6WV51; Match level="QueryCoverage=97%, HitCoverage=12%, E-value=0.0, Identity=89%"; Hit description =Glycosyltransferase 36
MSEIDITWAALKLAEDGHRAEKAGHPEAEGKGAIAYYLSGEGRKELEKVCGYKAPFGVKALRFYRGLGLWGLFIPTAIFTILILLLVNYCMIRAGLSTDLRTLFTLLAIFPAMDASYSLFNALVPWFVQPTRLIGFEYKEGLPEEARTLVAVPTFITSRDSIDEQIRNLEVHYLTNPRGEIYFALVSDWTDAKQEITPADMEIYEYAREEIAKLNEHYTGDDQPRFFLMHRRRLFNEKQNCWMGWERKRGKLHELNMLLRGDKDTTFLGGANIIPEGVKYVMTLDADTRLMRDAVTKLVGKMHHPINRPRIDPESGRVVEGYGLLQPRVTPSLTTGKDASVFQRVFSINRGIDPYVFTVSDVYQDLTSEGTFTGRVFTTWMLSRRR

SEQ ID NO: 143623 - protein, 51 aa, Glycine max
  Coding DNA Sequence Number=SeqID_51938
MEIYVSDRLGEKDDDKGDDKKLKDQSKNNSTESKINQRTIQVNQEQVKSSR

SEQ ID NO: 143624 - protein, 138 aa, Glycine max
  Coding DNA Sequence Number=SeqID_51939
MSYFRKIFMLYVQCKIIIIHPKQASIPRRLQWLEEKLQDDQCHQVEGIFIRIQHMSVSISISDFLNTYLHLIIAQRNVVDSCGPLINSPNSNQSGRIVIDIQATFVRVSRFWVVSRGIDSTFLCANMSSTRTNLNLRR

SEQ ID NO: 143625 - protein, 193 aa, Glycine max
  Coding DNA Sequence Number=SeqID_51940
MGEVEEIQEKMKADMEAIKEKMATMMEAMMSVKKIMEANAVAIAATSVVAKAKIWEVRAAPIMYKFKTSTPSRHMVCLPNYTPPNVVYIPNEDVNNSTPILIKSQQPQSDHAHVSRPMEETHEIPHHDLANFEPCLGYAAEGQALGGIPRQNPLEGPQYHPQLHLLHSTAVKNPHDYGRNGKVGSYRGKAQGH

SEQ ID NO: 143626 - protein, 157 aa, Glycine max
  Coding DNA Sequence Number=SeqID_51941
  Subcellular localization annotation: CTP_CleavageSite=35; ConfidenceScore=5.02e-01
MDMNVGYLISHQISLTAQHDTSRLGFPTLITALCKARGVQSNSRSLESLSPTINLAYIKKNYDDKGDDKMLKGQSKNEFKMFKIESRTLQDSRGKLKNTSRFKRKIEFKNQESRFKDQASKNQDQDSRLKIQESREDLIKSFYSLVIDYQIIVIDYQ

SEQ ID NO: 143627 - protein, 143 aa, Glycine max
  Coding DNA Sequence Number=SeqID_51942
VRARPAELPSTFAAPTPASTSTAPFVPAQIDSQCFEAMLQSIHQGQIILLQSLQMMAPPDSIPSVEQFNETDESSEATIHEPFDIGEEAEETQVRQVAVATPERSIEATSEPSPPMDTSPLTTLVLQLTNEEDGQTQDTQDQP

SEQ ID NO: 143628 - protein, 47 aa, Glycine max
  Coding DNA Sequence Number=SeqID_51943
MSYRLHEALACISFTIPPLSSGLTHARLLKEIEFGGERNTMSIVFKE

SEQ ID NO: 143629 - protein, 15 aa, Glycine max
  Coding DNA Sequence Number=SeqID_51944
VNAVKIFPDAQNGLG

SEQ ID NO: 143630 - protein, 89 aa, Glycine max
  Coding DNA Sequence Number=SeqID_51945
  Pfam annotation: Domain name=G-patch; Domain location=1-43; Score =8.9; E_value=0.016; Accession=PF01585.14; Description=G-patch domain
MVARVMLRHGYEPGRGLGWNGDGATSLVEFKENRGSFISVGWMCEGRIAMINNEVPQEQSNSVWSCPPEFELGNWQIIEQPKIFMANIM

SEQ ID NO: 143631 - protein, 600 aa, Glycine max
  Coding DNA Sequence Number=SeqID_51946
  Homolog annotation: Hit_ID=Q2HW90; Match level="QueryCoverage=48%, HitCoverage=62%, E-value=1e-25, Identity=27%"; Hit description =Putative uncharacterized protein
TYGKIWDLAMIEVFIEAIASLTQYYDQLLRCFTFGDFQLVPNVEEFEEILGCPLGGRKPYLFSGFYPSMGRIAKVVKIFAQELDRVKQNRNGVVGIPKKHLEEKAKALANQVVLFPNVDGLVDLAAIDAFLAYHHSKESLIVVVLADAYDTFDRRCKKSGARIVCCTPALYVWLVSHLIRHGSRPVCPLQGHRTCAKKGKANWEQLLVSMVGMRGSLCEGFLNIPLMGMRGCINYNLILAIRQLGYPMRGASSEESTTPFIARGFSDPNARINGIIDGYHKWLKARTQGLDWLLKLKVSSKEEAETLEESEEVQALKVKLERAQAVKERFKMMAIKVRKECDELRDVNVATTEALERETKRAQKEEWGRNKFRGALWGSNSELKLRRAKKDQSRVEGMILEDKLKACQRTKRSLSDQLRKTEENMLEDEYTKVSILQAEREARERVIGSLHKEAMMWMDRFAFTLNGSQELPRQLAKAKAMANAVNTITKHTLRHPYRTRSKTRVMGDIEEVQEQMKVDMLALKDQMASMMEAMLSMKRMMESNAAVAAAANAAIEADPTHPSVTNQAHQPILDMVGQGGEVLGSTRSPHMGYYRNAYPY

SEQ ID NO: 143632 - protein, 39 aa, Glycine max
  Coding DNA Sequence Number=SeqID_51947
MCFREENSSRGASVSDSVEILHRSSPFFVRSLLFFGLQS

SEQ ID NO: 143633 - protein, 70 aa, Glycine max
  Coding DNA Sequence Number=SeqID_51948
RAHHNAYFGKSALEVARGEAFAKIPRFCLGPSSLTDSFASWKMNGSGMEKEEREETPLQGEDESRRSSPP

SEQ ID NO: 143634 - protein, 135 aa, Glycine max
  Coding DNA Sequence Number=SeqID_51949
MIGEWVCLHVRPILLKCQPSDVYQMLDLVFKGQAFFGGVAWGFPMIFPGVITAIWLATRDGKRSSYVTGIGVNSGIGLGGKFLIALEPIPKWALPAGRVVVGAGAWGASLWMGVGALGCMGAELEEFPARAKMLG

SEQ ID NO: 143635 - protein, 80 aa, Glycine max
  Coding DNA Sequence Number=SeqID_51950
MPEDFSSSVLAPLPILIHLHVTLIRYRSNNESREGTNTGNPTVDFEQEASRTKDEEDEDVRLPPELERIIAREDREIRPH

SEQ ID NO: 143636 - protein, 112 aa, Glycine max
  Coding DNA Sequence Number=SeqID_51951
MTRGNPGDLRPFDPEIDGTFHRFVRHSVHPGHSVHFEHSVEGDFEYSDFEHSTTNFYTENMAQPPPRERTPREMAAPNFTYESLCIQYPDEGVPCVKILISILRSSISFVPP

SEQ ID NO: 143637 - protein, 157 aa, Glycine max
  Coding DNA Sequence Number=SeqID_51952
MLEDDCQYLMVSKIPTVGISLKAQTEINGLLEGYLRHFSANQPEGLELLDPLTPHTIAAGGGLPISLLFCQDVAGAQRPSPNLLKLKAWPGLKEEESRPCREADRRDRPREERAQPTRAPPDVGQPESEASWERAETDDSKTKSETTGRLAERLSTR

SEQ ID NO: 143638 - protein, 170 aa, Glycine max
  Coding DNA Sequence Number=SeqID_51953
VVVPGKIFQSPFPKWYNPSTTCAYHGGITGHSVEQCLALKSKGGGVNAIEVSRSHGPKLLKDVTTSRNFIYKALQKAGMIPRGKHREDSCLMHPGVLHDMETCSAEEKKPEENKVEEKKAEEEEKKEEEKKPEQSKDDKESKEESASPEIMQGTTIAMHGHFKHDFWHFL

SEQ ID NO: 143639 - protein, 41 aa, Glycine max
  Coding DNA Sequence Number=SeqID_51954
MLGVCMKWPQGSLPQRGPGRIRRPKELVPLPSMTVTALGAL

SEQ ID NO: 143640 - protein, 94 aa, Glycine max
  Coding DNA Sequence Number=SeqID_51955
MSGFTRDSPQISANLHQLDLAPYASGPYNAQWNAPGLFHDKHHVAFESYSRRNGGMAFVDNWVVGKEEPYRNGSHSMGFSLFLTLFICPVSQSS

SEQ ID NO: 143641 - protein, 70 aa, Glycine max
  Coding DNA Sequence Number=SeqID_51956
MEALKEQMAIMMEAMMSMRKIMEANAVAIAATSAVAKVNPMPPSSLNQMNHPTSDMVGNDLGSTGGPHYA

SEQ ID NO: 143642 - protein, 114 aa, Glycine max
  Coding DNA Sequence Number=SeqID_51957
MTPSTEDVKKAMQGLFVVLQLSMWGWFHTFFSKKVGPSIRYKDRELRGSSNGIIGGYHKWLRVRTQGLDWLPNLKTVRDDEVKASEESDEVQALKAELERARVVEEKFKSIAIK

SEQ ID NO: 143643 - protein, 58 aa, Glycine max
  Coding DNA Sequence Number=SeqID_51958
MTTLDMVPIFIQLKFQSLDIEMTFKAEVERHVEKKLRLSNLTVVVLIVEASFMMMNQD

SEQ ID NO: 143644 - protein, 131 aa, Glycine max
  Coding DNA Sequence Number=SeqID_51959
MDLQKYQLVCVVPTWGSHPQRHPVDLKKSNRALGFPALVTGLYRPYRAPVPPASSCHHDIGIVPARHLVDSKKANRVLELLALNTGLCQFKGVPVAPSKVIRPPTNRAFIKKYCAPRQTQGETPQQHWDGR

SEQ ID NO: 143645 - protein, 55 aa, Glycine max
  Coding DNA Sequence Number=SeqID_51960
MAITSTISIAQVDVMDEFIQFEDEDMSQEGKEDEYVEMEKAQATSNMESFVVGDV

SEQ ID NO: 143646 - protein, 48 aa, Glycine max
  Coding DNA Sequence Number=SeqID_51961
RKEGEACHPARPGSPRRARLLPLEGTAFSRNFLEGPSGPGCYLHPDVY

SEQ ID NO: 143647 - protein, 389 aa, Glycine max
  Coding DNA Sequence Number=SeqID_51962
MTHEVLSGNCDEPAKCAYGFLEKKGTFYTLSNELDRRHWRKELTDFLDGNIDVAIVKEFYANLYDPEDKSPKQVRVRGHLIKFDEDTLNTFLKTSVVVEEGETLCAYSRFALLGPYPQELAAKLCIPGRGFELNADGYPVKILRKNMTPLAQTWSVLSFSNLFPTSHTSDVTLDRAKLIYGIIMKVDMKVGYLISHQISLIAQHDTSRLGFPALITTLCKARGVQSDSRSLESLSPTINLAYIKKNCWNLDDPTVTFRGPRKARGKRSEAPSTSTPSEAPTPSSSPVPPSSSTQILVIPPTPLQMPLPAPLSTGPSDFLFTPQMLYSMLQSIHKGQSIIMQSLQGLGLPSIMSMEEFEAQVAWPGDHPSSFGGVGPQQPRSLILRSHQH

SEQ ID NO: 143648 - protein, 144 aa, Glycine max
  Coding DNA Sequence Number=SeqID_51963
MNLEISSPPSDSTQAPEVPTSNVPLSPPPMYQHLKFHKKMKQTRRHVKRESTQCWTVEAIDVEETIKKIKVKVRGVNSLPRELRIIVNFDDQGQAIGEAQALLAGFLGTLAADCKLFPMDYDRWSRPSGVPKAYFDDCFETILK

SEQ ID NO: 143649 - protein, 110 aa, Glycine max
  Coding DNA Sequence Number=SeqID_51964
MQNSGVTLSAESQHFASDDSNTGVRTDDVGFTLVDLKKLAYQNDPFIMAEQAKQHWAHQKASSGSNQLAWGREAEYEGFNTLGIQNSLKISEEKKKEGENPSRGTFVTFP

SEQ ID NO: 143650 - protein, 185 aa, Glycine max; identical to SEQ ID NO: 118639
  Coding DNA Sequence Number=SeqID_51965
  Homolog annotation: Hit_ID=A8ARU6; Match level="QueryCoverage=23%, HitCoverage=56%, E-value=3e-17, Identity=88%"; Hit description =Putative uncharacterized protein

SEQ ID NO: 143651 - protein, 278 aa, Glycine max
  Coding DNA Sequence Number=SeqID_51966
  Subcellular localization annotation: CTP_CleavageSite=27; ConfidenceScore=5.38e-01
MTTRPRLQRTTRPHHQRVARPLLQRTTCPHLQRSTHPPLKRTTCPRLLRTGRPHLQRATRSHLQRTTRPRLQRTTRFHAFAFRGLHVLTLRGPHVLAIRGPHVLAIRGLHALAFRGLHVLAFRGMDVLIFRGLHALTFSGPHVLPFRGLDVLTLRGLHALIFRGLHLLPYRGLHVLAFRGMDVLIFRGLHRTTRPHLQKPTRPRLQRTTRPPLQRTTRPRLHRNGRPDLKRATRPQLQRTIRPPFQKATLIAFRGIHALIFRGLHVLTFRGLHALTFK

SEQ ID NO: 143652 - protein, 183 aa, Glycine max
  Coding DNA Sequence Number=SeqID_51967
  Homolog annotation: Hit_ID=Q6WAY6; Match level="QueryCoverage=58%, HitCoverage=19%, E-value=2e-15, Identity=41%"; Hit description =Putative uncharacterized protein
GHHSCTEKGGANWDQLLANKEGAFVNWFPRWKEGRVGVLISCGGFPNVPLMGTRGCISYNLVLAIRQLGYPMRGAPLEDELAPVISRGFNKTNVETLQKVRKAWEVLQKKDKELRGSNNGSIDGYRKWLKAHVQGLDWLPSLRTAKREEDEALEEDEEVQALRTKRKQAQTVKERFKSATLKI

SEQ ID NO: 143653 - protein, 72 aa, Glycine max
  Coding DNA Sequence Number=SeqID_51968
MAGRKIGGEGFRENERLQGHVVIDYTNMVIDYQRATLPEITACNRLHYYGNRLPMVILARNKIEGFLGEKKF

SEQ ID NO: 143654 - protein, 137 aa, Glycine max
  Coding DNA Sequence Number=SeqID_51969
  Subcellular localization annotation: CTP_CleavageSite=50; ConfidenceScore=5.13e-01
LYTSSASSPSRDCHFSGSDASSSGMTSILIPGGDRSSAVGITGYPHGQVRSRNAIGQLLGYPLVLEEARSASMAEEEPDFARTAAGRVRSAHHMPPDQIWRLCQHICPDHIRPPHAEVPAGVRHPDTDEHPCGSVDR

SEQ ID NO: 143655 - protein, 115 aa, Glycine max
  Coding DNA Sequence Number=SeqID_51970
MSYRMSRHHASEHADCMCPYEQIKQVNNTRELLTQFGAPHLHLGATKPGRKSTLNSGTIKVAHKRLKSQNSQNNSSIPDLVQNSCSLHDYIAVYDSGLQVLDAGGDLSSSEKSAS

SEQ ID NO: 143656 - protein, 218 aa, Glycine max
  Coding DNA Sequence Number=SeqID_51971
CWIYEHFPSVAESTTDQDYDEGFSACVQVDCDEEDREEHSHTVVQGVPELTPDFGCLLDPLWGASGGLGLPRQIMLFRVVRQFGYTQTIPAPPIDSWVSYDDIYDRWMHYEDHIVPAGEVCVVPRACSSDYIDWFFRISHPFMTPGHALDPLPHGHAPQPRVVPQAPQMDIPRVPKLGASSTSAEEPRHAMEVCDDIAERVGAPSESRVVTPGSSTHE

SEQ ID NO: 143657 - protein, 31 aa, Glycine max
  Coding DNA Sequence Number=SeqID_51972
MEHLNQLLPRQIMSIFLKDLMTGMMIGLGEQ

SEQ ID NO: 143658 - protein, 69 aa, Glycine max
  Coding DNA Sequence Number=SeqID_51973
MRGQDIYSSQDEATTSPSSSKVKKQRGRSSEEIYPKKKDKLGWLRRSVRRVPMNPKRIKVIPEWPAPPS

SEQ ID NO: 143659 - protein, 109 aa, Glycine max
  Coding DNA Sequence Number=SeqID_51974
ITLVRHPVDPKKSNRVLGFPALITGLYQFYGVPISPSKVIRLPTNQAFIKKYCAPRQAKGETPQQPGDGQQRATDAPSPPPEPFSSSTKAGALPMTHGRPAGDQVQSQR

SEQ ID NO: 143660 - protein, 158 aa, Glycine max
  Coding DNA Sequence Number=SeqID_51975
MAKFDPDIVLKFYANAWPTEEGVRDMRSWVRGQWIPFDVEALSQFLGYPLVLKEGQECEYSQRRNRADGFDEEAIAQLPGDGYRSCMLPTRHPLDPDKSNRALGFPALISGLCQSFGVPVTPSKKYCTPRQAQGGAPQALDAPSPPHQDDPARSFDTE

SEQ ID NO: 143661 - protein, 209 aa, Glycine max
  Coding DNA Sequence Number=SeqID_51976
  Homolog annotation: Hit_ID=Q2HW90; Match level="QueryCoverage=97%, HitCoverage=39%, E-value=2e-17, Identity=32%"; Hit description =Putative uncharacterized protein
DLAAIDAFLAYHHSKESSAIAILVDAYDTFNRRCKKSSARIVCCTPALYVWLVSHIFRHESRPVCPLQGHRMCAEKGKENWEQLLVGMVGAFVNWFPLWKEGRVGVLSSCEGFLNVPLMGTRGCINYNPKLAIRQLGYHMRGAPSEESIMPFIARGFNDPNAKMLRRVRKAWNVVQRKDKELRGSINGVIGGYHKWLKARMQGITWLPN

SEQ ID NO: 143662 - protein, 243 aa, Glycine max
  Coding DNA Sequence Number=SeqID_51977
  Homolog annotation: Hit_ID=UPI00006A2D9E; Match level="QueryCoverage =69%, HitCoverage=98%, E-value=9e-09, Identity=18%"; Hit description =UPI00006A2D9E related cluster
MTGPLDESISCFLIRVNPWVLVPIAFRGLQVLTFRGLHALAFVGLHALTFRGLHALAFVGLHTLAFRGLHVLTFRGLDALAFVGLHALTFRGLHALTFRGLHALTFRGLHALTFRGLHSSPSSEVPLVPFAFRGLHVLATSERTARPCLQMTTRPRHQRTARPHHKRTTCPHLQRAARPRLQRTTRPRLQRVARPQLSENYASSPSEDYTSSPSEGCMPSSSEDYRSSPSEDYTSSPSEDYTS

SEQ ID NO: 143663 - protein, 132 aa, Glycine max
  Coding DNA Sequence Number=SeqID_51978
  Subcellular localization annotation: CTP_CleavageSite=73; ConfidenceScore=5.83e-01
MPPKASGISLRGGRSTGKGPRQALPEPTTNKSSTSSGSSTQAGSSTQKTNLEGPSTQITSIKPESSTQEPPKSATAKQTSVDYAWTIETLQALQDMDGTWILGQKSLQGVGQGFPIRISLQTNDHPEDKNFL

SEQ ID NO: 143664 - protein, 172 aa, Glycine max
  Coding DNA Sequence Number=SeqID_51979
VPGTGAEPCDARNFLIGFLPDFIESVPVEQGRHIEAVARCKGEISPKHRDIDCLVEGVDRRLDDVLCKCRTCISLEPPFDWALRPHIWRCKRACTQRANGYVYQRDFLRRQGSHHEEIVAEGRRDIRDLASDGVEHAEPDGVKAEALDQRYVKRRYDDQHGRIIKEHAQYDE

SEQ ID NO: 143665 - protein, 65 aa, Glycine max
  Coding DNA Sequence Number=SeqID_51980
RLTSSSTPLSSKDDESDDMPRYLMVIRTFCQPEASEPVYTQRLTSSSAPLSSRDGESDDMRRHPR

SEQ ID NO: 143666 - protein, 60 aa, Glycine max
  Coding DNA Sequence Number=SeqID_51981
MVNNPSEFNIHRKVEKKKQYPEEKGERELEGGLVPSLEEFESRSKGPTTLRAIGLRSTPN

SEQ ID NO: 143667 - protein, 119 aa, Glycine max
  Coding DNA Sequence Number=SeqID_51982
  Subcellular localization annotation: CTP_CleavageSite=68; ConfidenceScore=5.39e-01
MARKSRQDFSVSKPREKFRSSLSISRSLLLLFSHPPLLPNKASAFSAHFCSKSRKEGIFGVVKRVSTCGTSKFQVRVCFKFTSFSISLLKPRKTIELRGIGHLDPVLLCFEGGLWFRHD

SEQ ID NO: 143668 - protein, 164 aa, Glycine max
  Coding DNA Sequence Number=SeqID_51983
  Subcellular localization annotation: CTP_CleavageSite=43; ConfidenceScore=5.30e-01
MTLRSLFQGPKNPGLQDLRPHPLQFSPSSSRSLHSKLRAFLVYAAEPEPGPTPDYAELARCGLATTSYEHGGVSAEGCLARSPAFFFGRGEFLSGFLVEPIIRLIKVILVASTQTYLPSPEVASTLTYLPSSEVASSKTLQPVSSDPLLLRFMSSGIRALALDT

SEQ ID NO: 143669 - protein, 280 aa, Glycine max
  Coding DNA Sequence Number=SeqID_51984
  Gene Ontology: Mol. function=heme transporter activity; Cellular component=mitochondrion; Biological process=respiratory chain complex IV assembly
  Homolog annotation: Hit_ID=Q04647; Match level="QueryCoverage=99%, HitCoverage=48%, E-value=1e-119, Identity=77%"; Hit description =Probable cytochrome c biosynthesis protein
  Pfam annotation: Domain name=Cytochrom_C_asm; Domain location=1-280; Score=-45.7; E_value=0.0074; Accession=PF01578.11; Description =Cytochrome C assembly protein
MSLAPLGARRSRGSREGKRRTHPLLHLARDDKERASSIDEQRIDGALGIALFFSPFLSASSDPFVRNFFVRTEPLAESNPVPQDPISAIHPPCIYAGDVASAMGFGLCRSKMMNGIVALHSPPMRKDAAEKKGTLLRSAGCVGSRITSELFTKKFKHVVAKCYPALLLRSNRSLLMLLWRRFFAFSSLWTGALVDTGGEQAKRVVRNEQKDTTTSPLCWSAGANTVVSDQDQKQIRIWILTCRWFLTVGIMPGSWWAHHELGRGGWWFRDPVENASFMPW

SEQ ID NO: 143670 - protein, 110 aa, Glycine max
  Coding DNA Sequence Number=SeqID_51985
MVEAESSQNLQSTQDSTDWTNDIYSKVKGPEKRGRVHCLGKLPHQASSSQSSYTNNRIQKLENLLGNLVAVLKVRFAEDPQINQVLEAIDQEVPTNDSTGKDHQTTNNLS

SEQ ID NO: 143671 - protein, 51 aa, Glycine max
  Coding DNA Sequence Number=SeqID_51986
TLGVSVFSSLFMWGGILPVENDLEWQSEGKRHQKWVFLCRQSLTLPKIYLV

SEQ ID NO: 143672 - protein, 89 aa, Glycine max
  Coding DNA Sequence Number=SeqID_51987
MKNVEERSKPSRNSSRKRYGNVSEAPRLGFSSRKQFFQANSKEREKIGGEACHPARPGRKVASSRSNSLLEESSGGPKWPGCYLNPYFY

SEQ ID NO: 143673 - protein, 74 aa, Glycine max
  Coding DNA Sequence Number=SeqID_51988
MNMIKACHRYSEDVYVMMQENQHITTSHYVRMYVRETGEFEVQEIANTLLGRRAMACTVKLNEWSCDCEQFQAL

SEQ ID NO: 143674 - protein, 315 aa, Glycine max
  Coding DNA Sequence Number=SeqID_51989
  Homolog annotation: Hit_ID=Q6WAY6; Match level="QueryCoverage=34%, HitCoverage=23%, E-value=2e-13, Identity=35%"; Hit description =Putative uncharacterized protein
MVEVSTKAIASLAQYYDQPLICFTFGDFQLSPMVEEFEEILGCPLGGRRPYLFSRKQVENGVVGIPRKYLEAKARILASKGKWAPFIDIFVLLIFGGVLFPNVDGLVDLAAIDAFLAFHDHKESLVRHACPLESHRSCTEKGGANWDQLLANKEGVSVNWFPRWKEGRIGRGTLEEELAPVISRGFNKTNRETLQKVRKAWEVVQKKDKELRGSNNGPIGGYRRWLKAHVQGLDWLPSLRTAKREEVEALEEDKEVQALRAELEQAQTVKERFKSTALKIRKENAELRDTNIAITKALEQETKRVHREEHGRNKF

SEQ ID NO: 143675 - protein, 99 aa, Glycine max
  Coding DNA Sequence Number=SeqID_51990
MRKGFPLSSDIISARNWVANVVLKFYDDPTMNEPEIVVFLRQTQSYMQCGTMSVKNLVRCLGVRDKTDHTLVSQVTLTSFNSSRLKVIKLVGFPLWIPL

SEQ ID NO: 143676 - protein, 191 aa, Glycine max
  Coding DNA Sequence Number=SeqID_51991
MKDKRDEEEKLEKQKKKKDSKALSSKARGKEKEEKDSSKKIRKIILQQKVISKEHSFINNLSTLSYQGKHPSTLPYLFSLRYSEASNPYDRCDQGVPTNLKRIKVILERPTPPTPLIELVRNYVPSWEVAQEMGFQTLPYSNIPNTTNIYVFILFTSVEGRIPEFQEPLDLRSNPFQGGGNDAILPPNGIG

SEQ ID NO: 143677 - protein, 154 aa, Glycine max
  Coding DNA Sequence Number=SeqID_51992
  Homolog annotation: Hit_ID=P03851; Match level="QueryCoverage=54%, HitCoverage=100%, E-value=4e-44, Identity=98%"; Hit description =Uncharacterized 9.4 kDa protein
MNRKNAALLAFSIVLRPPDEHHENRRSSQRWRNRQDYKIPVRSPWKLPRALSCSDPAAYRIPVVRSKLGCVHEPPVQPDRCALSGNYRLESNPVRHDLSPLAAATGNRISRARYVGGATEFLKWWPNYGYTRRTVFGICALLKPVTFGKRVGSS

SEQ ID NO: 143678 - protein, 97 aa, Glycine max
  Coding DNA Sequence Number=SeqID_51993
MGRYFQHLVRQQAANHRGQVQIHECLYQLNLSQQSLDFAPFACRTPDQFRAEVAWPRDWPEDQTEEAPAGALDGAEDARMDEEMIDLLDFLGGCGAT

SEQ ID NO: 143679 - protein, 245 aa, Glycine max
  Coding DNA Sequence Number=SeqID_51994
RKVEIYHSELDEFKAELERRNFHKRLTNLVDGSIDLALVKEFYANLYSSEDHPPKQSRVRGHLVKIDANNLNTFLETLVVLAEGETLPAYSRYCRLPTDYRDIEAALCIPSRGFILNSEGHPGKILRKDLTTLAQSNTSRLGFPALITALCRARGVVSDSLSFERLSPVINLAFIRKNWARRARARPAELPSTSAAPTTASTSTAPSVPVVAPPGSIPSVEQFTEMVAWPGTQPSLHREYEGPTA

SEQ ID NO: 143680 - protein, 113 aa, Glycine max
  Coding DNA Sequence Number=SeqID_51995
  Gene Ontology: Mol. function=protein kinase activity; Cellular component=integral to membrane; Biological process=protein amino acid phosphorylation
  Homolog annotation: Hit_ID=A2Q5X8; Match level="QueryCoverage=98%, HitCoverage=18%, E-value=7e-41, Identity=73%"; Hit description =Protein kinase
ERPTEVYKAPETFKGNLVEWITELTSNAEHHDAIDESLVSKDADGELFQFLKVVCNCVSPTPKERPTMFEVYQLLRAIGGRYNFTTEDEILVPTDIGDTDKMEEFIVAREGSY

SEQ ID NO: 143681 - protein, 72 aa, Glycine max
  Coding DNA Sequence Number=SeqID_51996
MPIGWTSQKSGADIEGEELTDLGSNPLQGEMDDAILPRKEPVTRAMSKRLQEDWARVAEEGPRVLMNLRVDF

SEQ ID NO: 143682 - protein, 104 aa, Glycine max
  Coding DNA Sequence Number=SeqID_51997
SFLIGAAVVASFGYCKERDGSWVKKGAQPNDDKGQLPVEGDSSLLQSILDKFDGLQTYVGERFDALERQVDMRFDAMDSRITKVEEDVTIIRDCLDLPLPPSSV

SEQ ID NO: 143683 - protein, 84 aa, Glycine max
  Coding DNA Sequence Number=SeqID_51998
MEISSFHQFPNESLSEALDRFHGLLRKTPTHGYREPVQLNIFIDGLRPQSKQLLDASAGGRRMSHMWRNARAWAMYSPRRSFQE

SEQ ID NO: 143684 - protein, 120 aa, Glycine max
  Coding DNA Sequence Number=SeqID_51999
  Subcellular localization annotation: CTP_CleavageSite=40; ConfidenceScore=5.35e-01
MSAFTFSCTSSALPITLALAQVKLEVTRISTILNVFDNSRSNDVTQSIFCPNFCKMVTSILQLDSMNLFVKARAWFNPITQGMAILIANTSSTFHKDERLGNTHAMHGKWEYARFTHEQT

SEQ ID NO: 143685 - protein, 141 aa, Glycine max
  Coding DNA Sequence Number=SeqID_52000
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=60%, HitCoverage=72%, E-value=7e-25, Identity=68%"; Hit description=LacZ protein
MLATGNRLLPSAHEFLTSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 143686 - protein, 193 aa, Glycine max
  Coding DNA Sequence Number=SeqID_52001
  Homolog annotation: Hit_ID=Q0KIL1; Match level="QueryCoverage=71%, HitCoverage=16%, E-value=2e-07, Identity=29%"; Hit description =Gag/pol polyprotein, 3'-partial, putative
  Pfam annotation: Domain name=G-patch; Domain location=35-74; Score =24.3; E_value=0.00022; Accession=PF01585.14; Description=G-patch domain
ESLETAFQSFEVVSISSVDSLFGQPCLSDAAVMMARVMLGNGYEPGMGLGKDNGGITSLIKTQGNRGKYGLGYKPTQADMKRSTAGRKDSGQSSRWRQESEGSPPCHISRSFISAGLGDEGQVVAICEDDVPSTNTWDPSINFEQEMNQTEDEGDEDVGFPSELERMVAHEDQEMGLIKKNRASRLRIGSERG

SEQ ID NO: 143687 - protein, 161 aa, Glycine max
  Coding DNA Sequence Number=SeqID_52002
  Homolog annotation: Hit_ID=A6H595; Match level="QueryCoverage=45%, HitCoverage=85%, E-value=2e-27, Identity=81%"; Hit description =Putative 23S ribosomal RNA
HPETRKGVVSDEMLRGVEISVDPGIPDIGQPFELLLNPRAGKRQPELYKCRAARRSSRECCTLDGESPVAESITSLRSDPSSMGHVESRVNQQGPPCKAKYSWVTDSEVVPETTGAVAKASLHRAIVTAYGPEPGSEPTDVEESADELWLGVKCHSNPELA

SEQ ID NO: 143688 - protein, 78 aa, Glycine max
  Coding DNA Sequence Number=SeqID_52003
  Homolog annotation: Hit_ID=A6FJQ2; Match level="QueryCoverage=48%, HitCoverage=84%, E-value=5e-10, Identity=86%"; Hit description=50S ribosomal protein L5
MRKEKIPHQAPFAIQAAQLLGRAIGTGLFANTPAGERGMCCKAIKLGNARVFPVTTLSTLEDPHIHGAPKKGENGGLP

SEQ ID NO: 143689 - protein, 267 aa, Glycine max
  Coding DNA Sequence Number=SeqID_52004
  Homolog annotation: Hit_ID=Q2HW90; Match level="QueryCoverage=51%, HitCoverage=31%, E-value=7e-19, Identity=37%"; Hit description =Putative uncharacterized protein
MPTGRKEAISVLWVLSLHDKSCQGSAWRKGQRPWKIKANGLSFIDILALLIFGVVLFPNMEGLVDLAVIDASLAFHHGKESPVVAILAMYDTLDRRCEKSDARIVCCTPALYVWLVSHLFSKKVGPSIRYKEGRIRILSSCEGCPNVPLMGTRGCINYNPVLAIRQLGYPMRGVPSDESITPFIARGFSDHNARDRELRRSSNGIIGGYHKWLRVRTQGLDWLPNLKTVRDDEVKASEESDEVQALKAELERARVVKEKFKSIAIKV

SEQ ID NO: 143690 - protein, 215 aa, Glycine max
  Coding DNA Sequence Number=SeqID_52005
  Pfam annotation: Domain name=zf-CCHC; Domain location=8-25; Score =18.9; E_value=0.0021; Accession=PF00098.14; Description=Zinc knuckle
MEEKTSSIKCFKCLGRGHSTSQCPTTKTMIMRGPDIYSSQDEATTSPSSSERDEEKWEESSEEIYPQEEGQPLVVKEKCKEVSVSSKSLAKKETHFTIKTNIKEIFPLRQPPHFLFCKKTLVSTATPFGLEVKSLCFVGAQNSDQGVPKDPKRIKIILDWPTPPSIREIWGCHDLTNFYKRCQGKEPEYEEPQDLRSNPFQGGRDDAILPPKGIG

SEQ ID NO: 143691 - protein, 340 aa, Glycine max
  Coding DNA Sequence Number=SeqID_52006
  Gene Ontology: Mol. function=nucleotide binding; Cellular component =intrinsic to membrane; Biological process=defense response
  Homolog annotation: Hit_ID=A2Q3B4; Match level="QueryCoverage=99%, HitCoverage=70%, E-value=1e-111, Identity=59%"; Hit description =Disease resistance protein; Calcium-binding EF-hand
  Pfam annotation: Domain name=NB-ARC; Domain location=2-203; Score =33.0; E_value=2.2e-12; Accession=PF00931.13; Description=NB-ARC domain
MVDLEQLQNQLRSKLAGKKFLLVLDDVWNDDRVKWVELRNLIQEGVAGSKILVTTRIDSIASMMGTVTSHKLQRLSSENSLSLFVKWAFKEGEEQKHPHLVNIGKEIVKKCRGIPLAVRTLGSSLFSKFEANEWECVRDNEIWNLPQKKDDILPALKLSYDFLPSYLRQCFALFSLYPKDYEFRSFEVVRLWGALGVLASPRKNETLEDVVKQYLDELLSRSFLQDFIDCGTFYQFRIHDLVHDLAVFVTKEECLLVNSHIQNIPENIRHLSFAEYSCLGNSFTSKSVVVRTIMFPNGAEGGNVESLLNTCVSKFKLLRVLDLSYSTCKTLPRSIGKLNT

SEQ ID NO: 143692 - protein, 150 aa, Glycine max
  Coding DNA Sequence Number=SeqID_52007
MWAFHTGRQLDWAHLVRYRMLKALRLNAPLPYPHLVTLFLRHFQIPLDSKPYVPIKRSFLIGVAVIASFGYRKEHDGSWVKKGAQPADDEGNQPVEDNSSLLRRLLDKFDGLHTFLGDKFDAMELITKVEEDVSFIRTCFDPPPPPPSSS

SEQ ID NO: 143693 - protein, 102 aa, Glycine max
  Coding DNA Sequence Number=SeqID_52008
  Homolog annotation: Hit_ID=A9P815; Match level="QueryCoverage=68%, HitCoverage=41%, E-value=2e-15, Identity=55%"; Hit description =Putative uncharacterized protein
STGNHHWKITSVSSPLEDHLSLFNSKPASVGIKLLALKFLETFVLLFSSDIGDTEKLATKGIRQAVNVEWLVGGHPHPVLDPVVLISDANRTIGILLTLLLL

SEQ ID NO: 143694 - protein, 132 aa, Glycine max
  Coding DNA Sequence Number=SeqID_52009
EPFGTHSLRCNTFPKQAIGLTDRGLDGDPQQAPSTTTSGKSLSLLDHANKGMPHLRWSTRARTMHSLRRFFQGGELHGSSESPRIPRLQPRRTIRIEPREEFHIGIKLEESSGEPVQQGAKKSTWPEFQPRD

SEQ ID NO: 143695 - protein, 127 aa, Glycine max
  Coding DNA Sequence Number=SeqID_52010
MARAGDNGGVYHQLDESQRLFLDAWTTQMQRLLNRNKEEPYRRIAKSSSFTLKPLSPRKVCDDQIRMREKREQEKENSEAPQRNMKKKSDTPEEKSDTQERESDNSNQNLKMSFPRRFLMDCHLQEA

SEQ ID NO: 143696 - protein, 36 aa, Glycine max
  Coding DNA Sequence Number=SeqID_52011
EGASETFRNVSVRNSQRFNRSSTFFIRSSSFFDLQR

SEQ ID NO: 143697 - protein, 131 aa, Glycine max
  Coding DNA Sequence Number=SeqID_52012
MLLSSNVIYICVRVVMLVRMIRTRLFATAWVKSCPGMHSSYVIASISGCIRTVGPPPISGGGPGTVKRKLLVWIRSPLKVRTHSPLKARACSLLKFRTCRLLKVRECSPMMARTSNPLKVRACPPLKMGDM

SEQ ID NO: 143698 - protein, 97 aa, Glycine max
  Coding DNA Sequence Number=SeqID_52013
MPIGWTSKKSGADIEAEELTDLRSNPLQGGGDDAILPRKGPVTRAMSKRLQEDWARAAEEGPRVLMNLRVDFFMLYMFHDTYAHLVENLGLDLGLVG

SEQ ID NO: 143699 - protein, 159 aa, Glycine max
  Coding DNA Sequence Number=SeqID_52014
LELPRSEFLITNGGYAGAKAPLLSTTPPFAFMTCESGVMRRHPMVICPHIVAIQGPQVRLTSGDQMWSSAPFPEMSTSSGQVAGGHTQVIVRTSTTSVDLDPRVGWQADIPKYTQVIIPTKTTSVDLDPSVRYTQVIIPTKTTSVDLDPCVRWQADIPK

SEQ ID NO: 143700 - protein, 99 aa, Glycine max
  Coding DNA Sequence Number=SeqID_52015
MARSVFTPCPYFRDLHGRKLKGILVIIPKVGLHGKESTLIDWSNSLTKVPSGVANCRNLPFGRRATRGSWVRLPRKENAWSHHQRLFEENVGKTGKDVV

SEQ ID NO: 143701 - protein, 151 aa, Glycine max
  Coding DNA Sequence Number=SeqID_52016
  Homolog annotation: Hit_ID=UPI000065F7CF; Match level="QueryCoverage =97%, HitCoverage=22%, E-value=6e-13, Identity=32%"; Hit description =Homolog of Homo sapiens "Leucine-rich repeats and IQ motif containing 1
MAACPHLQRTTRPHHQRAARPHLQRTTCPRLERATRPHLGERTTRPRHQRAACPHLQRTTRPHLQRTTRPHHQRAARPHLQRTTCPRLERATRPHLGYYLPSPLRGLHVLALRGLHVLTIRGLHALTSRGLHVLALRGLHALTLGTSYPHR

SEQ ID NO: 143702 - protein, 20 aa, Glycine max
  Coding DNA Sequence Number=SeqID_52017
IKTGGVTSKKARKIEEKKKI

SEQ ID NO: 143703 - protein, 125 aa, Glycine max
  Coding DNA Sequence Number=SeqID_52018
  Gene Ontology: Mol. function=RNA-directed DNA polymerase activity; Biological process=RNA-dependent DNA replication
  Homolog annotation: Hit_ID=A5BSP7; Match level="QueryCoverage=67%, HitCoverage=7%, E-value=4e-16, Identity=49%"; Hit description =Putative uncharacterized protein
MILLDNQDIESESSRHDEMPPLEDCSDVDVVEPINGDVLVTSTLLVEKLGLPTLKHPNPYRLQWQNDCGDIRVTKQVLVSFSIGNDAILLRKGPITRAMSKRLQEDWARAPEEGPRVFMNLRVDF

SEQ ID NO: 143704 - protein, 64 aa, Glycine max
  Coding DNA Sequence Number=SeqID_52019
  Homolog annotation: Hit_ID=A5BKB8; Match level="QueryCoverage=75%, HitCoverage=13%, E-value=7e-17, Identity=89%"; Hit description =Putative uncharacterized protein
MGGGGWPFLVGGGDLSGIPSKRESSARVDYVPALCTHRPSLLPIEWSGEVFGLRRRERFAARDV

SEQ ID NO: 143705 - protein, 217 aa, Glycine max
  Coding DNA Sequence Number=SeqID_52020
  Homolog annotation: Hit_ID=Q6WAY4; Match level="QueryCoverage=75%, HitCoverage=29%, E-value=1e-19, Identity=35%"; Hit description =Putative uncharacterized protein
MGTNQTGKRFYQVKVKSLDTTSIKELGRLMEPLQMQAFRKTYGKILELTIAEVSIEAIASLTQYYDQPLRCFTFGDFQLVPTIEEFEEILGCPLGGRKPYLSSGCLPSLSRIATVVKDSARGLDRIKQTRNGIAGLPRGYLEDKARGMANQGDWVPFMDVLALLIFGAVLFPNVDGLVDLAAIDASLHTTIARRARCKTRGIHVRSKAIARVLKRGE

SEQ ID NO: 143706 - protein, 69 aa, Glycine max
  Coding DNA Sequence Number=SeqID_52021
MPLHCMSSRQGSELGAYFGAKATMPAPLHKEKGEDEVHIMRVWKRKKKKGKKGILKNSGCTKQKMEGVK

SEQ ID NO: 143707 - protein, 147 aa, Glycine max
  Coding DNA Sequence Number=SeqID_52022
MKIYSTLLFLAEFSLAEEQGLENRKLRKLLGKGRRRKMSSKGFKISQKLFKKIKKLFECKSRSWFYRLFMSGQENHWKSYNLEKILRKPLEELHLLTFYSKLVTVKSFLKSNSITGNRLQETGNRLPESMMEACLWSFYGGWIFELQ

SEQ ID NO: 143708 - protein, 62 aa, Glycine max
  Coding DNA Sequence Number=SeqID_52023
MMALGSKRVLNPLLFVGDKFDAMELQVDMRFDAMESRITKVEEDVSFIRTCFDPPPPPPSSS

SEQ ID NO: 143709 - protein, 98 aa, Glycine max
  Coding DNA Sequence Number=SeqID_52024
MAPHLRLQRTQVPGPPPDIGGGPNVRAQSEEEAITQLLYISGQDFARAVAKRRVRIMRTNMTTLTQIWMMLLLSNILPSDHNVDLPLWKYQLVCAVTT

SEQ ID NO: 143710 - protein, 154 aa, Glycine max
  Coding DNA Sequence Number=SeqID_52025
MLNIQNLIYGYEKISSAYSPSPVDALFFTQKKAYAALISWNICLFAKACLHFSGENTETFSSLTSYPELRRSEFLIGGYVGARALLLSTTPPFAVMTQELVTRGDTLRLSAPRHSVTPSVIDEQRPMWSSAPFPEMSASSGGDFFKSHKLSTTT

SEQ ID NO: 143711 - protein, 153 aa, Glycine max
  Coding DNA Sequence Number=SeqID_52026
  Homolog annotation: Hit_ID=Q8H6W2; Match level="QueryCoverage=39%, HitCoverage=65%, E-value=4e-07, Identity=45%"; Hit description=Gag -protease polyprotein-like protein
MRGYISCESVLVEGTSTWFFKENKGRDIPCGSLACKGLYKVERNLKNRRYLVESFTTSRFMASSNSLFPEGNSIPRPLIFNGEGYHYWKTPMQIFIEAVDLNIWEAIEIRPYIPTIVDVSTSTQHKNLEISGLMRIKEESHIILKPKTLSLLP

SEQ ID NO: 143712 - protein, 114 aa, Glycine max
  Coding DNA Sequence Number=SeqID_52027
  Homolog annotation: Hit_ID=Q51617; Match level="QueryCoverage=35%, HitCoverage=57%, E-value=4e-12, Identity=87%"; Hit description =Putative uncharacterized protein
  Subcellular localization annotation: CTP_CleavageSite=55; ConfidenceScore=5.56e-01
MMQDINAIKIGVSRGPFVSRVSVMTVKTSDTCSSRRRSQLVCKRMPGADKPVRARQRMRKEKIPHQAPFAIQAAQLLGRAIGAGLFAITPAGERGMCCKAIKLGNARVFPVTTL

SEQ ID NO: 143713 - protein, 66 aa, Glycine max
  Coding DNA Sequence Number=SeqID_52028
MVILHTFPPSRGDRVRCHAETNYGHSGARRPGSIVSNKTQRQIMVILRLVSSKRNKLDSTRMMCRY

SEQ ID NO: 143714 - protein, 44 aa, Glycine max
  Coding DNA Sequence Number=SeqID_52029
MADEHQQRVTLEDYSSSSVPQFFTSIARPEEKPRGGSTHLRVTV

SEQ ID NO: 143715 - protein, 158 aa, Glycine max
  Coding DNA Sequence Number=SeqID_52030
MGIQKNSQAVKPLNAFVLGNGKNQKEFSDCVVLNSLTREKGDTKEFRRLVLCSFGKGRRETQKEFRRLVLGEFFLAKGEENEKMNSTSFQGLENQKTSESFWYKEEEEVQRDSRLVKDCMNNFSRLLLERLIENSKQSLAFIDSSCLVKKAIQKSYNF

SEQ ID NO: 143716 - protein, 41 aa, Glycine max
  Coding DNA Sequence Number=SeqID_52031
MVKEECKEVNVSSKSDQGVPMNPKRIKVLRKTAQSFKNLRI

SEQ ID NO: 143717 - protein, 222 aa, Glycine max
  Coding DNA Sequence Number=SeqID_52032
  Homolog annotation: Hit_ID=A5AI19; Match level="QueryCoverage=90%, HitCoverage=48%, E-value=1e-08, Identity=24%"; Hit description =Putative uncharacterized protein
  Pfam annotation: Domain name=zf-CCHC; Domain location=49-66; Score =13.8; E_value=0.013; Accession=PF00098.14; Description=Zinc knuckle
KGIALKVNSLREEYQGSSSSEEDAKNFSLMDKKFSKSYKKVDDNNNNNNTYFECGKQGHIKSECPIYLRKHGGEKKRKKGNKQKKAYIAWEDSSSKASNSSSDDEIADVFLMEKSKNDPSTSEEIEVNSNFGELLEALDEMQEEAQRLVVLNKKLKSELKLHMCLKARDSLWYLDSSFSRNMMGDKSKLSDFMSKDGGYITFGDNNNGNIMGEGNIGNQHKT

SEQ ID NO: 143718 - protein, 98 aa, Glycine max
  Coding DNA Sequence Number=SeqID_52033
  Subcellular localization annotation: CTP_CleavageSite=35; ConfidenceScore=5.08e-01
MLSATPVFSGRMSWTLYPTSWILQLQCFQQLQYFRAGCPGHSSSRLIFSLKWRLLSTILLLHSAAIKIQEAKDFIDEEDQRPTSSNGATSCGIKSIFI

SEQ ID NO: 143719 - protein, 159 aa, Glycine max
  Coding DNA Sequence Number=SeqID_52034
MEETHEIPHHDLANFEPCLGYAAEGQAVGGIPLQNTLEGPQYHPQLHLLHSTTSKNPHAMAEMGKLDHLEERLRAIEGGEDYAFANLKELFLEPNIITPPKFKVLDLDKMQLQNMCKKGDGSFKEHTQKVEGSGGPGGTPNDGKGDDNRDGRHIIDTLL

SEQ ID NO: 143720 - protein, 105 aa, Glycine max
  Coding DNA Sequence Number=SeqID_52035
MEIYVSDRLGKSVFSKGYNSSIGLLTRLEESIKRVHLLGFLTENKRGYISCGSVLVEGTSTRLFKENKGGYIPCGSLLVKGFYQVEQKSQGPQVAWGLDVRPGCC

SEQ ID NO: 143721 - protein, 90 aa, Glycine max
  Coding DNA Sequence Number=SeqID_52036
MLVFACYQAFRLTDSKKNAYTDNHSGISARQSESNTAKKKVYTDNHSGISARQRDSNVSMTDLVIVEDDVNLRVSTGLSAAIDEGRRIRH

SEQ ID NO: 143722 - protein, 114 aa, Glycine max
  Coding DNA Sequence Number=SeqID_52037
MIGTSKPYTGAMRGTVHEPQANLEADQKFPTSNVQSFEFGMIGPLDESISCFLIRVDPWVLVPITFRGLHVLAIRRLHVLAIRGLHALTFRGFTRPHLQRATRPHLQRAARPHH

SEQ ID NO: 143723 - protein, 92 aa, Glycine max
  Coding DNA Sequence Number=SeqID_52038
MGKRKLQMAIEDQQISFDMFHEEKTLPDKNIYLKVIVMEEKRQKKNWMLEPCWTQDHKMMRQANDVKRALTGRQPMFSFPFLFFILYLLHLV

SEQ ID NO: 143724 - protein, 218 aa, Glycine max
  Coding DNA Sequence Number=SeqID_52039
  Homolog annotation: Hit_ID=UPI0000ECBAF8; Match level="QueryCoverage =18%, HitCoverage=48%, E-value=3e-16, Identity=100%"; Hit description= UPI0000ECBAF8 related cluster
ATLPEGRKADRYPVSGRVGTGERTRELPGGNACLWKNASNAAFVRFLAFCWPFAHMFFPALSPDSVDNRITAFEKRKSAQYANRLSPRVGRFINAAGTTGFPTGKRAVSATQLIYDHDYEFELGTPLSATVNSDHAKLLEVRYKGWHYPSAEWNTWVQQMQHKYECMQAWHWPSFYNVVTGKTLALPNLIALQHIPLSPAGVIAKRPAPIALPNSCAA

SEQ ID NO: 143725 - protein, 106 aa, Glycine max
  Coding DNA Sequence Number=SeqID_52040
  Pfam annotation: Domain name=zf-CCHC; Domain location=32-49; Score =32.1; E_value=2e-06; Accession=PF00098.14; Description=Zinc knuckle
  Pfam annotation: Domain name=zf-CCHC; Domain location=9-25; Score =14.9; E_value=0.0084; Accession=PF00098.14; Description=Zinc knuckle
  Pfam module annotation: Pfam domain module=zf-CCHC::zf-CCHC; Domain location=32-49::9-25
MSESRGTGVQCFQCGGPHLRRNCPQLQQTQENRCYVCGKVGHYARECRVTRRPTVTANSNTVNHGPTNSTRSGNVSNNNPSGGRPKVPSRVFAMSGSEAAASDDLI

SEQ ID NO: 143726 - protein, 123 aa, Glycine max
  Coding DNA Sequence Number=SeqID_52041
  Gene Ontology: Mol. function=manganese ion binding; Cellular component=ribosome; Biological process=protein modification process
  Homolog annotation: Hit_ID=A8GCA7; Match level="QueryCoverage=100%, HitCoverage=41%, E-value=1e-57, Identity=91%"; Hit description =Ribosomal protein S6 modification protein
  Pfam annotation: Domain name=GSH-S_ATP; Domain location=2-100; Score=- 67.2; E_value=4.7e-05; Accession=PF02955.7; Description=Prokaryotic glutathione synthetase, ATP-binding domain
  Pfam annotation: Domain name=RimK; Domain location=1-109; Score=76.3; E_value=1e-19; Accession=PF08443.2; Description=RimK-like ATP-grasp domain
  Pfam module annotation: Pfam domain module=GSH-S_ATP::RimK; Domain location=2-100::1-109
EYVREAQGRDVRCLVVGGRVVAAIERQAKPGEFRSNLHRGGTARKVTITARERAIAVKAASTLGLDVAGVDILRAERGPLVMEVNASPGLEGVETTTGLDIAGMMIEYIEQRGRPGFRLKSGG

SEQ ID NO: 143727 - protein, 184 aa, Glycine max
  Coding DNA Sequence Number=SeqID_52042
MGDQEETQEQMKADMLALKEQMASMMEAMLGMRQLMEKNVATATTVSSAAEVLQATVHHLGYNPVAYPYGLPPNYTPPVMQDDAGHISSPILEGEPPRQPDEVHEDHQEYAQRDVDFYPPILVEGPEPNTLPLPNLTAQPIILSTEGPPPATEERRKLDLLEERLRAVKGFGDYPFADMTDLCL

SEQ ID NO: 143728 - protein, 394 aa, Glycine max
  Coding DNA Sequence Number=SeqID_52043
VARAKHRPCGLSAIRCGMHRAKLALLAKPLKRKSTASRPQAQYDTRRFHSFDAWNRYIDNILDRNILLERNVQIYHTEFDEFKVELERRNLHKCLANLHDGSIDVAMVKEFYANLYTIKEQAPKQASVRGHLIKEAQTWSVFSYSNLAPTSHTSNLNMDRARLVYGLVTNMDMIIGVLISGQISSIAQSNSSRLRFPALITALCRARGVTSDSLTCERLSPAINLAYIKKNCWNVDDLIVNFRGERKARVRPAEVCSSSTLLAPSTFATPTPAPRGSSTQDSQRFEAMLQTPPRSILSVEQFIEKVSWPGTLPSVVREGEGPSAQVPQQISPDPPFPVVDQSSLRQPADPPTPADASTPLLDLLEDYATPVLGLTTTPPTTPMLHLTDEKGTQD

SEQ ID NO: 143729 - protein, 126 aa, Glycine max
  Coding DNA Sequence Number=SeqID_52044
  Homolog annotation: Hit_ID=A5ANW6; Match level="QueryCoverage=89%, HitCoverage=44%, E-value=2e-09, Identity=32%"; Hit description =Putative uncharacterized protein
QVEGTSTWLFRENKGGHIPYGSLACKGFYKVERNLKNRRLLGDWMYRSFQDHDEDQANLCLMTKSHENNKEESVRKKWYINSGCSKHMKRDVSKFTTISPKKSGHAIYSDNNISKISKDVTSKPSL

SEQ ID NO: 143730 - protein, 226 aa, Glycine max
  Coding DNA Sequence Number=SeqID_52045
MAPRKLASKRSRKDKAVEGTSFAPEYDNHRFRSVEHQQLFEAIKGWSFLRERRVQLRDDEYTDFQEEIVRRWWASLVTPMAMFDPDILLEFYANAWPTEEGVRDMRSWVRGQWIPFDADAIGQLLGYPLVLEEGQECEYGQRRNRSDGFDEEVIAQLLCIPGQDFARTVAERRVRIMRTNMTTLTQIGMTLLLSNIQPNDHNSDLPLPKCQLVYAILTRMSIHMAQ

SEQ ID NO: 143731 - protein, 61 aa, Glycine max
  Coding DNA Sequence Number=SeqID_52046
MEEDLKKTLKFLDATNETNLVTSKQIVPQMRNGPRSVIRKKKEINLLTKDYESDENISQED

SEQ ID NO: 143732 - protein, 153 aa, Glycine max
  Coding DNA Sequence Number=SeqID_52047
  Subcellular localization annotation: CTP_CleavageSite=53; ConfidenceScore=5.05e-01
MGKNKGRQSHSTAKQIMVKGTTSGSGKVLVKKAGTNSTKIDDVTHQVFDNLPECSAKSESSSEVSCTLGDNDSTTDDDSSHSCGSKSSPQLDDNKAPTPWVNLFKDNRNPSKGFGMKFSPLPSDDEVLLKETDLQPLEEAWDIALLAMWLADS

SEQ ID NO: 143733 - protein, 243 aa, Glycine max
  Coding DNA Sequence Number=SeqID_52048
  Gene Ontology: Mol. function=RNA-directed DNA polymerase activity; Biological process=regulation of transcription, DNA-dependent
  Homolog annotation: Hit_ID=Q8H6Q8; Match level="QueryCoverage=88%, HitCoverage=50%, E-value=5e-25, Identity=32%"; Hit description=CTV.20
TSSSALSDEDLNLIQQDDQLSSTDDDDRQINTLTREQDLLFEAINSIPDPQEKKVFLKKLKKILEVKPRQKDFITNNKFDVSNILKRLENSSTKPTTIQDLQIEINSLKREVKELRQQQEIHQIILSQLEEDSDPESANNSEENQPDNLEDDMFMGLINKIKIQKFYINIKIIINDFVLETMALFDTGADSNCILEGLIPTKFFEKTSEKLSTSNGSKLKINFKLSNAIIENQGLRINTNFLL

SEQ ID NO: 143734 - protein, 38 aa, Glycine max
  Coding DNA Sequence Number=SeqID_52049
MMAIISKYKEELDLATAHEHKVADEYTQVYAEKEERGR

SEQ ID NO: 143735 - protein, 119 aa, Glycine max
  Coding DNA Sequence Number=SeqID_52050
MSDLSILFSIVYVVYKLENPDESLETSNNNFQNCPMCGVACQCRDSYAILLKFQPARINWTLHLMLQGHTVLNGMPQGSSMICTCCVQVVSSENGGGGNLAEVMATIELSSRYESKFSI

SEQ ID NO: 143736 - protein, 121 aa, Glycine max
  Coding DNA Sequence Number=SeqID_52051
  Homolog annotation: Hit_ID=Q2HW90; Match level="QueryCoverage=71%, HitCoverage=17%, E-value=5e-10, Identity=37%"; Hit description =Putative uncharacterized protein
MGTNQNGKRFYQVKIKGLDVTNLKELGWLMGPLQRQAFRKVYGKILDLTTVEVFTEAVVSLAQYYDQPLRCFTFGDFQIVPTEEEFEEILGCPLGGRKPYLFSRFLSSLSKIAAVAEDLAR

SEQ ID NO: 143737 - protein, 213 aa, Glycine max
  Coding DNA Sequence Number=SeqID_52052
PFLAPRVPRPETTFPLAKRWSGGRLEYRATPYGDLVGYRSRIDHMESHEFGLQEDIPVDPMNLDLLHQIDMRDNHYIDWMEYHAGKNTTLFLYVVQQLHDPCTTITHNVAGPGVEQTHFEISHPQSMYSTPSPVHQTFGHTGESVTATTHEWMTDLFGVDFNTPNLAASYLSTLQQFDAPHSFGEHGQSSSAATTNIANTNIEQQHHHDMGEP

SEQ ID NO: 143738 - protein, 79 aa, Glycine max
  Coding DNA Sequence Number=SeqID_52053
  Subcellular localization annotation: CTP_CleavageSite=41; ConfidenceScore=5.66e-01
MAEPSKKRKGSSSTATAAAHRRHGPSGAPTTPIPPSLSSPRSSTLFSSDDQRLRSTRPIWFGTECLRPYGPMHLFLIHI

SEQ ID NO: 143739 - protein, 125 aa, Glycine max
  Coding DNA Sequence Number=SeqID_52054
MCMPKRVTSTSIDTTVPPVDPLGELVKNLLDVYQKSFQLPWDGAKFGIPNVKKGFFITHEDVTEIILGDKCLNIFILQLWTMAHWQLIVLCPQDNIVVWLCSLRKKPDVNIKGAINRLLSKFKVK

SEQ ID NO: 143740 - protein, 116 aa, Glycine max
  Coding DNA Sequence Number=SeqID_52055
MEWLVDLAVIDAFLAFHHGKESPVVAILTMYDTFDRGCEKSKNCLLCTGSLCVAGFTPFSPRRGCINYNPVLAIRQHGYPMRGVPSDESITPFIARGFSDHNARVLQGVRKAWDAA

SEQ ID NO: 143741 - protein, 42 aa, Glycine max
  Coding DNA Sequence Number=SeqID_52056
MKGTLKVVGLFLLDSNSSRDGTNPPSNSLYGNPQTRKQRDKQ

SEQ ID NO: 143742 - protein, 29 aa, Glycine max
  Coding DNA Sequence Number=SeqID_52057
MGEKLATQQGCFLQKQQPSGGIFWAQVGL

SEQ ID NO: 143743 - protein, 143 aa, Glycine max
  Coding DNA Sequence Number=SeqID_52058
MCMIYTRLFATGWVKSCPGMHSGCAIASSSGCAHIIGPPRGSGGWRTLSSLEAQIWSPLKVRTRSPQKVRACNPLKARACSPLKGKMCSPLKGRMYSPLKVRACSPLKVRTCSPLKSSEGEDVQPLKVRTCSPLKAGAYSPLM

SEQ ID NO: 143744 - protein, 165 aa, Glycine max
  Coding DNA Sequence Number=SeqID_52059
RIPSFRGSIPLPLSEKELQPEVDSLSAKVTNITGLSGVTHSGRLFASPHSAELPSKGKAPMIQEPTDVATPSKEVDPPVVKGAEKKEGLQGKTVTLEEAHEFLRLIQQSKFKVVEQLNKTLARNSRRFRNVSVGDSVKIFNRSSSFIVRSSMFFGLQSVLQSFLA

SEQ ID NO: 143745 - protein, 99 aa, Glycine max
  Coding DNA Sequence Number=SeqID_52060
MTSRDQVWSFCTLVSSRGGGPDDTRRYLTVIRTLLSSRGGGPDDTRKYPSEADIVFCTFCSSGNNKSFTCGNFMVTRDSRQPRGAKLVSYTNFRPGTFA

SEQ ID NO: 143746 - protein, 197 aa, Glycine max
  Coding DNA Sequence Number=SeqID_52061
MTGPLNELISCFLIRVDPWVLEPITFRGLHVLAFRGLNALTIRGLHVLTNRGLHTLTFRGLHVLAIRRLHVLTFRGLHVLVFRGLHVLAFRGLHALTFRGLHVLTLEDYTSSPLEDCTSSSSKGCLPSPSEDYASSPLEDYTSSPLEGYTSSPSEGYTSSPSEDYMSSPSEDYTSSPSEDYTSSPSKDYTSSPSEDC

SEQ ID NO: 143747 - protein, 125 aa, Glycine max
  Coding DNA Sequence Number=SeqID_52062
MSHGFCGTHLQIMVRTRGLGRALGQVTRRGVGRGDHDDSDDAPQRRRPTASAWRQRVTVTADHVDDPVIPDPNVQDDPMEAPTVVEGILADAGTEAAEDQPQGFPGGPSGPSVLTTYADHVARSV

SEQ ID NO: 143748 - protein, 115 aa, Glycine max
  Coding DNA Sequence Number=SeqID_52063
MAAQLIHDQVEMECLEGAWETLEGNTRCRFWGTIRFTATSLPVQVIEVTSSEEDPEEDLEELPPEPAVDALDFLEGDEDPLPEVDSPEDVMSASEADSTEDSGLGEMAISGGSSS

SEQ ID NO: 143749 - protein, 72 aa, Glycine max
  Coding DNA Sequence Number=SeqID_52064
MSQKSKGSRLARSVKFREVAEVEKRCFCAIPIWPTWALQKIPPEGCCFWRKQPCSPGKAELAWAASFSPILL

SEQ ID NO: 143750 - protein, 107 aa, Glycine max
  Coding DNA Sequence Number=SeqID_52065
MEAEEPWLGLWLPLNYQVDMGASQHRTPELGWCLAWVVWKVGFLVDLGMAFGYNWVVGKEKGCYWLSNDIVGLVGKLGRIGMAVTTWVSPSFSPSSFAPVFSFIQAG

SEQ ID NO: 143751 - protein, 164 aa, Glycine max
  Coding DNA Sequence Number=SeqID_52066
MAIGKIITQFTKIVTSHVEISSQYGHREGNIVNASPNKVGISQSKMPTQDKIASGCTGILRPGHSARCPKSAALMLMLCQILLCAKRAEAALSGGYVRVHLLGGFYTENKRGYISCGSVQVEGTSTWLFKENKGGYIPCGSLACKGFYKVERNLKNWLVAWGLD

SEQ ID NO: 143752 - protein, 458 aa, Glycine max
  Coding DNA Sequence Number=SeqID_52067
  Gene Ontology: Mol. function=transferase activity, transferring phosphorus-containing groups; Cellular component=membrane; Biological process=two-component signal transduction system (phosphorelay)
  Homolog annotation: Hit_ID=A7QJQ3; Match level="QueryCoverage=94%, HitCoverage=97%, E-value=0.0, Identity=77%"; Hit description =Chromosome undetermined scaffold_107, whole genome shotgun sequence
  Pfam annotation: Domain name=HisKA; Domain location=368-433; Score =79.6; E_value=1e-20; Accession=PF00512.16; Description=His Kinase A (phosphoacceptor) domain
  Pfam annotation: Domain name=PAS_4; Domain location=227-334; Score =6.5; E_value=0.048; Accession=PF08448.1; Description=PAS fold
  Pfam module annotation: Pfam domain module=HisKA::PAS_4; Domain location=368-433::227-334
MENDSIEDMDIEALPSMWPQDIGTEVGKQFNIEKAGRDQDMLEEVTIIEEPTIVDFKRLIELTDFTEKGSSQLAYLMKQWEYKQANVVRLLREELDNLSKQRQDAELRKLEILEEHRFEEEQYGGDKRPVSILDEVYDGIWQDIPCRKSDVVVQNKRSEIDVEYDTVMYWKQRALHSEKQLEASIQREEILEEKLHERIANIERQSSPVEELSQILKRADNFLHFILQNAPVVIGHQDKELRYCFIYNHFPSLHEEDIIGKTDVEIFTGAGVKEAQEFKREVLEKGLPAKREITFETELFGSKTFLIYVEPVFSKAGETIGINYMGMDITDQVRKRERMAKIREEIAVQKAKETELNKTIHITEETMRAKQMLATMSHEIRSPLSGVVSMAEILSNTKLDWEQRQLLDVMLSSGDLVLQIINDILDLSKVESGCKSILVNYIKTNFNYLESNLEVAYD

SEQ ID NO: 143753 - protein, 59 aa, Glycine max
  Coding DNA Sequence Number=SeqID_52068
ETSLSTAIPLELEVIPQVKELLDEGLPMDPKRIKVILEWPTPPTPLIELVRNYVLSWED

SEQ ID NO: 143754 - protein, 82 aa, Glycine max
  Coding DNA Sequence Number=SeqID_52069
  Subcellular localization annotation: CTP_CleavageSite=21; ConfidenceScore=5.53e-01
MATPPSSPPPPPTHSTSHSPSTMKRTRKVTCLRSLATRPVGAEKPLVHVDPATGKADSPHIKKLRTYLGIVARDKVDVTYKN

SEQ ID NO: 143755 - protein, 55 aa, Glycine max
  Coding DNA Sequence Number=SeqID_52070
MPKDRGRIVIIKKGGDCRQRIKLNVLMMPKDHMLLKALFKTKKLKIFKMDDQDSL

SEQ ID NO: 143756 - protein, 96 aa, Glycine max
  Coding DNA Sequence Number=SeqID_52071
MHKALRANAPLPYPHLITLFLRHFQIPLDDEPFVQVKRSFAIGAGAVTSFGYRKDRNGQWLKKDALPPQDERTPSRPKGRQPKGLNPFLLHFLPYL

SEQ ID NO: 143757 - protein, 118 aa, Glycine max
  Coding DNA Sequence Number=SeqID_52072
  Homolog annotation: Hit_ID=A6FJQ2; Match level="QueryCoverage=32%, HitCoverage=84%, E-value=3e-11, Identity=92%"; Hit description=50S ribosomal protein L5
MRKEKIPHQAPFAIQAAQLLGRAIGAGLFAITPAGERGMCCKAIKLGNARVFPVEGGIMLIIGKKKFVKNQTGKTVKCLRSDNGLEKSKLKSLLSSEFKMMDMRVIEKILGMEIKRDE

SEQ ID NO: 143758 - protein, 210 aa, Glycine max
  Coding DNA Sequence Number=SeqID_52073
MSSIIYAFKDYNVFSHLHLQDYNIFSHLRFQRLQCLQSFTLSKTTVSSVIYIYKTTISSVIYAFKGYNVFSHLRFQRLQCLQSFTLSKTTVSSVIYIYKTTISSFIYAFKGYSVFSHLRFQRLQCLQSFTLSKTTMFSVIYIYKTTISSVIYAFKGYNVFSHLRFQRLQCLQSFTLSKTTISSVIYAFKDYNVLSHLRFPRLQCLQSFTF

SEQ ID NO: 143759 - protein, 123 aa, Glycine max
  Coding DNA Sequence Number=SeqID_52074
MAPRKLASNRSRKDAAAAGTSVASEETHPAQGRRVHEFPGGDSSPALDIAGHSHGQVRSRCSPRVLCQCLAYRGGRTGPPVMGEGPVDSFRCRRPQSVLGISASIGGGPRMRIWSEEEPGRWT

SEQ ID NO: 143760 - protein, 194 aa, Glycine max
  Coding DNA Sequence Number=SeqID_52075
YPELRRSEFLIGGYVGAKASLLSTAPFSVTMTQELVAREDTLRLSAPRHLVTPSVIDEQRPMWSSAPFPEMSAFSDGDFSSLTSYPELRRSEFLIGGYGHVTCTLVSSRGGGPDDTRRYLTVIRTLLSSRGGGPDDKQRQNLAAGPMTSRDHVWSFCTLVSSRGGGPDYTRRYLTVIRTLVSSRGSGPDDEQRP

SEQ ID NO: 143761 - protein, 277 aa, Glycine max
  Coding DNA Sequence Number=SeqID_52076
  Gene Ontology: Mol. function=oxidoreductase activity; Cellular component=chloroplast; Biological process=metabolic process
  Homolog annotation: Hit_ID=Q0K1N7; Match level="QueryCoverage=71%, HitCoverage=77%, E-value=1e-63, Identity=64%"; Hit description=Short chain dehydrogenase
  Pfam annotation: Domain name=Epimerase; Domain location=68-244; Score= -67.9; E_value=0.041; Accession=PF01370.12; Description=NAD dependent epimerasedehydratase family
  Pfam annotation: Domain name=KR; Domain location=67-252; Score=-56.6; E_value=0.00047; Accession=PF08659.1; Description=KR domain
  Pfam annotation: Domain name=adh_short; Domain location=66-235; Score= 102.7; E_value=1.1e-27; Accession=PF00106.16; Description=short chain dehydrogenase
  Pfam module annotation: Pfam domain module=Epimerase::KR::adh_short; Domain location=68-244::67-252::66-235
  Subcellular localization annotation: CTP_CleavageSite=49; ConfidenceScore=5.68e-01
MASRPPETCARNCSPASVKVRLRVLRCSNLTPKSASSLATFLLTPPGVRLNRRAAAEKLPSSALRKVAIVTGASSGIGRTTAKLFAQHGAKVVVAARRESELTTLVAEIVADGGEAIAFAGDVQSEAFNQSLVELAVNSFGKLDIAFNNAGTLGEIGASDKVSLQGWNDTLSINLTSAFLGAKYQIPEMAKQGGGSVIFTSTFVGYSAAFPEFAAYAASKAGLIGLTQALAVEYGTKGVRVNAVLPGAVDTDMFREKNNTAEAHGISGRDACPQTGG

SEQ ID NO: 143762 - protein, 94 aa, Glycine max
  Coding DNA Sequence Number=SeqID_52077
  Subcellular localization annotation: CTP_CleavageSite=28; ConfidenceScore=5.28e-01
MVGAFSQNKVTLTGVATYPSAGGRRVTRGMRVPRKEYARSRHQRLFEENVGKTGKDAIYELLSERFGSCIYARGRVFPFAPTYSSIWDEKIRPT

SEQ ID NO: 143763 - protein, 263 aa, Glycine max
  Coding DNA Sequence Number=SeqID_52078
  Homolog annotation: Hit_ID=A5B939; Match level="QueryCoverage=27%, HitCoverage=57%, E-value=5e-20, Identity=60%"; Hit description =Putative uncharacterized protein
RCGCSVEPRHGIESSKWAIFGKQNWRCGMNRKLGYGAQLRANLDPTKGVGRLRQQDGGHGSRNPLRRRGGRCKTQGASPGGAVVGADLGGSSNIQMRTLKAEEGKGTGEARLIALCARTPKGNRVKFLNGTLPTLETAQPEVGSSGWKSTARRVVSGAPPAALENPEDRVPPTPGRTHNRIRSPRAGHGGPSPEPVGCRWTARAASAARAGRRVPVGGRIGNGPFGASSPGVEQSTQNCALNVKVKKFNQARVNGGSNYDSLK

SEQ ID NO: 143764 - protein, 72 aa, Glycine max
  Coding DNA Sequence Number=SeqID_52079
  Homolog annotation: Hit_ID=A5BGM4; Match level="QueryCoverage=100%, HitCoverage=5%, E-value=4e-09, Identity=37%"; Hit description =Putative uncharacterized protein
MNAYGDKQSDLGIIDKVLRTLTPRFDHIVVAIEQGQNLEEMKIEELQGILEAQEMRLNEKNLQRSAEQAMQA

SEQ ID NO: 143765 - protein, 48 aa, Glycine max
  Coding DNA Sequence Number=SeqID_52080
MRLKNQGSHSVHYVSHQGNQGAGKKFMKKHDKGRGTFLEGLPKVQVLV

SEQ ID NO: 143766 - protein, 213 aa, Glycine max
  Coding DNA Sequence Number=SeqID_52081
MKREKHVSYSSHNSCKSLSEELRDYYEGKHRSHLRPHSHRRENERKPQEVNIKLPYFHGKDNEEAYLDWEIRHLLSSNDDKGKTIEKQPPKASMQEKTSSIKCFKCLWKRTHYFSMSTKKTMIMRSQDIYSSQDEAATSPSSSESEEAKREESSEEIYPQEEGKPLMVKEECKETLVSIATPFGLEFIPQVKELLDEGLVRKSLNPCALLVPK

SEQ ID NO: 143767 - protein, 90 aa, Glycine max
  Coding DNA Sequence Number=SeqID_52082
MARKPRQGLKNIAEAFSLPLPHVAFLLPHSPLKLHTKLQPLAIILPQIVKGEHFRGREVRGYEWDFEISGLGGLLSLLIFVGMGFGRYDG

SEQ ID NO: 143768 - protein, 215 aa, Glycine max
  Coding DNA Sequence Number=SeqID_52083
  Gene Ontology: Mol. function=aspartic-type endopeptidase activity; Cellular component=extracellular region; Biological process =proteolysis
  Homolog annotation: Hit_ID=Q9LI73; Match level="QueryCoverage=99%, HitCoverage=49%, E-value=8e-67, Identity=59%"; Hit description =Chloroplast nucleoid DNA binding protein-like; nucellin-like protein
  Subcellular localization annotation: CTP_CleavageSite=55; ConfidenceScore=5.34e-01
MGLGRGPISFTSQLARKLSNTKTKNTFSYCLLDYTLSPPPTSYLTIGPTPNDVVSRNSFTYTPLLTNPFSPSFYYISIQSVSVDGVRLPISESVFRIDANGNGGTVVDSGTTLSFLAEPAYGKILAAFRRRVRLPAVESAAALGFDLCVNVSGVARPKLPRLRFRLAGKAVLSPPPVRPDSGFSVIGNLMQQGYLFEFDLDRSRIGFTRHGCAVR

SEQ ID NO: 143769 - protein, 323 aa, Glycine max
  Coding DNA Sequence Number=SeqID_52084
MATFHGCHSHFHTPLLLHTPPPFAHPTQFLGIDFESTRQRLLSLFDSERTPPSFQQPPYEASMAVVHGCHFPYGASTFHYHHPFPSHSFHTANHQQPCSQHPFPSMFDTSKHEGSLTHLEAVLTRLDESMHSMNLKIDELLNRFPPATPISNANPIPVPHPHHDAPANNHKINLEGPRTDDIALHLQEEKLLECRSQTPSPPPPPSPTPPPPPPPPPSPPLPSPPLVALIQPLPTTLPGPLHIVIVSLIANSNPHMSSDHRGITIPGVRKKHFSRGKELDHSFPLTLYTAKWLNTNLHLLISSPILIWDPGSNFEAMVEAPTP

SEQ ID NO: 143770 - protein, 338 aa, Glycine max
  Coding DNA Sequence Number=SeqID_52085
  Gene Ontology: Mol. function=nucleotide binding; Cellular component =chloroplast; Biological process=anion transport
  Homolog annotation: Hit_ID=A7P321; Match level="QueryCoverage=97%, HitCoverage=74%, E-value=1e-109, Identity=61%"; Hit description =Chromosome chr1 scaffold_5, whole genome shotgun sequence
NFCIDLQVQMLLEPLKLLKQADAQLNMTQGTLGGIVGEELGILPGMDSIFLVLALERLVGFLRIAASKSQQDKFDLIIYDGISSEETLRIIGASSKARLYLKYLRTLAEKTELGRLAAPSLLRLVDEAMLISSSRSYFNGKMSSEIWDTLDQMLERGSSAFSNPKKFGCFLVMDPNNPTSINSALRYWGCTIQTGARVSGAFGITSQLENLESLERAKKEFSPLPSASISRLSMNNSIDWSRVLLDTGNEDARHLLNSLSSQGGDMPSPVRFDKKGKLVTLFMPGFDKSEIKLYQYRGGSELLVEAGDQRRVIPLPPEIQGKVGGAKFGDRSLVITLL

SEQ ID NO: 143771 - protein, 481 aa, Glycine max
  Coding DNA Sequence Number=SeqID_52086
  Gene Ontology: Cellular component=chloroplast thylakoid membrane
  Homolog annotation: Hit_ID=A7P319; Match level="QueryCoverage=80%, HitCoverage=83%, E-value=1e-131, Identity=62%"; Hit description =Chromosome chr1 scaffold_5, whole genome shotgun sequence
  Subcellular localization annotation: CTP_CleavageSite=40; ConfidenceScore=5.05e-01
MPLWDSALRSLLFSPSLLPQGKVGVAVYGVGFIFRFPRPMWSAVETRHDQNDAREFDVSGGSKSTLSEADTEDNNVAVTQTDKSVVVEKPKRVVIPVCVDSTQEEALSVLKSLKIIEDDVEANELCTRREFARWLVKLNSSLERNPKHRIAPIVSLSGSVFTAFDDISIDDPDFRSIQVLAEAGVIPSKLSWNNSFDYGGFDTQQNINFFPDRFISRQDLIDWRAQLEYDFFSGVVDQISIKKAGYMDVKEIISSAVYVDMLAGDKSILRKVFGQSKRFQPNKPSTKAQAVVALTGGRMKEAISAELLRIEAENSARLAEAEEIRSELLSRGDIQRFWDEKLNEEKNRGFDVERLYHMEVKNLEEEEINQDKISAEYLKEKAAMDCQKQLLLNLKKEVDEISEKVALERVTYVDERHVVQKLLGDLELKHEELLNTKSTLEAEKEALQILRSWVEDEARRSQARAAVLEEVGRRWKWDDQA

SEQ ID NO: 143772 - protein, 39 aa, Glycine max
  Coding DNA Sequence Number=SeqID_52087
MSMGSEKYEMESFRDVKRKKKLGFKGQNFVVEAKLVSTG

SEQ ID NO: 143773 - protein, 160 aa, Glycine max
  Coding DNA Sequence Number=SeqID_52088
MAALWPLWQNGTTLFFANRHRQFVKGYPLRRCIGHNEKVEQNIRYSAENRARQGNTRKVPKNIRNCRKCHQKVVGHVSEIRGNDSELQRTTLHGVNCKATRYNSSRAHDCQSGKTDMRYRIPSYLISLLKVKLIKLPMYESAAELDREALSDAIIASEPE

SEQ ID NO: 143774 - protein, 50 aa, Glycine max
  Coding DNA Sequence Number=SeqID_52089
MWDRHRLKGALKPGVFILKTYIPNSPSGHLPPDSDTAHELYNTHDLTVVF

SEQ ID NO: 143775 - protein, 259 aa, Glycine max
  Coding DNA Sequence Number=SeqID_52090
  Subcellular localization annotation: CTP_CleavageSite=44; ConfidenceScore=5.44e-01
MAPRLLSVTLSLLVETNSTTPNELKSPPSPSSNSTTPAIAERISSASGAEAEPESFLMQSYPARALDRKLQVDWARDAREGPRVLMSLRTHLLLEVASPLSLSLSPFRCHSSSKKQRNPLMKKILGLQAPMELASLSLLFFEWGPFFISASRVFLPNSDSNTYDVTKTSFLLMSLSKEGHVVAFFDPNRRRSDFKLENRSELVAVDGGDDDVVVVGSRSLLERLMVEIYQRFANPQSPKSDSIEFDCDDDLFAIVGVSQ

SEQ ID NO: 143776 - protein, 95 aa, Glycine max
  Coding DNA Sequence Number=SeqID_52091
MFDTLKIDGEFDHFKLGNGEMTSQGNKYVGSKWGCKVYKGRYLVLQKNKSNLCYLDEQALKRNHDSKVKKKMKFSNIVEVLGETSVGGGVCLLSN

SEQ ID NO: 143777 - protein, 731 aa, Glycine max
  Coding DNA Sequence Number=SeqID_52092
  Gene Ontology: Mol. function=metal ion binding; Cellular component =nucleus; Biological process=regulation of transcription, DNA -dependent
  Homolog annotation: Hit_ID=A7P9L8; Match level="QueryCoverage=93%, HitCoverage=97%, E-value=1e-114, Identity=38%"; Hit description =Chromosome chr3 scaffold_8, whole genome shotgun sequence
  Pfam annotation: Domain name=zf-C3HC4; Domain location=684-724; Score= 42.4; E_value=1.6e-09; Accession=PF00097.16; Description=Zinc finger, C3HC4 type (RING finger)
MTFEHLLPPIWHVHPYVCLYQEQKHCHQCDPEDLFIRQISGTGMPRLGPSSSGTDMNHQSSLNHVQNAVDFCLSDYRGSSGETACLRGTGHNVQSFSGWNTGESSSRLNLINQVNDEGLKSEHGLSSSYNAATEDDLRSEEGQFKANNVIFPVSSNTNLHGNQSRVHPSFLQGSSSTHINQNISLDMGHVANAADRGKGKEAGSSVNANNTSGIDREKTLFGSASCNHTGASSESSGYMAWGDSANSSSSLVNWGPSCKRKALEGSSRQLCSGGSSSTLVQSGNGCWPTDPVDLNASSDLTDSTPIEDIPVTSPPLFQNATNEERQEAPNGFPLISIAENVERPLRNFDRRMSHLQHQESVPLNLPSTGSARHHNHSSLHQAPGSHSINDSLELRLTAGGTSSANSGASLNQSPALRIHSFPWNRTANPRGARSSTSYNSGERAVREDFNLRMFPRDSTEHPMNVPASSGHEPIGWHTPSGNVNNSGGAPPPSWIGSSSNVHSPANRSWIFNHEVPAENMQSVSEFSPWSLFPSISSASGVHNAHSAPSSSGPPSFTQGSSSNQSYARTALVMERRGGDVLSGGPHSLRALTFDNEGRRRLISEDYMVFDHPFLYHGMAEMHDRHREMRLDVDNMSYEELLALEEHIGDVSTGLNEDVIIKLMKQRIYVRAIIMTDSYTDLEPCCICQEEFSDGENVGSLDCGHEFHSGCIKQWLMQKNLCPICKTTALAT

SEQ ID NO: 143778 - protein, 104 aa, Glycine max
  Coding DNA Sequence Number=SeqID_52093
  Subcellular localization annotation: CTP_CleavageSite=40; ConfidenceScore=5.33e-01
MAMGGSGTGIVSPIPYPNFSTYSHTRTRYPTGLSLLSHPRTRRVSDFKWWDGFGVGTGLVISYPYPYPTFGYRGKPEPDQLGYYPSKSGRIRADIHGYGFSCHV

SEQ ID NO: 143779 - protein, 295 aa, Glycine max
  Coding DNA Sequence Number=SeqID_52094
  Gene Ontology: Mol. function=transferase activity, transferring glycosyl groups; Cellular component=integral to membrane; Biological process=metabolic process
  Homolog annotation: Hit_ID=Q8W3P8; Match level="QueryCoverage=85%, HitCoverage=63%, E-value=1e-65, Identity=47%"; Hit description=ABA -glucosyltransferase
MAPKIDSIKIELFFPFLEGGHQIPMIDAVRVFASHGAKSTILTTPSNSLFFHNSIMRRGHQIPMIDATRVFASHGAKSTILATPSNSLHFQNSISRDQKTSLPVPIHTFSIDIPDANMPTVSPFIYSSALLEPHRHLVILHPPNCIIVDMFHCRAHEISDKLGIMSIVFNGHENPSQFPDRMNHFDNSLNIVTNNFYDLELDYADYVKKGKKTFVGPVSLCNKSTVDKSITGRPLIINEQKCLNWLTSKKPNSVLYVSFGSIARLPPEHLKEISYGLEASEQSFIWVVRNIHNNP

SEQ ID NO: 143780 - protein, 231 aa, Glycine max
  Coding DNA Sequence Number=SeqID_52095
  Subcellular localization annotation: CTP_CleavageSite=56; ConfidenceScore=5.56e-01
MATPFGSPHPFSESTTPSLSMSKKTRKATRLRSLATRPAGVERLVAHVDPVTGKIDGSHRKKLRTNLGIVTHDKLDLTSKWALAHDNGGEDDKACEKDDISKEEWTHTDTVVDPPSPIRRHVKWKMARTKKSSQMMSEEAKKNADKIGSFVTHGCQDALTAAIGRPEHLSRVYSAGVGVTIKHYFGPASRGTHTSLSMAPEDLEQLTQKIKDRLEDSITQKMTQQLMMFLS

SEQ ID NO: 143781 - protein, 445 aa, Glycine max
  Coding DNA Sequence Number=SeqID_52096
  Gene Ontology: Mol. function=transferase activity, transferring glycosyl groups; Cellular component=integral to membrane; Biological process=metabolic process
  Homolog annotation: Hit_ID=A7P9M8; Match level="QueryCoverage=98%, HitCoverage=98%, E-value=1e-142, Identity=54%"; Hit description =Chromosome chr3 scaffold_8, whole genome shotgun sequence
  Pfam annotation: Domain name=UDPGT; Domain location=9-444; Score= -97.9; E_value=1.1e-05; Accession=PF00201.9; Description=UDP -glucoronosyl and UDP-glucosyl transferase
MASNDDSLHMFFFPFLAHGHMIPLVDMAKLFAAKGVRATILTTPLNAPIISKAIEKTKTHQGKEIQIQTLKFLGTEFGLPEGCEHCDSLPSPNLFPAFIMATALLQEPFEQLLHQQRPNCVVADMFFPWTTDSADKFGIPRLVFHGISFFSLCASQIMSLYQPYNNTSSDTELFVIPNFPGEIKMTRLQEANFFRKDDVDSSRFWKQIYESEVRSYGVVVNSFYELEKDYADHYRKELGIKAWHIGPLSLCNRDKEEKHLEEMKRLLMSTKIAMGLEASGQQFIWVVRKSIQEKGEKWLPEGFEKRMEGKGLIIRGWAPQVLILEHEAIGAFVTHCGWNSTLEAVSAGVPMITWPVGGEQFYNEKLVTEVLKIGVPVGVKKWTRFIGDDSVKWDALEKAVKMVMVEEMRNRAQVFKQMARRAVEEGGSSDSNLDALVRELCSLSH

SEQ ID NO: 143782 - protein, 143 aa, Glycine max
  Coding DNA Sequence Number=SeqID_52097
MVRTRGLGRALGAGRGRGISEDAHEADVPRCRRPTASARRQWVRLREDVTERPEDVAQLHEDVPHVSDATPEMIGLVDAVQTEGVATNGSLGSPAADEGFPDGPRDPLTLLSMSHTASGVDSRKVDKIGRPTPEIECYIAATG

SEQ ID NO: 143783 - protein, 290 aa, Glycine max
  Coding DNA Sequence Number=SeqID_52098
  Gene Ontology: Mol. function=transferase activity, transferring glycosyl groups; Cellular component=integral to membrane; Biological process=metabolic process
  Homolog annotation: Hit_ID=Q2V6J9; Match level="QueryCoverage=98%, HitCoverage=64%, E-value=9e-87, Identity=52%"; Hit description=UDP -glucose glucosyltransferase
MAKLFAEKGVKATIVTTPLNAPFISKAIGKSKTKHNRIHIQTIELPCAEAVLPDSCENTDSITSQDLFESFCMATCFLQEPFEQLIEKQHPDCIVADMFFPWATDSAAKFGIPRLVFHGYSFISLCATSCMELYKSHNDAESSSFVIPNLPELRSYGVVVNNFYELEKVYADHSRNVLGRKAWHIGPLSLCNKDNEEKAHRGKEASIDEHECLKWLDTKKPNSVVYLCFGSAVKLSDSQLREIAMGLEASGQQFIWVAGKTKEQKGEKWLPEGFEKRMEVKGLIVRINVS

SEQ ID NO: 143784 - protein, 215 aa, Glycine max
  Coding DNA Sequence Number=SeqID_52099
  Gene Ontology: Mol. function=RNA-directed DNA polymerase activity; Biological process=RNA-dependent DNA replication
  Homolog annotation: Hit_ID=Q1AKH8; Match level="QueryCoverage=52%, HitCoverage=30%, E-value=2e-09, Identity=40%"; Hit description =Reverse transcriptase family member
MCPCSNPDEVITSMGTRGGKTRLSIGSHQGSVMSPYLFNLILDEITRGIHKIIPNSMLIANDIGLVQEEQFETFGRPLLVIEQEHLWGMFLMGLKEEQLMDEGLENKNRTMIFALQLHDHSARISYETKGGRRGKTGIRGKRGQSFELKSQVLMNVEKNLDAKKGSNFQELVEHDLMESTIMVAKDKGSASNIAKISTERGELNLAEVVFYLSKV

SEQ ID NO: 143785 - protein, 480 aa, Glycine max
  Coding DNA Sequence Number=SeqID_52100
  Gene Ontology: Mol. function=transferase activity, transferring glycosyl groups; Cellular component=integral to membrane; Biological process=metabolic process
  Homolog annotation: Hit_ID=A7P9M8; Match level="QueryCoverage=94%, HitCoverage=94%, E-value=1e-151, Identity=57%"; Hit description =Chromosome chr3 scaffold_8, whole genome shotgun sequence
  Pfam annotation: Domain name=UDPGT; Domain location=10-479; Score= -82.6; E_value=1.9e-06; Accession=PF00201.9; Description=UDP -glucoronosyl and UDP-glucosyl transferase
MSSCEHHPLHIFFFPFFGHGHMIPTVDMAKLFAEKGVKATIVTTPLNAPFFSKAIGNSKTNGNKIHIETIEFPCAEAGLPVGCENVDSIPSPNLFQAFIMATGLLQEPLEQLLLKQRPDCIVADFFFPWTTDSAAKFGIPRLVFHGTGFFSSCATTCMGLYEPYNDVSSDSESFVIPNLPGEIKMTRMQLPPFFKGKEKTGLAKLLVEARESESRCYGVVVNSFYELEKVYADHFRNVLGRKAWHIGPLFLCNKDTEEKVHRGKEASIDEHECLKWLDNKKPGSVVYVCFGSVAKFSDSQLREIAIGLEASGQQFIWVVKKSREEKGEKWLPDGFEKRMEGKGLIIRGWAPQVLILEHEAIGAFVTHCGWNSTLEAVTAGVPMVTWPIAAEQFFNEKLLSEVLKIGVPVGAKKWLRLEGDSITWDAVEKAVKRIMIEEEAIEMRNRTKVLSQLAKQAVEGGGSSDSDLKALIEELSSLSH

SEQ ID NO: 143786 - protein, 87 aa, Glycine max
  Coding DNA Sequence Number=SeqID_52101
MKGKKGCGKDDASIDVVEDDANEGHDDVELVHGKNIGRVTKTTWPLWMPGEEMTKASVVVDLEGLCDKGFLRMVLSDKEVMDILFKI

SEQ ID NO: 143787 - protein, 578 aa, Glycine max
  Coding DNA Sequence Number=SeqID_52102
  Gene Ontology: Mol. function=protein serine/threonine kinase activity; Cellular component=chloroplast; Biological process =regulation of photosynthesis, light reaction
  Homolog annotation: Hit_ID=A7P333; Match level="QueryCoverage=100%, HitCoverage=100%, E-value=0.0, Identity=73%"; Hit description =Chromosome chr1 scaffold_5, whole genome shotgun sequence
  Pfam annotation: Domain name=Pkinase; Domain location=158-465; Score =72.0; E_value=1.9e-18; Accession=PF00069.16; Description=Protein kinase domain
  Pfam annotation: Domain name=Pkinase_Tyr; Domain location=158-428; Score=-158.1; E_value=0.0099; Accession=PF07714.8; Description =Protein tyrosine kinase
  Pfam module annotation: Pfam domain module=Pkinase::Pkinase_Tyr; Domain location=158-465::158-428
  Subcellular localization annotation: CTP_CleavageSite=57; ConfidenceScore=5.22e-01
MATIGIGVGVTKLQQPHRPKSKSLFLGQRLRISPFWGEPQCSERRLFGVSNPPRVVQVFALGGGEWLDTVHNLFVGVGVGLPCSVMQCGDVIYRSTLPKSNGLTLTVPGVILALGTLSYLWATPGVAPGFFDMFVLAFVERLFRPTYKKAWGLQQDDFVLGKKLGEGSFGVVYRVSLANKPSSKEGDLVLKKATEYGAVEIWMNERVRRACASSCADFVYGFLESSSKKAAEYWLIWRFEGDATLADLMQSRDFPYNVDLPKGLERENRIIQTIMRQILFALDGLHSTGIVHRDIKPQNVIFSEESRTFKIIDLGAATDLRVGINYIPKEFLLDPRYAAPEQYIMSTQTPSAPSVPVATALSPVLWQLNLPDRFDIYSAGLIFLQMAFPSLRSDNSLIQFNRQLKRCDYDLVAWRKTAEARSELRKGFELLDLDGGIGWELLKSMVRYKARQRLSAKAALAHPYFVREGLLALSFMQTLRLQLLRATQQDYSEAARWIIQLMAKSGTQKDGGFTEAQLQELREIEPKKKASAPRNALASALKLQRKIIRTIRTLNESMDELTRRRKSFWWSRWIPREE

SEQ ID NO: 143788 - protein, 543 aa, Glycine max
  Coding DNA Sequence Number=SeqID_52103
  Gene Ontology: Mol. function=lipid-A-disaccharide synthase activity; Biological process=lipid A biosynthetic process
  Homolog annotation: Hit_ID=A7PXB5; Match level="QueryCoverage=70%, HitCoverage=81%, E-value=1e-153, Identity=70%"; Hit description =Chromosome chr12 scaffold_36, whole genome shotgun sequence
  Pfam annotation: Domain name=LpxB; Domain location=183-543; Score =173.9; E_value=4.3e-49; Accession=PF02684.6; Description=Lipid-A -disaccharide synthetase
MIIVMFTVVTINIISALTSDGSGDNDENHVGGDNNDHEGNYNGDGGGSNDDNHHDDEPVSPSRRRSAPNLPPSNNFTAAQPSSAEPLHGGPTSPLGPGNCGAIIKRTTQRLPCSLAQQGKLTLRIVMLSKWIPPISLGAKSLLRRKCNLNPNPNIPRVQWFSVSSSKAAPMIEMAARDGELRVFLVAGEVSGDSIASRLMASLKILSPLPIRFAGVGGVKMTSEGLQSLFPIEDISVMGLWELLPHLYRIRVKLNETVKAAALFEPHVVLTIDSKGFSFRFLKQLRARYRQKKLHSPAHFHYVAPSFWAWKGGETRLRGLAEFVDHLLCILPNEDKICRLNGLCATFVGHPVLEDVLELNLRNNSSIHEWKAEGNGEDFRIKHAVPAGATIISLLPGSRMQEVSRMLPIFSNTVELMKDMVPQLMTIIHVAPNEHVENFIADAVHRWPVPVVLIPGGTTQLRYDAFSASRAALCTSGTVAVELQLARLPCVVAYRAHILTEWYIWYKAKIQYISLTNILLDKAIIPEALFQSCKPLNLALLLK

SEQ ID NO: 143789 - protein, 78 aa, Glycine max
  Coding DNA Sequence Number=SeqID_52104
MWLQSRAICGSQCSGERRKEKHSTLTPTLLSQRALLRASEGEAHGCAFQRRKDAQSRHQRLFEENVKKTKGNRSKQKF

SEQ ID NO: 143790 - protein, 158 aa, Glycine max
  Coding DNA Sequence Number=SeqID_52105
ETTSFPSSSESEDEVRGEESSEKVYPQEEGDLVMVAKDQVQIKYNWDKEKNRKRKEEQPLMVKEEYKELSLSSKRTLLSTAIPLKLEVIPQVKELLDEDLVRKSLNPCALLVPKICIMRHQIPKIGGMMNVLSGATRFCKITYATNIFMIHIHRDSLG

SEQ ID NO: 143791 - protein, 156 aa, Glycine max
  Coding DNA Sequence Number=SeqID_52106
MVAITPTKVHQPPFLQEYDSNATCACHGEAPGHSIEHCRGLKRKVQGLIDAGWLKFEENRVFSTFTGIWVQAIGLFAQATCAPEFGLPRPFNQRLLVLRVGGGAVKQQSSSNLLEIFHSLCKTPFTKSEPHRDNPSLVFKNPLQQETHGLLIPFQK

SEQ ID NO: 143792 - protein, 100 aa, Glycine max
  Coding DNA Sequence Number=SeqID_52107
  Subcellular localization annotation: CTP_CleavageSite=50; ConfidenceScore=5.35e-01
MFAHSIKGCRPLGRTCGVLIPSPCVNTTPEPFNLKVRRSRLFRFFRRFPRINVGGDSARIPFVEHASRESRVALPPKGRLRHKEFEEQIYQSMRRHFPPC

SEQ ID NO: 143793 - protein, 182 aa, Glycine max
  Coding DNA Sequence Number=SeqID_52108
  Homolog annotation: Hit_ID=Q6WAY4; Match level="QueryCoverage=80%, HitCoverage=26%, E-value=3e-15, Identity=34%"; Hit description =Putative uncharacterized protein
MGTNQTGKRFYQVKIKSLDITSIKELGRLMGPLQIQAFRKAYGKILDLTITKISTEAIASLTQYYDQPLRCFTFGDFQLVPTVEEFEEILGCPLRGRKPYLFSGFFPSLSKIAIVVRDLARGLDRMKQTRNGVVGLPRKYLEGKMRDMANQEEWVSFMDVLALLIFDGNKERREFSSHVRAT

SEQ ID NO: 143794 - protein, 58 aa, Glycine max
  Coding DNA Sequence Number=SeqID_52109
MESSIVIVSNVVSSNLASFYEIKLQKRKTESLIRHRIQMEHAIIDMKTDEKFEITFLT

SEQ ID NO: 143795 - protein, 162 aa, Glycine max
  Coding DNA Sequence Number=SeqID_52110
MARGLHTSWDRGEFLSWPRGKVPLSRWNRCQSGHCRPSESGLEPELCGGLSFLSPGWAHTLRCTKLRGCFVWKRNRFNYRGVSSRLDLSSIATGPPSVLRPCYVARRDDINEGTSLSVKPTGELRLSPLASNTKSCEAGGHVAHEFLTVKLDLAQGVYHHIW

SEQ ID NO: 143796 - protein, 44 aa, Glycine max
  Coding DNA Sequence Number=SeqID_52111
MKATIRSFQEWTQEGSKLVYQVVTPRKTQGSYMSKHENKYAKNM

SEQ ID NO: 143797 - protein, 121 aa, Glycine max
  Coding DNA Sequence Number=SeqID_52112
  Subcellular localization annotation: CTP_CleavageSite=38; ConfidenceScore=5.34e-01
MVLSAVPSCSATDGWCIRNRQKHTSRTSALASVAGVLNADAVFQSNAFVRKKAAPVRQHEYVNTDSLYSGEFRQSSYRSVVTAASAQKWLTPTGRNSDRRRQEHVHREVPSQARRGKAVFP

SEQ ID NO: 143798 - protein, 46 aa, Glycine max
  Coding DNA Sequence Number=SeqID_52113
MTSIPQPVADNPVDQVDHQILENDEQPVEPHDPQENVDATLRRSTR

SEQ ID NO: 143799 - protein, 126 aa, Glycine max
  Coding DNA Sequence Number=SeqID_52114
AIQWLTNQNEENVTEGSFMTNGIELFGYCESLEGLMGTRLVEVGELICAIARSPLSTTYDKVVPGDMSRGSGDLGDVRWGAIAQKQAWPIPTQPVHSQSVRTCDVPKQASSWQSTNKRTKSMKQGG

SEQ ID NO: 143800 - protein, 162 aa, Glycine max
  Coding DNA Sequence Number=SeqID_52115
  Homolog annotation: Hit_ID=A5ATL8; Match level="QueryCoverage=45%, HitCoverage=58%, E-value=5e-30, Identity=87%"; Hit description =Putative uncharacterized protein
  Subcellular localization annotation: CTP_CleavageSite=76; ConfidenceScore=5.53e-01
SANSVPAAAVRQRMQALSGMIGRKASVGGFLSSPSNPRAQPWTGGGNYQAGVRYPSSPSRKRWILGAVRIDPCNAVANALSIPPGEYRRTLPGLDMPRILLKERGAFGNADTGGAWLSSARATAGDKPEEGEDDVSHHAPYALGDTRATMDGTKDRDPARVS

SEQ ID NO: 143801 - protein, 51 aa, Glycine max
  Coding DNA Sequence Number=SeqID_52116
MTLSASHGSCRNLPFCERARRGSRVDKSGALAPTYPPSKRKSDLRSSFKRQ

SEQ ID NO: 143802 - protein, 182 aa, Glycine max
  Coding DNA Sequence Number=SeqID_52117
MAPTRHPLDPDKSNRALGFPALITGLCQSFGVPVAPSKVIRPPITRAFIEKYCTQRQAQGDAPQVADVPPPHQAGPAGSFDTEQYLQHLVRQQAANHRAHVQTHDCLYKMSLSLQSQGFTSFPCLTPDQFRAEVAWPGDWPEARAGEAHAEAPAEAPDEADEAREDEEMTDLLDFLGGSGAT

SEQ ID NO: 143803 - protein, 63 aa, Glycine max
  Coding DNA Sequence Number=SeqID_52118
MYISMAQKYIMKHSQQNMLSYKTPHTYSQNNSKAPKFLKACNELKTKKGEHRLKGAIKGINSG

SEQ ID NO: 143804 - protein, 64 aa, Glycine max
  Coding DNA Sequence Number=SeqID_52119
PSCWLNENSLSAKEVSGHPLEEVFRLWKAKSSVGSSLGNWSDSKVLDSTGLSCCAITRNRGTRT

SEQ ID NO: 143805 - protein, 169 aa, Glycine max
  Coding DNA Sequence Number=SeqID_52120
  Homolog annotation: Hit_ID=A5BKB8; Match level="QueryCoverage=53%, HitCoverage=25%, E-value=2e-40, Identity=92%"; Hit description =Putative uncharacterized protein
MGGGAWPFLVGGAICLVNSVNERDLSLLNSYVEIIAIVGLQRGIPSKRESSARVDYVPALCTHRPSLLPIEWSGEVFGLRRRERFAARDVVRSPLNLSFRGRRSRNKVSVGEPAEGSLSMPHNQIDPRTCLFIYRREGGDDHGAPCARPPRPRDKHKPRRFVRQGTQIC

SEQ ID NO: 143806 - protein, 138 aa, Glycine max
  Coding DNA Sequence Number=SeqID_52121
MTGRLLTGSLTFDNRIMHYIIVRILLPRSSNLAQAFEEDLILMWAFLTDRQIDWAHLVWYRMHKALWANAPLPYPQLVTLFLRHFQIPLDDEPFVQVKRSFAIGASAEWISVSRSLKRIWVIFVRASIFHHHHHPLSV

SEQ ID NO: 143807 - protein, 120 aa, Glycine max
  Coding DNA Sequence Number=SeqID_52122
MAPTRHPLDPEKSNRALGFPVLITGLFQFYGVHVTPSKVIRPPITRAFIEKYCTPRQVQGDAHQTAGASPPPRQADSAGPLSVAWPGDWPDAQTGEKLAESNLDEDMTNLLSFFGGSEAT

SEQ ID NO: 143808 - protein, 88 aa, Glycine max
  Coding DNA Sequence Number=SeqID_52123
MASKRCWCSALLKWWLSNSGVTLVPSAATSLLDLFVESFFGDISCEDKHLERLFVSSYLFYIFMYMVNNIFTQTRQTSWCSPNNQLLA

SEQ ID NO: 143809 - protein, 154 aa, Glycine max
  Coding DNA Sequence Number=SeqID_52124
MTLVSACYPALSLTDSKKSFYTDNHLGISACPLTSRVSIDRNCLCGELLVYLRMLPDFTGQDNKKCVAVDKSEAFAPSYPQFVMRVQMTTLASACQSKLGSPNDEVRITVRCLRMLPDTWVMIAKGGVVDKSEALAPTYPPFVMRNSDLRSSFL

SEQ ID NO: 143810 - protein, 79 aa, Glycine max
  Coding DNA Sequence Number=SeqID_52125
MKCKTLESYLQVVINLQTLNQTLVSRGKHQPCEENMKIEGTISKKATEIDENEENLKQAQPNMRAKCASRTKRARQHRR

SEQ ID NO: 143811 - protein, 44 aa, Glycine max
  Coding DNA Sequence Number=SeqID_52126
MTSEAKTSIDEEIQGLQAHMELHHVLLEHLRPRFYHFSVIIFLC

SEQ ID NO: 143812 - protein, 244 aa, Glycine max
  Coding DNA Sequence Number=SeqID_52127
  Gene Ontology: Biological process=transposition, DNA-mediated
  Homolog annotation: Hit_ID=Q6UUU1; Match level="QueryCoverage=24%, HitCoverage=40%, E-value=3e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPVTTLIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 143813 - protein, 151 aa, Glycine max
  Coding DNA Sequence Number=SeqID_52128
  Homolog annotation: Hit_ID=A6FJQ2; Match level="QueryCoverage=25%, HitCoverage=84%, E-value=3e-11, Identity=92%"; Hit description=50S ribosomal protein L5
MTVKTSDTCSSRRRSQLVCKRMPGADKPVRARQRMRKEKIPHQAPFAIQAAQLLGRAIGAGLFAITPAGERGMCCKAIKLGNARVFPVTTLSTLEDPRLAIKEGSKSTYDIKIGANSGTFFTGNSFPYWRLCSDWSYRWSEGFPRRAEKLD

SEQ ID NO: 143814 - protein, 158 aa, Glycine max
  Coding DNA Sequence Number=SeqID_52129
MERSMIDAASGGALGDMTPAEARNLIEKMASNSQQFSARNDAIVIRGVHKVAMNSSSSAETKKLEGKLDALVNLPEAYAANIYNRPPQPQQQNQPQQNNYDLSSNRYNLGWRNRPNLIWSSPQPQQQQPAPSFQNATSPSRPYVPPPVQQQQQQQQHQ

SEQ ID NO: 143815 - protein, 69 aa, Glycine max
  Coding DNA Sequence Number=SeqID_52130
MTKARQKGVRKDNGGDACHPARPGEQGDFLQKQPPSGGIFWRAQVGLVAICTPTFTKYTPALFFVILFP

SEQ ID NO: 143816 - protein, 119 aa, Glycine max
  Coding DNA Sequence Number=SeqID_52131
  Gene Ontology: Biological process=transposition, DNA-mediated
  Homolog annotation: Hit_ID=Q1J7G7; Match level="QueryCoverage=31%, HitCoverage=67%, E-value=7e-11, Identity=72%"; Hit description =Transposase
DLPSQWLLFLSAVPPVQLLTGWCVTAKAPPDISAGKCSGRVPFAIQAAQLLGRAIGAGLFAITPAGERGMCCKAIKLGNARVFPEFDKVVMGPRTRYGEIWNKWLNPKGIEEQWGISAY

SEQ ID NO: 143817 - protein, 42 aa, Glycine max
  Coding DNA Sequence Number=SeqID_52132
CRNLPFGGRATRGLMGASSKKGKCAELPPTFIRGKCQKNRKV

SEQ ID NO: 143818 - protein, 158 aa, Glycine max
  Coding DNA Sequence Number=SeqID_52133
MVIDQSLFHDLTQLSSDGVPFEGTLNDDWKFDFSAHDARQLVCTNNADMTRRLLAGSLAFESHILHYLIVGIFLPRSSNLAQVSEEDLVIMWAFHTGRQLDWAHLRSFLIGAAAIASFGYRKERDGSWVKKGTQPADEEGNLPDEDNSTLLRRLMDKF

SEQ ID NO: 143819 - protein, 217 aa, Glycine max
  Coding DNA Sequence Number=SeqID_52134
GLHVLTFRGPNILIFRGLHVLTFRGLHVLTFRGLHALAIKGLHVLTFRGLHALTFRGLHALAIKRLHALAFRGLYVLAFRGLHILTFRGLHICALREFMLLCILGQDFTRAVAKRRVRVMRTNMTTLTQIWMTLLVSNIPPGDRNADLPLRKYRLVQFHPDIGPRVSSSGYGPLVSSTKGARRPQQGQDTTVAWGWAAADNRRTAATSKAPQFIHKK

SEQ ID NO: 143820 - protein, 90 aa, Glycine max
  Coding DNA Sequence Number=SeqID_52135
MAAAWSALNPLALTLRPGQDKLAPPVGEIPNAAVPPSDSASYPRAGPSQPLAAEAPARPKGISTHKNAAQFEDFTCCARLRYRSGLTLHH

SEQ ID NO: 143821 - protein, 173 aa, Glycine max
  Coding DNA Sequence Number=SeqID_52136
  Gene Ontology: Biological process=transposition, DNA-mediated
  Homolog annotation: Hit_ID=Q1J7G7; Match level="QueryCoverage=21%, HitCoverage=67%, E-value=1e-10, Identity=72%"; Hit description =Transposase
DLPSQWLLFLSAVPPVQLLTGWCVTAKAPPDISAGKCSGRVPFAIQAAQLLGRAIGAGLFAITPAGERGMCCKAIKLGNARVFPVTTLQDNQVAHSLARASRFHAKIKLIDTVDLEGGPVGKPVVPAALMNRPTRGERRFAYWALAECILAYYVGTDEGVSEVLHVAGEKRLH

SEQ ID NO: 143822 - protein, 110 aa, Glycine max
  Coding DNA Sequence Number=SeqID_52137
VYEENDGVIFEGSKKAIQIKRGISFNALKKIGDKDVAGASMFHSANFLTSYGNDLSNNEVQPPTNVSNLHGDDDDDYLVSNSYIEESLDEDDSVDGISDTDDEVADNIQP

SEQ ID NO: 143823 - protein, 216 aa, Glycine max
  Coding DNA Sequence Number=SeqID_52138
  Subcellular localization annotation: CTP_CleavageSite=39; ConfidenceScore=5.23e-01
AVYVSSTIESGAPRIHCLALFANSPFSNLIRRPMNSLPSVVHVSSTIESGAPRIHCLALPMNSLPSAVHVPSTIESAAPQIHCLALFANSPFSNLIRRPMNSLPSAVHVSSIIKRGASEKRSRNESRYGLITERARRTKSVSYLCFPLISDKRYLASFVAQYVKSRDVSKIKRKQAYAIREIPPTWAFQFLPPEGGCFWRKQPCSPGRAELAWASW

SEQ ID NO: 143824 - protein, 147 aa, Glycine max
  Coding DNA Sequence Number=SeqID_52139
MVKVGTSYVPINVSFSPKVRPRACPVFFELHGVIMVYQLSLPVQLLTGWCVNSAKATAGSIALASVSLGCDAERQAGRSRRPLRITPALKGGVCILAYYVGTDAGCFPVRSASCGRKKATVRQSEYVIRTHIGRIPRDSYAGRHAAA

SEQ ID NO: 143825 - protein, 78 aa, Glycine max
  Coding DNA Sequence Number=SeqID_52140
MAGTFFLLKKQNSLEIMSGTPQLVVSEQKLDSSEPVMVLLYDYCVSLKLGSRFRGVTLSHTLCVFLPYCLEHGCVTDS

SEQ ID NO: 143826 - protein, 53 aa, Glycine max
  Coding DNA Sequence Number=SeqID_52141
  Gene Ontology: Mol. function=aspartic-type endopeptidase activity; Biological process=DNA integration
  Homolog annotation: Hit_ID=A5B591; Match level="QueryCoverage=90%, HitCoverage=4%, E-value=2e-17, Identity=85%"; Hit description =Putative uncharacterized protein
YDDLGEQRPGPFARYLEEWGIVPQYTMPGSPSMNGVAERQNKTLKDMLPMGIL

SEQ ID NO: 143827 - protein, 78 aa, Glycine max
  Coding DNA Sequence Number=SeqID_52142
RAPLLGGRVSSKVRTGSPLMARRAPHCPSEGFESNDSYVEGEDVDVLMMPKESSASNVLFKARIQESKKIKIYDQVDL

SEQ ID NO: 143828 - protein, 80 aa, Glycine max
  Coding DNA Sequence Number=SeqID_52143
MAGPGDGGGDYHQLDGSQCLLLDAMTTQMQQLLNRNNEELYRRIEGLEHQMNPNAGRPYGRNKRVNNGPNRIEGQDRIEG

SEQ ID NO: 143829 - protein, 63 aa, Glycine max
  Coding DNA Sequence Number=SeqID_52144
  Homolog annotation: Hit_ID=A5BPN8; Match level="QueryCoverage=80%, HitCoverage=5%, E-value=8e-08, Identity=54%"; Hit description =Putative uncharacterized protein
MYLISCLTCKEGLSFNSDIVGTSSLLVNDNLYLLDTIASYGESFNTELRGTKRRIDNTNSGAL

SEQ ID NO: 143830 - protein, 223 aa, Glycine max
  Coding DNA Sequence Number=SeqID_52145
  Gene Ontology: Mol. function=pyridoxal phosphate binding; Biological process=lipopolysaccharide biosynthetic process
  Homolog annotation: Hit_ID=Q6UUU1; Match level="QueryCoverage=26%, HitCoverage=40%, E-value=2e-18, Identity=78%"; Hit description =Putative uncharacterized protein
AIGAGLFAITPAGERGMCCKAIKLGNARVFPVTTLTSGSPGLQEFDFCQLTGNQHAIAVSSATAGMHITLMALKIGKGDEVINQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 143831 - protein, 118 aa, Glycine max
  Coding DNA Sequence Number=SeqID_52146
MKGENRLKGAIKGINSRKHQQESSQGYCATNQWGKTHQKIMMMDARILTKNQTNVIKVKNEIGKKNSLSHGRGRVGWSKEVSSTTTSTKEGFMRNGLSRCPLTLKLLFVESLLISTIL

SEQ ID NO: 143832 - protein, 79 aa, Glycine max
  Coding DNA Sequence Number=SeqID_52147
MKSGGRRGYLMVIHTFRQPGASEPADAQRLASSSAPFVVQRRRVLLLSSRDGDSDDMRGYLMVIRTFCQPRRTSSMVSG

SEQ ID NO: 143833 - protein, 126 aa, Glycine max
  Coding DNA Sequence Number=SeqID_52148
MAYTHIPDSTSDSPQISASPYQLDLAPYASEPYNAQWNAPGLLRDKHTLRSSRILGEMEVDEPWLGLWLPLNYQVDMEQVSIGHWNWGEFYRLSRCKIHFLTNFVVDLGIAFVHNWVVGKEKEWQS

SEQ ID NO: 143834 - protein, 56 aa, Glycine max
  Coding DNA Sequence Number=SeqID_52149
MLQPYGISIDLKEHSNLMTPKAYTPKSPSGPLPPDSAYNSIHTSQYTYLNTHVSQI

SEQ ID NO: 143835 - protein, 156 aa, Glycine max
  Coding DNA Sequence Number=SeqID_52150
MRTTKEVEVETTKEDEEVQALKTELEKAQTVKEKFKSAAIRIRKENAELRDVNIATTKALERETKRAHREEHGQNKFRGALWGSNSELKLRREERDQSRVDSLILKDELRVWQRSKRSLSQRLCETETNMLAIISKYQEKLNLATAHEHKVADEYA

SEQ ID NO: 143836 - protein, 73 aa, Glycine max
  Coding DNA Sequence Number=SeqID_52151
KAVASGGSNLARLGELGGNHLPYFAINRGGSKKEKAEALPKHFRNVFREEFHEGFDRSSTFFIRSSSFFDLQR

SEQ ID NO: 143837 - protein, 77 aa, Glycine max
  Coding DNA Sequence Number=SeqID_52152
  Subcellular localization annotation: CTP_CleavageSite=40; ConfidenceScore=5.05e-01
SIPDYAVSDIVDPAASLLHLTFILHCTATPVFSGWMSGHRVRHRGSCSFTSALDFYLALYSNSSILGQDVRTLNPTS

SEQ ID NO: 143838 - protein, 78 aa, Glycine max
  Coding DNA Sequence Number=SeqID_52153
MRNDAGHVLSPILEGEPPRQSDEVHEDRREHAHGDIDSYSPVLVKGPTPNTPPQPNLTGEPQNLLAQPIFLSAEGPPP

SEQ ID NO: 143839 - protein, 70 aa, Glycine max
  Coding DNA Sequence Number=SeqID_52154
  Subcellular localization annotation: CTP_CleavageSite=63; ConfidenceScore=5.65e-01
MATPPALPPPPPAVASTSPSTLKQTRKATQLRSLATRPPGVELILRPARPTVDVTYETWKEVSAAQKDLI

SEQ ID NO: 143840 - protein, 170 aa, Glycine max
  Coding DNA Sequence Number=SeqID_52155
MDMDDVAISTFYRRPQCNLPCRCIGWSVRHDIGIAPIRRPMDPKKSNRALGFPALVAGLCQSYRVPVPPSEESHPQRHPVDPEKSNRALGFPALGSRLQDTQWTRRSPTGSWSYQALITSLCQFYGVPVAPSKGIRPPTNRAFIKKYCVPRQAQGSTKRLERCLQPMADQ

SEQ ID NO: 143841 - protein, 75 aa, Glycine max
  Coding DNA Sequence Number=SeqID_52156
MKEISPDKSCEVSLRKKCKIADAQKVINDWRCIKLFYTLSPKKSGHSTFKNEFKLNKEVESLGVGKIGTNSFKTP

SEQ ID NO: 143842 - protein, 98 aa, Glycine max
  Coding DNA Sequence Number=SeqID_52157
LETCQKSKGSRLAQSVKFRDVAEIEKRSFLLKAVASGGSNLARLGELGGKLLPYFAINRGRSEEEKGPAFLAFRILLNLLRKNVPVKKIQAEALPLQR

SEQ ID NO: 143843 - protein, 182 aa, Glycine max
  Coding DNA Sequence Number=SeqID_52158
  Homolog annotation: Hit_ID=A2Q6B4; Match level="QueryCoverage=87%, HitCoverage=67%, E-value=2e-19, Identity=30%"; Hit description =Ribosomal protein L33; Nucleic acid-binding, OB-fold
CIFQGDQIHAICKSDHLKSWKADLKENCTYVMHNFKGVKNDGQFRVCEHEYKLFFIGVMVVREDDLHELPFKEFRFVEFPNVVAGNFVSGLLVDIIGVVDQVVFRHVSSKNTRVVFRMKDLSGEILSCTLWEHYCAQFLSYLNERGDDGPMVVILTHARIKDAQGSYPNFSEQFLQGVKTID

SEQ ID NO: 143844 - protein, 155 aa, Glycine max
  Coding DNA Sequence Number=SeqID_52159
MELIENMVASDHTILRDRTHIATKRILLELSSQDALLAQNKLLSKQLEALTETLSCAICGGAHKSGYCISTEDHAHEVNYMGNQPRQNFNYGHWRAHPGNQFNKDQGGPSNRLQQQGPNLYERTTKLEETLAQFIQVSLSNHKSTESAIKNLEIQ

SEQ ID NO: 143845 - protein, 81 aa, Glycine max
  Coding DNA Sequence Number=SeqID_52160
MASKKLSTKRFRRDAATEGSSATPEFDSHHFRSAEHQQCFEAIKGWSFHRERRVQLRKDEYTDFQEEIAHRHLDVAGDSHG

SEQ ID NO: 143846 - protein, 218 aa, Glycine max
  Coding DNA Sequence Number=SeqID_52161
ASSEEGLTPFITRGFNSINAGVLQRVRKAWEMVQRKDKELRGSSNGPIGGYHRWLKAYAQGLDWLPSLRTTKEMEGEALEKDEEGIRKENAELRDVNIATTKALEQEAKRARKEEHGRNKFRGALWGSNSELKLQREERDQSRLDGVILKDELKTCLRSKRSLSQRLGEIETNMLAIINKYKEELSLAIAHEHKVADEYTRVYAEKEARGKVIDSLHQ

SEQ ID NO: 143847 - protein, 43 aa, Glycine max
  Coding DNA Sequence Number=SeqID_52162
MGPKSTLRLMRILGPSLASLAQSSWSLLFNSLGGGFGMNTLID

SEQ ID NO: 143848 - protein, 280 aa, Glycine max
  Coding DNA Sequence Number=SeqID_52163
ELYANLYSPEGPSPKQVRIRGHLIRIGADSLNAFLETPVVLAEGFILNAEGHLGKILRKDLTTLAQVWSVLSYSNLAPTSHTSDLTVDRARLIFGLVTQLDMNVGALISGQITSMAQSNSSRLGFPALIIALCRTRGVASDSLVFERLSPAPSTSVAPHLGSTSAAPPSARIATAPSILPPANFQCFEAMLQSIHQGQIILLQSLQLVAPPDSIPMTEQFNEWVAWPGTQPPLHREDENPAAQEAVATLEKSPEATPEPPAPLADTTSPQQAADPSTPKD

SEQ ID NO: 143849 - protein, 75 aa, Glycine max
  Coding DNA Sequence Number=SeqID_52164
MVGYTPSSFTDLVFASERIEVGLKRGKFNHPILMNKKSGANEEGEDEGETHLVTTIPIRPSFPSTQQCHYLGGIL

SEQ ID NO: 143850 - protein, 151 aa, Glycine max
  Coding DNA Sequence Number=SeqID_52165
  Homolog annotation: Hit_ID=A0ST23; Match level="QueryCoverage=29%, HitCoverage=91%, E-value=1e-11, Identity=73%"; Hit description =Putative reverse transcriptase
DAGSRQARQGASAGVGGCRGWLNYAASEQIVLRVHHMRAIGAGLFAITPAGERGMCCKAIKLGNARVFPVTTLALHLKGFVVHSVIFFFLSSWVMEIKHLAFIAIGTELEFVIMVIAVSFGKPVVPAALMNRPTRGERRFAYWALFRFLAH

SEQ ID NO: 143851 - protein, 153 aa, Glycine max
  Coding DNA Sequence Number=SeqID_52166
MARTSKVVKISAQELDRVKQYKNGVVGIPRKRLEEKAEALVDQGKWTSFIDILALLVFGTILFPNVNGLVDLDAINAFLAYHHRKESLIIVVLVDAYDTFNLRCKKRNVRIVYCTPALYVWLIRQALESVVFHLLAKPICWLSERLLSATLLG

SEQ ID NO: 143852 - protein, 113 aa, Glycine max
  Coding DNA Sequence Number=SeqID_52167
DSTSDSPQISASLHQLDFAPYASRSYNAQLNVPELLHDMHMLRSSRILGKMEAGLVADLGMAFVDDWVRGTIRAPSCICSVVASYPEPYQNCTDTDYQMQPLGPSKNGLGKVP

SEQ ID NO: 143853 - protein, 72 aa, Glycine max
  Coding DNA Sequence Number=SeqID_52168
MKMKANKTRNELKVSDSKTYRLKNEERMKNGEERRKTFTNLLTETSRKRYGSTSAWIFFTETIFFIQNSLNA

SEQ ID NO: 143854 - protein, 158 aa, Glycine max
  Coding DNA Sequence Number=SeqID_52169
MSLCGSRTQKCNITVASRLCSQSLAWRKTKMFVDPANAKTATLGEVAEALQYMVSPQGRNTCTFDDLVPYVEKITILSEEQERVTEPVSHGPASERQFPAQQFHMLQSSIETQGIDRRRDIVEAEEYSQQMAERGHGMYYTPQTFAEYPTQMYQYPFQ

SEQ ID NO: 143855 - protein, 43 aa, Glycine max
  Coding DNA Sequence Number=SeqID_52170
FMMIALSGPCRAKHVHLGCCTQNDADAKRTCALSVNGILKYPV

SEQ ID NO: 143856 - protein, 167 aa, Glycine max
  Coding DNA Sequence Number=SeqID_52171
MAVVLEAGKKFSKILSKIKSSQLGWRSKLPRQCRNFFLPNDIIVRYSLSHKLGSKQSSFKNITSHAGYFWMPSFLKSGATIPLESSHEVEVVPCSQNGKIRMLRIRMLQNYNCSRQDVQQSPITECTDSPVNGMSAMIKRIKGFFKQMDSLLLLCFQHNLHSKTAQD

SEQ ID NO: 143857 - protein, 138 aa, Glycine max
  Coding DNA Sequence Number=SeqID_52172
  Homolog annotation: Hit_ID=A2Q6B4; Match level="QueryCoverage=62%, HitCoverage=42%, E-value=6e-07, Identity=32%"; Hit description =Ribosomal protein L33; Nucleic acid-binding, OB-fold
VTVVRECVLGDIPFRKYRFVGFADVVVGQFEHGLLVDVIGLVEEVVFRQVSGKASNCYLALCWDDYCLQFVNFLDDYEGDGPITVLLSHCRIKEAQGSYPASINNSLKASKLIINQPVMDIQEFNERYFLLAELGIEA

SEQ ID NO: 143858 - protein, 167 aa, Glycine max
  Coding DNA Sequence Number=SeqID_52173
  Homolog annotation: Hit_ID=A0ST23; Match level="QueryCoverage=14%, HitCoverage=51%, E-value=4e-07, Identity=100%"; Hit description =Putative reverse transcriptase
RVPFAIQAAQLLGRAIGAGLFAITPAGERGMCCKAIKLGNARVFPVTTLANWSSTAVAAALELVDPPGCRNSILTKIADIAIFVSKGGARYQLLFPLVRVNFELGVIMVIAVSFGKPVVPAALMNRPTRGERRFAYWALAECILAYYVGTDEGVSEVLHVAGEKRLH

SEQ ID NO: 143859 - protein, 148 aa, Glycine max
  Coding DNA Sequence Number=SeqID_52174
  Homolog annotation: Hit_ID=Q84VH5; Match level="QueryCoverage=77%, HitCoverage=21%, E-value=1e-53, Identity=77%"; Hit description =Envelope-like protein
SGGYCCSEHQIAKEITAKQVQHWPKKGKLSAGKLSVKYAILHRIGTANWVPTNHTSTVATESFAVKLPIAFPTVLCGIMLSQHPNILNNIDSVKKRESPLSLHYKLFEGTHVPDIVSTSGKAAASAAEEEEDAAEDTESDDDDSDATP

SEQ ID NO: 143860 - protein, 172 aa, Glycine max
  Coding DNA Sequence Number=SeqID_52175
MAPRKLASKRLGRIKRLKEPVLLPSMTVTALGALNTSSASRPSRDGHFFGSDVQLRDDEYTDFQEEIGRRQWASLVTPMAKFDPDIVLEFYANAWPTEEGVRDMRSWVRGQWISFDADAIGQLLGYPLVLEEGQKCEYGQRRNRSDGFDEEAIAQLLCIPGQDFARTAAGRR

SEQ ID NO: 143861 - protein, 15 aa, Glycine max
  Coding DNA Sequence Number=SeqID_52176
DTQQQNFLYRKGGIL

SEQ ID NO: 143862 - protein, 96 aa, Glycine max
  Coding DNA Sequence Number=SeqID_52177
AGAVTSFGYCKDRDGQWLKKDELPPQDKRTPSPPPQRDDSSALMNEVISELRGLRTYVGERFDSLDGHFEGMDTRITQLEEDVTYLRRCFDLPPPS

SEQ ID NO: 143863 - protein, 49 aa, Glycine max
  Coding DNA Sequence Number=SeqID_52178
MTEDIVVFEMNVMTEDIFVFEMCVDYRIRRLRMLPDFSQVGVVELCVYG

SEQ ID NO: 143864 - protein, 108 aa, Glycine max
  Coding DNA Sequence Number=SeqID_52179
MGIAPTETPSGPEEVNRALGAPVPPSKFMSSWHRDCARKTPSGPEEGQQGLGVASSKYGSLSVLGSVCRPQQGHQAPLPIELSSRSTAPPGRRRAKHHISIGMAGSGQ

SEQ ID NO: 143865 - protein, 131 aa, Glycine max
  Coding DNA Sequence Number=SeqID_52180
MIMRGQDIYSSQDETTTSPSSSKSEEAKGEESSEEIYPQEERQPLMVKKECKEVSVSSKRLAKKENHFSIKANIKETSPLRKPPHLLVCKKTLVSTATPLGLEIILQVKKLLDKDLVRKSLNPCALLVSKI

SEQ ID NO: 143866 - protein, 94 aa, Glycine max
  Coding DNA Sequence Number=SeqID_52181
NVYTDNHSGISARQRDSNVSMTDLVSAEDDQKNVYTDNHSGISARQCDSNVSMTDLVSAEDDQKNVYTDNHSGISARQRDSNVSMTDLVSAEDD

SEQ ID NO: 143867 - protein, 59 aa, Glycine max
  Coding DNA Sequence Number=SeqID_52182
MWTTTGTYNESKSLVQGEVVAAQLAQASQVASSKSNSLLEESSGGGPSGPGCYLHPHFY

SEQ ID NO: 143868 - protein, 700 aa, Glycine max
  Coding DNA Sequence Number=SeqID_52183
  Gene Ontology: Mol. function=transcription factor activity; Cellular component=intracellular; Biological process=regulation of transcription, DNA-dependent
  Homolog annotation: Hit_ID=A6TCG3; Match level="QueryCoverage=54%, HitCoverage=98%, E-value=1e-133, Identity=59%"; Hit description =Putative NAGC-like transcriptional regulator
  Pfam annotation: Domain name=ROK; Domain location=134-309; Score =45.7; E_value=1.6e-10; Accession=PF00480.11; Description=ROK family
MPRRISHGWVAAQPDKAFARHYQNVFYRNSANSADEAKGGRVKTVGLNNFQVRKHNKALFMQLMWRHKRLSKSQLAQLSGLTIPAASKILQELLEQGHVQHSSATLSTRGNSNGSFQLPAQGAWTLCLCVKPTSIELQLADAQLVSQGDYQQISINAQTPEQLLAEIETVWRATCKRWPKRQINLALAVHGQVDPVTGVSQHMPQAAWRSPLQLKFLLEEKLAVDVRVDNDCVMLALAEKWLNRNALAEFCVINVDYGIGSSFVINGEIFRGNLYGSGQIGHTIIDPHGERCNCGRQGCLETVASLSTLKRLAHQRAPQAVQPTSRQLLAAWQAGEPWIVEWAQRSAEAIGMSLYNFLNTLNINQIWLYGRSCTFGESWLQTIVHQIDFNPFDPRDALKSKATNVHFGQLDRARQVLGIGYLYVEADPGTAYRTLTLVRRVAVNNHQHLNMRYVWSICLVAACGGLLFGYDNGCGQAGAAAAVDRRRISAVLWVGDRHRAGQHLRYDAEIMPGRQIAQTRCPAFQPIAAGTAHAADCHHRHRAGDFPAVVRYQRDFQLCAGDFCFGRFRYQRYAEVDRGHRPDQFAGNSAGTAAGGPARSPQTDADRRRRTDAVLCTDCRCLHAGHHRLAGADSGTGGDCGLCADAGTGHLGAAGGNFPQPDSRSGDVGRHAGTVDCLFCADLYLSHPQCRTWCSGQLYA

SEQ ID NO: 143869 - protein, 301 aa, Glycine max
  Coding DNA Sequence Number=SeqID_52184
  Gene Ontology: Mol. function=transcription factor activity; Cellular component=cytoplasm; Biological process=regulation of transcription, DNA-dependent
  Homolog annotation: Hit_ID=A4WB80; Match level="QueryCoverage=99%, HitCoverage=99%, E-value=1e-143, Identity=83%"; Hit description =Transcriptional regulator, LysR family
  Pfam annotation: Domain name=HTH_1; Domain location=7-65; Score=65.8; E_value=1.4e-16; Accession=PF00126.18; Description=Bacterial regulatory helix-turn-helix protein, lysR family
  Pfam annotation: Domain name=LysR_substrate; Domain location=87-294; Score=126.5; E_value=7.6e-35; Accession=PF03466.11; Description=LysR substrate binding domain
  Pfam module annotation: Pfam domain module=HTH_1::LysR_substrate; Domain location=7-65::87-294
MRELPPTAMLRAFEVATRHPTFTAAAEELFITQSAVSHQLKNLEEIWGVQLFQRGKTLSLTPAGAALAPIVREFFSNLETTLADLREQKGRVRLRVNTTYSFALKWLLPRLPGLTRLHPEILVTLESTDDAITFSRQDSDVAIRFGHGNYPALHSEFMFREQLFPVASPALLQRFGTPQEPAELLRYPLLMRDGADLVPKWEIWFKQVGLTLDALQESVRFADTNMTLEAALLGQGVALARSGHVEKELRDGSLVRLFSVAFSSPAAYYFVCPQGIESQPHIVDFRRWLLAESRQAQQDYQ

SEQ ID NO: 143870 - protein, 840 aa, Glycine max
  Coding DNA Sequence Number=SeqID_52185
  Gene Ontology: Mol. function=catalytic activity; Cellular component =integral to membrane; Biological process=metabolic process
  Homolog annotation: Hit_ID=Q024C6; Match level="QueryCoverage=40%, HitCoverage=86%, E-value=2e-74, Identity=39%"; Hit description =Mandelate racemase/muconate lactonizing enzyme, C-terminal domain protein precursor
  Pfam annotation: Domain name=DUF1228; Domain location=119-190; Score=- 18.4; E_value=0.015; Accession=PF06779.5; Description=Protein of unknown function (DUF1228)
  Pfam annotation: Domain name=FCD; Domain location=724-824; Score=6.4; E_value=3.8e-05; Accession=PF07729.3; Description=FCD domain
  Pfam annotation: Domain name=GntR; Domain location=684-731; Score =1.6; E_value=0.045; Accession=PF00392.12; Description=Bacterial regulatory proteins, gntR fam
  Pfam annotation: Domain name=MFS_1; Domain location=97-398; Score= -21.4; E_value=0.096; Accession=PF07690.7; Description=Major Facilitator Superfamily
  Pfam annotation: Domain name=MR_MLE; Domain location=416-519; Score =53.8; E_value=6e-13; Accession=PF01188.12; Description=Mandelate racemase  muconate lactonizing enzyme, C-terminal domain
  Pfam annotation: Domain name=MR_MLE_N; Domain location=317-414; Score= 42.6; E_value=1.4e-09; Accession=PF02746.7; Description=Mandelate racemase  muconate lactonizing enzyme, N-terminal domain
  Pfam module annotation: Pfam domain module=DUF1228::FCD::GntR::MFS _1::MR_MLE::MR_MLE_N; Domain location=119-190::724-824::684-731::97 -398::416-519::317-414
MTGIPIALIIGTPVSSLLLELHGWLGLRGWQLMFLLEAIPAIALGLIVPFALPDRPEDARFLSADEQHWLVTTLAAERQKLPSRGHGGLLKALFSPLVLLFSLTYYGLANLNGAVSTFLPLIISETGLSHVQTGFITIIPYVFGLAGMLVLGRIADRPGSRLLANYLALIFSFVGLLCVAWFDNSLVKMMFLCCSAFGFFGAMPVFWGLPAQFIPASVVAGGLALINALGSIASVVNPWVIGVIRDRSGSYNGGFYWLAAMAMLSIITLSIIFRRQRLPAYQASNEQRVMPGEGDFWEERLARPTDIYAQFRTVNNHDGGVQLEDGFAITTVFLEIVSDEGVDGLAGPVPHAVASIIHGQLRPLLLGQDPRDTERLWDQMYRAQIHGRQGDGMLAISAVDCALWDLRAKWMQQPDMARVHERALEYKALGYRGQKWFFRHGPMSGREGLKKNIELAKTLREAVGDDYDLMFDCWQSMDVTYLLELAKGIEPYRPRWLEECVMADRIGSMQRLKDKLSIPMAGGEHEYTRWGFKRFFESGALDVIQPDIYWCGGLSETLKIAAIATLYDLQVIPHGHSSIATAHFSTTQSPIHTPYQEYLVKWNDIHQYFLRDPLVPQNGLIPVPQGPGMGMALNPAHIQQQTYFAHRHSDPLNARCLKDARHAMPADKLIIDWSSKNILRPQSLSSILADHIRDLIVNCQIAPGALISENDIATQLNVSRTPREMRETCEMRQILESGALKLALQHDRQALIARLNEQLARGRDALQNAPETYRETDAAFHMALIEASQNSELGSQNDHEAIVARLTNYEDEQALELLHWHLGGIMRMFQRSVADTDSAS

SEQ ID NO: 143871 - protein, 168 aa, Glycine max
  Coding DNA Sequence Number=SeqID_52186
  Homolog annotation: Hit_ID=A0R741; Match level="QueryCoverage=69%, HitCoverage=65%, E-value=9e-25, Identity=49%"; Hit description =Putative uncharacterized protein
MAEYTLSVYLEKSEFNRGPHLDGAEGAEAIAAFILRPEHEEALASGLAHFTGLPLIDLRGDSAVVTSYLQLIYLDDKGESRMLANHGSSPGYRIHRVVVNRWELKRIAGQWKIHRRTLIPVDGSARPRCAATSSMIIRYETGGAGWCPAWQQSGYSFQPNPLVMYLPV

SEQ ID NO: 143872 - protein, 427 aa, Glycine max
  Coding DNA Sequence Number=SeqID_52187
  Gene Ontology: Mol. function=transporter activity; Cellular component= integral to membrane; Biological process=transport
  Homolog annotation: Hit_ID=A4W5S2; Match level="QueryCoverage=100%, HitCoverage=99%, E-value=1e-151, Identity=65%"; Hit description =Major facilitator superfamily MFS_1
  Pfam annotation: Domain name=MFS_1; Domain location=19-380; Score =95.5; E_value=1.7e-25; Accession=PF07690.7; Description=Major Facilitator Superfamily
  Pfam annotation: Domain name=Sugar_tr; Domain location=15-417; Score =78.5; E_value=2.2e-20; Accession=PF00083.15; Description=Sugar (and other) transporter
  Pfam module annotation: Pfam domain module=MFS_1::Sugar_tr; Domain location=19-380::15-417
MMSSAVAPAVNQKRVLIAGSVGNFIEWYEFAVYGFMATLIAKHFFQLEGESALTSLILTYAAFAVAFFFRPLGAVLFGRLGDRYGRKPVLIAVLVLMTLATVAIGLVPVYASIGVAAPLLITLLRILQGLFAGGEYGGAVSLMTESAPPGKRGFYGAWQSLTVALGLLAGAGVVAVLPLLLGDAAMNAWGWRIPFLLALPLGAVALWLRSGLDESPQFSQTPAAPQQQASLGVTLRAIVLGIGRLMIWSAAGYTYLVIMPTYLQAALHTGFNQALLIAVISNLGFAATILPAGILSDRYGRRTLMLLATFLLLVLAFPLLKVLQHPESGMAIKALVVFIAGALVGMLAGPGPAMLAEMFPTRVRYTGLGLAYSLSNALFSGCAGLIITGLMKQTGNADIPAWYVMATAVVSFVALLSLNKDDHRRPL

SEQ ID NO: 143873 - protein, 528 aa, Glycine max
  Coding DNA Sequence Number=SeqID_52188
  Gene Ontology: Mol. function=hydrolase activity, hydrolyzing O -glycosyl compounds; Cellular component=cell surface; Biological process=trehalose biosynthetic process
  Homolog annotation: Hit_ID=A7MRL2; Match level="QueryCoverage=100%, HitCoverage=88%, E-value=0.0, Identity=77%"; Hit description =Putative uncharacterized protein
  Pfam annotation: Domain name=Alpha-amylase; Domain location=117-459; Score=31.6; E_value=2.1e-11; Accession=PF00128.15; Description=Alpha amylase, catalytic domain
  Pfam annotation: Domain name=Isoamylase_N; Domain location=9-79; Score=27.3; E_value=5.8e-05; Accession=PF02922.9; Description =Isoamylase N-terminal domain
  Pfam module annotation: Pfam domain module=Alpha-amylase::Isoamylase _N; Domain location=117-459::9-79
MESTTLEKSWGAEILADGSVRFRLWAPGQQQITLHADGQQHAMQPQQDGWFSLTLRGPGHGSEYHYELADGSTVPDPAARAQRADVNGPSLVIDPHHYDWQQRDWQGRPWHETVVYELHIGTFTAEGTFRAAIEKLPALADLGITMIEVLPVSQFGGTRGWGYDGVLLYAPHSAYGSPDDFKAFVDAAHALGLSVVLDIVLNHFGPEGNYLPLLAPAFFHEERMTPWGAGIAYDVDAARRYIVEAPLYWLKEFNLDGLRFDAIDQIEDTSSKHVLIEIAERIRSEIHSRPIHLTTEDSRNVIFLHPRDADGNAPLFSGEWNDDFHNAIHVFATGETHAYYQDFADVPEKLIARILTEGFAYQGELSPQSGQRRGVPSAGQPPVAFVDFIQNHDQVGNRAQGERLISLAGVDRTKVLLATLLLSPHIPLLFMGEEYGETNPFLFFTDFHGELAKAVREGRAREFTGHAGHDDTVPDPNAEETFTRSKLDWGKVENPAGQAWLTLTRQLLALRQQHIVPLLADARRHNGQ

SEQ ID NO: 143874 - protein, 82 aa, Glycine max
  Coding DNA Sequence Number=SeqID_52189
MKSSPNYEGLRSYVGDRFDLLDSRFAGYCIVIIKKGEIVDAIGFDVLMMIMHDVLQLMQMGFSRLKFKTILQDYKSQHQDDH

SEQ ID NO: 143875 - protein, 170 aa, Glycine max
  Coding DNA Sequence Number=SeqID_52190
MERSMIDAANGGALGDMTPVEARNLIEKMASNSLQFSTRNDVIVIRGVHEVATNSAASSETKKLEGKLDALVNLTFALPCSNLEQLSSLKLMLQTFYNRPPQPQQQNQPQQNNYDLSSNRYNPGWRNHPNLRWSSPQQQQQQPAPSFQNVASPSRPYIPPPIQQQQQPQK

SEQ ID NO: 143876 - protein, 240 aa, Glycine max
  Coding DNA Sequence Number=SeqID_52191
GAPMEESMSPFLVSDFGAQNFKAIQRIRKAWETPVHRKRNEEVQALKSELRNRRNCAKEKFQEVWTANTHPEGVCRITGRECNYRKRPLKTRGQEGNNELKLEGLKRVDQREHMHGLERRVSRLQGQNGACLAAIYCETKTNMLAIIAKYKKSSTPTRHRVAEEYAQFALCVWLVSHLFQQDTRHPCPLLSHRSCTEKRRIDWDQLLAGIGGRTINWFPRWKEGKERSPFLMWRIPKHSR

SEQ ID NO: 143877 - protein, 82 aa, Glycine max
  Coding DNA Sequence Number=SeqID_52192
MVVVGDGEKAWVIGNDFGRKKGEEMAFFLNYMKAKLRTDSKHFLKDPNGQIVEKCLVKLQTEFRKDPTVNEGWEGFLPRQLM

SEQ ID NO: 143878 - protein, 85 aa, Glycine max
  Coding DNA Sequence Number=SeqID_52193
AAQLLGRAIGAGLFAITPAGERGMCCKAIKLGNARVFPVTTLNSIPTASTGIIARGQGFDRTRIYTSVEAVPIKLIDTVDLEGGP

SEQ ID NO: 143879 - protein, 111 aa, Glycine max
  Coding DNA Sequence Number=SeqID_52194
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=88%, HitCoverage=75%, E-value=3e-25, Identity=66%"; Hit description=LacZ protein
  Subcellular localization annotation: CTP_CleavageSite=32; ConfidenceScore=5.05e-01
MTMITPSSKLTLTKGNKSCPGDPLVLERPPPRWSSNSPYSESYYNSLAVVLQRRDWENPGVTQLNRLAAHPPFASWRNSEEARTDRPSQQLRSLNGEWDAPCSGALCAAGV

SEQ ID NO: 143880 - protein, 122 aa, Glycine max
  Coding DNA Sequence Number=SeqID_52195
  Homolog annotation: Hit_ID=A0ST23; Match level="QueryCoverage=22%, HitCoverage=55%, E-value=2e-08, Identity=100%"; Hit description =Putative reverse transcriptase
RVPFAIQAAQLLGRAIGAGLFAITPAGERGMCCKAIKLDRVKDILANPGASGSTFIKLIDTVDLEGGPVGKPVVPAALMNRPTRGERRFAYWALAECILAYYVGTDEGVSEVLHVAGEKRLH

SEQ ID NO: 143881 - protein, 113 aa, Glycine max
  Coding DNA Sequence Number=SeqID_52196
STCTTGLSTPGGLVDNDRRREAFRVCFTADVEADASEVGGGGGEEGGGGGGGGGGVGVEAGGEPVATYPSAGGRRETRGMRVPRTEYARSRHQRLFEENVGKTGRDAIYELLS

SEQ ID NO: 143882 - protein, 172 aa, Glycine max
  Coding DNA Sequence Number=SeqID_52197
MSVLELYIEKDVSNLHGDEDDDDDDDYLVSNSYVEESLDEDDSIDGISDTDDEVTDMIQPIRIVHPVEGVQGIQNPFWNDALHYKNINWSHPDEEDICGLEMPSSFNVGQELYVGMDFDSKDAVKNVVKQYVMKVHQSFKVVESKSNKYVVCCLNKSAECPCPFYMRTISSK

SEQ ID NO: 143883 - protein, 397 aa, Glycine max
  Coding DNA Sequence Number=SeqID_52198
LVHVDVDDLRAVLDLLAGHRQRLVVFFFADQAREHLAAGDVGAFAHVHEQRVLVDVERLQARQAGLDRNLRHHPRRQRRDLFGDGADVVRRGAAAAARHVHQPGAGEFLQQRRGVGRRLVKAGLGHRVGQAGVGVDTDVGVADLGQLGHVRAHQRRAQRAVQADGDRARMAHRVPEGFDGLARQDAAGGVGDGARDHHRQADAALLEHLLGGEDRRLGVERVEDGHAQLVEGDVARARVVHVGRDRRRLGLRAERAGHEARFVRRAVLVTGLARQLRGHQVQFVGQFRQVVVALRDRGGAEGVGLDDVGAGLQVLAVDLRDHVRPHQRQQLVVALEVLAMAGEALAAEIGLAQLVALDHRAHGAVQDQDALTQLAGEFAAAGEALGRVRQAGIRHVQ

SEQ ID NO: 143884 - protein, 176 aa, Glycine max
  Coding DNA Sequence Number=SeqID_52199
ILDPKYIDLEFFDEETFDCYQVFQNSALIDFMTLKHPYFPELVKVFYNNLKIQDGILYFEVHNIPIVIDQPLFYSLTKLPSQGVPFEGTLVDDWKFDYSSHDARRMALRANAPLPYPHLVTLFLHHFNVPLDDEPYVKVKRLFSIVAGAITSFGYRKDVDGQWVRKQDLPPPILDE

SEQ ID NO: 143885 - protein, 102 aa, Glycine max
  Coding DNA Sequence Number=SeqID_52200
MAGDWPEAQQRGTPEAPGAGEEAHEDEEMADLLDFLGGSGDTVLRLGTSSEKYVCKTNKNHDKSRKEKNEMEKRTKEKRREQVKKKKASKKKGGKRENKLSS

SEQ ID NO: 143886 - protein, 142 aa, Glycine max
  Coding DNA Sequence Number=SeqID_52201
QQKVFTDNHSGISARQRDSKVSMTDRVSAEDDQKVYTDNHSSISARQRDSKVSMTDLVSAEDDVNLRVLTGIQQKVYTENHSGISARQRDSKVSMTDLVSAEDDGAEDDVSLYVLSGFSSYRQQKVCTDNHSGIFACQRDSK

SEQ ID NO: 143887 - protein, 39 aa, Glycine max
  Coding DNA Sequence Number=SeqID_52202
MGRRLPPSSPRQAQLAQHYGCPGSPGIPSFNKTGEVVAT

SEQ ID NO: 143888 - protein, 155 aa, Glycine max
  Coding DNA Sequence Number=SeqID_52203
MASMMKAMLGMRQLMEKNMATATAVSLAAKADPTLPATAHHPLPNAVGRERSTLGHTSNPHLGYNWVAYPYGLPPNYTPPVMRDDVGRVPSPILEGEPPRQPEGMSNSTPRSPSRDQRPTHCLSTTSQHSQYSCPQKDHPRPQKKEGNSISSRRD

SEQ ID NO: 143889 - protein, 35 aa, Glycine max
  Coding DNA Sequence Number=SeqID_52204
MVARPGELMLTPEVTCSPKRAAARPDACNLYLEMQ

SEQ ID NO: 143890 - protein, 134 aa, Glycine max
  Coding DNA Sequence Number=SeqID_52205
MGIAPTKTPSGPEEVQQGPGVSSSGYGPLSVLQGARTPPPPAKKRHHRECLSPPARSSGPPYQSSFHQEVLRPRQAQGETPQQHWDGRQRETDAPPSPLEFTSAHPQKGLSIAYTTWPTNRRPSPKPKDAPSCS

SEQ ID NO: 143891 - protein, 205 aa, Glycine max
  Coding DNA Sequence Number=SeqID_52206
  Homolog annotation: Hit_ID=A4W4Y2; Match level="QueryCoverage=100%, HitCoverage=35%, E-value=3e-91, Identity=82%"; Hit description=AsmA family protein precursor
MKFIGKLLVYLLVALLIVLLALYILLQTRWGATQVSSWVTVNTDYELSFDKMNHRFSSPSHIILENVTFGRDGKPATLVAKKVDIGLSSRQLTDPLHMDTITLFDGTLNLSPQTAPLLFQADRLQLNNMAFNSPNTEWDLSAQKVTGGVSPWQPEAGNVLGKSAQIQMSAGSLTLNGVPATNVLIEGQLNGKEVVLSTIGADMAR

SEQ ID NO: 143892 - protein, 86 aa, Glycine max
  Coding DNA Sequence Number=SeqID_52207
MRGYHMVIRTCRQPGENEPVDARRLTSSSAPFVLLTREVGPMKSADMQSYLMVTCTFRQPGANEPIDARRLTLSSAPFVVLTLEVR

SEQ ID NO: 143893 - protein, 152 aa, Glycine max
  Coding DNA Sequence Number=SeqID_52208
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=57%, HitCoverage=75%, E-value=2e-24, Identity=67%"; Hit description=LacZ protein
MRLAAETYHGVGLADLHGRPRGRDLAQLSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 143894 - protein, 109 aa, Glycine max
  Coding DNA Sequence Number=SeqID_52209
MEIYHTELDEFKAELERRNFHKRLTNLVDSSIDLALVKEFYANLYSSEDLSPKQVKVRGHLVRIDVDNLNTFLEMPVILAEGETLPAYSRYCRLPIDYKEIEAALCIPG

SEQ ID NO: 143895 - protein, 428 aa, Glycine max
  Coding DNA Sequence Number=SeqID_52210
  Gene Ontology: Mol. function=oxidoreductase activity; Cellular component=chloroplast thylakoid membrane; Biological process =metabolic process
  Homolog annotation: Hit_ID=A8M1L3; Match level="QueryCoverage=35%, HitCoverage=46%, E-value=3e-16, Identity=38%"; Hit description =Alcohol dehydrogenase zinc-binding domain protein
  Pfam annotation: Domain name=ADH_zinc_N; Domain location=1-121; Score= -14.2; E_value=0.012; Accession=PF00107.17; Description=Zinc-binding dehydrogenase
  Pfam annotation: Domain name=Ifi-6-16; Domain location=356-428; Score= -13.8; E_value=0.088; Accession=PF06140.4; Description=Interferon -induced 6-16 family
  Pfam module annotation: Pfam domain module=ADH_zinc_N::Ifi-6-16; Domain location=1-121::356-428
LAALRGAEVWATCGARNAPLVERLGAVRTFDQRVSPPSDIPAGRLDAVVDIAGGIPLRAMQRLTAHRGTIVLVTGDGGHVLGPVPRMLRAAVLSIGSRRIRPLAETPRPEVLAKLLELVAEGRVVPVIEREYPFAEGSAALAQNEAGHTVGKVVVRGSGVLQHWNSGNQAAAFDAVRPRAEEGQAWAAALLSWLHMQQGYPGIDESVTWAIAAAHGGLPGQLVHAYNSLLAHLPSNPALVNRLPEIFQVGSPWGNGTDHVGQGWNLVANGQAELGLQVMMLPTPYPTPEPQLSALVAQANDRAIELDNVMAALREREAEAGLLVTATTSDATNALFMADARRNTEESRGAWRWGLVVLGGAALVAVLPVVLHYLQLGPDYLAFEQIAVHLVSTAALGTFAGVLLARARSRDHAAQRANDLSTAMGTMI

SEQ ID NO: 143896 - protein, 73 aa, Glycine max
  Coding DNA Sequence Number=SeqID_52211
MILPMDSMSLTPYKHDLSSENFRILDSYSNLRVRILSILSHIPRTHSGHDQVHIEATIVLRYSLKHPQTFPIK

SEQ ID NO: 143897 - protein, 223 aa, Glycine max
  Coding DNA Sequence Number=SeqID_52212
MERSIIDAASGGALGDITPTEARNLIEKMASNSQQFSAFIDAMIIRGVHEVATNSSAPSETKKLEGKLDALVNLVTQLALNNKFVPVARVYGLCSSTDHHTDLCPSIWSSPQQQQQPTPSFQNATGPSRPYIPPPIQQQQQPQKQQIVEAPPQPSLEELVRQMTMQTMQFQQETRASIQSLTNQMGQLATQLNQQQSQNSDKLPSQSVQNPKNVSAISLRSGK

SEQ ID NO: 143898 - protein, 66 aa, Glycine max
  Coding DNA Sequence Number=SeqID_52213
  Pfam annotation: Domain name=G-patch; Domain location=1-42; Score =13.6; E_value=0.0042; Accession=PF01585.14; Description=G-patch domain
MVAWVMLRHGYEPGMGLGKDSHENADVVDIRGNPYKYGLGYEPGKPGRRNAPSRLRADRAWPGHVS

SEQ ID NO: 143899 - protein, 276 aa, Glycine max
  Coding DNA Sequence Number=SeqID_52214
  Homolog annotation: Hit_ID=Q6UUU1; Match level="QueryCoverage=21%, HitCoverage=40%, E-value=4e-18, Identity=78%"; Hit description =Putative uncharacterized protein
  Subcellular localization annotation: CTP_CleavageSite=42; ConfidenceScore=5.16e-01
GTSYVPINVSFSPKVGPGLPAVPPVQLLTGWCVTAKAPPDISAGKCSGRVPFAIQAAQLLGRAIGAGLFAITPAGERGMCCKAIKLGNARVFPVTTLNSIALVAQAGVQWHDLGSHNLCLPETRFLHVDLLIRLVYQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 143900 - protein, 166 aa, Glycine max
  Coding DNA Sequence Number=SeqID_52215
  Homolog annotation: Hit_ID=Q6WAY6; Match level="QueryCoverage=28%, HitCoverage=9%, E-value=1e-08, Identity=56%"; Hit description =Putative uncharacterized protein
FLAFHHGKESPVIAILAMYDTFDRGPSIRYKEGRIRILSSCEGFPNVPLMGTRGCINYNLVLAIRQLGYPMRGVPSHESITPFITRGFSDPNAKDRELRGSSNGIIGGYHKWLRVRTQGLDWLPNLKTVRDNEVKASEESDEVQALKAKLERARVVKEKFKSIAIK

SEQ ID NO: 143901 - protein, 86 aa, Glycine max
  Coding DNA Sequence Number=SeqID_52216
  Subcellular localization annotation: CTP_CleavageSite=54; ConfidenceScore=5.22e-01
MRGANTFLKCKYNSRIWNILHDRFPSVFPTFPTNKRWWRLCAFSSFGRRTREPRLARPQKGSWKVHITFLIEHMGHYAPKCACKKR

SEQ ID NO: 143902 - protein, 64 aa, Glycine max
  Coding DNA Sequence Number=SeqID_52217
MTPVNRKAGTGERTREPPGGNAWGAEPMEKRLCREPSQSSLLILTSSSEFRPVVRPFPLAASPA

SEQ ID NO: 143903 - protein, 43 aa, Glycine max
  Coding DNA Sequence Number=SeqID_52218
EQNRLRPRSEVKTSQWQKSTKGHDRPSSLPGTRQAENVAARQP

SEQ ID NO: 143904 - protein, 166 aa, Glycine max
  Coding DNA Sequence Number=SeqID_52219
MSISPCRRIAPTRHQVDPEKSNRALGFPTLVTGLFQSYRVLVPPARSCHRDIGITPVRHPVDPEKSNRVLGFPTLITGLCRFYGVPVAPNKVIRPPTNELSSRSTAPSCRHRARHHSSLGMADSGQQTHRRHLQSPSAHLQRLEHCLRPVADQQATKSKAKGKQKY

SEQ ID NO: 143905 - protein, 128 aa, Glycine max
  Coding DNA Sequence Number=SeqID_52220
VPSTLHQKLKFVVEGHLVIVSGEEDILHFLRGLPLWATLSVRCGAKVVEEQDGEAPQLASNKDIPQGAPGKMVEKGRCPRLKPASSFRGLNSASEFAGRILNSSTKPRLEVSLLEYKKVKEAPSLPHK

SEQ ID NO: 143906 - protein, 40 aa, Glycine max
  Coding DNA Sequence Number=SeqID_52221
MGNLRLTASGYITPIIRQSVKFRDKLEVERKHCCAIRKVS

SEQ ID NO: 143907 - protein, 104 aa, Glycine max
  Coding DNA Sequence Number=SeqID_52222
MEKFDFGNLPVEDQRTTKNERRTSKNSLKSLKSPTKTLRKRYGSASAWIFITETFFLTNFKSLPPRSPRRARLLPPEAGRSNRLLEEHLARPKYACFLFVPPFY

SEQ ID NO: 143908 - protein, 300 aa, Glycine max
  Coding DNA Sequence Number=SeqID_52223
  Gene Ontology: Biological process=transposition, DNA-mediated
  Homolog annotation: Hit_ID=Q6UUU1; Match level="QueryCoverage=20%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPVTTLANWSSTAVAAALELVDPPGCRNSIRSGATGGRVFAGYQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 143909 - protein, 130 aa, Glycine max
  Coding DNA Sequence Number=SeqID_52224
MGEVEKVQEQMKADMEAMKEQMATMMEAIISMKKIREVDMVAVAATNAVAKVNPMPPSGLNQMNHPTSNMTHISQTMGETHEIPHHNLADFEPCLGYATEGQAIGGIPLQKHFGGPSVSPTITTLTFHSG

SEQ ID NO: 143910 - protein, 146 aa, Glycine max
  Coding DNA Sequence Number=SeqID_52225
MGIAPTKTPSGPEEVQQGPGVSSSGYGPLSALQGARSPKQTPSGPEEGQLGLGVASSKYGSLSALGSACRPQQGHQVPPTNRAFIKKFCVSRQAQGETPQQPGNGRQRATDAPPSPLEFTSAHPQKGLSIAYTTWPTNRRPSPKPK

SEQ ID NO: 143911 - protein, 162 aa, Glycine max
  Coding DNA Sequence Number=SeqID_52226
MTQELVARGDTLRLSAPRHSVTPSVIDEQRPVWSFAPFPEMSASSSGDFFKSHKLSRTTSKSLAFVDRPTRSFILTLRSYDMRRQNLVIPHPFAIQTQSCPMARRDKIWSFCTLCHPEAAGPMTCGDKIWSFRTPLPFRHSRVRWHAETKFGHSAPFVIQRR

SEQ ID NO: 143912 - protein, 150 aa, Glycine max
  Coding DNA Sequence Number=SeqID_52227
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=34%, HitCoverage=50%, E-value=4e-24, Identity=100%"; Hit description=LacZ protein
MAEYEACALAVQAAIDSRCQTTQGVRRISVARGIPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 143913 - protein, 150 aa, Glycine max
  Coding DNA Sequence Number=SeqID_52228
MAPRKLSTKRSRKDVAAEGTSATPEFDNHRFRSVEHQQRFEAIKGWSFHRERRVQLRDDEYTDFQEAIAHRRWTSLVTPMAKFDPDVVLEFYANAWPTEEGVRDMRSWVRGQWIPFYADALNQFLGDPLLLEEGQECEYSQRRNQANGFD

SEQ ID NO: 143914 - protein, 251 aa, Glycine max
  Coding DNA Sequence Number=SeqID_52229
MRWAPAGLTSPRASACCCTCCTACRWCSSWPGRGASAQHQPDRCGDGGAAGRAVLRAHAVLRRPGGGRPDGDGQHAAHVRHPEPVHCRLCGGAMAGRRCARAAQRVPRAGAVRAGVPGGGVLHQPLHLGGCIRRLQRPADRPAIPAAGVAGAEPGARAGVRAAPADGAHRAGGGPDDPAVAAVGGRHPGGRPCTAPGGGRIRGGDARFRPAQHPAADRPAGTAGGAGSAGATGRSDRGANRREFDALLLAE

SEQ ID NO: 143915 - protein, 108 aa, Glycine max
  Coding DNA Sequence Number=SeqID_52230
MGETHEISHHNLVDFEPRLGYSTEGQAVSDIPLQNTLEGPQYHPQPYPLHSTAGKNPPTMAEMGKLDHLEERLRAIKGGRDYAFSNLEELFLVPNIVTPPKFKVPDFD

SEQ ID NO: 143916 - protein, 161 aa, Glycine max
  Coding DNA Sequence Number=SeqID_52231
MTRGNPGDLQPFDPKIDRTFHRLVRHSVHPGHSLHFEHPDHFEHSVVGDSEYSTINFHTENMAQPPPRERTLREMAAPDFTLKACEDPHKHLNVEAKLHDESKMIQSSKDQRTTQVNQRTSQVNQEQVKSSRIKKNSRLKKKAYNQESRFKISRIKIKIQE

SEQ ID NO: 143917 - protein, 110 aa, Glycine max
  Coding DNA Sequence Number=SeqID_52232
MTTQPSLEEAQSSESSSAFPDLRECKVGASEAHIMAEDQPRRVTLEDYSSSTVPQFFISIARPEVQAHTITYPYSLIQLIQGNLSHGLSNEDPYAHHATYIEIYNTMKIT

SEQ ID NO: 143918 - protein, 145 aa, Glycine max
  Coding DNA Sequence Number=SeqID_52233
MGPCKNSPDGEAIYRGSNKSSAHDGDGDCPSQCTVREAEKPDAAARLKSGSRLRKAMCWSKYSLQLYGLPPDFTSRATPEVKSPYRGAMTRQKGRRLPTRSTQNCAPTWMKAPQNIQSSYQPNPPNIRVGIPPDSTCKRNFPSRR

SEQ ID NO: 143919 - protein, 66 aa, Glycine max
  Coding DNA Sequence Number=SeqID_52234
MWDTLQLTHEGTTDEHEMELQCHNQNEENDKKKRSIALKASSSMQEENEEEDSDDEEDFSFFVKKF

SEQ ID NO: 143920 - protein, 103 aa, Glycine max
  Coding DNA Sequence Number=SeqID_52235
GVVPPLELEVGPSAARVNTKGSHVNPSRVYEGVDNYPQRPFGHMPIEKVHKLFQGKPEDYIKKWIENSQRDVYQGAYLNSVLKGFDDSQGSKSKTTAKWISVK

SEQ ID NO: 143921 - protein, 59 aa, Glycine max
  Coding DNA Sequence Number=SeqID_52236
MMITKDDDKVQDKNQEEFKTQEESLETRIKIQGSRSQESRSRFKAQDSRMKRRLNQDKY

SEQ ID NO: 143922 - protein, 137 aa, Glycine max
  Coding DNA Sequence Number=SeqID_52237
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=37%, HitCoverage=50%, E-value=4e-24, Identity=100%"; Hit description=LacZ protein
MDEITIKKHNYLSFRVLCPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 143923 - protein, 99 aa, Glycine max
  Coding DNA Sequence Number=SeqID_52238
MQCGTISVKNLVGRLGVHDKTNHTLGDESGSQCFARMLQSYGINIGLKEHSNRVTPKAYTPKSLSGPLPLIQVQPRKHFSTQTLSMNCTKHTTPQLFSK

SEQ ID NO: 143924 - protein, 125 aa, Glycine max
  Coding DNA Sequence Number=SeqID_52239
MPYVEAVEESLETTFQSFEVVSIASVDSLSGQPCLSDTAMMVARVMLGKNRGQGLRLGQQAKGPPPCHISRSFISAGLRHEGQVAAICEDDSSRRSDLVRPCPPGFRLGNWRVEERPDVYATSIM

SEQ ID NO: 143925 - protein, 356 aa, Glycine max
  Coding DNA Sequence Number=SeqID_52240
  Gene Ontology: Mol. function=hydrolase activity, hydrolyzing O -glycosyl compounds; Cellular component=extracellular region; Biological process=carbohydrate metabolic process
  Homolog annotation: Hit_ID=UPI0001662C42; Match level="QueryCoverage =75%, HitCoverage=23%, E-value=9e-87, Identity=62%"; Hit description =UPI0001662C42 related cluster
  Pfam annotation: Domain name=DUF1983; Domain location=106-195; Score =126.1; E_value=1e-34; Accession=PF09327.2; Description=Domain of unknown function (DUF1983)
MASRLEELGAKTDKASGGIQNNAIALITSTLAQVNQRNLLSVQYGDNKAGIERVDNVMADASKAVAESLRTLDSSAGGNTSNVTDLSKTLADFTQASATQINSLKVTVNGQSAAIIQNSQVSADINNNLNAMYSIKVAVDSNGNQYAAGMGIGVQNTPSGMQTQVLFVADRFAVMSQAGGAVTLPFVIQNGQTFIRASFIQDGTIDNAKIGNYIQSNNYVAGSAGWKLDKGGTFEINGVAGGGRMLISSTLIRIYDSNNVLRVRMGLCAGLIAVDLSDYAIRYIGSTSVTFAAGETSKNVSFAGITQDGSFISIVSTGPTVNEYHCRAYNGGFTAYYLPTTGSPAITLNVEVYNFQ

SEQ ID NO: 143926 - protein, 37 aa, Glycine max
  Coding DNA Sequence Number=SeqID_52241
STLEDPLSLSLHSSPSSSKLLSIASYGGELLLDSSSP

SEQ ID NO: 143927 - protein, 80 aa, Glycine max
  Coding DNA Sequence Number=SeqID_52242
MASYGVASPLSLPFSIPLPFIFQEAKESIDEEDPRPTSSNGACITTYASNSFMLIMEGKPKPRQLGGARYHPLFPLERII

SEQ ID NO: 143928 - protein, 79 aa, Glycine max
  Coding DNA Sequence Number=SeqID_52243
MAQLISDAIHYLQGSRPQDTQWTRRSPIGPWGFQLWLWASGSRPQDTSGPEEVQQGPGVSSSNYGPLSILPECPSPGIL

SEQ ID NO: 143929 - protein, 88 aa, Glycine max
  Coding DNA Sequence Number=SeqID_52244
MVIPKFKVLDFDKYKGTTCLKNHLKIGVYKNDEGRTWRPLKRKWPNDEAMMSVKKIMEAHYAVLQIAATKSCCLLSEPDVPIRPRKDK

SEQ ID NO: 143930 - protein, 274 aa, Glycine max
  Coding DNA Sequence Number=SeqID_52245
  Gene Ontology: Mol. function=aspartic-type endopeptidase activity; Biological process=proteolysis
  Homolog annotation: Hit_ID=A7PT07; Match level="QueryCoverage=86%, HitCoverage=14%, E-value=3e-59, Identity=47%"; Hit description =Chromosome chr8 scaffold_29, whole genome shotgun sequence
MVTRSTSKLINVINEDSGQNSDNTTEIGSVSEKNINPINSKHWKTTSKLYYQRPTAPDLLLEERGENNFKSFSANNIYEWNIDTQTEYNIMNTLQHMTMVATAYQTSHECSEETIIDILVAGFSGQLKGWWDNYLTNEEKSKIYSAVKTNLNGKVITNDDDKEIPDAVNTLIFTIAQHFIGDPSLWKDRSAELLSNLKCRTLADFRWYRDTFLTRVYTREDSQQPFWKEKFLAGLPRSLVSQPTLRREGDARLSGCVYLRKTSEKPEKTRSMNF

SEQ ID NO: 143931 - protein, 173 aa, Glycine max
  Coding DNA Sequence Number=SeqID_52246
MAPRKLSAKRSRKDVAAEGTSAAPEFDGHRFRSAEHQQRFEAIKGWSFHRERRVQLRDDEYTYFQEEIAHRCWTSLVTLMAKFDPNVVLEFYANAWPTEEGVRDMRSWVRGQWIPFDADALSQFLGDPLVLEEGQECEYSQRRNRADGFDEEAIAQLLCIPGQDFARTAAGRW

SEQ ID NO: 143932 - protein, 174 aa, Glycine max
  Coding DNA Sequence Number=SeqID_52247
MAQPPPRERTLREMAAPDFTYDSLCIQYPDEDVPYVLKTGLIHLLPMFHGLVDLCPSMQQPGAIEQPEAYAANIYNRPPQPQQQNQPQQNNYDLSSNRYNPGWRNHPNLRWSSPQQQQQQPAPSFQNAAGPSRPYIPPPIQQQQQPQKQPTVEAPPQTSLEELVRQMTMQNMQF

SEQ ID NO: 143933 - protein, 59 aa, Glycine max
  Coding DNA Sequence Number=SeqID_52248
PQQQGPSLYDRTTKLEETLAQFMQVSMSNHKSTESAIKNLEVQVGQLAKQLADRPSCSF

SEQ ID NO: 143934 - protein, 201 aa, Glycine max
  Coding DNA Sequence Number=SeqID_52249
  Homolog annotation: Hit_ID=Q2HW90; Match level="QueryCoverage=72%, HitCoverage=34%, E-value=2e-11, Identity=28%"; Hit description =Putative uncharacterized protein
MGQLQQQAFRKAYGKIWDLARVEVSMEPIASLSQYYDQPLRCFTFEDFQLVLTVKEFEEILGCPLGGRKPYLFSGFYPSTTRVAKVVKISAQELERLKQNRNGVVGVPRKFVLFPNMEGLVDLAAIDAFLAFHHGKESPVVAILAMYDTFDRGCPSIRYKVTARASKKGKGVKNFPPLLAKAKAVADTYSAPEEIHGLLSY

SEQ ID NO: 143935 - protein, 286 aa, Glycine max
  Coding DNA Sequence Number=SeqID_52250
  Homolog annotation: Hit_ID=A1FSV3; Match level="QueryCoverage=13%, HitCoverage=13%, E-value=6e-11, Identity=86%"; Hit description =Transcriptional regulator, AraC family
MVDRLAILLERFAITASVFHAGALCGINTLDGEDEAGQSRAADRAGRSAEPAAVSAADATSIQYRPAAGRRHGLRQPAFRGRPAQSDQRCAARFHLPAAGRPVWRPRGAGTAVRGGVRAALRAGGDGQPAVRGGDDPGAAPADGSARTVLDPGRPGRGRRHVTQRVRRQLPRGDGHHARPVPAGVAGRTRATGAAAGAAAEADRRRCGLWQRSGVVARVQGAYRAVATGMARAGAGQRGLIGQPSTSRASFMPPNRPARASATEPPAYSAASPCWPRCSSRPISSA

SEQ ID NO: 143936 - protein, 145 aa, Glycine max
  Coding DNA Sequence Number=SeqID_52251
MLESFKQQEQMSVLELYIEKDVAGGSMFHSANSLTSCGNYLSNDETQPPTNMSNLHVDEDDDDDYLVSNSYVEESLDKDDSVDGTSDTDDEVTDMIQPVHNELKIHFGMMLCIITISTVVILMRRTFAVWRCRRPLMLTKNYMLA

SEQ ID NO: 143937 - protein, 103 aa, Glycine max
  Coding DNA Sequence Number=SeqID_52252
MTRTPISPYRRDRSHKTPSGPEEVQQGPGVSSSDYGPLSILRSARRPQQGRRRARHHNSLGKASSEQQTHHHHLQNPPQFIYKGWSVAYDTWSTSRRPSPKPQ

SEQ ID NO: 143938 - protein, 107 aa, Glycine max
  Coding DNA Sequence Number=SeqID_52253
MTEKEMIIIIVVTLPMFYYEKNGGVCTFKLCGFGLRRRKIAAGLKRGKFDHPALMNVKTEENEEDENEGETLAMIAIPTQSNFPSAQQCHYSANNSPSHPIIPKVHP

SEQ ID NO: 143939 - protein, 51 aa, Glycine max
  Coding DNA Sequence Number=SeqID_52254
MENAKHMATPLNTVAYLDKMKPVSQYFMDVKKYPDFNQIPNSQHLSVVKRT

SEQ ID NO: 143940 - protein, 142 aa, Glycine max
  Coding DNA Sequence Number=SeqID_52255
MLVLRAIRLFVLQTPKKNVYTDNHSGISARQRDSNVSMTDLVSAEDDVNLRVSMGLSAAMTKGAEDDVSLCVLSGFSSYRQQKRMFIRITTRACRPRLTKGTEDDVSLCVLSGFSSYRQQKRMFIRITTRVSPPVSVTQMSV

SEQ ID NO: 143941 - protein, 96 aa, Glycine max
  Coding DNA Sequence Number=SeqID_52256
MVRMGNGRPVAATQLTRREGTADRNQIRQAGNYLTKGTKAVPGPPSRYDVIDKLACSPYCTLNQTLELILLQFLVVPVITGSPGPTFGENETLIGT

SEQ ID NO: 143942 - protein, 158 aa, Glycine max
  Coding DNA Sequence Number=SeqID_52257
EMKDIELVEEEEARIGADSSSATSNKSENCKEEAQNAAQKHKVKRVESVNADAEAFGDSTVLKIGDSTKVVIKQDMKGRRHKYGFNNNKREKPEKIMGSPPASPPPLPPPPPAPLDASASPSAVKRTRKASRLRSLSTRPPGAERPGVHVDPATSKAD

SEQ ID NO: 143943 - protein, 148 aa, Glycine max
  Coding DNA Sequence Number=SeqID_52258
MTPVNRKAGTGERTREPPGGNAWGAEPMEKRLCRGPLTSLLSIFLASSGNLRPVRKPFRSRAVEFEPEVASQFERPPPRWSSIPIGSYLHILLAPVQPFFSCHMKHVRLETLALPNINRLCTHPPFASWRNTQRPAPIALPLQLPTGS

SEQ ID NO: 143944 - protein, 92 aa, Glycine max
  Coding DNA Sequence Number=SeqID_52259
MSWFLLYSMLPLMKKLAANLLKVLLSLSEAYGGYSLLSTYRLISKYQGLPSGSSSTRQQCAGLPRQLNSMYGRSSCGVSWNMDAKVASAFAI

SEQ ID NO: 143945 - protein, 277 aa, Glycine max
  Coding DNA Sequence Number=SeqID_52260
  Gene Ontology: Biological process=transposition, DNA-mediated
  Homolog annotation: Hit_ID=Q6UUU1; Match level="QueryCoverage=21%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPVTTLQDTLVTSGLNQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 143946 - protein, 136 aa, Glycine max
  Coding DNA Sequence Number=SeqID_52261
  Subcellular localization annotation: CTP_CleavageSite=42; ConfidenceScore=5.13e-01
WNSYVPINVSFSPKVGPGLPAVPPVQLLTGWCVTAKAPPDISAGKCSGHAARRVPFAIQAAQLLGRAIGAGLFAITPAGERGMCCKAIKLGNARVFPVTTLVHLLGLLTENKRGYISCGSVLVEGTSTRLFKENKG

SEQ ID NO: 143947 - protein, 81 aa, Glycine max
  Coding DNA Sequence Number=SeqID_52262
MATMMEAMMSVKKIMEANAVAISATSVVAKPQSKADFGRPCLGICAKGISRIGGILPSKKILLRKVALVSSPATPLAFHNK

SEQ ID NO: 143948 - protein, 91 aa, Glycine max
  Coding DNA Sequence Number=SeqID_52263
IAPAGHPVDPKKSNRVLGFPALITGLCQFCGVPAIPSKVIRPPTNRAFIKKYCAPRQAEGKRHHNSLGMANNRQQMHRRHLQSPSAHPPKG

SEQ ID NO: 143949 - protein, 115 aa, Glycine max
  Coding DNA Sequence Number=SeqID_52264
MHFANHVLAVGELCLVPGRVSTDYMEWFFRISHPFMIPTQAGDQPRDAPAADLEEYMQPPIPQAIAQRLERVLNLRIVTTGTELNDIMQDCLTIAREGVSADGSVRARQRRCTEH

SEQ ID NO: 143950 - protein, 262 aa, Glycine max
  Coding DNA Sequence Number=SeqID_52265
  Gene Ontology: Biological process=transposition, DNA-mediated
  Homolog annotation: Hit_ID=Q6UUU1; Match level="QueryCoverage=22%, HitCoverage=40%, E-value=3e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGIRSTACLGEHVIMTVFRLFEPPFSTSWLIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 143951 - protein, 83 aa, Glycine max
  Coding DNA Sequence Number=SeqID_52266
DALIAELKDTGKVLEATIKATIKATTEKKMELERLIKRLSESGIDDGEAVEEEEEAAEEEDAAAEEEADAAEDTESDDSEATP

SEQ ID NO: 143952 - protein, 113 aa, Glycine max
  Coding DNA Sequence Number=SeqID_52267
MEAWRLMRCKSVNLGGPKRMGDVLTSRRFILEALHEAGIICLDGDKGDSCLIHPGASHNVETCPMLVDKSPSKPKPLVIHFTRDVATQKSRGFQPVPIKKPAPFPYKSDKAVP

SEQ ID NO: 143953 - protein, 146 aa, Glycine max
  Coding DNA Sequence Number=SeqID_52268
MKYEAWFHPLNGAGDFKVNVSASDYHQMDKGVKGELKMQGTRFQLKYTKEEDFRLRGAAQLWRFLWLRSTQQHQLQAVHHHHKEQRNVDKVAQRRRERVHQVKQQKCPDANHQQTSQIKPHHRSPVGVDRGDRPPDRQSSRDTGPS

SEQ ID NO: 143954 - protein, 112 aa, Glycine max
  Coding DNA Sequence Number=SeqID_52269
  Subcellular localization annotation: CTP_CleavageSite=38; ConfidenceScore=5.35e-01
VRKVDYIGNPGSTLISTPRSISSLTTPFLVSGCLALYRLSSRVGDKRTRTADIRHRDPATGEPGTESFPRPPFFSARLFALKNTGFYGRSATPGCRRRPWGDLVVPTGWRRW

SEQ ID NO: 143955 - protein, 274 aa, Glycine max
  Coding DNA Sequence Number=SeqID_52270
  Gene Ontology: Biological process=transposition, DNA-mediated
  Homolog annotation: Hit_ID=Q6UUU1; Match level="QueryCoverage=21%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPEFDHAQFMILYYSSPKDQYCGICKSSDINDYVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 143956 - protein, 173 aa, Glycine max
  Coding DNA Sequence Number=SeqID_52271
MAPRKLASKRSKKDKAAEGTSSAPKYDSHRFRSAEHQQCFEAIKGWSFLRERRVQLKDDEYADFQEEIVRRQWASLVTPMAKFDPDIVLEFFANAWPTEEGVGDMRSWVRGQWIPFDADAINQFLGYPLVLEEGQECEYGQRRNRSDGFDEEAIAQLLCIPGQDFARTAAGRR

SEQ ID NO: 143957 - protein, 28 aa, Glycine max
  Coding DNA Sequence Number=SeqID_52272
IAKVAPNTTVIIPIKAIPFIIAGPSIAS

SEQ ID NO: 143958 - protein, 68 aa, Glycine max
  Coding DNA Sequence Number=SeqID_52273
MTTPTYLDATISSNENSAEPELEQRKRRKTKHEAKRENEPEHGAIAIKRQRCGGGHVVVQWQHHDSRE

SEQ ID NO: 143959 - protein, 168 aa, Glycine max
  Coding DNA Sequence Number=SeqID_52274
MIMRGQDIYSSQDEATTSPSSSESEEAKGEESMVKEKCKEVSVSSKRLAKKETHFTIKTNIEETFPLRQPPHFLFCKKTLVSTATLLGLEVIPQVKELFDEGLVRKSLNPCALLVPKICIIRHQIPTISDMMNVLSVATLFCKISHAPNVFMIDVHRDSLGRCSYGTP

SEQ ID NO: 143960 - protein, 16 aa, Glycine max
  Coding DNA Sequence Number=SeqID_52275
MAPRKLSSKRSRKEAD

SEQ ID NO: 143961 - protein, 261 aa, Glycine max
  Coding DNA Sequence Number=SeqID_52276
  Gene Ontology: Biological process=transposition, DNA-mediated
  Homolog annotation: Hit_ID=Q6UUU1; Match level="QueryCoverage=22%, HitCoverage=40%, E-value=3e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPVTTLRRDKFRRKHNRFGCFFLSYFLIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 143962 - protein, 115 aa, Glycine max
  Coding DNA Sequence Number=SeqID_52277
MVTRTFHQPGANEPVDVKRLTSSSAPFAIQGQRVKWQAEIPYGHPRLSSTEGNQFDGFYTRRLETFKPNNAQDSSLLGRDDRVQWQKEVSWLSNFVIFETLKFVGASDAFSFLSE

SEQ ID NO: 143963 - protein, 77 aa, Glycine max
  Coding DNA Sequence Number=SeqID_52278
MDSGRFQVSVPGNSYPSVVGDDTEGPPKGFVGVYHQLLALQWHIRGKARSRLDCGGEFHSVSPTVERHVYDEVVGSQ

SEQ ID NO: 143964 - protein, 54 aa, Glycine max
  Coding DNA Sequence Number=SeqID_52279
MDKSLKVGKDEWRENERRNMKFYASNELWSNPLIQDQVQDSPLSVLRCHEACKA

SEQ ID NO: 143965 - protein, 178 aa, Glycine max
  Coding DNA Sequence Number=SeqID_52280
MTPTRHPLDPDKSNRALGFPALITGLCQSFGVPVTPSKVIRPPITRAFIEKYCTQRQVQGDAPQAADVPPPHQAGPAGLFDTEQYLRHLVRQQAANHWAHVQTHDCLYQMSLSLQSQGFTSFPCPTPDQFRAEVAWPGDWPEAQAGKAPAEAPDEADEAREDEEMTDLLDFLGGSGAT

SEQ ID NO: 143966 - protein, 97 aa, Glycine max
  Coding DNA Sequence Number=SeqID_52281
MVGYAPSSFADLVFAGERIEAGLKRGKFDHPALMNEKAGANEEDENEEGTHAQPQPCAYLEDLGMSPSCYELKRERCQSKGKAQAIEVEVKIMPLLT

SEQ ID NO: 143967 - protein, 68 aa, Glycine max
  Coding DNA Sequence Number=SeqID_52282
MGTVYCHTPNREGCTTVWICLAPSQCSPDYMNWFYMIYHPFMSPAQPGDPPRHPPVQHHDTFVELDVA

SEQ ID NO: 143968 - protein, 165 aa, Glycine max
  Coding DNA Sequence Number=SeqID_52283
  Gene Ontology: Mol. function=tetracycline:hydrogen antiporter activity; Cellular component=integral to membrane; Biological process=response to antibiotic
  Homolog annotation: Hit_ID=Q8GEG0; Match level="QueryCoverage=75%, HitCoverage=96%, E-value=7e-26, Identity=55%"; Hit description =Putative uncharacterized protein
  Subcellular localization annotation: CTP_CleavageSite=41; ConfidenceScore=5.07e-01
MTMITPSSKLTLTKGNKSWTLFSNFCCKVFDVENQQYLFIRSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 143969 - protein, 101 aa, Glycine max
  Coding DNA Sequence Number=SeqID_52284
MSDGFCGTHLQIMVRTRGLGHALGQVTGRGLGRGDRDDSDDAPQRRRPTASARRQRVAVTADHVDEPVIPAPDVQDDPMEAPAVVEDIPADAGVEAVEDQP

SEQ ID NO: 143970 - protein, 94 aa, Glycine max
  Coding DNA Sequence Number=SeqID_52285
MTPVNRKAGTGERTREPPGGNAGIFIVLSGFATTDLSVRFRDACQGGGAYGKTALPRPSHFPVKYLPGIFQEISAPFVSHFRSPQSNDRAIASQ

SEQ ID NO: 143971 - protein, 178 aa, Glycine max
  Coding DNA Sequence Number=SeqID_52286
YIMNSIITVLYFNGRVYVDNDGVIFEGSKKTIQIKRGISFNALKKKKLEIRFLVSGKYVALQICDDEDVETMIESFQQQQQMSVLELYVEKDVAGGSMFHAANSITSCERNVSHHESELPRNISNLHDDDDDYLASNSYVEESLDEDDSDDGISDTDDEVTDIVEPVSIVHPREGKCL

SEQ ID NO: 143972 - protein, 58 aa, Glycine max
  Coding DNA Sequence Number=SeqID_52287
MREIPRELHCQMLSQRTLGQTLAHPLRVHPWIFIPIPLKIIEATRYNTELKAGAGLRA

SEQ ID NO: 143973 - protein, 135 aa, Glycine max
  Coding DNA Sequence Number=SeqID_52288
MGKVEEIQEKMKADMEAMKEQMAMMMEAMMIMKKIMKASAVAVAATSTVAKVNPMPQSGLNQMNHPTSAMVGKDLGSMGGPHDVRIQNERAFPPCGLPLNYTPPNVAYSPNKDVNNSTPIPIESQQPQADHAHVS

SEQ ID NO: 143974 - protein, 289 aa, Glycine max
  Coding DNA Sequence Number=SeqID_52289
MVKHGAAEVVDVEGYGYVNGDRGRRAVVLIVAEGEGLPEEREFRERTASNNNLIMLNNFNGPSHRRLYSCNSARRFYCRLRRSSSNGRGRRTPFATRRGSATRGTGRTVAVKASPMRTWTSSRPATWSSSPSGPTSTSSMGPSLTRAPSPSIAPRRPPPYVVSEGELRLRDGAGPREHLCGRWGLKAYDVWASGVEDSVGGAVRGREGPVGADGESPRVRGVCRRRRKGVVGDRRGCDSDGSGEWHLERVGDMSGNRERVGVGKIVVVEYNGCPMLFMLDRNEILRYFL

SEQ ID NO: 143975 - protein, 203 aa, Glycine max
  Coding DNA Sequence Number=SeqID_52290
  Gene Ontology: Mol. function=RNA-directed DNA polymerase activity; Cellular component=chromatin; Biological process=chromatin assembly or disassembly
  Homolog annotation: Hit_ID=A5B2I6; Match level="QueryCoverage=60%, HitCoverage=6%, E-value=5e-12, Identity=29%"; Hit description =Putative uncharacterized protein
MEMHIKAMEKVIEENRKAVESWLSSIEGMIQRNLEMPIFDGEDLMRWLTKIERYFRLLAVREENKLEAIMVAMDGEALGWFQWWESWNPIHSWDGFKIAVTQSKTMQGFIGQFEKCVGMVKGLEEPFLVEVFLKGVEDKNKVLGKLPMSNGKGSNFQKNVHLGQNWVWDWQLANNKIADPTNVDKDPLDGKVEEPSIICHPWK

SEQ ID NO: 143976 - protein, 286 aa, Glycine max
  Coding DNA Sequence Number=SeqID_52291
  Gene Ontology: Mol. function=ribose-5-phosphate isomerase activity; Biological process=pentose-phosphate shunt, non-oxidative branch
  Homolog annotation: Hit_ID=A9PIX0; Match level="QueryCoverage=65%, HitCoverage=64%, E-value=4e-68, Identity=73%"; Hit description =Putative uncharacterized protein
  Pfam annotation: Domain name=Rib_5-P_isom_A; Domain location=92-231; Score=-82.7; E_value=0.0018; Accession=PF06026.5; Description=Ribose 5-phosphate isomerase A (phosphoriboisomerase A)
  Subcellular localization annotation: CTP_CleavageSite=49; ConfidenceScore=5.43e-01
MASVASSSSFSTRLLLHSHTPLVCRRRCRPNFLRMVTRSCLDDSSALLRAAQHTVDTYVKSGMVVGLGSGHASGMAIQHLGSQLRTGNLKDIVGIPMSVSSASEAAKAGIPLDTYQGSSQIDFAFDDADVIEEGTLVAIIGRRKLQGGESIIQEKSIINSANKCVFIIEENQYKGGLEGSIPVLIQSLNWMTIAEEIDDMFLGDAEVSLYIYSFAEFLHMNIIKNVLSGCLLTNPKKAFLLNDLGFCNVPQQQQQQFKAFATKWGWLHASNMPLCSYLNQFIGEAI

SEQ ID NO: 143977 - protein, 146 aa, Glycine max
  Coding DNA Sequence Number=SeqID_52292
MKQGGSDNFSGGDHCLIIIPSTPSVDSNITSITAMDLNEIHGGVVQLKDIQQWEGWFQRREEQTSTRKKGESMREEGYRVKGQISSQIFSSESGSLKQWTPCNFQKFLAYLYANKLEKCREVHTFSFSSSYIFRCNQMISRVDLIV

SEQ ID NO: 143978 - protein, 44 aa, Glycine max
  Coding DNA Sequence Number=SeqID_52293
MIVVVKMMVVVVIVVLMVITRCDDNNNNDDCCGDDDDEDKTMTM

SEQ ID NO: 143979 - protein, 296 aa, Glycine max
  Coding DNA Sequence Number=SeqID_52294
  Gene Ontology: Mol. function=nucleic acid binding
  Homolog annotation: Hit_ID=A7PQX0; Match level="QueryCoverage=53%, HitCoverage=84%, E-value=2e-47, Identity=57%"; Hit description =Chromosome chr6 scaffold_25, whole genome shotgun sequence
  Subcellular localization annotation: CTP_CleavageSite=28; ConfidenceScore=5.25e-01
MRGTIGRKIPNPDFSNATRKMLVPFSISSGFGGGGRGHGRGGSLPGSGLFNINERAPVKPNSILFNGKDDGSDTGRERENRGRGGFDRGRGRGRGSEKGKGKVREKDVDEKVMDTDDFATGLYKGEDADGEKLARKIGPEIMNQLTEGFEEMTSRILPLALEDEFLDALDINYAIEFEPEYLVEFDNPDIDEKEPIPLRDALEKAKPFLMSYEGIQSQEEWEIVDHYSGPDRVTAKKQQEELDRVAKILPESAPSSVKQFTNRSVISLQLFPSYVDNLIISISANDVLLLAHAVQC

SEQ ID NO: 143980 - protein, 511 aa, Glycine max
  Coding DNA Sequence Number=SeqID_52295
  Gene Ontology: Mol. function=sequence-specific DNA binding; Cellular component=nucleus; Biological process=regulation of transcription, DNA-dependent
  Homolog annotation: Hit_ID=A7Q4V5; Match level="QueryCoverage=78%, HitCoverage=85%, E-value=1e-108, Identity=55%"; Hit description =Chromosome chr10 scaffold_50, whole genome shotgun sequence
  Pfam annotation: Domain name=WRKY; Domain location=277-337; Score =139.3; E_value=1.1e-38; Accession=PF03106.6; Description=WRKY DNA -binding domain
MDNYQGDLTDILRASGGAYGSTGTGTGTSSSDQLPTTSHHLHHHSSHTTLSHNDHWHHQHFSSSSSSDPITFSSSSSSSSSVLIQDPMRGATNFGDPFSIMRDPFLQVLDMPSSASAYFTGGLELEAAATFGAAVNTNSNTATSSTTNTNTTTTTVFAAAHKMLVEHDNNSMRRPCKNIFSNMIQISPNAKLPVSPYDSTTTAMAPSPRPIKPPAVVSPNIMLNANTSKECLVDTTGMQISSPRNPGLKRRKNQAKKVVCIPAPAATNSRQTGEVVPSDLWAWRKYGQKPIKGSPYPRGYYRCSSSKGCSARKQVERSRNDPNMLVITYTSEHNHPWPTQRNALAGSTRSQPSKNNNNAASNSKNSEGSNPQKGTATRTKDEEESNNNNNSEGNVSPVMAGNSSNSVKEENMEDIERHQIEMDEGEFSDGLPYKPSLMDQSTNNQQSEDFFAELGEIEADPLDLLFTQGFGGADDQRESKSLDPFHLFDWSGDNNTNTNTSSSFEEPNNKR

SEQ ID NO: 143981 - protein, 233 aa, Glycine max
  Coding DNA Sequence Number=SeqID_52296
  Gene Ontology: Mol. function=calcium-dependent phospholipid binding; Cellular component=cytoplasm; Biological process=response to stress
  Homolog annotation: Hit_ID=Q94CK4; Match level="QueryCoverage=99%, HitCoverage=90%, E-value=1e-72, Identity=59%"; Hit description =Annexin-like protein
  Pfam annotation: Domain name=Annexin; Domain location=164-229; Score =50.5; E_value=6e-12; Accession=PF00191.11; Description=Annexin
  Pfam annotation: Domain name=Annexin; Domain location=6-71; Score =50.5; E_value=5.8e-12; Accession=PF00191.11; Description=Annexin
  Pfam annotation: Domain name=Annexin; Domain location=89-154; Score =30.2; E_value=7.7e-06; Accession=PF00191.11; Description=Annexin
  Pfam module annotation: Pfam domain module=Annexin::Annexin::Annexin; Domain location=164-229::6-71::89-154
MDPAERDAAFINEALKKETPDYKVIVEIVCTRTSEEFLAAKRSYQFQYKHCLEEDVASKTIGDIRRLLVAVISTYRYDGDEFDENLAHLEANILHQVIENKAFNDDEIIRILCTRSKKQLCATFSTFRNVYGTTITKGLSTNPNDEYMTALRTVIRCIKNPRRYLAKVLCYALNELIAEEHELSRVIITRAERDLNEINDLYFKRNGVTLDSSVAKKTSGNYKNFLLALLGNN

SEQ ID NO: 143982 - protein, 306 aa, Glycine max
  Coding DNA Sequence Number=SeqID_52297
  Gene Ontology: Mol. function=protein kinase activity; Biological process=recognition or rejection of self pollen
  Homolog annotation: Hit_ID=Q9ZUZ6; Match level="QueryCoverage=75%, HitCoverage=75%, E-value=4e-64, Identity=46%"; Hit description =Putative uncharacterized protein At2g39120
  Pfam annotation: Domain name=Peptidase_C12; Domain location=54-259; Score=-27.9; E_value=0.00017; Accession=PF01088.12; Description =Ubiquitin carboxyl-terminal hydrolase, family 1
  Subcellular localization annotation: CTP_CleavageSite=43; ConfidenceScore=5.33e-01
MTQLSTSTTPFSSSLSLPSKTALPGIPMGPFLSLQCQRGDRDRCAHEGCNIYEAISIFEEFTGPKYNLPWFRLTPEAAEIDRDEKRVYEECREDLRSRLRKMILMTREHVLPLKIIQGMQWYLGLLSDFLQHPEQNLDESFRFVDMEDGLKGLALDSGEKIYSLMEKNATKRDKRLVGVLHELLSLFVEHSAERKKLFCLKKYFGLPQKVHRAFERHPHMFYISFRNKTRTVILKEAYSNKSAIEKHPLLRVRKKYIKLMKKSEVILRNRRVNNRFSNCNAKLDIDSNDLGEKGHEMSSCSLEQVA

SEQ ID NO: 143983 - protein, 919 aa, Glycine max
  Coding DNA Sequence Number=SeqID_52298
  Gene Ontology: Mol. function=hydrolase activity, hydrolyzing O -glycosyl compounds; Cellular component=cellulose and pectin -containing cell wall; Biological process=carbohydrate metabolic process
  Homolog annotation: Hit_ID=A7QC19; Match level="QueryCoverage=99%, HitCoverage=99%, E-value=0.0, Identity=63%"; Hit description =Chromosome chr10 scaffold_76, whole genome shotgun sequence
  Pfam annotation: Domain name=Glyco_hydro_31; Domain location=281-765; Score=799.4; E_value=2.1e-237; Accession=PF01055.17; Description =Glycosyl hydrolases family 31
MATTTVITPLLFCICVCLGFCSSSLSEATPVGYGYIISTVNSYPISVSLAANLKLIKPSSVFGPDIPHLSLAASFENKDRLRVRITDSNNQRWEIPQQVLPRGSPSQYYPLYYFNTNQGFQHSLSLTHPDSDLVFTLHNTTPFGFTVSRKSSNDVLFNTAPNPSNPETFLIFKDQYLQLSSSLPSQRASLFGLGEHTKSSFKLRPNQTLTLWNADIGSDNLDVNLYGSHPFYLDVRSPSADGTVKAGTTHGVLLLNSNGMDIVYGGDRITYKVIGGVFDLYFFSGSSPELVLEQYTELIGRPAPMPYWSFVCLFMLILIGMIFLGREGFHQCRWGYKNVSDLEGVVDNYAKAGIPLEVMWTDIDYMDAYKDFTLDPINFPLDKMISFVDALHKNGQKYVLILDPGISVNKTDATYVRGLKADVYIKRNEVNYLGEVWPGPVYYPDFLNPRSQAFWGGEIKLFRDLLSFDGLWLDMNELSNFITSPPNPSSNLDNPPYKINNGEVQQSINYRTVPATSLHFGNITEYNAHNLYGLLESKVTNKALVDITGKRPFILSRSTFVSSGKYASHWTGDNAATWNDLAYSIPSILNSGIFGIPMVGADICGFGGNTTEELCRRWIQLGAFYPFARDHSEKNSIRQELYIWDSVASSARKVLGLRYSLLPYFYTLMYEAHTKGTPIARPLFFSFPEDVTTYKINSQFLVGKGVLVSPVLQSGATTVNAYFPKGSWFDLFNVSNSVNAESGKYVTLDAPSDHINVHVGEGNILALQGEAMTTDAARKTAFQLVVVISSSRDSYGQVYLDDGEALDIAGENDQWTLVSFYGTLHNSSVIVTSKVTNGIFALDQRWIIDNIIFLGIPKYQRFNGMDLAGNELNIVKGTDSMRTAVVKSESDSSSQFLNVQVSKLSLLIGEEFKLEIEIK

SEQ ID NO: 143984 - protein, 63 aa, Glycine max
  Coding DNA Sequence Number=SeqID_52299
MGNHYVVAKLSGARTVRVVSLQSAKVLAIIVCYHPNQCDKNMNKISEVLIQGGERGLQRVVLS

SEQ ID NO: 143985 - protein, 636 aa, Glycine max
  Coding DNA Sequence Number=SeqID_52300
  Gene Ontology: Mol. function=hydrolase activity, hydrolyzing O -glycosyl compounds; Cellular component=cellulose and pectin -containing cell wall; Biological process=carbohydrate metabolic process
  Homolog annotation: Hit_ID=A5AKC2; Match level="QueryCoverage=94%, HitCoverage=85%, E-value=1e-153, Identity=55%"; Hit description =Putative uncharacterized protein
  Pfam annotation: Domain name=Glyco_hydro_31; Domain location=87-523; Score=459.2; E_value=5.6e-135; Accession=PF01055.17; Description =Glycosyl hydrolases family 31
MGNPRRHHSHFPEAPLAKINDLLGSLNSEKPQPQPQDSPSNLTLTHPDSDLIFTLHKTTPFGFTVSRKSSNDVLFNTTPDPSNTSNFLIFKDQYLQLSSSLPPQRASLYGLGEHTKKSFKLQPSLLTMWNADIPSANVDSNLYGSHPFYMDVRSTSSDGRVKAGTTHGVLLLNSNGIYGRRMDAYKDFTFDPINFPIERMKNFVDTLHQNGQKYVPIVDPGIGINDTYETYPRGLKADVYIKRNGTNYLGKVWPGPVYLPDFLNPTTQDFWGGEIKLFRDLLPVDGIWLDMNELANFIASPIENSTLDNPPYKITHATNKALTNITGKRPFILSRSTFVSSGKYVAHWTGDNAASWNDLAYSIRAILNSGIFGIPMVGADICGFLGSTNEELCRRWTQLGAFYPFARDHSDKNSNRQELYLWDSVADSAKKVLGLRYRLLPYLYTLMMSQLNEISSQFLLGKGVLVSPVLKSGATTVDTYFPKGNWFDLFNFSNSVNGESGKNVTLDAPSDHINVHVGEGNILAMQGEAMTTEAARNTTFQLDIAGTLVSFNATLLNTTSVLVTSKVTNGAFALDKKWILEKVTVLGIPKQSKNLARKNLKFVKTQNDTSSQFDIVEVSKLSQLIGEDFKMDIKIR

SEQ ID NO: 143986 - protein, 503 aa, Glycine max
  Coding DNA Sequence Number=SeqID_52301
  Gene Ontology: Mol. function=oxidoreductase activity; Cellular component=anchored to membrane; Biological process=embryonic development ending in seed dormancy
  Homolog annotation: Hit_ID=A7Q4S7; Match level="QueryCoverage=95%, HitCoverage=93%, E-value=1e-148, Identity=51%"; Hit description =Chromosome chr10 scaffold_50, whole genome shotgun sequence
  Pfam annotation: Domain name=BBE; Domain location=426-481; Score =94.0; E_value=4.8e-25; Accession=PF08031.3; Description=Berberine and berberine like
  Pfam annotation: Domain name=FAD_binding_4; Domain location=79-218; Score=76.2; E_value=1.1e-19; Accession=PF01565.14; Description=FAD binding domain
  Pfam module annotation: Pfam domain module=BBE::FAD_binding_4; Domain location=426-481::79-218
  Subcellular localization annotation: CTP_CleavageSite=87; ConfidenceScore=5.79e-01
MAKPSLAYLFTAFVFLSVSTSSAQPPNPPLSDTFLSCLTQHANSSTPHSNIVFDNTNPNFTTVLPNYIARLNTPLTPKPLLIVTVLQESHVQATVICAKSTNVQLRIRSGGHDYEGLSYVSQNPFILLDMFNLHRITVDVKNEVAMGQASATLGEVYYRIWDSSKVHGFPASVCPIVAVGGHISGGGYGNMLRKYGLSVDNVIDAQIVDVKGNLLNRQTMGDDLFWAIRGGRVASFGVVVLFTIKIVPVPETVAPTTDDRLFMRLLLAPSGKTVRASVMALFLGEANEVLPILEKEFPLLGLKKVNCTEAHWIDSVAWFNDDQGSKNGAKPETLLNANPREGLEIIWKKMIELGEMGLVFNPYRGKMAQIPSDATPFPHRKGNLFKARYSVSWKDPSPAAAQNFLNQTRELHSCMTPYVSKNPRSAFLNYRDLDIGVNSFGKNSFQEVYGAKYFNDNLQRLVKVKTAVDPENFFRNEQSIPYNVKNDLWHADGSWFEVAYVLH

SEQ ID NO: 143987 - protein, 537 aa, Glycine max
  Coding DNA Sequence Number=SeqID_52302
  Gene Ontology: Mol. function=oxidoreductase activity; Cellular component=anchored to membrane; Biological process=electron transport
  Homolog annotation: Hit_ID=A7Q4S7; Match level="QueryCoverage=97%, HitCoverage=93%, E-value=1e-180, Identity=58%"; Hit description =Chromosome chr10 scaffold_50, whole genome shotgun sequence
  Pfam annotation: Domain name=BBE; Domain location=476-533; Score =89.9; E_value=8e-24; Accession=PF08031.3; Description=Berberine and berberine like
  Pfam annotation: Domain name=FAD_binding_4; Domain location=84-223; Score=88.2; E_value=2.6e-23; Accession=PF01565.14; Description=FAD binding domain
  Pfam module annotation: Pfam domain module=BBE::FAD_binding_4; Domain location=476-533::84-223
MEKPSPLATIMLPIVIVLLLSPHASYAAQATESVYETFVDCLRNYINSPNISNIVFAQTNSSYSSILRAYIRNARFNTTSSPKPLIIVAPVQESHVQTAVICAESIDMQIKTRSGGHDFEGLSYISDEPFIMLDMFNLRNITVDAQNKVAVVQAGATLGELYYRIWEKSDVLGFPAGVCHTVGVGGHFSGGGYGNMMRKYGLSIDHISDAQIVDVKGRILNKESMGEDLFWAIRGGGGASFGVILSYTIKLVPVPEVVTVFQVEKTLEQNATDLVVQWQQVAPYTDERLFMRLQLHPMISNVGERHKTVRAAVMTMFLGGAEELVSLLDKKFPTLGLKKENCIEMSWIESVVWWDSFPNGAHPEALLGRNLNSAKFLKRKSDYVKDPISKDGLEWIWKRMIELGQTGMAFNPYGGRMNEISANATAFPHRAGNLFKIEYSANWEEPGGSAEKNFTTQIRRLHSYMTPFVSKNPRRAFLNYRDLDIGINHHDNNSYQEGEVYGFKYFDDNFYRLAKIKTEVDPGNYFRNEQSIPTLKL

SEQ ID NO: 143988 - protein, 40 aa, Glycine max
  Coding DNA Sequence Number=SeqID_52303
MREKSMLWWCRERKGEVKGGECVACVREKRRFGREREERV

SEQ ID NO: 143989 - protein, 375 aa, Glycine max
  Coding DNA Sequence Number=SeqID_52304
  Gene Ontology: Mol. function=oxidoreductase activity; Cellular component=anchored to membrane; Biological process=electron transport
  Homolog annotation: Hit_ID=Q9SVG3; Match level="QueryCoverage=94%, HitCoverage=74%, E-value=1e-120, Identity=56%"; Hit description =Reticuline oxidase-like protein
  Pfam annotation: Domain name=BBE; Domain location=312-369; Score =96.1; E_value=1.1e-25; Accession=PF08031.3; Description=Berberine and berberine like
  Pfam annotation: Domain name=FAD_binding_4; Domain location=3-106; Score=-1.1; E_value=0.0025; Accession=PF01565.14; Description=FAD binding domain
  Pfam module annotation: Pfam domain module=BBE::FAD_binding_4; Domain location=312-369::3-106
MQQKTMSYAEFCSKSQPNINLGGIIVNVKNEVAMVQAGATLGEVYYRIWEKSKVLGFPAGVCPTVDVGGHISGGGYDNMLRKHGLSVDNVIDAQIVDVKGNLLNRKTMGEDLFWAIRGGGGASFGVILSFTFKLVPVPKTQVAPTTDERLFMRLLLQPVSSKVVKGGNTIRASVVALFLGGANEVVPILAKQFPLLGLRKENCTEVSWMDSVLWWDDDKSLKNGAKPETLLDRHANTADFLKRKSDYVQKAIPREGLEFIWKRMIELGKTGLVFNPYGRKMAQVSSMRRLFHTARKLYSYMTPFVSKNPRSAFLNYRDLDIGVNNFRKNSFQEGEVYGAKYFNGNFQRLIKVKTVVDSTNFFRNEQSIPLAPSKA

SEQ ID NO: 143990 - protein, 498 aa, Glycine max
  Coding DNA Sequence Number=SeqID_52305
  Gene Ontology: Mol. function=oxidoreductase activity; Cellular component=anchored to membrane; Biological process=electron transport
  Homolog annotation: Hit_ID=A7PJK7; Match level="QueryCoverage=92%, HitCoverage=86%, E-value=1e-127, Identity=49%"; Hit description =Chromosome chr12 scaffold_18, whole genome shotgun sequence
  Pfam annotation: Domain name=BBE; Domain location=438-494; Score =103.1; E_value=8.7e-28; Accession=PF08031.3; Description=Berberine and berberine like
  Pfam annotation: Domain name=FAD_binding_4; Domain location=46-185; Score=93.8; E_value=5.6e-25; Accession=PF01565.14; Description=FAD binding domain
  Pfam module annotation: Pfam domain module=BBE::FAD_binding_4; Domain location=438-494::46-185
  Subcellular localization annotation: CTP_CleavageSite=63; ConfidenceScore=5.29e-01
MAFSSGLEDSNSTTEVILTQSSSSYTSLLQSLIRNLRFLNSSVPKPNLIVTPQNLAHIQAAITCSRKHGLQVRVRSGGHDYEGLSYVSDVPFLIIDLINLRSINIDINDESAWVQAGATLGELCYAIAKTSNMCGFPDGSCPTVGVGGHLSVVGFGTIFRKYGLAADQVIDAEMVDVNGNILNRTLMGEDLLWDIRGGGGSSFGVITAWKVKLVPVPPKVTIFNVAKTLDQGASNLFQKWQTISHKLPNELFLHSVMGVANSSSPNGGKTVVVSFTGLYLGTAENLLPLMQNNFAELGLQLNSFTEMSWIQSVLYKYRLFNQWTLGGFASEKPNIQKLQSNIRLCYRTHSCGRFGRAVEHVARREHSQHTNLILTPYGGRMSEISGSETPFPHRNGSIYGIQYLVYWDSNEETPKHIYGMRRLYSYVTPYVSKCPRAAYLNYRDLNLGVNRGSTSYEEAKSWGVKYFKFHFERLARVKAEFDPSNFFWHEQSIPPSFN

SEQ ID NO: 143991 - protein, 305 aa, Glycine max
  Coding DNA Sequence Number=SeqID_52306
  Gene Ontology: Mol. function=transition metal ion binding; Cellular component=endoplasmic reticulum membrane; Biological process=fatty acid biosynthetic process
  Homolog annotation: Hit_ID=A3CJN6; Match level="QueryCoverage=32%, HitCoverage=17%, E-value=2e-38, Identity=70%"; Hit description =Methionine aminopeptidase
  Pfam annotation: Domain name=FA_hydroxylase; Domain location=28-105; Score=-21.6; E_value=0.015; Accession=PF04116.4; Description=Fatty acid hydroxylase
MVVQNFVVDLNKALVFQVGHLGEAYEEWVHQPIVSKEGPRFFENEILEFWNLVKLMATTSTAPALFGGGLLGYVMYDCTHYYLHHGQPRTEVPRNLKKYHLNHHFRIQDKGFGITSSLWDKVFGTLPPKMDAKTKYGFGCQPVPVIRNETEASHTWRGIVMTWSHIEDNITWSINNGDSARFWTDRWIPGFQPLSSMMQNVCSTIAAINPPVQGYKDTPIWCTSRNGMLSVKTAYWYLAGYYDNPRDESGDFKMIWRYEGPQRVCLFLWKLMHGRLLPNEERIRRHMTNDSARIHYAHSVIVKTS

SEQ ID NO: 143992 - protein, 387 aa, Glycine max
  Coding DNA Sequence Number=SeqID_52307
  Gene Ontology: Cellular component=nucleus
  Homolog annotation: Hit_ID=A7Q4R6; Match level="QueryCoverage=41%, HitCoverage=47%, E-value=5e-21, Identity=40%"; Hit description =Chromosome chr10 scaffold_50, whole genome shotgun sequence
MPFPWKKNRVPRISQIVADLQSPKRGGSLVVETGFPTSLIDLFVKNRSRFQKHRSKKPPPPPPPKSLSATDPPPPPPPSPATSPPPRVPTFPATPIQQNDTAVSAPDRIAQCSPRSGVNAVVLVAKILMVLVLVASVERLTVGITASAFSLLLLEYAGRRVVVSCSVPESWWFQKVGMKERVERIEFESEELSNKGLSIDEIEDVETTDEVGVSCEIGDVALKVLEPCLCDEDVSECKIRPSRSGRFRSKMVKLVSKKFRGSKKEKKGEVNKHNEGESGSEISSAVGEEKLPILEIEVEEENGDNKSSNSKLDCGITCSYDNEKRVERVGNSGSSMVLVMIIALVGLLLGRFPALVLLMTWCCLMKIVGILWRSQNVPMIKCSVSNS

SEQ ID NO: 143993 - protein, 410 aa, Glycine max
  Coding DNA Sequence Number=SeqID_52308
  Homolog annotation: Hit_ID=O24097; Match level="QueryCoverage=98%, HitCoverage=99%, E-value=1e-156, Identity=63%"; Hit description =MtN19 protein precursor
  Pfam annotation: Domain name=SURNod19; Domain location=31-409; Score =789.3; E_value=2.3e-234; Accession=PF07712.3; Description=Stress up -regulated Nod 19
MFNMRFVSQDWVVSCALILLVSCTTYSSASLGKPENNIKTSVFLSPKIELGPGLVSNKFYFDVDFPRGHIALKSFNAELVDESGKSLPLQETYLHHWFIIKYQQPKNVTHNNPTDNIVYVRNSGFCQDGPLIQYFGLGSETRGTATDIPDPFGIEVGNPSDIPYGYDEKWLINVHPIDTRGVEDRLGCIECRCDLYNITKDADGNPLSPDYKGGLDCCPDNTTCRLNKGFKGPKRTLYLKYTVKWFSWDNYVVPLKIYILDVTDVLSVSKGVTPMHNCEVEYQVEPCSKGYSSSACIDVRKTSFPMQNGGYVIYGVGHQHVGAIASKLYGQDGGVICSSIPKYGTGSEVGNEGGYVVGMSTCYPRPGTIKIKDGETLTLEIIYSNSEMHSGVMGLFYILVAEQLPHQHLL

SEQ ID NO: 143994 - protein, 413 aa, Glycine max
  Coding DNA Sequence Number=SeqID_52309
  Gene Ontology: Mol. function=protein binding; Cellular component =nucleolus; Biological process=hermaphrodite genitalia development
  Homolog annotation: Hit_ID=Q9LIQ0; Match level="QueryCoverage=89%, HitCoverage=56%, E-value=2e-69, Identity=42%"; Hit description =Genomic DNA, chromosome 3, BAC clone:F14O13
  Pfam annotation: Domain name=Krr1; Domain location=112-347; Score =203.2; E_value=6.3e-58; Accession=PF05178.3; Description=Krr1 family
SGKNLNVGEDELQEISEDEIELERQEEYEYRFQENPGDRVLGHARKVEGSVRKKTNARKEQRKSKEERMAIEQKEREEELKRLKNLKKQEIQEKVKKIMRGAGIHGDDIIPLSMAEIEEEFDPEEYDRMMKKAFDEKYYNAVDADPDFCSDIDDNEKPDFEKEDELLGLPKGWDACGSNGGFLAAREKALKEKIENTSDDDLPEAEDEKERFENTSDDNLPEGEDEKEEKIPEEGSRKRKRKTALLEKARQAMMDEYYKLDYEDTIGDLKTRFKYAKTKPSRFGLSASEILLMDDKELNQYVSLKKLAPYQEEEWKLSKQKRYMLKMRAKELLRTSSLDKKKRKKSKVDSGKITSSKSVVENEKPSTEESNINRDNLSRKAKRRRQVANLKLSQSRLKAYGKIPSKSKHGGKH

SEQ ID NO: 143995 - protein, 274 aa, Glycine max
  Coding DNA Sequence Number=SeqID_52310
  Gene Ontology: Mol. function=GTP binding; Cellular component =intracellular; Biological process=embryonic development ending in birth or egg hatching
  Homolog annotation: Hit_ID=A7Q4M8; Match level="QueryCoverage=100%, HitCoverage=73%, E-value=1e-131, Identity=80%"; Hit description =Chromosome chr10 scaffold_50, whole genome shotgun sequence
  Pfam annotation: Domain name=MMR_HSR1; Domain location=25-194; Score =106.1; E_value=1.1e-28; Accession=PF01926.14; Description=GTPase of unknown function
MPPKSAKSKEAPAERPILGRFSSHLKIGIVGLPNVGKSTLFNTLTKLAIPAENFPFCTIEPNEARVNVPDERFEWLCQLFKPKSEVSAFLEIHDIAGLVRGAHQGQGLGNSFLSHIRAVDGIFHVLLINLEPCCLLGAFEDPDIIHVDDTVDPVRDLEVITEELRLKDIEFMERKIEDIEKSMKRSNDKQLKIELECCQRVKALLEEGKDIRLGDWKAADIEILNSFQLLTAKPVVYLEHGGETIIPFSCALERNLADMPPDEAAKYCEENKTQ

SEQ ID NO: 143996 - protein, 42 aa, Glycine max
  Coding DNA Sequence Number=SeqID_52311
MDKSFKVEKEEWRERDRRSMKFSASNEPTNPRSSPRFSTKCA

SEQ ID NO: 143997 - protein, 209 aa, Glycine max
  Coding DNA Sequence Number=SeqID_52312
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=24%, HitCoverage=50%, E-value=8e-23, Identity=98%"; Hit description=LacZ protein
MTVKTSDTCSSRRRSQLVCKRMPGADKPVRARQRMRKEKIPHQAPFAIQAAHLLGRAIGAGLFAITPAGERGMCCKAIKLGNARGSNSCSPGDPLVLERPPPRWSSNSPYSESYYNSLAVVLQRRDWENTGVTQLNRLAAHPPFASWRNSEEARTDRPSQQLRSLNGEWDAPCSGALSAAGVVVTRSVTATLASADVRRCFCRYAPPRQ

SEQ ID NO: 143998 - protein, 126 aa, Glycine max
  Coding DNA Sequence Number=SeqID_52313
QAQGETPQQPGDGRQRATDAPPAPLEFTSAHPQKGLSIAYTTWPTNRRPSPKPKGENVNPYPRKQKKKRKIPIKEKAKRKERKFPTKEWEKVKKEGKKVPDQRNWKKCAERSFDQTIFEQYRIVTK

SEQ ID NO: 143999 - protein, 111 aa, Glycine max
  Coding DNA Sequence Number=SeqID_52314
  Homolog annotation: Hit_ID=A5ATL8; Match level="QueryCoverage=77%, HitCoverage=68%, E-value=2e-20, Identity=65%"; Hit description =Putative uncharacterized protein
MDTSAVRIDPCNAVANALSIPPGEYRRTLPGLDMPRILLKERGAFGNADTGGAWLSSARATAGDKPEEGEDDVKSSCPLCPGRHTCYNGRDKGSRSREGELTPKTRPQFGL

SEQ ID NO: 144000 - protein, 154 aa, Glycine max
  Coding DNA Sequence Number=SeqID_52315
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=33%, HitCoverage=50%, E-value=4e-24, Identity=100%"; Hit description=LacZ protein
MPLAIQVHHAVCDGFHVGRMLNELQQYCDEWQGGAPGDPLILERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 144001 - protein, 141 aa, Glycine max
  Coding DNA Sequence Number=SeqID_52316
  Pfam annotation: Domain name=FAR1; Domain location=48-132; Score= -25.6; E_value=0.033; Accession=PF03101.6; Description=FAR1 family
MDEDQWIYNSIMSKEVDMNEQNEDEAAIKSKHVDCSDAFNTFQARVVAYEIDFVAVIMRSGTNTSMRGMTSFILIGCEMSGQYRSRKKDFIRRNTSSRKRGYPFKLREKPVVGDQGWMVKLMCQSHNHEMTKTLVGHPCTD

SEQ ID NO: 144002 - protein, 98 aa, Glycine max
  Coding DNA Sequence Number=SeqID_52317
MSSLTVPKIPLVFPLTALIEFPNVRKTEKGLKPPFGLSSCDSFFSLREHYLATPNGQNDRSFTKTALGFCGKEKCYSARGISLSSDVISKFPTVRIQR

SEQ ID NO: 144003 - protein, 64 aa, Glycine max
  Coding DNA Sequence Number=SeqID_52318
MKKQQWKRSGRQRRTGERRRHPLGNKPWKKELHHQDEPWIRSLERMLQWRKRKRERKREGGARN

SEQ ID NO: 144004 - protein, 85 aa, Glycine max
  Coding DNA Sequence Number=SeqID_52319
  Subcellular localization annotation: CTP_CleavageSite=14; ConfidenceScore=5.12e-01
MASAITWATWTLIRVVMLVRMIRTRLPAAVWAKSCPGVHNNWAMASSSNPLALFLLWLNSHYLPSSNTSGSPRNWLRASTSKGIH

SEQ ID NO: 144005 - protein, 166 aa, Glycine max
  Coding DNA Sequence Number=SeqID_52320
MVLFRGAPVAYHVSISCPFLFSTERGGYPRNSAKAYRPEHQRASVAGVRRCSVPPHPPRLMRPLQGASAFAIQETAATAYDGTGRSSAGLFAYYPAAKGRMVSVTKCVHVAEKKAAPVRQHEYVDTTHYIGRIPLMSSYRWSSCGERKGSRTRDPPELQEFDPGND

SEQ ID NO: 144006 - protein, 297 aa, Glycine max
  Coding DNA Sequence Number=SeqID_52321
  Gene Ontology: Biological process=transposition, DNA-mediated
  Homolog annotation: Hit_ID=Q6UUU1; Match level="QueryCoverage=20%, HitCoverage=40%, E-value=4e-18, Identity=78%"; Hit description =Putative uncharacterized protein
MVKVGTSYVPINVSFRQKLAQGFPVLQWLLFLSAVPPVQLLTGWCVTAKAPPDISAGKCSGHAARRVPFAIQAAQLLGRAIGAGLFAITPAGERGMCCKAIKLGNARVFPVTTLNSMDVNLDGKIFITLILGLTDEHIALFSVSFYTKGVGGPLPIDQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 144007 - protein, 163 aa, Glycine max
  Coding DNA Sequence Number=SeqID_52322
MTGRLLAGSLAFESRILHYLIVQILLPRSSNLAQVSEEDLVIMWAFHTRCQLDWAHLRSFLIGAAVIASFGYRKEHDGSWVKKGAQPADDEGNLPVEDNSSLLRKLLDKFDGLQTFVGDKFDAMELQVDMRFDAMESRITKVEEDVSFIRTCFDPPPPPPSSS

SEQ ID NO: 144008 - protein, 169 aa, Glycine max
  Coding DNA Sequence Number=SeqID_52323
DFAQVQKNAMYLLGVERAVQSEFWMFACRSQRSKCRLMHYRLPVKFWSRSNEFSLPCSVLLGCDSLCCLYVVLLGCCGSLGGLMGARGWWVYTLIVDVENLLCTIARPPPSTTCDGVKLPAFIVDHRVVLGDMSRGSGDLGGRQASSWQSTDKRNKDHKARRLVVAGPA

SEQ ID NO: 144009 - protein, 153 aa, Glycine max
  Coding DNA Sequence Number=SeqID_52324
VIHDWSASIGYGPLYGFLEPQYIHNASRRHQECENYIGRWLKEAGKQIYIAPYLNQAHWQLVVLCPGDNVVVWFCALKKKPDAAIKGAVNSAMKSVTKTAEGKPPQHGPQWIEAKWFSNRSPLTEETMTTLRHKWAAYFIQMKKCEPRKNLIT

SEQ ID NO: 144010 - protein, 15 aa, Glycine max
  Coding DNA Sequence Number=SeqID_52325
VNAVKIFPDAQNGLE

SEQ ID NO: 144011 - protein, 89 aa, Glycine max
  Coding DNA Sequence Number=SeqID_52326
MAQPPPRERTLREMATPDFTYESLCIQYPDEDVPYVLKTGLIHLLPKFHGLAGLSNMERSMIDAASGGALGDMTPAEARNLIEKMASNS

SEQ ID NO: 144012 - protein, 154 aa, Glycine max
  Coding DNA Sequence Number=SeqID_52327
HDDWMWNYLDFVEAWEDLWGPDVERNEDKGYVGVRELSWRWATGDGGLYVICGCGESFCTIARPPPKWYLEICRGGQETLGDVRRVLGSQQIKGTKTTKQGGLWWLASCEFCVIYGLWPLVIDYQGLENEASGNRLPACVIDYTEGWVTGNRLP

SEQ ID NO: 144013 - protein, 60 aa, Glycine max
  Coding DNA Sequence Number=SeqID_52328
MSFLALFMCPPLSIIKRDTSGSSLCADDQLRIKDKSCHFLKRPDGGNQCPLFAFLVSPMR

SEQ ID NO: 144014 - protein, 214 aa, Glycine max
  Coding DNA Sequence Number=SeqID_52329
  Gene Ontology: Mol. function=aminoacyl-tRNA hydrolase activity; Cellular component=cytoplasm; Biological process=translation
  Homolog annotation: Hit_ID=A4WBD3; Match level="QueryCoverage=89%, HitCoverage=98%, E-value=3e-83, Identity=79%"; Hit description =Peptidyl-tRNA hydrolase
  Pfam annotation: Domain name=Pept_tRNA_hydro; Domain location=25-209; Score=358.0; E_value=1.6e-104; Accession=PF01195.10; Description =Peptidyl-tRNA hydrolase
MVNKPRHIKPLPTRDRINIVSSIKLIVGLANPGAEYAATRHNAGAWYVDLLCSRHNQSLKEEPKFFGYTARLSLAGEDVRLLVPTTFMNLSGKAVAAMATFYRITPEEILVAHDEMDLPPGVAKFKQGGGHGGHNGLKDIISKLGNNNNFHRLRVGIGHPGDRNKVTGFVLGKAPANEQKLIDEAVDEAVRCTELWLKEDKIKAMNRLHAFKAS

SEQ ID NO: 144015 - protein, 301 aa, Glycine max
  Coding DNA Sequence Number=SeqID_52330
  Gene Ontology: Mol. function=transcription repressor activity; Cellular component=nucleus; Biological process=regulation of nitrogen utilization
  Homolog annotation: Hit_ID=Q2KBP3; Match level="QueryCoverage=98%, HitCoverage=95%, E-value=1e-118, Identity=68%"; Hit description =Hypothetical conserved protein
  Pfam annotation: Domain name=NmrA; Domain location=8-236; Score =147.4; E_value=4e-41; Accession=PF05368.4; Description=NmrA-like family
MAEEKRIITVFGATGHQGKGVVQALKRASQFRVRALTRNPQTYTGEADEVQYADLEKPETLHDALKGVQGVFLVTDYWQQGTDERKQAAFAIEAAKSAGVSHFIWSTLPDVESVSQGEFRLPQFTNKARIDSLVKAAGFTYYTFVVPPAYYQNFAGPFGPQKQQDGSYGWVLPINPDVRCIHMGDINELGKIVVGAFAHPDNAGKGAYLPLVGDFLSFREIVGTLNQLGHPVTFKQVPREVYAGFFPGAEALADTLAYYEKYTYLGPGSHEAAIAQADKIAEFQPATFKSWARDHFSLNSK

SEQ ID NO: 144016 - protein, 276 aa, Glycine max
  Coding DNA Sequence Number=SeqID_52331
  Gene Ontology: Mol. function=transcription factor activity; Biological process=regulation of transcription, DNA-dependent
  Homolog annotation: Hit_ID=A6TCQ1; Match level="QueryCoverage=100%, HitCoverage=95%, E-value=1e-123, Identity=78%"; Hit description =Putative transcriptional regulator
  Pfam annotation: Domain name=HTH_1; Domain location=1-57; Score=61.9; E_value=2.2e-15; Accession=PF00126.18; Description=Bacterial regulatory helix-turn-helix protein, lysR family
  Pfam annotation: Domain name=LysR_substrate; Domain location=81-275; Score=120.6; E_value=4.6e-33; Accession=PF03466.11; Description=LysR substrate binding domain
  Pfam module annotation: Pfam domain module=HTH_1::LysR_substrate; Domain location=1-57::81-275
MQVFIRVAEAGSFVRAAETLSLPSSTVTSTIKNLEKYLQVRLLNRTTRRVSLTPEGLQYLAQCREILALVEHTEASLADLNRRPRGRLRVDMPGGIAHFIVMPNLKEFYSRYPDIYLMIGVSDRQVDLVQEGVDCVIRTGELLNSTLVARPLGEFRWITCASPDYLREYGIPQSPEDLSHHRAIHYFSGQSRRTDELRFVKGTETLSVSVSGHAAVNETGLYIKMCLEGFGLAQLAENVVTEHLEKGTLVEVLADWQPPSVPVTLLYPHQRFLSPA

SEQ ID NO: 144017 - protein, 469 aa, Glycine max
  Coding DNA Sequence Number=SeqID_52332
  Gene Ontology: Mol. function=oxidoreductase activity; Cellular component=cytosol; Biological process=electron transport
  Homolog annotation: Hit_ID=A6TCQ2; Match level="QueryCoverage=29%, HitCoverage=72%, E-value=3e-56, Identity=73%"; Hit description =Putative uncharacterized protein
  Pfam annotation: Domain name=Flavodoxin_2; Domain location=104-271; Score=112.7; E_value=1.1e-30; Accession=PF02525.8; Description =Flavodoxin-like fold
MWRKPEQDLFKVCDELDIGFMAYSPLGNGFLSGQVTADTTYGEGDYRGMMGRFKPEVMENNQALLDLIAQIAERNNATSAQIVLAWELAQKPYIVPIPGTTKLHRLEENFHAANVQLTLAKGAASLTDLEVRYLYDLYPDGKIDVAAEQAALEKTDRIVLQFPMQWYSTPPLLKQWLDDVLTYGWSHGGETQALRDKQLMLAVSLGGAESAYQPDGAAGHTVGEYLLSFETISGYLGMNYIKPFITGGSATITDEEIAAQAYTRGLVEESGLFAVQIPVVSQMETVLYAGEHSYRDRPDKNHKIPMFYMKEFDIPLVQGCAGWLVCKVMPNAEYELEHNLFMGEIAGAWSDDRVFRNGHWIFDEAPDELRTIHYVAGGQFYAIGKGTRFDHAAGDVASEPEGEAAFRRLQPAFLYAPKVTVLFYPPVEFICCLPEGRSQLRECIFDFGRYFTKDSARNKMPAFEFLKIL

SEQ ID NO: 144018 - protein, 78 aa, Glycine max
  Coding DNA Sequence Number=SeqID_52333
MGVQIATRPTWALQKAVASGGSNLACLGELGGNHLPYFAINRGGTEALLKRFREEFREGFDRSSTFFIRSSSFFDLQR

SEQ ID NO: 144019 - protein, 52 aa, Glycine max
  Coding DNA Sequence Number=SeqID_52334
MDLPASYDKRRDQHTTHALRHDVDVRKRNKGMYIAWQISSDNHTAKAYMKIQ

SEQ ID NO: 144020 - protein, 206 aa, Glycine max
  Coding DNA Sequence Number=SeqID_52335
  Homolog annotation: Hit_ID=Q2JIC4; Match level="QueryCoverage=63%, HitCoverage=24%, E-value=9e-09, Identity=43%"; Hit description =ISSoc9, transposase
  Subcellular localization annotation: CTP_CleavageSite=30; ConfidenceScore=5.10e-01
RATRPRLQRTTGPRFQRTARPRLQRTACPRLQRATHPCLAFRGLHALAFRGLHVLAFRELHALAFRGLHVLAFEGLHVLPFRGLHAIAFRGLHAIAFRGLNVLAFRGLHALAFRGLQVHTFRGLHVLAFRGLQVLASRGLHVLAFRGLLVLAFRGLHTLALPLEGYPPSPSEGYMPSPSEDYTSSPSEGCTPLPSEDYTSSPSEDY

SEQ ID NO: 144021 - protein, 314 aa, Glycine max
  Coding DNA Sequence Number=SeqID_52336
  Homolog annotation: Hit_ID=Q3JXP0; Match level="QueryCoverage=31%, HitCoverage=39%, E-value=1e-08, Identity=40%"; Hit description =Putative regulator
  Subcellular localization annotation: CTP_CleavageSite=39; ConfidenceScore=5.40e-01
MASRSIMRASTGMLRWLPGSTNVANDNPICRPISSPAVRTAANASCMVKPTATPIITCCRATHTAFAEKIGISTGGRDGATIIEMIMPSPTLTRLGIDFSLRIGAVAHIVQQQVQHPRPGHDNRHEHGDDFRDERQRHFVNLRGGLQDTDNQTGNQRDKQQRRGNGNRDFHRFRAHHHDRFGCHCRSLTVETLRQRTDQQLPAVDQYKEHDLKGQGNGRGRHHHHPERHQDAGDHQVDNQERNKDGKANLERGFQLAGDIGRQKNTHWHRFRSLHLAGVGQAGKEGQVGFARLTQHKLSQRLSAFIQRLLHGDF

SEQ ID NO: 144022 - protein, 205 aa, Glycine max
  Coding DNA Sequence Number=SeqID_52337
  Gene Ontology: Mol. function=phosphoinositide phospholipase C activity; Biological process=intracellular signaling cascade
  Homolog annotation: Hit_ID=A7Q9M1; Match level="QueryCoverage=100%, HitCoverage=65%, E-value=4e-22, Identity=30%"; Hit description =Chromosome chr5 scaffold_67, whole genome shotgun sequence
MFVDKSSKRVHLKYLQFLRDLRECNSYAWGVAVLGNLYREMCITTDYNTKSIGSFTLFQLWACERCPTLAPSVIPPQQQNAPLGYRWLGGELHHIGNDNLIEFRRKLDVMKRDEFVWVPYAGHVEMNLSQPDRVMRQFGMQQPILGPVMQPNNIHDLTLKGKEGKNWMRLMQPVLNEWNSRYERRVEQTPPQTGTLSLNSEYMRW

SEQ ID NO: 144023 - protein, 126 aa, Glycine max
  Coding DNA Sequence Number=SeqID_52338
  Gene Ontology: Mol. function=chitin binding; Cellular component =extracellular region; Biological process=chitin metabolic process
  Homolog annotation: Hit_ID=UPI00006A17C9; Match level="QueryCoverage =93%, HitCoverage=100%, E-value=4e-12, Identity=34%"; Hit description= UPI00006A17C9 related cluster
  Subcellular localization annotation: CTP_CleavageSite=46; ConfidenceScore=5.19e-01
VWIWSPLKVRTRSPLKVRVCSPTKVKAHDPLTVRTCSPLEVRECSPLMARTCSPLKVRACSPLLARTCIPLKVKARTYSPLEVRACSPLVVRTCSPLKARTCSPLEVRACSPLKARTCSPLEGEGN

SEQ ID NO: 144024 - protein, 157 aa, Glycine max
  Coding DNA Sequence Number=SeqID_52339
MKRWWATHPQSFADLVFASERIDVGPKRGKFDHPTRTTEKTGANEEGEKEGETHAVTAIPIRPSFPPTLQCLYSANNKPSPYPPPSYPQRPSLNQPQTRKPVEFTPIPVSYADLIPYLLDNSMVVITLAKVHQPPFLREYDSKRNVCLSRRSPGAFH

SEQ ID NO: 144025 - protein, 126 aa, Glycine max
  Coding DNA Sequence Number=SeqID_52340
  Homolog annotation: Hit_ID=Q2A9Z5; Match level="QueryCoverage=67%, HitCoverage=23%, E-value=3e-07, Identity=31%"; Hit description=Gag -pol polyprotein, putative
MMHQIPMIGGMMNVLSGATLFCKITHAPNIFMICVHRDSLGRNNQHKNKEKGMFYSITFLNFLNSDQGIPMDPKRIKVISEWPTPSSIREIWGFNILTIFYKKVLRKESMSFRTFGFEVKSLSRGR

SEQ ID NO: 144026 - protein, 144 aa, Glycine max
  Coding DNA Sequence Number=SeqID_52341
MTQELVARGDTLRLSAPRHSVTPSVIDEQRPMWSSAPFLEMSASSGGDFFKSHKGGGPDDMRRQNLVIPHPFAIQTQSCPMVHRDKIWSFCTLCHPEAAGPMTRGDKIWSFRTPLPFRHSRVRWRAETKFGHSAPFVIQRRRAR

SEQ ID NO: 144027 - protein, 113 aa, Glycine max
  Coding DNA Sequence Number=SeqID_52342
MRVVVGGDTEGLPKCFQGVYHQLLALQWHIRAKARSRLDCDGEFHVSPPRFKRHVHDQFGVVGSQFIDILIGSVRHIGWRIVERQAIWREGVIILNLHIMGAARTSQIFAYHI

SEQ ID NO: 144028 - protein, 236 aa, Glycine max
  Coding DNA Sequence Number=SeqID_52343
  Homolog annotation: Hit_ID=Q84VH5; Match level="QueryCoverage=86%, HitCoverage=34%, E-value=5e-89, Identity=75%"; Hit description =Envelope-like protein
KSDEYQKVFVRGKCVRFSPAVINKYLGRPTKEWWILPVSEHQIAKEITAKQVQHWPKKGKLSAGKLSVKYAILHRIGTANWVPTNHTSTIATESFAVKLPIAFPTVLCGIMLSQHPNILNNIDSVKKRESALSLHYKLFEGTHVPDIVSTSGKAAASGAVSKDALIAELKDTCKVLEATIKATTEKKMELERLIKRLSDSGIDDGEAAEEEEEAAEEEEDAAEDTESDDDDSDATP

SEQ ID NO: 144029 - protein, 99 aa, Glycine max
  Coding DNA Sequence Number=SeqID_52344
MPLELSWSFESYWALSTYQLLKFVSAERGFGNSDVVKKASLLVERFGKEYWRLGSCRDAKFWLDNRNGDTVFGLWLTSIVGYSQILVIRMPWWLKWHIG

SEQ ID NO: 144030 - protein, 133 aa, Glycine max
  Coding DNA Sequence Number=SeqID_52345
  Gene Ontology: Mol. function=protein transporter activity; Cellular component=membrane; Biological process=protein secretion
  Homolog annotation: Hit_ID=Q9AEG2; Match level="QueryCoverage=100%, HitCoverage=33%, E-value=8e-53, Identity=79%"; Hit description=AcrA protein precursor
MNKNRGLTPLAVVLMLSGSLALTGCDDKPAQQGAQQAPEVGVVTLKSEPLQITTELPGRTNAYRIAEVRPQVSGIILKRNFTEGGDVQAGESLYQIDPATYQASYESAKGDLAKAQAAAIIAQLTLNRYQKLL

SEQ ID NO: 144031 - protein, 181 aa, Glycine max
  Coding DNA Sequence Number=SeqID_52346
  Homolog annotation: Hit_ID=UPI00006A2264; Match level="QueryCoverage =64%, HitCoverage=26%, E-value=2e-10, Identity=35%"; Hit description =UPI00006A2264 related cluster
RTTRPRLQRTARPHLDRTTRPSQQRASYPRLERTTRPHLERTTRPHHQRAARPHLPEDYTSSPWVLHVTSPSEGCTPSPPEDYMSSPWDYTSSPSEGCTPSPSEDCTPSPPEDYTSSPWVLITLTFKGLHVLALRGLHVLTIKRLHALTIRGLHVLAFVGLHVLTSEDYTSSPSEDYASSP

SEQ ID NO: 144032 - protein, 99 aa, Glycine max
  Coding DNA Sequence Number=SeqID_52347
VQPYPSGGGEASIAQDPVPEEDEPIPPEPFIYELVTEIAQEEAASPELVPQSSPSPTPVLEDPESSVPALVPDQPLAQDPPAAPVLDLNEHAEDHLQDD

SEQ ID NO: 144033 - protein, 164 aa, Glycine max
  Coding DNA Sequence Number=SeqID_52348
  Homolog annotation: Hit_ID=Q84VI1; Match level="QueryCoverage=100%, HitCoverage=24%, E-value=3e-47, Identity=64%"; Hit description =Envelope-like protein
MATSPKEISASGSPAVPSSPHQEQPEFNIQPIQIIPGQASVPEKLVPRRPQGVKIAENPSSATSSREVDTEMDKKIRSIVSSILKDASVPDAEKDVPTSSNPNVSVPDVKKDVPTSSAPNAEALPSSSEEESTEEEDNASEETPAPRAPETAPGDLIDLEEVES

SEQ ID NO: 144034 - protein, 82 aa, Glycine max
  Coding DNA Sequence Number=SeqID_52349
MTCLSKDNPIRRHSYGCFVGSPMCPESIIKPDLPHIFKDGGPIKTTIKHLCELSFEHPDDLPVRKNDKTAGLSQSHDLECTV

SEQ ID NO: 144035 - protein, 151 aa, Glycine max
  Coding DNA Sequence Number=SeqID_52350
SFGVPVTPRKVIRPPITRAFIKKYCTPRQAQGGDPQAPDAPPPPPQADPAGSFDTEWYLWHLVHQQAANHRTHVQTHDYLYQLSLSLQSQGFPPFPCPTSDQFRAEVAWPGDWPEAQAGEAPAEAPGDADEARMDEEMTNLLDFLGGSRAT

SEQ ID NO: 144036 - protein, 98 aa, Glycine max
  Coding DNA Sequence Number=SeqID_52351
MKVITQVVFQWRSFIVGTAAILIFMGPKQKSGWVSRCRFRAERFHRNNINYITRRHHILENNCDTYAKWESSLYTEKKAGPQRFISFLNESCRGNSSG

SEQ ID NO: 144037 - protein, 83 aa, Glycine max
  Coding DNA Sequence Number=SeqID_52352
MSILTLGSKKRKRKEIPNQRVGESKKKRKEILNQRVGESKKKRKKIPNRRMGESKKEKERKLLIKDRKKTEEICRKVFGPDDI

SEQ ID NO: 144038 - protein, 200 aa, Glycine max
  Coding DNA Sequence Number=SeqID_52353
  Homolog annotation: Hit_ID=A0ST23; Match level="QueryCoverage=13%, HitCoverage=55%, E-value=3e-08, Identity=100%"; Hit description =Putative reverse transcriptase
ANWSSTAVAAALELVDPPGCRNSIEKTLTEAFEEISECEENESSDCLQQLDAFKEIPYHQSLFGELKEEKPNENSECLQHLNVSREIPYHQSLFEELKEEKPNEATKMELKALPPHLKYVFLAGDSQKPVIINIKLIDTVDLEGGPVGKPVVPAALMNRPTRGERRFAYWALAECILAYYVGTDEGVSEVLHVAGEKRLH

SEQ ID NO: 144039 - protein, 146 aa, Glycine max
  Coding DNA Sequence Number=SeqID_52354
  Homolog annotation: Hit_ID=A5ATL8; Match level="QueryCoverage=39%, HitCoverage=45%, E-value=3e-19, Identity=82%"; Hit description =Putative uncharacterized protein
  Subcellular localization annotation: CTP_CleavageSite=76; ConfidenceScore=5.53e-01
SANSVPAAAVRQRMQALSGMIGRKASVGGFLSSPSNPRAQPWTGGGNYQAGVRYPSSPSRKRWILGAVRIDPCNAVANALSIPPGEYRRTLPGLDMPRILLKERGAFGNADTGGAWLSSARATAGDKPEEGEDDVKSSCPLCPGRH

SEQ ID NO: 144040 - protein, 55 aa, Glycine max
  Coding DNA Sequence Number=SeqID_52355
  Gene Ontology: Mol. function=protein binding; Cellular component =integral to membrane
  Homolog annotation: Hit_ID=P0ABC8; Match level="QueryCoverage=100%, HitCoverage=13%, E-value=2e-14, Identity=69%"; Hit description =Protein hflK
MAWNQPGNNGQDRDPWGSSNNQGGNSGGNKGGRDQGPPDLDDIFRKLSKKLGGLG

SEQ ID NO: 144041 - protein, 101 aa, Glycine max
  Coding DNA Sequence Number=SeqID_52356
MSGFTHDSPQISAIPHQLDLAPYASEPYNAQWNAPGLFSDKHTLRSNRILGEMEVDEPWLGLWLPLNYQAFSLQNSFLGWCSWFVLKVVFVIGSAVDRLCG

SEQ ID NO: 144042 - protein, 107 aa, Glycine max
  Coding DNA Sequence Number=SeqID_52357
  Subcellular localization annotation: CTP_CleavageSite=35; ConfidenceScore=5.55e-01
MHTQSFTIPQFPKIGLTHKNSPQWSRQLSQPTLLRASEARLTGAFSKGGKCAESPPTFICGKCQKNRRKTVMKNIPSSGVVFTFEEGRQKRGSCSYVPSIEEEIRPT

SEQ ID NO: 144043 - protein, 130 aa, Glycine max
  Coding DNA Sequence Number=SeqID_52358
MADVSGTSSNFTPQFDYSMEDYQMGFLPREKVITPIDLTLGDNIKFKGKRLPIEPTFNMSSLLLNIGSIDPQLLPNYIEQWTFTVMRDYRVNHGSHVSNSQDMIARVKTYLGDIARACWDSFKQTFPEQI

SEQ ID NO: 144044 - protein, 252 aa, Glycine max
  Coding DNA Sequence Number=SeqID_52359
ANTRRIGATRAKRKEGDTHVVTSMPAWVKPPQISHVGGPLSSGSNPDSPGQQCPLWHRFQRDKELSPEANSRIHPDPNDVRRLLAIPHRQPDGCGISLIANQMGVIPRGGHKKVSCLMHLGAPHSMEACLAVGNLLQQMIDQGRLEVDDEGGEEQHICMQSTDEEGLRKPKPLVIHFTRDAAPQTPRHPSVVRPIPFPYKNSHAVPWRYAPPSERKEGVTDISSLSAKVTNITGLSGMTRSGRVFAPPDQPT

SEQ ID NO: 144045 - protein, 235 aa, Glycine max
  Coding DNA Sequence Number=SeqID_52360
  Homolog annotation: Hit_ID=Q6WAY6; Match level="QueryCoverage=52%, HitCoverage=21%, E-value=1e-12, Identity=31%"; Hit description =Putative uncharacterized protein
VDSRGSHLFQQDIRHPCPLRSHCSCIEKRRVDWDQHLVGIGGRIVNWFPRWKEGKEGVFFSCGGYPNIPLIGKRDCINYNPALAIRQLGYPMRGAPTEESLSPFLVRDFGAQNFKVIQRVHKAWESPLRKDKELRGIRNGIIGGYHEWLKVRTRGLDWLTKLKIINEEDFEAPEEDEEVRALKNELGKARLAKEKFKLVATDVRKECARLREENAATAKALEQETKRARKEEAWP

SEQ ID NO: 144046 - protein, 109 aa, Glycine max
  Coding DNA Sequence Number=SeqID_52361
  Gene Ontology: Mol. function=structural constituent of ribosome; Cellular component=ribonucleoprotein complex; Biological process =translation
  Homolog annotation: Hit_ID=P02358; Match level="QueryCoverage=100%, HitCoverage=80%, E-value=2e-54, Identity=94%"; Hit description=30S ribosomal protein S6 [Contains: 30S ribosomal protein S6, fully modified isoform; ...
  Homolog annotation: Hit description=30S ribosomal protein S6, non -modified isoform]
  Pfam annotation: Domain name=Ribosomal_S6; Domain location=2-92; Score=170.9; E_value=3.2e-48; Accession=PF01250.8; Description =Ribosomal protein S6
MRHYEIVFMVHPDQSEQVPGMIERYTGAITGAQGTIHRLEDWGRRQLAYPINKLHKAHYVLLNVEAPQEVIDELETNFRFNDAVIRSMVMRVKHAVTEASPMVKAKDER

SEQ ID NO: 144047 - protein, 518 aa, Glycine max
  Coding DNA Sequence Number=SeqID_52362
  Gene Ontology: Mol. function=signal transducer activity; Cellular component=membrane; Biological process=signal transduction
  Homolog annotation: Hit_ID=A7MM86; Match level="QueryCoverage=96%, HitCoverage=78%, E-value=1e-148, Identity=54%"; Hit description =Putative uncharacterized protein
  Pfam annotation: Domain name=HAMP; Domain location=312-381; Score =51.9; E_value=2.3e-12; Accession=PF00672.16; Description=HAMP domain
  Pfam annotation: Domain name=HAMP; Domain location=8-65; Score=1.4; E_ value=1.3; Accession=PF00672.16; Description=HAMP domain
  Pfam annotation: Domain name=MCPsignal; Domain location=412-518; Score=-78.7; E_value=0.0043; Accession=PF00015.12; Description =Methyl-accepting chemotaxis protein (MCP) signaling domain
  Pfam module annotation: Pfam domain module=HAMP::HAMP::MCPsignal; Domain location=312-381::8-65::412-518
MSLGIKLSVLTSFSVAIVLFALTLTLSHNAARQLEQLAVDDMQNQVLGINEMATMFNATLSEEVANYTRLFQSFLPKRFSRDDSSRIQVGSFSTPTLRAGLKTLNLDQIAVDDFLDRTGAVSTIFVRDGEDYIRIATSLKKKDGSRAVGTELDRSSAAWRSVNKGEVYRGLATLFGHRYITQYQPVQDDSGAVIAILFVGVQIDKQYALMREKVLARRLGDSGSFFVLNGTPGSAQGQYLFARQSEGKLPDWDRSVQQQILTQPHGLLEIAHQGETRLLAWQQLPGWNWIIAGEVSRASLLAPITHSRNLFILIGLALVLAFAIGFVLYSRRAITRPLQQVIHLAEQYAAGNLQAHLDSARRDEIGQLVNAINGIGDGLEKVVGQVRAAAREISDGTDTIAASSSSISEQIGRQASSVEETSASMEQFGATVAQTAANVRQAMALVGEAASTVSQGGSTVARSVETMAEIRIASQSIADITHVIESIAFQTNILALNAAVEAARRRWSTAKASRSSLR

SEQ ID NO: 144048 - protein, 131 aa, Glycine max
  Coding DNA Sequence Number=SeqID_52363
  Gene Ontology: Mol. function=phenylalanine-tRNA ligase activity; Biological process=regulation of transcription, DNA-dependent
  Homolog annotation: Hit_ID=Q57GL3; Match level="QueryCoverage=93%, HitCoverage=88%, E-value=4e-41, Identity=68%"; Hit description=HTH -type transcriptional repressor nsrR
  Pfam annotation: Domain name=Rrf2; Domain location=1-101; Score =103.0; E_value=9e-28; Accession=PF02082.11; Description =Transcriptional regulator
MATLPQGQQTNITEVTDTYGVSRNHMVKIINQLSRAGFVAATRGKNGGIRLGMDPEKIVIGDVVRKMEPLQLVNCKECAINPACRLRSALNNAVQLFLQELDKYTLADLVQNNDSLYHILLSEPPVAIPHK

SEQ ID NO: 144049 - protein, 401 aa, Glycine max
  Coding DNA Sequence Number=SeqID_52364
  Gene Ontology: Mol. function=nucleotide binding; Cellular component =intracellular; Biological process=small GTPase mediated signal transduction
  Homolog annotation: Hit_ID=P25519; Match level="QueryCoverage=74%, HitCoverage=69%, E-value=1e-151, Identity=91%"; Hit description=GTP -binding protein hflX
  Pfam annotation: Domain name=LSM; Domain location=5-64; Score=49.3; E_ value=1.3e-11; Accession=PF01423.13; Description=LSM domain
  Pfam annotation: Domain name=MMR_HSR1; Domain location=302-400; Score= 106.9; E_value=6.1e-29; Accession=PF01926.14; Description=GTPase of unknown function
  Pfam module annotation: Pfam domain module=LSM::MMR_HSR1; Domain location=5-64::302-400
MAKGQSLQDPFLNALRRERVPVSIYLVNGIKLQGQIESFDQFVILLKNTVSQMVYKHAISTVVPSRPVSHHSNNAGGSGGSNYHHGGSNQGAQSQPQQDGDNADLFDRYDAGEQAVLVHIWFSQDKELEDLQEFETLVSSAGVDALQVITGSRKAPHPKYFVGEGKAVEIADAVKASGASVVLFDHALSPAQERNLERLCECRVIDRTGLILDIFAQRARTHEGKLQVELAQLRHLATRLVRGWTHLERQKGGIGLRGPGETQLETDRRLLRGRISQILSRLERVEKQREQGRQARAKADVPTVSLVGYTNAGKSTLFNAITSANVYAADQLFATLDPTLRRLNVADVGEVVLADTVGFIRHLPHDLVAAFKATLQETRQASLLLHVIDAADLRVNDNIDA

SEQ ID NO: 144050 - protein, 304 aa, Glycine max
  Coding DNA Sequence Number=SeqID_52365
  Gene Ontology: Mol. function=mismatched DNA binding; Biological process=response to DNA damage stimulus
  Homolog annotation: Hit_ID=A8G8U7; Match level="QueryCoverage=99%, HitCoverage=48%, E-value=2e-73, Identity=49%"; Hit description=DNA mismatch repair protein mutL
  Pfam annotation: Domain name=DNA_mis_repair; Domain location=1-110; Score=135.0; E_value=2.2e-37; Accession=PF01119.10; Description=DNA mismatch repair protein, C-terminal domain
MQHALRIDWQHDDLALRGWVADPAGSRQVTDLQYCYVNGRMMRDKLINHAIRQAYQTQLGEDQQPAYVLYLEIDPHQVDVNVHPAKHEVRFHQSRLVHDFIWQGVMSVLQASRSAELPLAHAEEPPPQWQPENRQAAGANHFAQPATGARSGGSAASGGTGGQWQHKEPGYRAREGAVYQQLIKTPAAETPRTPAAEPAPAPAPAPAPAPRPAPAREAPLAAHTQSFGRVLSVVRERYALLERGETLQLLSLSVAARWLKQAQLQPGDEGLKPQPLLIPVRLKIAHEELSVIDAQAALLSSDGH

SEQ ID NO: 144051 - protein, 77 aa, Glycine max
  Coding DNA Sequence Number=SeqID_52366
  Subcellular localization annotation: CTP_CleavageSite=8; ConfidenceScore=5.04e-01
MKQNCGPPQQNRGGACHPARPGELSSPRRARLLPPETTTFWRKNLEGPTLEEVAKTHGLRKTPSFDFRHITEFSRIA

SEQ ID NO: 144052 - protein, 270 aa, Glycine max
  Coding DNA Sequence Number=SeqID_52367
  Gene Ontology: Mol. function=D-sedoheptulose 7-phosphate isomerase activity; Cellular component=cytoplasm; Biological process =lipopolysaccharide core region biosynthetic process
  Homolog annotation: Hit_ID=P66818; Match level="QueryCoverage=55%, HitCoverage=76%, E-value=8e-76, Identity=98%"; Hit description=DnaA initiator-associating protein diaA
  Pfam annotation: Domain name=UPF0102; Domain location=30-123; Score =142.2; E_value=1.4e-39; Accession=PF02021.8; Description =Uncharacterised protein family UPF0102
LRDQQEVIMDQIPAGANRPDQLSRKETGDAWELKARRWLEGKGLRFIAANVRGRGGEIDLIMKDGQVIVFVEVRFRQSSRFGGAAASVTLAKQHKLLQTAHLWLARHNGSFDTVDCRDNVLERIKVCFTESIQTQIAAAEALPDAISRAAMTLVQSLLNGNKILCCGNGTSAANAQHFAASMINRFETERPSLPAIALNTDNVVLTAIANDRLHDEIYAKQVRALGHAGDVLLAISTRGNSRDIVKAVEAAVTRDMTIVALTGYDGGELA

SEQ ID NO: 144053 - protein, 346 aa, Glycine max
  Coding DNA Sequence Number=SeqID_52368
DAATEGTSAAPEFDSHRFRSVEHQQRFEAIKGWSFHRERRVQHRDDEYTDFQEEIARQRWTSLVTPMAKFDPDIVLEFYANAWPTEEGEGQECEFSQRRNRADGFDEEAIAQLLCIPGQDFAQTAAGRRVRIMRTSMTTLTQMWMMLLLSNVLLSDHNSDLHLPKCQLVYAILTRMSVHVAQLITDTIYLFAGMSPTRHPLDPDKSNRALGFPALITGLCQSFGVPVTPSKATDAPPPPHQADPAGSFGMERYLQHLVRQQAANHRGQVQTHECLYQLSPSLQSQGFAAFACPTPDQFRAEVAWPGDWPEAQAGEAPAEAPDDSEEGRMDKEMTDLLDILGGSGAT

SEQ ID NO: 144054 - protein, 167 aa, Glycine max
  Coding DNA Sequence Number=SeqID_52369
LGHHFKNSVAPPTYLALLILLPVAAASGDKSCLTGATLPEGRKADRYPVSGRVGTGERTRELPGGNACLWKNASNAAFLRFLAFCWPFAHMFFPALSPDSVDNRITAFEKRKSAQYANRLSPRVGRFINAAGTTGFPTGKRARITISHRKQAMTMITNSKLGNPGIL

SEQ ID NO: 144055 - protein, 42 aa, Glycine max
  Coding DNA Sequence Number=SeqID_52370
MVKVGTSYVPINVSFSPKGGPGLPGINRDTRIYLLGEVIYSH

SEQ ID NO: 144056 - protein, 72 aa, Glycine max
  Coding DNA Sequence Number=SeqID_52371
  Subcellular localization annotation: CTP_CleavageSite=30; ConfidenceScore=5.51e-01
MWSPLKARTCSPLKARMCSTLKAKACSPLKARMSSPLKARACSPLKGMRPSKGEGVQPSEGEGVQPSKGEGV

SEQ ID NO: 144057 - protein, 180 aa, Glycine max
  Coding DNA Sequence Number=SeqID_52372
  Subcellular localization annotation: CTP_CleavageSite=14; ConfidenceScore=5.10e-01
MAEPSKKRKGTSSRSQRHSGSQETPIPPFVPSGPLFSSEEQREQYTNLFSSRSIIDPKFIDMEFFSNENFECFQAFENSNLIPFMSLKLPVYSELVNAFYSNLEIHEGVPFEGALIDEWKFDFSVHDACQLVCTNQADMTGRLLAGSLAFESCILHYLIVCIVDAIGFDVLMMIMIMCCN

SEQ ID NO: 144058 - protein, 135 aa, Glycine max
  Coding DNA Sequence Number=SeqID_52373
MGKAEEVQEKVKANMEAMKEKMATMMEAMMSMRKIMEANAVTIAATSTVAKVNPMPPSGLNQMNHPTLDRVGKDLGSRDGPHDVQNQNKHAFPPYGLPLNYTPSNVAYTPNKNVNNSTPIPIESQQPQTDHAHVS

SEQ ID NO: 144059 - protein, 98 aa, Glycine max
  Coding DNA Sequence Number=SeqID_52374
  Subcellular localization annotation: CTP_CleavageSite=29; ConfidenceScore=5.44e-01
MGGATCAAKSLHRCAYSLKVSPSFLNIFVATYPSAGGRRVTRGMRAPRKEYARSRHQRLFEENVGKTGKDASYELLSERVFPFAPTYSSICDEEIRPT

SEQ ID NO: 144060 - protein, 136 aa, Glycine max
  Coding DNA Sequence Number=SeqID_52375
  Homolog annotation: Hit_ID=Q51617; Match level="QueryCoverage=30%, HitCoverage=59%, E-value=1e-14, Identity=95%"; Hit description =Putative uncharacterized protein
  Subcellular localization annotation: CTP_CleavageSite=77; ConfidenceScore=5.19e-01
MTVKTSDTCSSRRRSQLVCKRMPGADKPVRARQRVLAGVGAGLTMRHQSRLCVRRKYRIRRHSPFRLRNCWEGRSVRASSLLRQLAKGGCAARRLSWVTPGFSQSRRCKTTASAKLACLQVDSRGSLLGVCGPDLR

SEQ ID NO: 144061 - protein, 161 aa, Glycine max
  Coding DNA Sequence Number=SeqID_52376
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=52%, HitCoverage=72%, E-value=4e-24, Identity=69%"; Hit description=LacZ protein
MKHFTDTLISANILLGRLRQEKGLNPGGKGYISEPRLSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 144062 - protein, 76 aa, Glycine max
  Coding DNA Sequence Number=SeqID_52377
MAPLIPCGTHLAAPFWNGISRLGKDAAAAVDCAKEKRPVPFPFNIHSKYSPLAMLQPAAALRTALALTAASYASCF

SEQ ID NO: 144063 - protein, 89 aa, Glycine max
  Coding DNA Sequence Number=SeqID_52378
MKRWWVAHPQSFADLVFASERIDVGPKRGKFDHPTRTTEKTGANEEGEKEGETHAVTAIPVRPSFPPTQQCHYSTLLLTYRPFIHKGHP

SEQ ID NO: 144064 - protein, 284 aa, Glycine max
  Coding DNA Sequence Number=SeqID_52379
  Homolog annotation: Hit_ID=Q6UUU1; Match level="QueryCoverage=21%, HitCoverage=40%, E-value=4e-18, Identity=78%"; Hit description =Putative uncharacterized protein
WNLLRADQRLISPKVGPGLPGINRDTRIYLFCEVISVTAVPPVQLLTGWCVTAKAPPDISAGKCSGHAARRVPFAIQAAQLLGRAIGAGLFAITPAGERGMCCKAIKLGNARVFPVTTLNSMGYVRIPKIHRAQSIKKSHITQVLGLDICHISFMGKAQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 144065 - protein, 247 aa, Glycine max
  Coding DNA Sequence Number=SeqID_52380
  Gene Ontology: Mol. function=phosphoprotein phosphatase activity
  Homolog annotation: Hit_ID=A7UQU7; Match level="QueryCoverage=53%, HitCoverage=23%, E-value=3e-18, Identity=41%"; Hit description=IMP dehydrogenase/GMP reductase, putative
  Pfam annotation: Domain name=DUF1723; Domain location=164-213; Score =64.3; E_value=4.1e-16; Accession=PF08330.1; Description=Protein of unknown function (DUF1723)
MARTRGLGRAIGRVVGRDIAADEDAGDVPERRRPTASARRLRVHQMTTEGRDMAEDVADMTDDVPEQPTEAPEMRADAQGADSGEGSDGDDAAEEFPGGPRDPSVLTSFAEHVAHAVWSGQERPDLKLVSHGRKLTLIGRLVPEIEGLVAATGLSPLIDCSVITGDPGLISAFVERWHSETSTFHLPVGELTITLDDVSSILHLPITGALHSFHALSTEEARFLLTELLEVSAEEARAETALTRGAY

SEQ ID NO: 144066 - protein, 292 aa, Glycine max
  Coding DNA Sequence Number=SeqID_52381
  Homolog annotation: Hit_ID=A1FU69; Match level="QueryCoverage=100%, HitCoverage=42%, E-value=2e-79, Identity=57%"; Hit description =Putative uncharacterized protein precursor
MHDQCTSGDIGDGASAKGNALEVDIDVGAALGIGTQVVHVAQVVLAGAGATMRGATGVEVVAGAAGIHRAAIATLVDVETGLLHRLQATDQPGDVDATRLHDQRDAATDDAGRGRRQVGLRLLGGTDHGRRRRGGLGLLRCAATGRQQHGDGQRQDGKGQTHRRLLAGDTTDGIVHERSTVRQAGARIACRDRSMAPAAAPGAQLAGKGIAAESQAGSGFGAAAMGDLQRGLQQGMVDPLAHLRVQPFHAFGQLTARPFGQQRFPLAGIGTAGAAATAARAVQRGIDVCHAD

SEQ ID NO: 144067 - protein, 150 aa, Glycine max
  Coding DNA Sequence Number=SeqID_52382
MTLLLSNILPSDRNANLPLQKYQLVCVVPTWGSHPQDTQWTRKSPTGPWGFQLWLRASISPTGCPYPPARSCHPDIGIAPAGHPVDPKKSNRVLGFPALITGLCQFYGVPVAPTRSLGPALIGLSSRSTAPPDGRRARHHSSIGMAGSGQ

SEQ ID NO: 144068 - protein, 15 aa, Glycine max
  Coding DNA Sequence Number=SeqID_52383
RKMQGSSLKDNNIAA

SEQ ID NO: 144069 - protein, 47 aa, Glycine max
  Coding DNA Sequence Number=SeqID_52384
MTKSKGKDPLEGLGGQGLEQGKPRKLFNKCCPYYLNTSPSFKEKSPR

SEQ ID NO: 144070 - protein, 293 aa, Glycine max
  Coding DNA Sequence Number=SeqID_52385
  Gene Ontology: Mol. function=sodium:dicarboxylate symporter activity; Cellular component=integral to membrane; Biological process =transposition, DNA-mediated
  Homolog annotation: Hit_ID=Q6UUU1; Match level="QueryCoverage=20%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGIRFAILFFALVVLGIVARLCGLSVWILIRILKDELNQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 144071 - protein, 209 aa, Glycine max
  Coding DNA Sequence Number=SeqID_52386
MDNEEGVQEQMKVGLLALKDQMASISEVMLKLQKTIEDKATTTASSTVREAEPVLQPTLNLGLDRNTAVFGRRYSPQAYPYGLPPDFTPRATPKDLSQAPTFEGQLPPYEDYPGQDDGEGDTHLGPLLHLKDPSPHELPQPNIVRHIPASPTPVKESVPFAEDKGKMEALEGRLRAVEGLGNYPFSDLADLCLVPNIIIPPKFKVSDFD

SEQ ID NO: 144072 - protein, 86 aa, Glycine max
  Coding DNA Sequence Number=SeqID_52387
MASESSSIRRRMLVSMRIKGQAQIAQRTILPLNGFDNLLVEIAAGFFTVQRQPVAYVDMFARAGNQVALLIIDTGIQDTAVFRQQT

SEQ ID NO: 144073 - protein, 139 aa, Glycine max
  Coding DNA Sequence Number=SeqID_52388
MPDAEDELAPPEPFVFETDLVAQEEAAAQEPTAQPLEEKEHVIRSMTENVSQFVRLIVKECIDCITESIIHRKLGSKQICLKFGGVIIKKYVHWERNTQGLILSFLIYILPTFENGPRRVQRNARNWNQRGGMQTEAGF

SEQ ID NO: 144074 - protein, 67 aa, Glycine max
  Coding DNA Sequence Number=SeqID_52389
MMASKKRKATATPSKVRYDRSKFTYPEAWERYTDINVPRKLLPERNVVIYHTEFDEFKEELERKKMG

SEQ ID NO: 144075 - protein, 21 aa, Glycine max
  Coding DNA Sequence Number=SeqID_52390
MEEKGDAAEDKGEEVRGGAIH

SEQ ID NO: 144076 - protein, 132 aa, Glycine max
  Coding DNA Sequence Number=SeqID_52391
MTQRFGKYGRPHDVQIQNEHAFLPYGLPPNYTPPNVAYTPSEIVNNSTPILIESQQPQTDHAHVSQTMGETHEISHHNLADFEPCLGYATEGQVVGGMPLQNTLEDPQYHPQPHPLDSTAGKNLMLWQKLES

SEQ ID NO: 144077 - protein, 153 aa, Glycine max
  Coding DNA Sequence Number=SeqID_52392
  Homolog annotation: Hit_ID=A5C0D0; Match level="QueryCoverage=72%, HitCoverage=44%, E-value=6e-11, Identity=39%"; Hit description =Putative uncharacterized protein
MGSKQITSKEAPSLNRPPLFEGEHFLFWQKGTEIFIQSIDPGAWNAIIKGPFIATKEVKAFQMKNGETISEHQTRFTHIVNHLLSLGKMFEDDELNIKILNCLTRTREPMITMIKEFKDLGIIVDGSFLRKIARCMNMEANSTISCRINRKEN

SEQ ID NO: 144078 - protein, 90 aa, Glycine max
  Coding DNA Sequence Number=SeqID_52393
  Subcellular localization annotation: CTP_CleavageSite=56; ConfidenceScore=5.09e-01
MRACSPTKARTYAVLWMVRACQPSEGRCSLSRRGHVAPLEVRACSPLMVRACSPLKARTYSPLEVRACSPLVLRTRSPLKARTCSPLNGE

SEQ ID NO: 144079 - protein, 90 aa, Glycine max
  Coding DNA Sequence Number=SeqID_52394
MQNSKCNVYLGAYLNGAHWQMVVILPKENLVVWFCSLHNRPDNYLKGIINSALKGLDDTPQPKSKAGVRWIVVKCNRQKESTECDYYVIH

SEQ ID NO: 144080 - protein, 272 aa, Glycine max
  Coding DNA Sequence Number=SeqID_52395
  Gene Ontology: Mol. function=motor activity; Cellular component=cell projection
  Homolog annotation: Hit_ID=UPI00016621D1; Match level="QueryCoverage =97%, HitCoverage=46%, E-value=5e-22, Identity=34%"; Hit description =UPI00016621D1 related cluster
MSLPFRGLHVLVFRGLHVVAFRGIHALAFRGLHVHTFRGLHAFALRGLHVLAFKGLHLLTFRGLHALTFRGVHVLAIRRLHVLTFRVLHVLTFRGILILAFKGLHVLAFRGLHVLTFNGVHVLAFRALHVLIFSGLHVLAIRGLHTLNFRGLHVLTFRGLHALTIRGMHILIIRGLHVLTFRGLHRTTRPCLLRVIRRTLKGVHVLAFRGLHALTFTGLHVLAIRGIPVLTFRGLHVLAFIGLHVLDFKGLHILAIKGQHILTFRRLHAFAL

SEQ ID NO: 144081 - protein, 136 aa, Glycine max
  Coding DNA Sequence Number=SeqID_52396
  Gene Ontology: Biological process=transposition, DNA-mediated
  Homolog annotation: Hit_ID=Q1J7G7; Match level="QueryCoverage=23%, HitCoverage=45%, E-value=7e-11, Identity=93%"; Hit description =Transposase
MVKVGTSYVPINVSFSPKVGPGLPGINRGHQDLFILRSDLPSQVLQWLLFLSAVPPVQLMTGWCVTAKAPPDISGAKCSGHAARNHHTRQTNCEISAPITLDICSLAANILPSSRASFLRSALGAQKIPKTNPSYY

SEQ ID NO: 144082 - protein, 252 aa, Glycine max
  Coding DNA Sequence Number=SeqID_52397
  Gene Ontology: Mol. function=transporter activity; Cellular component= membrane; Biological process=transport
  Homolog annotation: Hit_ID=P0AC25; Match level="QueryCoverage=100%, HitCoverage=88%, E-value=1e-136, Identity=94%"; Hit description =Probable formate transporter 1
  Pfam annotation: Domain name=Form_Nir_trans; Domain location=1-252; Score=496.2; E_value=4.1e-146; Accession=PF01226.8; Description =Formatenitrite transporter
MAKVAEEAGVYKATKHPLKTFYLAITAGVFISIAFVFYITATTGTAAMPFGIAKLIGGVCFSLGLILCVICGADLFTSTVLIVVAKASGRITWGQLAKNWLNVYVGNLIGALLFVLLMWLSGEYMTANGGWGLNVLQTADHKMHHTFIEAVCLGILANLMVCLAVWMSYSGRSLMDKAMIMVLPVAMFVASGFEHSIANMFMIPMGIVIRNFASPEFWTAIGSTPESFSHLTVMNFITDNLIPVTIGNIIGG

SEQ ID NO: 144083 - protein, 114 aa, Glycine max
  Coding DNA Sequence Number=SeqID_52398
MEDPMAYKLQWSLHHPGHTTWGRVAGKPSRIRPIGNTERMSLSGDMGVPVAYLSKVAPVGWLNLGGGTGLCDIGRYFLLIRGWLVIAEALDCSQPLFKRLNLPLSFHELGDSLV

SEQ ID NO: 144084 - protein, 199 aa, Glycine max
  Coding DNA Sequence Number=SeqID_52399
HFPTVHESVIDPEYDEMSPRACWWLTTKAYSKGFPASTYQTRIDALMILDVCWMPYGEHRGVRAFDLISCFQGELRWDPVVVTHRPERMYVPDYMDWFFRISHSFITPTQAVDPPRHPPIPHHDTYVEPDIPVVPATPEAGPSHAPSDVEQPRHAVDACQVIAERLERLLNLRIVTVGTEIHEVMEDCIRIARGVTTDG

SEQ ID NO: 144085 - protein, 33 aa, Glycine max
  Coding DNA Sequence Number=SeqID_52400
MARSRIVSGHGQKSRQVSGRNLPRYLGMEANGG

SEQ ID NO: 144086 - protein, 57 aa, Glycine max
  Coding DNA Sequence Number=SeqID_52401
MSLPSAIHVFSIIKCEASGDWEHKKKEEVEMRVVITERAGRTKSVSYLCFPLISDER

SEQ ID NO: 144087 - protein, 57 aa, Glycine max
  Coding DNA Sequence Number=SeqID_52402
MSQPTLRREGDEGLTGAFSKKGKCADSPPTFIRGRHRKNRKGKALAPHASVTRDNNL

SEQ ID NO: 144088 - protein, 147 aa, Glycine max
  Coding DNA Sequence Number=SeqID_52403
  Homolog annotation: Hit_ID=A5BLR1; Match level="QueryCoverage=68%, HitCoverage=13%, E-value=9e-09, Identity=32%"; Hit description =Putative uncharacterized protein
MRLHQHEENDKKNKGITLRASSSSIQEESDKEYLNEIEEDHDFIFFVKRFNKFLRNKGNQRISNINPKKKGENSSLAPKCYECDQPENLRFDCPVFKRRMEKFDKRNFKEKKAYIIWEDNDMNSSSDSENEVINLGLMAKDYESEEK

SEQ ID NO: 144089 - protein, 143 aa, Glycine max
  Coding DNA Sequence Number=SeqID_52404
MARTRGLGRAIGRLIGRDRHDDHDAVDVPERRRPTASARRQRVHQMTADARDMVEDVADMVEDVPDLAKEAPEMRADVQGADGVEGSNADDAEGFPGGPRDPSVLTSFADHVAHAVWSGQERPDLKLGVTWGGRGDIDWEASA

SEQ ID NO: 144090 - protein, 130 aa, Glycine max
  Coding DNA Sequence Number=SeqID_52405
  Homolog annotation: Hit_ID=Q6WAY3; Match level="QueryCoverage=48%, HitCoverage=2%, E-value=6e-08, Identity=44%"; Hit description =Gag/pol polyprotein
MNFAAKKPIEFTPIPVSYADLLPYLLDTAMVAITPVRFPQPPFFRGYDSNTMCGYHGGAPGHSIERCMTLKRKDFQVNAIIVSHSYNAKMDELDILVSLILSQTHLCLFNFHRNVSVSHCGLFVQSNLRS

SEQ ID NO: 144091 - protein, 574 aa, Glycine max
  Coding DNA Sequence Number=SeqID_52406
MASSSCSRRGGTVANEVGQRRGLPVIAIVAFRFDHGLACVVAPVVAILQRLALVVACPQLIQRFIAGLQQYLQLPVGLITQELIQPSFQRLCDQVDAAIRGLRAFRHAHREPMRFGHLAGFAVNGDVQGAGAEHRIHPEQHAIAVNGGKDLGYGFALAGGIERLPPMGAKVRAVEYAFGADEIQRAFTRQRHQFAADKGRPVVVALRPGDQCPDGALFHIDQPAPLGQKKHALLPAANRIVDRLVEFPQHLQSLRAAEQHLAEIVGRPAVKAIVGPALTPFADEQQSAVLRRVAVDEIVTGYRRQGLVALGPLPLRIAANVIISAPSPDPAAIACGADCAVKAADLGEALDQQRQAADHQHHQQQNRRQFATKALQGPGIQVKARRGIGVIRHRQAEHKARHDRAENEDNARAQVKAGFGEVAAAADEVSLAIAVVDDPTHRRQLGDGVVLAIQHLQRIAFGDEKRMLPTKYRMQFGIGDVERAGRQREVRLLLAPRIGVQILHLARDLIVEEFVAQGVDRLDAGGLDAVGEGDAERSGRRDVLPLQHAIQRIEQAPAAAMPDQQQLRIYEGWL

SEQ ID NO: 144092 - protein, 72 aa, Glycine max
  Coding DNA Sequence Number=SeqID_52407
  Gene Ontology: Mol. function=transferase activity, transferring glycosyl groups; Cellular component=cytoplasm; Biological process =purine ribonucleoside salvage
  Homolog annotation: Hit_ID=A8GAD0; Match level="QueryCoverage=98%, HitCoverage=46%, E-value=3e-35, Identity=97%"; Hit description =Xanthine phosphoribosyltransferase
MKVLKRAEGDGEGFIVVDDLVDTGGTAKAIRDMYPKAHFVTIFAKPAGRPLVDDYVVDIPQDTWIEQPWDMG

SEQ ID NO: 144093 - protein, 125 aa, Glycine max
  Coding DNA Sequence Number=SeqID_52408
  Gene Ontology: Mol. function=DNA binding; Biological process =regulation of transcription, DNA-dependent
  Homolog annotation: Hit_ID=A8GAI6; Match level="QueryCoverage=96%, HitCoverage=47%, E-value=2e-47, Identity=79%"; Hit description =Transcriptional regulator, IclR family
  Pfam annotation: Domain name=HTH_IclR; Domain location=3-95; Score =69.8; E_value=9.1e-18; Accession=PF09339.1; Description=IclR helix -turn-helix domain
MTTLENAAAVLKLFSQQRVMHGQPGIAFSDVVDQLALPKSTVSRLLQSMENQGMLERDPDSRRYRIGALLLAASSHYLSMPLVDNLAASMAQLCRQTACTGYLSVLEGQEIMVMRMFPGRHCGIL

SEQ ID NO: 144094 - protein, 782 aa, Glycine max
  Coding DNA Sequence Number=SeqID_52409
  Gene Ontology: Mol. function=methylated-DNA-[protein]-cysteine S -methyltransferase activity; Cellular component=intracellular; Biological process=regulation of transcription, DNA-dependent
  Homolog annotation: Hit_ID=A4YR82; Match level="QueryCoverage=27%, HitCoverage=87%, E-value=3e-90, Identity=71%"; Hit description =Putative uncharacterized protein
  Pfam annotation: Domain name=HTH_AraC; Domain location=11-56; Score =36.4; E_value=1.1e-07; Accession=PF00165.14; Description=Bacterial regulatory helix-turn-helix proteins, araC family
  Pfam annotation: Domain name=HTH_AraC; Domain location=60-105; Score =16.0; E_value=0.037; Accession=PF00165.14; Description=Bacterial regulatory helix-turn-helix proteins, araC family
  Pfam module annotation: Pfam domain module=HTH_AraC::HTH_AraC; Domain location=11-56::60-105
LTEQHARQIAEACRYIERAEKAPSLQTLARHVGLSQYHFHRLFKAITGLTPKGYADAQRSQRLRTGLTQQETVTDAIFDAGYGANGRFYQQANAALGMTPKAYRAGGKGMRIHFAVGRCSLGEILAAQSEVGICAILLGDDAQRLVQDLQDKFPNAELIGGDAQYEALMAQLCRYCPAHRRAQSGARGGWRLRRQRAGGGDPLSPGGAQRRRLVRLSLGRRAQASLAGKRGAAMSGLLAARLAELDWATIERELDAQGCARLPGVLSQDLCRELAALYPHDAHFRSRVVMAQHGFGRGEYRYFAYPLPLPVAEARSLMYARLAPVANRWNTLLGLAARYPAEHEAYLAECHRAGQRRPTPLLLRYEAGDYNCLHQDLYGERVFPLQVAFLLSAPERDFTGGEFVLTEQRPRMQSRPEVVPLQQGDAVVFAVHHRPMAGAKGYYRVNLRHGVSRLARQQGGEAQRDTVAGGVGLVQLADVLVVFEDLPVAIIMLQFTRAKSERKRQRAGIILAIHRRHDQVMAAAYGAALHVLHDMRNLLAFEKHHHHCGQDEVVFAAEAVGIEILHPGAQAGQLLGVDDLIEAVYRRRVLVPGGDVETLQIEIERIAAAAAAQIQRLARRDARRRLDHFGVGARQFVFLVVVIFRRAVKRQPASHIVREGNDAVPLLRCDKRRLAFGAELPGLGGGAVLGHHGERQAAAQYGELRPGAALGVVALAEGLRQRVAGKDADTSFIPPDILPFAEPGRAAGAGGLYQQNHHHGANGAPRRCQSPAADADPGQRRR

SEQ ID NO: 144095 - protein, 598 aa, Glycine max
  Coding DNA Sequence Number=SeqID_52410
  Gene Ontology: Mol. function=phenylacetaldehyde dehydrogenase activity; Cellular component=cytoplasm; Biological process=metabolic process
  Homolog annotation: Hit_ID=A8GAE9; Match level="QueryCoverage=65%, HitCoverage=78%, E-value=0.0, Identity=85%"; Hit description =Phenylacetaldehyde dehydrogenase
  Pfam annotation: Domain name=Aldedh; Domain location=226-596; Score =449.8; E_value=3.7e-132; Accession=PF00171.13; Description=Aldehyde dehydrogenase family
  Pfam annotation: Domain name=LysE; Domain location=14-185; Score =21.9; E_value=0.00012; Accession=PF01810.9; Description=LysE type translocator
  Pfam module annotation: Pfam domain module=Aldedh::LysE; Domain location=226-596::14-185
MDLFGRGGLHYHSAGAEYAVRTENRRIARRARRLHRGARRVHRRCDPDLLRLYRRGFADPHHAVPVYPGAFSRRDLPAAQQQQIEGGHSILRKSLTLSLTNPKAILFYVSFFVQFIDFNYAHTGLSFTILALILEAVSFIYMSTLIFSGAMLAHFFNHKKGLAKLGNGLIGLLFLGFATRLATLSSVNDNLMSLIGGCMSDNTVAVLDSVSRFLDRQHGLYIDGQWRASAAEGRLAVYNPANGQQIATTADANEQDVALAVQSAHKAFSEGVWAQRLPVERERILLRFADLVEQHAEELAQLETLEQGKSINIARAFEVGSTLNWMRYTAGLATKITGQTLDVSIPMPPGAKYQVYTRKEPIGVVAGIVPWNFPLMIGMWKVMPALAAGCSIVIKPSETTPLTLLRIAELASEAGVPPGVFNVVTGRGTVCGKALTEHPLIAKVSFTGSTPVGKSIARAAADRLTRVTLELGGKNPAIVLKDADPQQVIEGLMLGSFLNQGQVCAASSRIYIEAPIYDQLVAGFEQAVKSLSVGPGMDTGAQINPLVSLAHRDKVAAYLDDARAKNAELIGGAAGPDANGFYIPPTLVINSGRSAEPD

SEQ ID NO: 144096 - protein, 444 aa, Glycine max
  Coding DNA Sequence Number=SeqID_52411
  Gene Ontology: Mol. function=NAD(P)H dehydrogenase (quinone) activity; Cellular component=integral to membrane; Biological process=electron transport
  Homolog annotation: Hit_ID=A1FRX4; Match level="QueryCoverage=57%, HitCoverage=94%, E-value=5e-77, Identity=55%"; Hit description =NAD(P)H dehydrogenase
  Pfam annotation: Domain name=FMN_red; Domain location=153-362; Score=- 22.7; E_value=0.0017; Accession=PF03358.6; Description=NADPH -dependent FMN reductase
  Pfam annotation: Domain name=Flavodoxin_2; Domain location=153-365; Score=196.8; E_value=5.5e-56; Accession=PF02525.8; Description =Flavodoxin-like fold
  Pfam module annotation: Pfam domain module=FMN_red::Flavodoxin_2; Domain location=153-362::153-365
VPIKFGPELASCGLNDSGEATVQYTSASEAASAPPADNRPQPASTNPAIGQTALIGRALAVCIIALAGGVQLGEMVFRPSVERRQRLDQRAGDGAEPFAVAHRPLRQRGQDQHHPLAGNQRQRIARGALARIDVAGIGHWGIAAPPYNGRNRMNVLIVLAHPEPHSFNAHLAEQARQAWLAQGHQVKTVDLYQEGFDPREGAGHYPSRKQADRFDAMQEQRHHWTTQALPAEIRRHIELLRWADTLVLQFPFWWFGAPAILKGWMDRVFVYGGIYDSRHRHENGVMRGKRALLTVTAGASAQACAPNGRDGDMRLMLWPIMHALHYIGFSVLEPFLVYGVRGGLACEERQAQNAALAQVTQAYREGLSDLAAWPAVWFNRNEDFDADLALKPGAPVVDNRRFDVGELLLDIGDGFGHARAGEGAGEGQQRQIGVAVRQFAADSA

SEQ ID NO: 144097 - protein, 253 aa, Glycine max
  Coding DNA Sequence Number=SeqID_52412
MPANFADLVFAGERIESRLRKGKFEYASNVAPNNNRRAPVVGTRKKEGDTHVVTTAPTWMKAPQNVQNSYQHNPPNFSIRAGSSLPTQVKGPPATERTPAQHTTPATPRPTNNTTPGTSYNNAWRPPPRDDFSPIPMAYSELWPSLLENHLVVAIPGKEGPNVKTNPLASHGGASVNAIEEHWPSGAKRLEDVATSRRFIYQSLQAACMVSRGGDKRDECLYHLGESHDMETYPAVEELLQRLMDWGQLEVSK

SEQ ID NO: 144098 - protein, 75 aa, Glycine max
  Coding DNA Sequence Number=SeqID_52413
GNVPLPKSTLKIIPKLYWRIPMNPSFPYKGSPPIEGIPLKAKGLNIVFFMEIWEANVNLLRPSILFSSLGVMFSM

SEQ ID NO: 144099 - protein, 183 aa, Glycine max
  Coding DNA Sequence Number=SeqID_52414
DNATAVASNTTREAEPVLQPAINLGQDRNATGFNRRYSPQAYPYGLPPDFTPRTAPDDLSQALTFEGQLLPHVDYPLQEDDEGDAHLGPLLPLKEPAPHELPQPNIVCHVPSPSALVKELVPFAKDQEEKIDLLEELVGAAVAYRYTKWKLLKSGHGKTWQLPSLGISQYNTEVCSAPDRTTS

SEQ ID NO: 144100 - protein, 130 aa, Glycine max
  Coding DNA Sequence Number=SeqID_52415
MDKVDIFVPHPLTNTSLLIQLPSECECKPLVCLLKQPALLSVDFQDRSIRDYSSCTLVGVSLREERNASSIYTGSATSRAYVQSSSNPLEIFHSLCKTSFTKSEPHRDNPSLVFKNPYNLRDPRSLNQSL

SEQ ID NO: 144101 - protein, 44 aa, Glycine max
  Coding DNA Sequence Number=SeqID_52416
MGFAGGSGSKPSTFSTRITCYKCDKRGIFKEIAHIPRRSRMVGA

SEQ ID NO: 144102 - protein, 72 aa, Glycine max
  Coding DNA Sequence Number=SeqID_52417
  Homolog annotation: Hit_ID=A5C3F2; Match level="QueryCoverage=95%, HitCoverage=6%, E-value=1e-07, Identity=35%"; Hit description =Putative uncharacterized protein
MDPVKYIFEKPALTGRIAWWQPMHPEFPDEDIMALFEEEVEDEDRDKWVVWFDGASNALGHGTGAILVSSDK

SEQ ID NO: 144103 - protein, 19 aa, Glycine max
  Coding DNA Sequence Number=SeqID_52418
MSVRSWYCVVEAKLHGESK

SEQ ID NO: 144104 - protein, 66 aa, Glycine max
  Coding DNA Sequence Number=SeqID_52419
MGESNKRKKAPDQRSKETRRNVQKGLWTRQYLNNTELSPNEQKEGKETMTYSGLLPLITSQNHVRQ

SEQ ID NO: 144105 - protein, 233 aa, Glycine max
  Coding DNA Sequence Number=SeqID_52420
  Homolog annotation: Hit_ID=A5BQJ4; Match level="QueryCoverage=86%, HitCoverage=17%, E-value=8e-07, Identity=23%"; Hit description =Putative uncharacterized protein
  Subcellular localization annotation: CTP_CleavageSite=17; ConfidenceScore=5.16e-01
MAEPSKKRKGSSSTAAAAAHRRHGPSEASTAPIHPSLSSPRSSTLFYSDDQRLWYLSQFSSRIILDPKYLDVEFFIDETFDCYQVFQNSGLVDFMSLKLPHYPELVKVFYCNLKIQDDIISSEVHGIPMIIDQSLFFSLTHLPSQGAPFEGTIVDDWKFDYSSHDARRMVCNDQVEMTGRLLAGSLTFDNRIMHYIIVRILLPRSSNLAQASEEDLILMWAFLTGRQIDWAHL

SEQ ID NO: 144106 - protein, 186 aa, Glycine max
  Coding DNA Sequence Number=SeqID_52421
MELYHFEFDEFKTKLERRNLYKHLANLQEGSIDVAMVKEFYANFYCPVDQAPKCARIKGHLIKIDVDSLNEFLQTLVLLEEGESLPAYSRFCILRSDPREIKASLCILGKGFILNTEGQPWKLLRKDLTTLAQTWSVFSYSNLAPTSRTSDLNTDRARLVYGLITRMDMNIGGLISRQMLSLTLLS

SEQ ID NO: 144107 - protein, 114 aa, Glycine max
  Coding DNA Sequence Number=SeqID_52422
  Gene Ontology: Mol. function=aspartic-type endopeptidase activity; Biological process=DNA integration
  Homolog annotation: Hit_ID=A5BE46; Match level="QueryCoverage=85%, HitCoverage=9%, E-value=8e-21, Identity=46%"; Hit description =Putative uncharacterized protein
MTDMTVQVNNVWGLLLDIVIESPTQDNLVVHEEQTQDPQEPMLHELVPLRRSIRERRNAIPDDYVVFCQEREENNGMIKAMNEKHKSMQDNKTKRDSNGNVERYKARLVANGYT

SEQ ID NO: 144108 - protein, 138 aa, Glycine max
  Coding DNA Sequence Number=SeqID_52423
MAPTRHPLDPDKSNRALGFPALITGLCQSFGVPVAPSKVIRPPITRAFIEKYCTQRQVQGDAPQATDAPPPHQAGPAGSLDTEQYLRHLVRQQAANHRAHPEAQVGEAPAEAPDEADEAREDEEMTDLLDFLGGSRAT

SEQ ID NO: 144109 - protein, 162 aa, Glycine max
  Coding DNA Sequence Number=SeqID_52424
VEFDIPEAYDSRTKRKLLQTVGERWRQFKSDLTRKLALAADQDGVEDTVCEKYGISKEKWAQFCQTRKDPSWEDVRKKAQAIQKQNTAPHILSRGGYDYLEQKLLVEKMKKKLEEAAQLGTVDGIIDPPSPVRSHVKWKMSRTKKTREMTTEAAKENTGDDD

SEQ ID NO: 144110 - protein, 35 aa, Glycine max
  Coding DNA Sequence Number=SeqID_52425
AYITWDENDMKSSEDSENEEINLCLMAKSYKSDEE

SEQ ID NO: 144111 - protein, 94 aa, Glycine max; identical to SEQ ID NO: 94714
  Coding DNA Sequence Number=SeqID_52426
  Subcellular localization annotation: CTP_CleavageSite=21; ConfidenceScore=5.47e-01

SEQ ID NO: 144112 - protein, 100 aa, Glycine max
  Coding DNA Sequence Number=SeqID_52427
MMKVEKKLIHRIGQQQSPRSKKSGDNNNLQGVKRVGGSEIEHETSLATCLAMIGFSPSGLPRLITNEEPMLFRWNKLNQLKIDGVRFSQDSTRGNFPWHP

SEQ ID NO: 144113 - protein, 132 aa, Glycine max
  Coding DNA Sequence Number=SeqID_52428
MSISPCGSISWLCCPDIGKDHAHKTPSGPGGAQQGPGVSSSGYGPLSVLQGARPPQQGIAPARHLVDPEKSNRVLGFPPMITGLCQFYGVSVTPCKVIRAPINRTFIEKYCAPGRRRARHHSSGQQAHRHHL

SEQ ID NO: 144114 - protein, 283 aa, Glycine max
  Coding DNA Sequence Number=SeqID_52429
  Pfam annotation: Domain name=zf-CCHC; Domain location=98-115; Score =22.6; E_value=0.00058; Accession=PF00098.14; Description=Zinc knuckle
MKREKHASYSSHNSCKSLSEVLCDYYEGRHRSHLRPHSHRREKERKPQEANIKLSYFHGKDNVEANLDWEIRVEQQLKGKTIEKQAPKASLQEKTSSIKCFKCLGRGHITSQCPTTKTMIMRGQDIYSSQDEATNSPSSSESEKAKGEESSEEIYPQEEGQPLVVKEKCKEVSVSSKSLAKKETHFTIKTNIKETFPLRQPPHFLFCKKALASIATPLGLEFIPQVKKSLDEGLVRKSLNPCALLVPKIGIIRYQVPKIGGMMNVLSGATLFCQITRTPNIFM

SEQ ID NO: 144115 - protein, 63 aa, Glycine max
  Coding DNA Sequence Number=SeqID_52430
MQQGQADILIARFPDPNYGVKTLIVAMGDGESAWDFRNGFARKQEEEMTFFLSYTKAKTEVLK

SEQ ID NO: 144116 - protein, 50 aa, Glycine max
  Coding DNA Sequence Number=SeqID_52431
QFRAEVAWPGDWPEAQAGEAPTEAHGDAEEARIDEEMKNLLGFLGGSGAT

SEQ ID NO: 144117 - protein, 139 aa, Glycine max
  Coding DNA Sequence Number=SeqID_52432
TASGDVVPINLEIEDTCRRSNAARRRREQDTEGSSYTSPPLSPHHAKMDGEPARRVTLEDFSNTATPHFFTSIAKPEVQAANICYPHSLIQLIQGNLFHGLPSEDPYAHLASRGKTMVALFRRKQLKNLGRSSGKVLKE

SEQ ID NO: 144118 - protein, 64 aa, Glycine max
  Coding DNA Sequence Number=SeqID_52433
MVAFLLRGMIALHSSFGFFLVFAPKVLEELSTICFANWPSGMEKEEREEMPLQGEDESRRSSPP

SEQ ID NO: 144119 - protein, 155 aa, Glycine max
  Coding DNA Sequence Number=SeqID_52434
  Subcellular localization annotation: CTP_CleavageSite=34; ConfidenceScore=5.10e-01
MSNHKSIESALKNLKVQVGQLAKQIANKSSNSFVANTKHNPKEECKAVMTRRKRFVEAEDEDGVVHKKKIADKKGTDGKKNEVRGENDDKGDDKKLKGQSKNEFKIFKIESRTLQDSRGKLISRIKNQDSRDQESRIKIQEIKIQDSRFKNQEKA

SEQ ID NO: 144120 - protein, 111 aa, Glycine max
  Coding DNA Sequence Number=SeqID_52435
WATGDGVLMSGLVEMGYLFCAIARSPPSTTYDGVVPEDMSRGSRDLGDVRWGAIAQNQARPIPTQLGHSQLVRTCDVPKQASSWQSTNKGTKVHEVGRLGLKIETERSVAI

SEQ ID NO: 144121 - protein, 376 aa, Glycine max
  Coding DNA Sequence Number=SeqID_52436
  Gene Ontology: Mol. function=oxidoreductase activity; Cellular component=cytoplasm; Biological process=cell redox homeostasis
  Homolog annotation: Hit_ID=Q0K0C7; Match level="QueryCoverage=97%, HitCoverage=80%, E-value=6e-93, Identity=46%"; Hit description =Dihydrolipoamide dehydrogenase
  Pfam annotation: Domain name=Pyr_redox; Domain location=111-206; Score=96.8; E_value=6.7e-26; Accession=PF00070.18; Description =Pyridine nucleotide-disulphide oxidor
  Pfam annotation: Domain name=Pyr_redox_2; Domain location=1-252; Score=38.4; E_value=2.5e-08; Accession=PF07992.5; Description =Pyridine nucleotide-disulphide oxidore
  Pfam annotation: Domain name=Pyr_redox_dim; Domain location=282-376; Score=38.4; E_value=1.9e-08; Accession=PF02852.13; Description =Pyridine nucleotide-disulphide oxidored
  Pfam module annotation: Pfam domain module=Pyr_redox::Pyr_redox _2::Pyr_redox_dim; Domain location=111-206::1-252::282-376
MWDISHAEEFGIHVPQSGKVDMKKIKERKEAIIEEDRNSIEKGILDNENITLYKGEAHFVSNYEVIVNSELLTSKNIFINVGSRPYISEEYKHIPYFTNENLLKTIDLPEHLIIIGGSFIGVEFAQMFKRFGSRVTIVNRGSRIIQTEDNEVSSEVAKILESEKVDIILNADYIQVTENENSSITVVLNKEKTVSVTGSHILLAIGRIPNTDTLQLYNTDIKINHRGFIEVNDYCQTNVPGIFAMGDCNGKGAFTHTSYHDYQVVESFLFGTKLRKVSDRIVTYSLFTDPPLGRVGMTKHQALEKGYNVLIAHRPMNRIKRAKVKGEVKGFIQIIIDADTNLFLGASILGVGGDEIISVLTNLMYAKQPYTVLRDT

SEQ ID NO: 144122 - protein, 207 aa, Glycine max
  Coding DNA Sequence Number=SeqID_52437
AAVSPAKPPQKSYPKIDDPLYLMTLTILELFLRPYQIKHEDLSEIAHGGQCLNILVLQLWIMHLTKTSMRAGNYDLYGFLEPQSIQRSRQSQFKAESYIKSWMQSSKRDVYLGAYLNGGHWQMVVIMPKEHLVVWFCSLHNRTDNYLKGIINSALKGLNDAPQPKSKAYARWIVVKYFNDPRPLEPERLKALQIQWAQYYLRVRAES

SEQ ID NO: 144123 - protein, 92 aa, Glycine max
  Coding DNA Sequence Number=SeqID_52438
MVLRAAPARMVSEYSPNLDGATDDAPFGLAGVVSFDAPDDDDDDGEGVVAAGEMVGVVADVDGDGGDVAGARVFGGVAIEGGWEMGEGGVGM

SEQ ID NO: 144124 - protein, 203 aa, Glycine max
  Coding DNA Sequence Number=SeqID_52439
MERSMIDAASGGALGDMTPVEARNLIEKMASNSQQFSARNDAIVLRGVHEVATDSSSSTENKKLDGKLDALVNLVTQLCMNQKSAPVARVYGLCSSADHHIDLCPSLQQSGVNEQPEAYAVNIYNRLPQQKNQQQQNNYDLSSNRYNPAQENDFKIESRTIQESRERFKRKFHQEDSRFKNNQDQDSRLKDSRIKRRLNQDKY

SEQ ID NO: 144125 - protein, 163 aa, Glycine max
  Coding DNA Sequence Number=SeqID_52440
  Homolog annotation: Hit_ID=UPI0000ECBAF8; Match level="QueryCoverage =25%, HitCoverage=48%, E-value=1e-16, Identity=100%"; Hit description= UPI0000ECBAF8 related cluster
MRKRHASRREKGGQGIRGGGAYGKTPATRPFYGSWPFAGLLLTCSFLRYPLILWITVLPPLSELIPLAAAERPSAASHITGKANLEKSDLEPALKAPKDRLMTKNVSRPAGMQAWHWPSFYNVVTGKTLALPNLIALQHIPLSPAGVIAKRPAPIALPNSCAA

SEQ ID NO: 144126 - protein, 236 aa, Glycine max
  Coding DNA Sequence Number=SeqID_52441
MTTLTQIWMTLLLSNILPTDHNSDLPLPKCQLVYAILTRMSVHVAQLIADAIYIFAGMAPTRHPLDLDKSNRALGFPALITGLCQSFGVPVAPTKVIRPPITRAFIEKYCTQRQAQGDAPQAAGAPPPPHQAGPAGSFDMEQYLRHLVRQQAANHRAHVQTHDCLYQMSLSMQSQGFASFSCPTPDQFRAEVAWSGDWPEAQAGEVPPEVPGDGEEAHEDEEMADLLDFLGGSGAT

SEQ ID NO: 144127 - protein, 101 aa, Glycine max
  Coding DNA Sequence Number=SeqID_52442
VTFFEDTPFFLASVDHSSSLQEVLPIPCPLGNSDQNVNEVPSSLPNSIEVVSPPLLTYHHRTRPADSTVPEASPRDSHPSPTSPPTMDPASSPVSHHSESD

SEQ ID NO: 144128 - protein, 261 aa, Glycine max
  Coding DNA Sequence Number=SeqID_52443
  Gene Ontology: Mol. function=ATP-dependent helicase activity; Cellular component=intracellular; Biological process=double-strand break repair via homologous recombination
  Homolog annotation: Hit_ID=A7QCM0; Match level="QueryCoverage=30%, HitCoverage=58%, E-value=4e-20, Identity=60%"; Hit description =Chromosome chr12 scaffold_78, whole genome shotgun sequence
DAGSRQARQGASAGVGGCRGWLNYAASEQIVLRVHHMRAIGAGLFAITPAGERGMCCKAIKLGNARVFPVTTLSTLEDPPNYTGQINKSSNCMAVDIDDDDSLFKNIDVDQIVEDYCTPKPSISKLPPITPTADKDNFARQGDDVLPPELCLDCVHGYMLGFCPEAASHLQDMKDNLIAIFNELLDNGENLNSTQIGYRARIRNHGHSCFLRETCRASCINESANARGEAVCVLGALPLPRSLTRCARSFGCGERYQLTQR

SEQ ID NO: 144129 - protein, 69 aa, Glycine max
  Coding DNA Sequence Number=SeqID_52444
MAHQISKELIQGRLIWVEAYKNKMPKSSPNMHVKQEVSTRVKPRLLCKQSMGQNTQNKIDDDDSNSHQG

SEQ ID NO: 144130 - protein, 202 aa, Glycine max
  Coding DNA Sequence Number=SeqID_52445
  Homolog annotation: Hit_ID=Q5CDC4; Match level="QueryCoverage=13%, HitCoverage=21%, E-value=2e-07, Identity=100%"; Hit description =LacOPZ-alpha peptide from pUC9
MTLTYKNRRITRPFRLARFGDDADAGSRQARQGASAGVGGCRGWLNYAASEQIVLRVHHMRCEIPHRCVRRKYRIRRHSPFRLRNCWEGRSVRASSLLRQLAKGGCAARRLSWVTPGFSQSRRCKTTASAKLACLQVDSRAIPSRPAATGRTPRCCGRCRAAGSARGWGTELEFVIMVIAVSCVKLLSAHNSTQHTSRKHKV

SEQ ID NO: 144131 - protein, 66 aa, Glycine max
  Coding DNA Sequence Number=SeqID_52446
MAAQLIHDRVVMECLKGVWETLKGNESTSGGTCTHTSAACGVDTTYTYSISTSGASSSHRGCGVPK

SEQ ID NO: 144132 - protein, 141 aa, Glycine max
  Coding DNA Sequence Number=SeqID_52447
MHKALRANAPLPYPYLITLFLHHFQIPLDDEPFLQVKRSFAIGAGAVTSFGYRKDRNGQWLKKDALPPQDERTPSPPPHCDDSALMNEVLSELRGLRSYVCDHFDSLDTRFAGMDIRLTQLEEDVGYICQSFDLPPPPPSS

SEQ ID NO: 144133 - protein, 99 aa, Glycine max
  Coding DNA Sequence Number=SeqID_52448
MWTTTGEKLAAQLAQASKVASSRSNSLLEGPSGPAFEEVTETHGLPKDTSFRLLPHYGISRIAQTYFLLISETSRDFIYCATKDAKYLKAANQRLHVIK

SEQ ID NO: 144134 - protein, 192 aa, Glycine max
  Coding DNA Sequence Number=SeqID_52449
  Pfam annotation: Domain name=Transposase_23; Domain location=65-130; Score=-8.8; E_value=0.011; Accession=PF03017.5; Description =TNP1ENSPM transposase
DVLTAAIGHPEHPGRVRAAGAGVTIKQYFGSAPQTKSDAAAHGIIQPDAVPDLVPDAISGTCTASRASGWSLRSCPLVAMGRVYEGSIVVHNTPLLPGQVKVGVEEVTDADAPVPIPTYEVSLVGQAVVSLEKPPQKPYSEVDDPLYLMTLTIPELFLRPYQVTWDATVFGVFNPYFPLYIKHEDLYEITHG

SEQ ID NO: 144135 - protein, 89 aa, Glycine max
  Coding DNA Sequence Number=SeqID_52450
MAYTLHSGIYTRNSPQISASPHQLDLAPYASEPYHAQWNAPGLLRDKHTLRSSRILGEMEVDEPWLGLWLPLNYQVDMGASQHRTLELG

SEQ ID NO: 144136 - protein, 165 aa, Glycine max
  Coding DNA Sequence Number=SeqID_52451
  Homolog annotation: Hit_ID=A5AZ88; Match level="QueryCoverage=84%, HitCoverage=13%, E-value=8e-07, Identity=27%"; Hit description =Putative uncharacterized protein
MRPQTNELLDASAGGKIKLKTPEEATKLIENMLASDHAILRDKTHQPTKKSLLELSSHDAFLAQNKLLSKQLESLVEALGCTICGEAYETGQCNPIEENTQEIHYMGNQQRQGYTPGGFSGFQQGPYSQQGQWRSHPAISSTKIRVDLRIGQSNKGLTSFKGLLS

SEQ ID NO: 144137 - protein, 118 aa, Glycine max
  Coding DNA Sequence Number=SeqID_52452
MKGRTSIDKWQRRTQQRRTPQCAYSDGRAGQFAAKTKLGERRKKKNNRVQARGVCSFSSIGACRPRIFFINGFICFLEDEWQWNGEGREREETPLQGEDESRRSSPPYEERERRRHIF

SEQ ID NO: 144138 - protein, 121 aa, Glycine max
  Coding DNA Sequence Number=SeqID_52453
MGDQEETQEQMKDDMSALKEQMASMMEAMLGMRQLMEKNVATAAAVSSAAKADPTLLAIAHHPPPNAVGQERSTLGHSNNPHLGYNQVAYPYGLPPNYTLPVIHDDAGHVPSLILEGEPPR

SEQ ID NO: 144139 - protein, 190 aa, Glycine max
  Coding DNA Sequence Number=SeqID_52454
  Subcellular localization annotation: CTP_CleavageSite=67; ConfidenceScore=5.18e-01
YNPGWRNHPNLRWSNPQQQQQQPAPSFQNAAGPSRPYIPPPIQQQQQPQKQPTVEAPPQPSLEELVRQMTMQNMQFQQETRASIQSLTNQMGQLATQNSDKLPSQAVQNPKNVSAISLRLGKQCQGPQPVAPSSSANEPAKLHSTPEKGDDKNLPNNFCAEAAHSPSSIPSKSSFQQKNGRGRERDIGNV

SEQ ID NO: 144140 - protein, 125 aa, Glycine max
  Coding DNA Sequence Number=SeqID_52455
MSNHKSTESALKNLEVQVGQLAKQIADKSSNSFVANTEKNPKEKCKAVMTRSKRFVEAEDEESVVPKKKAAEKKGTDEKKDYVICESNQEKEKQIMNDERSRSEQAREKKKEKAVNDGVEVPYPV

SEQ ID NO: 144141 - protein, 151 aa, Glycine max
  Coding DNA Sequence Number=SeqID_52456
  Gene Ontology: Mol. function=receptor activity; Cellular component =integral to membrane; Biological process=defense response to fungus
  Homolog annotation: Hit_ID=A7PBD9; Match level="QueryCoverage=90%, HitCoverage=16%, E-value=3e-34, Identity=50%"; Hit description =Chromosome chr16 scaffold_10, whole genome shotgun sequence
  Pfam annotation: Domain name=LRRNT_2; Domain location=21-63; Score =37.9; E_value=3.6e-08; Accession=PF08263.3; Description=Leucine rich repeat N-terminal domain
  Pfam annotation: Domain name=LRR_1; Domain location=121-143; Score =14.3; E_value=0.46; Accession=PF00560.24; Description=Leucine Rich Repeat
  Pfam annotation: Domain name=LRR_1; Domain location=96-118; Score =10.5; E_value=3.5; Accession=PF00560.24; Description=Leucine Rich Repeat
  Pfam module annotation: Pfam domain module=LRRNT_2::LRR_1::LRR_1; Domain location=21-63::121-143::96-118
MKNGSILGFNSLPNSTEIKCIETERQVLLNFTHGLIDDFDILSTWRDDHSNRDCCKWKGIQCNNQTGHVEMLHLRGNGTQFLSGAINISSLIALENIEHLDLSSNDFEVSHIPELMGSFTNLRYLNLSDSLFGGSIPSDIGKLTHLLSLDL

SEQ ID NO: 144142 - protein, 285 aa, Glycine max
  Coding DNA Sequence Number=SeqID_52457
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=24%, HitCoverage=68%, E-value=7e-33, Identity=97%"; Hit description=LacZ protein
MRKRHASRREKGGQVSGKRQGRNRRAHEGASRGKRLGAGAYGKTPATRPFYGSWPFAGLLLTCSFLRYPLILWITVLPPLSELIPLAAAERPSAARNSYDHDYEFELGTHPPLVHLGHITIDHQYHGSTPTQPPSDLLFSAPSLLLALMVQLQLHIHSSTALSRKSWFDRDGWMNHIRGGRRQRLQSCMGDPLESTCRHASLALAVVLQRRDWENPGVTQLNRLAAHPPFASWRNSEEARTDRPSQQLRSLNGEWRLMRYFLLTHLCGISHRIWCTLSTICSDAA

SEQ ID NO: 144143 - protein, 291 aa, Glycine max
  Coding DNA Sequence Number=SeqID_52458
  Subcellular localization annotation: CTP_CleavageSite=24; ConfidenceScore=5.29e-01
MAESSRKCKESSTSVAATRTPRPRATGASPTPIPPSLSSSTLFSFDEQRIHQGAPFEGTIIDNWKFDYSSLDARRMACNDQVDMTGRLLAGSLTFDCRIMHYIIVRILLPKPSNLAQASEEDLILMWAFLIGRSIDWAYLIRYRMHKALRSNAPLPNPHLVTLFLHHFQIPLDNEPFVKVKRSFAIGVSAVTSFGYCKDMDGQWLKKDAQPPQDEHTPSPPPQRDDSSALMHEVLSDLCGLRTYVGERFDSLDGRIDAIDARFAGMDTHITQLEEDISYVRQCFDLPPPSS

SEQ ID NO: 144144 - protein, 70 aa, Glycine max
  Coding DNA Sequence Number=SeqID_52459
MGEWELYTLKLQRQVPAEVGDLSYPYEDRTFKAAQVAVVDFHERDLARSLIVFAHNHGDSAFAEMETPFC

SEQ ID NO: 144145 - protein, 64 aa, Glycine max
  Coding DNA Sequence Number=SeqID_52460
MYFPLTGGSVLDNGGRMNNARLDGGGCMNDNQFMGLWIRFDGGGCMNNTRQSIHGVPDSMVEDA

SEQ ID NO: 144146 - protein, 191 aa, Glycine max
  Coding DNA Sequence Number=SeqID_52461
GHPGKILKKDRTTLAQVWSVLLYSNLAPTSHTFDLTVDKARLIFGLVSRLDMNIGTLIFGQMTSIAQSNTSRLRLPALITTLCRARGDVSDSLTFERLSPDESSEATIPDPFVIREEAGETQATSEPSTQGEDIPSPQHATDPSTPLLEMLEDPTTLVLAMDTSPPATPVLHLTDEEDVQTRDPQDQSQES

SEQ ID NO: 144147 - protein, 208 aa, Glycine max
  Coding DNA Sequence Number=SeqID_52462
  Gene Ontology: Mol. function=aspartic-type endopeptidase activity; Cellular component=small subunit processome; Biological process=DNA integration
  Homolog annotation: Hit_ID=A5CB76; Match level="QueryCoverage=100%, HitCoverage=75%, E-value=2e-41, Identity=41%"; Hit description =Putative uncharacterized protein
MASSGPVLSFSGTPTITTAKLNWKNYLSWSASVELWFLGQGHHDHLEKAAEEVPIDKRPEWEKLDYQLCAVLWQSVEPDVLEILRSFKTCCSFWKKAREIFANDIQSLFDATMKVTALKQTNHDMIAHIGKARAAVEELKRFLVADSLEEVNRKLDKYYMVLILRSLHSDFDHVRDQVLAGDQVPSMDSLITRLLRVPHALKEDNPAE

SEQ ID NO: 144148 - protein, 119 aa, Glycine max
  Coding DNA Sequence Number=SeqID_52463
MDSRDGGYCRAVVGVSVAGCYYWSCPSSFVCLGMQYFSMNDLLMGDKLGYTNTDLGQNSINQLAFRQPEIRVMVVGKDVAEEKHHSDLCLGGHASAHDPHPPWIFFINGVLCFLKFNGN

SEQ ID NO: 144149 - protein, 106 aa, Glycine max
  Coding DNA Sequence Number=SeqID_52464
  Homolog annotation: Hit_ID=A6FJQ2; Match level="QueryCoverage=35%, HitCoverage=84%, E-value=2e-11, Identity=92%"; Hit description=50S ribosomal protein L5
MTVKTSDTCSSRRRSQLVCKRMPGADKPVRARQRMRKEKIPHQAPFAIQAAQLLGRAIGAGLFAITPAGERGMCCKAIKLGNARVFPVTTLSNDGQCQACMPAGRL

SEQ ID NO: 144150 - protein, 120 aa, Glycine max
  Coding DNA Sequence Number=SeqID_52465
MPGADKPVRARQRVLAGVGAGLTMRHQSRFVLRVHHMRCEIPHRCVRRKYRIRRHSPFRLRNCWEGRSVRASSLLRQLAKGGCAARRLSWVTPGFSQSRRCKTTASAKLACLQVDSRGSP

SEQ ID NO: 144151 - protein, 75 aa, Glycine max
  Coding DNA Sequence Number=SeqID_52466
MKRETLDGNQHTPFAIQRPESPVACGDTLQLSAPRHLETPSRIDKQRPMWSSAPFPEMSASSDRDYFSLTEARTT

SEQ ID NO: 144152 - protein, 73 aa, Glycine max
  Coding DNA Sequence Number=SeqID_52467
  Homolog annotation: Hit_ID=A5C2U3; Match level="QueryCoverage=54%, HitCoverage=3%, E-value=2e-09, Identity=70%"; Hit description =Putative uncharacterized protein
MSIRCDSQATLAKAYSQVYNGKSRHLGVRHNMVRELIMHGARKKRTTYISMKFSRFKKLGLGFDMLMKDRDTG

SEQ ID NO: 144153 - protein, 155 aa, Glycine max
  Coding DNA Sequence Number=SeqID_52468
MRSQSKSGRKKKEKKENPNQSNGRKWKKRMEVLSPFTSLEPKSLTHHKPSLGSIVCHSKKKEREFPIKEKAKKEGKEIPNQRESKNRRKGTTETFSSLTSYPELRRSEFLIGGYVGAKASLLSNRAAFCYHDPRAGSPRRHLTVIRTSSFSEPQV

SEQ ID NO: 144154 - protein, 99 aa, Glycine max
  Coding DNA Sequence Number=SeqID_52469
  Homolog annotation: Hit_ID=A5AYU6; Match level="QueryCoverage=86%, HitCoverage=15%, E-value=9e-12, Identity=43%"; Hit description =Putative uncharacterized protein
MSLATLFGKLQEHEMELQRLNQNEKEQAYVCLMTKNHESDEEDSLKKKWYIDSGFSKHMTGDVSKFTTISPKKSGHVTYGDNNRAKTTILNYGIKGSLT

SEQ ID NO: 144155 - protein, 104 aa, Glycine max
  Coding DNA Sequence Number=SeqID_52470
MRHQSRFVLRVHHMRCEIPHRCVRRKYRIRRHSPFRLRNCWEGRSVRASSLLRQLAKGGCAARRLSWVTPGFSQSRRCKTTASAKLACLQVDSRGSPALSHGWK

SEQ ID NO: 144156 - protein, 45 aa, Glycine max
  Coding DNA Sequence Number=SeqID_52471
MGGYIPCGSLLVVMQSYPARALDKKLQVDWARDAREGPRVLMSLR

SEQ ID NO: 144157 - protein, 179 aa, Glycine max
  Coding DNA Sequence Number=SeqID_52472
MASYGGELLLDSSSPGNGVSSLSSFSILLPFIFQEAKESIDEEVPRPTSSNGAYIKYNQSNNEDPTHECCFGWCLQSSFFHLHSAAIDLQEEKDSIDEEYPRPTSSTWSYIKKLVASQELGWFYGELSSLLGTELLYGSSSYEELKNTWLVSPMTKPGVVLWRGDVESLVGGWQGKSSK

SEQ ID NO: 144158 - protein, 84 aa, Glycine max
  Coding DNA Sequence Number=SeqID_52473
MTNEEHQTENDVEDDYSRDSAAPRPYFLFFLLLLPSFSQNLSMLNAGTLYSTSLMPIYSKKWPLEQMAARPSELMLHLEVTGSA

SEQ ID NO: 144159 - protein, 66 aa, Glycine max
  Coding DNA Sequence Number=SeqID_52474
MEFCSLLWYLVQNVEQLSIIQAAPFGACRPWIFFINGVPCFLKMNGCGMEKEERDDWRRHFKEKMS

SEQ ID NO: 144160 - protein, 178 aa, Glycine max
  Coding DNA Sequence Number=SeqID_52475
  Homolog annotation: Hit_ID=A5BRB9; Match level="QueryCoverage=57%, HitCoverage=51%, E-value=3e-09, Identity=33%"; Hit description =Putative uncharacterized protein
MTRGNPSDLQPFDPVIDRTFHRLVRHHFIPFDHSEHSITGESVHSVIGDFEHPDLEHYNFEHSDSEHSDFAHFENMAQPPPRERTLREMAAPDFTYESLCIQYPDEDVPYVLKTGLIHLLPKFHGLAGEDPHKHLKEFHIVCSTMKPPDVQEDHIFLKAFPSFIRGSGKGLGCITLLQ

SEQ ID NO: 144161 - protein, 228 aa, Glycine max
  Coding DNA Sequence Number=SeqID_52476
  Gene Ontology: Mol. function=long-chain-fatty-acid-CoA ligase activity; Cellular component=membrane; Biological process=fatty acid metabolic process
  Homolog annotation: Hit_ID=A8GFH1; Match level="QueryCoverage=100%, HitCoverage=39%, E-value=1e-122, Identity=93%"; Hit description=AMP -dependent synthetase and ligase
  Pfam annotation: Domain name=AMP-binding; Domain location=1-151; Score=-117.5; E_value=0.017; Accession=PF00501.19; Description=AMP -binding enzyme
MSVQKAVAEKWEKTTGKHLLEGYGLTECAPLVAGNPYDLKHYSGSIGLPVPSTDIRLLDDNGQDVPPGEPGELWVKGPQVMLGYWQRPEATDEVLKDGWLATGDVVTVDEQGFVRIVDRKKDMILVSGFNVYPNEIEDVVSQHPKVLECAAIGVPSEVSGETVKICVVKKDASLTKEELLTHCRRHLTGYKVPKIVEFRDELPKSNVGKILRRELRDELKTPKPADAA

SEQ ID NO: 144162 - protein, 86 aa, Glycine max
  Coding DNA Sequence Number=SeqID_52477
MGEVEEVQEKVKADMEAMKGQMAMMMETMMIMKKIMEASAVAVAATSTVAKVNLMPQSGLNQMNHPTSTMVGKDLGSMGGPHDVQI

SEQ ID NO: 144163 - protein, 122 aa, Glycine max
  Coding DNA Sequence Number=SeqID_52478
MSKNGRKPSRNYSRKRYGSASAWIFFTETIFLGNFERIRSAKKVEPLPPSFLPLYNSKIGEELATQLAQASKVASSRSNRLLEEETGRPNFRRSYGTDCAKTPLFNFRHITEFHGSRKPASL

SEQ ID NO: 144164 - protein, 58 aa, Glycine max
  Coding DNA Sequence Number=SeqID_52479
  Homolog annotation: Hit_ID=A5B6Q8; Match level="QueryCoverage=94%, HitCoverage=4%, E-value=7e-09, Identity=58%"; Hit description =Putative uncharacterized protein
SEASPPDSHPSSINPQAMDPATSHPSDSDWPIVIRKVKVGPNGEIDRLKARLVAKGYT

SEQ ID NO: 144165 - protein, 403 aa, Glycine max
  Coding DNA Sequence Number=SeqID_52480
MPKKQKKVKQFEPEPSVTVEGGEPGRKKKIKTKSSKEQGENQPVDVQPPSTDVDGTEAENTPSIAEMGNPVEQPDLPQEQPTVEVQQNASVEEIPSCARTSPAPETDAVNVEEQGEGQEAIQEAEAGGSDIYPASSTSKLSASVGIAEETFIKMQDEDPAAALRLLLNTSQANTSSEKIPGASSSSDADITSSVRQDCLLLKLSMEYAREDVLKSIEENPSAAFGHLNFLKKLHNPLTSDEILGKVIQIEAIIDQFASTVQKKRENDARLDAQKQAHILLLEKAQTAQHEVERLTKEAKEGSSEIKACDDNISSWEATIMDLLSQVDDLRQKIVTEQAKRKELQEKAAHSIQKLIAEKGREGLKAFSASQAVADEARAMESADQVLSKEMATLKKLYEDLVMH

SEQ ID NO: 144166 - protein, 148 aa, Glycine max
  Coding DNA Sequence Number=SeqID_52481
  Homolog annotation: Hit_ID=Q6L477; Match level="QueryCoverage=72%, HitCoverage=17%, E-value=2e-08, Identity=28%"; Hit description =Putative uncharacterized protein OSJNBa0009L15.8
GHAKPHVYDRCPTRPPGAERLVVHVDPATGKADDPHKKKLRTYLGIVVRDKVDVTYENWKKVPTTQKDLIWEDIPVEFDILEASDSRTKRKLLQTMGERSSQFKSDLTRKWALVADQDEVEDTVCEKYDISKEKWAQFCQTRRDPSWE

SEQ ID NO: 144167 - protein, 70 aa, Glycine max
  Coding DNA Sequence Number=SeqID_52482
MQSQGFASVSGPTPDQFRAEVAWPGDWPEAQAGEAPLEAPGDGEEAHEDEEMADLLDFLGGSGDTAYIFV

SEQ ID NO: 144168 - protein, 83 aa, Glycine max
  Coding DNA Sequence Number=SeqID_52483
MWLCSLPRNQANRSSPRPCGCLYCLGLKTISGPCDLCLELIRSRAWKSGKTLALQAEAELVEAVMGLHVCPVVGRLLVNRGIL

SEQ ID NO: 144169 - protein, 67 aa, Glycine max
  Coding DNA Sequence Number=SeqID_52484
MALVLSHFMGIWICAQQLPAEMYSASAVDNANTILLLAIPRDKSRPYELTCATSALPICFRSGKIRI

SEQ ID NO: 144170 - protein, 104 aa, Glycine max
  Coding DNA Sequence Number=SeqID_52485
  Gene Ontology: Mol. function=2-oxoglutarate decarboxylase activity; Biological process=menaquinone biosynthetic process
  Homolog annotation: Hit_ID=A7PNB6; Match level="QueryCoverage=53%, HitCoverage=13%, E-value=1e-11, Identity=48%"; Hit description =Chromosome chr1 scaffold_22, whole genome shotgun sequence
MVCHIVGQCFVMCFFMFLVIPIDVFEGITDEGVAKVVDGLALKVVDEGVAKVVDEALSSESALFLGNSMPIRDANIYGSANKGASGIDGLLSTTIGFAIGCNKK

SEQ ID NO: 144171 - protein, 133 aa, Glycine max
  Coding DNA Sequence Number=SeqID_52486
MTQGSFVPQGRDNILNTTIGRPDHGGHVRAAGSGVGGHHVPPMAEIIGSIREQVKNEIEEEKRRSLETWKKKLKDANIIEMSQKGSQVATPTHVDINVLGARVSTKESNAKIGVNPSGEEQVGHVTPTMGLYV

SEQ ID NO: 144172 - protein, 126 aa, Glycine max
  Coding DNA Sequence Number=SeqID_52487
  Gene Ontology: Mol. function=binding
  Homolog annotation: Hit_ID=A7NW29; Match level="QueryCoverage=75%, HitCoverage=19%, E-value=2e-21, Identity=51%"; Hit description =Chromosome chr5 scaffold_2, whole genome shotgun sequence
  Pfam annotation: Domain name=PPR; Domain location=83-116; Score=17.5; E_value=0.049; Accession=PF01535.11; Description=PPR repeat
MFPINFDTADLRLTKLGGGNFNLYGGGQQCRMLGTSQGLKELDEAIELFEELDSNNNVPLGNFNEACNLLERQNRKGCIPNLIAYNCILTCLGRKGKVEEAFTILEAMKMDAATNLTSYNILIHRL

SEQ ID NO: 144173 - protein, 79 aa, Glycine max
  Coding DNA Sequence Number=SeqID_52488
  Subcellular localization annotation: CTP_CleavageSite=48; ConfidenceScore=5.19e-01
MRVHCYQASRRPNMTTDSPPLLMFPWTRRSRQLSQPTLRRDGDAGLTGASSKKGKCAESPPTFIRGKHRKNQKGVVYKL

SEQ ID NO: 144174 - protein, 57 aa, Glycine max
  Coding DNA Sequence Number=SeqID_52489
MDILTLVSSIELFDTDTKREGQKGLFRVFSGPQLAQASLWLAWALKWLRVEVTSSLG

SEQ ID NO: 144175 - protein, 164 aa, Glycine max
  Coding DNA Sequence Number=SeqID_52490
MFSRCPYRTRDRGRVMGKVEEVQEQMKVDMEAMKEQMATMMKAMMSMKKIMEANAVVVAATRAVAMVNPMPPSDLNQMNHPTSDMVGKDLGSTDDPMMCKFKTSTPSRHMACLPTIRHPMWRTLPMRRMSITPFLYPLRANNPKLIMHMSLKPWGRHMKFPTTI

SEQ ID NO: 144176 - protein, 115 aa, Glycine max
  Coding DNA Sequence Number=SeqID_52491
MVPEIGTSFCLRGSPKLPLGTPSPLDHGLAVPPSRSTRKKRKGLVIDYQRLPKFPDFVFKPGNRLHPLELACLGTSQVLTDRLCPGWVGIGQAWFWAIAPHLTSPRSPDPRDISP

SEQ ID NO: 144177 - protein, 62 aa, Glycine max
  Coding DNA Sequence Number=SeqID_52492
MENWRKALRNNFAGLSRLEELGNDIRGSPNKSGEWRIGGQRYAITSHGSRLEGGECMNSARQ

SEQ ID NO: 144178 - protein, 111 aa, Glycine max
  Coding DNA Sequence Number=SeqID_52493
  Subcellular localization annotation: CTP_CleavageSite=32; ConfidenceScore=5.46e-01
MVGMSPPPLGPLNHSQTQLTLSGRLPFPALVSVDLRTTKSLKLSGIWTSLSLSRIEDMQKLLKKNGQTPPLNLISGLNRWLCSCSFFLALSRGGLHSEDGSLSQQISLARR

SEQ ID NO: 144179 - protein, 127 aa, Glycine max
  Coding DNA Sequence Number=SeqID_52494
  Homolog annotation: Hit_ID=A5BEV8; Match level="QueryCoverage=68%, HitCoverage=12%, E-value=7e-09, Identity=35%"; Hit description =Putative uncharacterized protein
MDEDQWMYERIMPEEVDMDDENEEECGVNEPHVDCSDAFNTSQVFDSQEYVLRWARSVAYENGFVAMIVRSDTNTGSRGRTSFVLIGCERSGEYRCRKKGFVRRDTETRKCRCPFKLHGKPVVGGQG

SEQ ID NO: 144180 - protein, 27 aa, Glycine max
  Coding DNA Sequence Number=SeqID_52495
MDKSLKVGEDDWRQRERRGHKIYASNE

SEQ ID NO: 144181 - protein, 254 aa, Glycine max
  Coding DNA Sequence Number=SeqID_52496
  Homolog annotation: Hit_ID=Q2HW90; Match level="QueryCoverage=65%, HitCoverage=38%, E-value=2e-13, Identity=31%"; Hit description =Putative uncharacterized protein
MGQLQRQAFRKVYGKIWDLARVEVSMEPIASLSQYYDQPLRCFTFEDFQLVPTVKEFEEILGCPLGGRKPYLFSGFYPSTTRVAKYQGSAWRKGQRPWKIKANGLSFIDILALLIFGVVLFPNMEGLVDLAVIDASLAFHHGKESPVVAILAMYDTLDRRCEKSDARIVVYTGSLCVTGFAPFFQEVTTTRGYSKEFARHGMRREERTESLGEATVRDDEVKASEESDEVQALKAELERAWVVEEKFKSIAIKV

SEQ ID NO: 144182 - protein, 66 aa, Glycine max
  Coding DNA Sequence Number=SeqID_52497
MEEVLIPSSNVNTTPESRIFFMTGFLRFFRRFPQINVGGDSVLFPPLEDAPVSLASLARKRVGCDS

SEQ ID NO: 144183 - protein, 314 aa, Glycine max
  Coding DNA Sequence Number=SeqID_52498
  Gene Ontology: Mol. function=nucleic acid binding
  Homolog annotation: Hit_ID=Q2HTA0; Match level="QueryCoverage=84%, HitCoverage=47%, E-value=5e-22, Identity=30%"; Hit description=IMP dehydrogenase/GMP reductase, related
  Pfam annotation: Domain name=DUF1723; Domain location=50-99; Score =60.2; E_value=6.9e-15; Accession=PF08330.1; Description=Protein of unknown function (DUF1723)
MICTSIQERPELKLVSHGRKVALIGRPVPAIEGLVVATGLSPLIECSVVTDDPGLISAFVERWHRETNTFHLPVGDLAITLDDVSSLLHLPISGAFHSFEALSVDEVVFLLMEFLEVSGEEARAETAFRDLGQSGGYAWGAVALVHMYDQLDEASWTTTRQIGGYLTLLQCWIYEHFLSVHQCVTDDAYEETSPHASRWLTTKAHMKGITGAPYRAHCDAFTVTDVCWFPYSDHRGVRGFELISSFQGQLRWGPTVVAVRPKRVLCQFGYIQSIPPSPVSVSLSYDDIDDRWMHFMHFSDHVVAVGDLCVVLGQ

SEQ ID NO: 144184 - protein, 108 aa, Glycine max
  Coding DNA Sequence Number=SeqID_52499
MHSMRFLLCQYLLAKVCDIYPRIELANGQTKYAKYSDSKSIQMPKLRRITMTRVTSKMTATATKSISLKPLGRDGTVRHHLAEEIPIVVPRYAVKPMARVTLESTDQR

SEQ ID NO: 144185 - protein, 308 aa, Glycine max
  Coding DNA Sequence Number=SeqID_52500
  Gene Ontology: Mol. function=helicase activity; Biological process =viral genome replication
  Homolog annotation: Hit_ID=Q9LTU4; Match level="QueryCoverage=98%, HitCoverage=22%, E-value=5e-94, Identity=51%"; Hit description =Helicase-like protein
MLEQPKELRVDKFYSLQQSSEAGNTEGLGQGKRIILPSTFVGSPRYMDQLYFDGIAICSHVGFPNLFITFTCNPNWLEIHRLLTPLNLTPIDRPEIISRIFKLKYEQMLLDLTKNHLLGKVVALEFQKRGLPHVHLLLFLHANNKYPSPNDIDNIISAEIPSQKDDPELYKLVQNHMIHGPCEILRPASPCRKEGKCSRFYPKKFQPTTLIDGDGYPVYRRRNTGQTITKNGIIIDNRCIVPYNPRLLKKYQAHINIEWCNQSTSIKYLFKYINKGYDRVTAVMVHDDNETVSHANTPNDEIKEYLDC

SEQ ID NO: 144186 - protein, 157 aa, Glycine max
  Coding DNA Sequence Number=SeqID_52501
MTQELVARGDTLRLSAPRHSVTPSVIDEQRPMWSSAPFPEMSASSDTVVSDGTQRQNLVILHPLSSRGGGPDDMRRQNLVIPHPFAIQTQSCPMARRDKIWSFCTLCHPEAVGPMTCGDKIWSFRTPLSFRHSRVRWRAETKIGHSAPFVIQRRRAR

SEQ ID NO: 144187 - protein, 98 aa, Glycine max
  Coding DNA Sequence Number=SeqID_52502
MEFGDIVVHFNILDAMKHPSEDHSIFRVEILDQIVDDYMFDFDSLHGVVPLDVDFLESKCTNHVAGSTYTSDLFYEVQAEDLLLLLPWFLPLFSHHPH

SEQ ID NO: 144188 - protein, 103 aa, Glycine max
  Coding DNA Sequence Number=SeqID_52503
MTRGNPGDLQPFDPEIDRTFLRLVRNSVHPDHSVHFEHSEYFVAGDYEYSDFEHSTTNFILRTWFNLHLVRRLLGRWLHLISLMKVCAFNILMRMFHMFSRLD

SEQ ID NO: 144189 - protein, 176 aa, Glycine max
  Coding DNA Sequence Number=SeqID_52504
  Homolog annotation: Hit_ID=A9PEY2; Match level="QueryCoverage=98%, HitCoverage=65%, E-value=2e-13, Identity=35%"; Hit description =Putative uncharacterized protein
  Subcellular localization annotation: CTP_CleavageSite=26; ConfidenceScore=5.35e-01
MKIVSVAVRSISANLPNQFHQSHLLRSLSTWKFTDNATGNRQFNNSESPEESEQFGGNRGKYAQLDSIFEKFNQQGMARQRPGSVNGASSERMHDLEETYDTLTDGMDGKLMNAATYFEFDEDEIEKEDYAFRYDANFPLGSKYDVKGNTYYTKSCAQYSENREFSDLTKMVHSQQ

SEQ ID NO: 144190 - protein, 286 aa, Glycine max
  Coding DNA Sequence Number=SeqID_52505
  Gene Ontology: Mol. function=calcium-dependent phospholipid binding; Cellular component=integral to membrane
  Homolog annotation: Hit_ID=A7P3T0; Match level="QueryCoverage=81%, HitCoverage=82%, E-value=3e-48, Identity=57%"; Hit description =Chromosome chr1 scaffold_5, whole genome shotgun sequence
  Pfam annotation: Domain name=PLAC8; Domain location=230-286; Score =10.1; E_value=0.0019; Accession=PF04749.8; Description=PLAC8 family
  Pfam annotation: Domain name=PLAC8; Domain location=43-142; Score =185.6; E_value=1.2e-52; Accession=PF04749.8; Description=PLAC8 family
  Pfam module annotation: Pfam domain module=PLAC8::PLAC8; Domain location=230-286::43-142
  Subcellular localization annotation: CTP_CleavageSite=22; ConfidenceScore=5.35e-01
SDPTKQSPATGFPVSYSNSTTYSTNEASYAPVPPPQPKPLVNWSTGLCDCFSECGNCCMTCWCPCVTFGRVAEIVDKGSTSCGASGALYTLICCVIGCGCLYSCFYRPKMRRQYGLKGNGCSDCLIHCFCEPCALCQEYRELQHRGFDMIIATKSGSSHDCYNSSISRKWHEPLNSMQFSSSDPRKPSAPATGFPVSYSTSTTEAEVYSYSYGPVVVPVPPPHPKPIVEWSTGLCDCFSDWGNSCMTFWCPCVTFGRVAEIVDRGSPCGGVAGAGAGYTLASTAPI

SEQ ID NO: 144191 - protein, 59 aa, Glycine max
  Coding DNA Sequence Number=SeqID_52506
MNNEDSFLNLSMLGWECANAYTWRDISSGSGRWHDPLDRAVSWSGSSSFTYVYGLWGLQ

SEQ ID NO: 144192 - protein, 172 aa, Glycine max
  Coding DNA Sequence Number=SeqID_52507
  Gene Ontology: Mol. function=metal ion binding
  Homolog annotation: Hit_ID=A0ZT53; Match level="QueryCoverage=96%, HitCoverage=59%, E-value=2e-73, Identity=68%"; Hit description =Putative E3 ubiquitin ligase
  Pfam annotation: Domain name=Hemerythrin; Domain location=107-168; Score=17.1; E_value=0.065; Accession=PF01814.14; Description =Hemerythrin
  Pfam annotation: Domain name=Hemerythrin; Domain location=38-99; Score=28.9; E_value=1.9e-05; Accession=PF01814.14; Description =Hemerythrin
  Pfam module annotation: Pfam domain module=Hemerythrin::Hemerythrin; Domain location=107-168::38-99
MASPLDGGGVAVLPNSVNKVDSSSVLNGGLKCSKPESPILIFLFFHKAIRNELDALHRLAVAFATGNRSDIKPLSGRYHFLSSMYRHHCNAEDEVIFPALDIRVKNVAQTYSLEHKGESNLFDHLFELLNSSINNVESFPKELASCTGALQTSVSQHMAKEEEQKFIKTKRI

SEQ ID NO: 144193 - protein, 555 aa, Glycine max
  Coding DNA Sequence Number=SeqID_52508
  Gene Ontology: Mol. function=calcium ion binding; Cellular component =nucleus; Biological process=ciliary or flagellar motility
  Homolog annotation: Hit_ID=Q6Z2I7; Match level="QueryCoverage=63%, HitCoverage=73%, E-value=1e-117, Identity=60%"; Hit description=SET domain-containing protein-like
  Pfam annotation: Domain name=Rubis-subs-bind; Domain location=406 -531; Score=92.9; E_value=9.8e-25; Accession=PF09273.2; Description =Rubisco LSMT substrate-binding
  Pfam annotation: Domain name=SET; Domain location=135-366; Score =100.9; E_value=3.9e-27; Accession=PF00856.19; Description=SET domain
  Pfam annotation: Domain name=efhand; Domain location=109-137; Score =35.2; E_value=2.3e-07; Accession=PF00036.23; Description=EF hand
  Pfam annotation: Domain name=efhand; Domain location=145-173; Score =29.9; E_value=9.6e-06; Accession=PF00036.23; Description=EF hand
  Pfam annotation: Domain name=efhand; Domain location=36-64; Score =38.1; E_value=3.1e-08; Accession=PF00036.23; Description=EF hand
  Pfam annotation: Domain name=efhand; Domain location=72-100; Score =29.9; E_value=9.3e-06; Accession=PF00036.23; Description=EF hand
  Pfam module annotation: Pfam domain module=Rubis-subs-bind::SET::efhan d::efhand::efhand::efhand; Domain location=406-531::135-366::109 -137::145-173::36-64::72-100
  Subcellular localization annotation: CTP_CleavageSite=53; ConfidenceScore=5.16e-01
MGLKSLFNRNKDAISSDTASRSTSLSVRSRTRMADELEQVFNKFDVNGDGKISASELGSIMGSLGQPATELELDNMIREVDGDGDGCISLPEFIELNTKGVDSDEVLENLKDAFAVFDIDGNGSITAEELNTVMRSLGEDCSLAECRRMISGVDGDGDGTIDFEEFRAIGRGRGIFREDGNVFADPVASANMRRFRTGPHQELWAMKLGLKLLQERAKVGSFWWPYITNLPETYTVPIFFPGEDIKNLHYASLLHQREVKRALVSLTPDKHPFGGQEVDASSLGWAMSAVSSRAFRLYGEKDPNGIRIDVPMMLPLIDMCNHSFNPNARIVQEQDTSDSKMKVVAETAIKEDDPLLLCYGCLNNDLFLLDYGFVMHSNPYDCIELKYDGALLDAASTAAGVSSPNFSTPAPWQELILSQLNLAGETPDLKVSLGGQETVEGRLLAALRVILSTNVETMQKYDLSILQSLDAEAPLGVANEIAVFRTLIALCVIALGHFPTKIMDDESLLKQGASGSTELAIQYRIQKKSVIIDVMKNLSRRLKLVSSKETTTAEG

SEQ ID NO: 144194 - protein, 667 aa, Glycine max
  Coding DNA Sequence Number=SeqID_52509
  Gene Ontology: Mol. function=microtubule binding; Cellular component =cortical microtubule, transverse to long axis; Biological process =cytoskeleton organization and biogenesis
  Homolog annotation: Hit_ID=A7P3V5; Match level="QueryCoverage=88%, HitCoverage=92%, E-value=0.0, Identity=74%"; Hit description =Chromosome chr1 scaffold_5, whole genome shotgun sequence
  Pfam annotation: Domain name=Myosin_HC-like; Domain location=218-574; Score=760.1; E_value=1.4e-225; Accession=PF07058.2; Description =Myosin II heavy chain-like
  Subcellular localization annotation: CTP_CleavageSite=32; ConfidenceScore=5.01e-01
MAEVSGEGVAEATVSTPAPPLAVSGSFKEGKSSSRRRAHSMRPSLDADEFMNLLHGSDPVKVELNRLENEVRDKDRELSEAQAEIKALRLSERLREKAVEELTEELSRVEGKLKLTESLLESKNLEIKKINDEKKASMAAQFAAEATLRRVHAAQKDDDMPPIEAILAPLEAELKLARQEIAKLQDDNKALDRLTKSKEAALIEAEKTVQIALAKASMVDDLQNKNQELIKQIEICQVFAISYGVSLSKYASLNNVAEVEKLTQTVRELEEAVLAGGAAANAVRDYQRKVQEMNEERKTLDRELARAKVTANRVAVVVANEWKDANDKVMPVKQWLEERRFLQGEMQQLRDKLAITERTAKSEAQLKEKYQLRLKVLQDSLRETSNSINRGTSEGRCVSNGPSRRQSLGGSDNISKLASNGFLKRSPSTQIRSSVSSSTVLKHAKGTSKSFDGGTRSLERSKILLNGKPPSYSFNQSSEGTKDGEENDKWKGNSDDKPNDLPTVDTEDSVPGVLYDLLQKEVLALRKAGHEKDQSLKDKDDAIEMLAKKVDTLTKAMEVEAKKMRREVASMEKEVAAMRVEKEQESRAKRFSNVKGTVNSAQHQLNLPPEKLPEELPDEQFVLLEEPSSGRSSFGSFSGRRFFRKNKVKILPVASSEEQSYRKKFFR

SEQ ID NO: 144195 - protein, 644 aa, Glycine max
  Coding DNA Sequence Number=SeqID_52510
  Gene Ontology: Mol. function=hydrolase activity; Cellular component =cytoskeleton; Biological process=cell division
  Homolog annotation: Hit_ID=Q8LF21; Match level="QueryCoverage=100%, HitCoverage=100%, E-value=0.0, Identity=76%"; Hit description =Dynamin-related protein 1C
  Pfam annotation: Domain name=Dynamin_M; Domain location=253-522; Score=221.8; E_value=1.5e-63; Accession=PF01031.11; Description =Dynamin central region
  Pfam annotation: Domain name=Dynamin_N; Domain location=38-244; Score= 247.2; E_value=3.5e-71; Accession=PF00350.14; Description=Dynamin family
  Pfam annotation: Domain name=GED; Domain location=551-641; Score =104.0; E_value=4.6e-28; Accession=PF02212.9; Description=Dynamin GTPase effector domain
  Pfam annotation: Domain name=MMR_HSR1; Domain location=36-204; Score=- 6.9; E_value=0.0046; Accession=PF01926.14; Description=GTPase of unknown function
  Pfam module annotation: Pfam domain module=Dynamin_M::Dynamin _N::GED::MMR_HSR1; Domain location=253-522::38-244::551-641::36-204
MATMTSLIGLINKIQRACTVLGDHGGEGLSLWEALPSVAVVGGQSSGKSSVLESVVGRDFLPRGSGIVTRRPLVLQLHKTEDGTQEYAEFLHIPRRRFTDFAAVRKEISDETDRITGKTKQISNIPIHLSIYSPNVVNLTLIDLPGLTKVAVEGQQESIVQDIENMVRSYVEKITFLMFLLNDLTEFSLIVKPNCIILAISPANQDIATSDAIKIAREVDPSGMAVYIGRNSKGERTFGVVTKLDLMDKGTNAVDVLEGRQYRLQHPWVGIVNRSQADINRNVDMIAARRKEREYFETSPEYGHLAHKMGSEYLAKLLSQHLEQVIRQKIPSIIALINKTIDELNAELDRIGRPIAVDSGAQLYTILEMCRAFDKVFREHLDGGRPGGDRIYGVFDHQLPAALKKLPFDRHLSLKNVQRVVTEADGYQPHLIAPEQGYRRLIEGSIGYFKGPAEASVDAELKRFPTLSNDIATAANEALEKFREESRKTVLRLVDMESSYLTVEFFRKIHFEPEKNPNGPPNPNRNGPPNMDSYTDNHLRKIDLPGYTFIILFVVTGSNVNSYIGMVCDTLKNTIPKAVVHCQVREAKRSLLNHFYVHVGRKEKEKLGAMLDEDPALMERRNQIAKRLELYKQARDDIDSVAWK

SEQ ID NO: 144196 - protein, 213 aa, Glycine max
  Coding DNA Sequence Number=SeqID_52511
  Homolog annotation: Hit_ID=A7P3X2; Match level="QueryCoverage=95%, HitCoverage=34%, E-value=7e-70, Identity=64%"; Hit description =Chromosome chr1 scaffold_5, whole genome shotgun sequence
MGGAHKDVGDRLAIHVQHLLNPPIMLNNKIEDTPIWSEEINDDRFFEAINGKKFSHVCTAPVKYNPRWSSDKDVAFIVTGAQLDVKKHDSRSVLHLRLLFSKVSNCAVVKSSWTQGSSGLSQRSGIFSVISTSISGKDQNQKKPVVVLDSSVFPTGPPVPVQTQKLLKFVETSQLCKGPQDSPGHWLVTGASLVLDKGKICLWAKFSLLHAGS

SEQ ID NO: 144197 - protein, 291 aa, Glycine max
  Coding DNA Sequence Number=SeqID_52512
  Gene Ontology: Mol. function=two-component response regulator activity; Cellular component=nucleus; Biological process=two -component signal transduction system (phosphorelay)
  Homolog annotation: Hit_ID=A7P3W0; Match level="QueryCoverage=95%, HitCoverage=52%, E-value=3e-57, Identity=43%"; Hit description =Chromosome chr1 scaffold_5, whole genome shotgun sequence
  Pfam annotation: Domain name=Myb_DNA-binding; Domain location=199 -249; Score=40.2; E_value=7.5e-09; Accession=PF00249.22; Description =Myb-like DNA-binding domain
  Pfam annotation: Domain name=Response_reg; Domain location=18-131; Score=50.8; E_value=4.6e-12; Accession=PF00072.15; Description =Response regulator receiver domain
  Pfam module annotation: Pfam domain module=Myb_DNA-binding::Response _reg; Domain location=199-249::18-131
MAQVSSFEKVQYQFPEKIRVLVVDNNPTDLDFIKQICNLCNYEVSTCTESTQALNLVLERKDCIDLILIEVHMPTMNGYEFLYRASKEIDVPVIVMSLDHSNYTVTRAVQLGACDFWVKPLRYYQFKNMWTHVLRKSLKENNIQTKDYVGSLEDGERSRKRGKDNSEFGSSSVVRDQSNSSSKEAEESKHRVSSMKKPRVVWIAELHSKFVNAVKKLGLHQAVPKRIVEEMNVPGLTRENVASHLQKYRDYLKRKSEMKETQTQEHTEMQLPNMVPGTTESRVGASSIKTQ

SEQ ID NO: 144198 - protein, 516 aa, Glycine max
  Coding DNA Sequence Number=SeqID_52513
  Gene Ontology: Mol. function=hydrolase activity; Cellular component =nucleus; Biological process=metabolic process
  Homolog annotation: Hit_ID=A5BJS3; Match level="QueryCoverage=95%, HitCoverage=77%, E-value=0.0, Identity=62%"; Hit description =Putative uncharacterized protein
  Pfam annotation: Domain name=PPR; Domain location=108-142; Score =36.5; E_value=9.7e-08; Accession=PF01535.11; Description=PPR repeat
  Pfam annotation: Domain name=PPR; Domain location=211-245; Score =38.6; E_value=2.3e-08; Accession=PF01535.11; Description=PPR repeat
  Pfam annotation: Domain name=PPR; Domain location=246-280; Score =15.5; E_value=0.11; Accession=PF01535.11; Description=PPR repeat
  Pfam annotation: Domain name=PPR; Domain location=282-315; Score=2.7; E_value=3.8; Accession=PF01535.11; Description=PPR repeat
  Pfam annotation: Domain name=PPR; Domain location=348-382; Score=2.6; E_value=3.8; Accession=PF01535.11; Description=PPR repeat
  Pfam annotation: Domain name=PPR; Domain location=7-41; Score=44.0; E_ value=5.4e-10; Accession=PF01535.11; Description=PPR repeat
  Pfam module annotation: Pfam domain module=PPR::PPR::PPR::PPR::PPR::PP R; Domain location=108-142::211-245::246-280::282-315::348-382::7-41
MPVRDVVSWNTVIAGNAQNGMYEEALNMVKEMGKENLRPDSFTLSSILPIFTEHANVTKGKEIHGYAIRHGFDKDVFIGSSLIDMYAKCTQVELSVCAFHLLSNRDAISWNSIIAGCVQNGRFDQGLGFFRRMLKEKVKPMQVSFSSVIPACAHLTALNLGKQLHAYIIRLGFDDNKFIASSLLDMYAKCGNIKMARYIFNKIEMCDRDMVSWTAIIMGCAMHGHALDAVSLFEEMLVDGVKPCYVAFMAVLTACSHAGLVDEGWKYFNSMQRDFGVAPGLEHYAAVADLLGRAGRLEEAYDFISNMGEEPTGSVWSTLLAACRAHKNIELAEKVVNKILLVDPGNMGAHVIMSNIYSAAQRWRDAAKLRVRMRKTGLKKTPACSWIEVGNKVHTFLAGDKSHPYYDKINEALNILLEQMEKEGYVLDTNEVLHDVDEEHKRDLLRTHSERLAIAFGIISTTSGTTIRVIKNIRVCVDCHTAIKFMAKIVGREIIVRDNSRFHHFKNGSCSCGDYW

SEQ ID NO: 144199 - protein, 63 aa, Glycine max
  Coding DNA Sequence Number=SeqID_52514
MSLHLQAPMSSSTSPSTILGTVREVAGKGFGGDDERIFNLFFPSYFFDLLVTSPVDQLQTALR

SEQ ID NO: 144200 - protein, 284 aa, Glycine max
  Coding DNA Sequence Number=SeqID_52515
  Gene Ontology: Mol. function=zinc ion binding; Cellular component =intracellular
  Homolog annotation: Hit_ID=A8MQN6; Match level="QueryCoverage=54%, HitCoverage=65%, E-value=1e-34, Identity=48%"; Hit description =Uncharacterized protein At2g01818.1
  Pfam annotation: Domain name=PLATZ; Domain location=75-205; Score =139.1; E_value=1.3e-38; Accession=PF04640.5; Description=PLATZ transcription factor
  Pfam annotation: Domain name=zf-B_box; Domain location=70-113; Score =21.0; E_value=0.0008; Accession=PF00643.15; Description=B-box zinc finger
  Pfam module annotation: Pfam domain module=PLATZ::zf-B_box; Domain location=75-205::70-113
  Subcellular localization annotation: CTP_CleavageSite=67; ConfidenceScore=5.56e-01
MGGRQLATLFGVSTLFSFLGPTSHSLSTNLHRPITFQSNGTTALRFPPIGGQNLSPKERSRDWIGVLMNSSFGYCTYHHDLRSNEMNVFCVDCALRMCRHCKEAHSLHRRFQIYKYSYQDVFRHAELQKYFDCSKIQTYISNNERIVHLKPRPSITKSKSADLSPDSKYKETGIATRPKSGGTCEECGKHLQDERNRFCSITCKISVHPVETQYQGQNQCSPNHQSARGIINPKPEGIDFTMNDNHNSEPESSISEAEPYGWVEVVNFRKRPRKSIPQRPVFVF

SEQ ID NO: 144201 - protein, 616 aa, Glycine max
  Coding DNA Sequence Number=SeqID_52516
  Homolog annotation: Hit_ID=A7P3X8; Match level="QueryCoverage=81%, HitCoverage=96%, E-value=1e-175, Identity=64%"; Hit description =Chromosome chr1 scaffold_5, whole genome shotgun sequence
MVCMSCESLSFLAVPFQWVVLSFSVSGDLPDKVFARVCDEGVAAVVDGDVIGSIDLFGGEGGKEETVVGAEVVGDEGVERRDPRRKRYGDDGVGDVMESMELCIFDLRRGQHEGQELDKILFFFPAGLPFSKQLSVIGLSEGLITFTRIFSPEAACDVIEAERHSHVFYEAEPDIWIVMVPSPVADKSNDSEPIWRVDALRKVLKEIHSLFVMFHGSIRAMLEKEPGGGLTRRHLYTFIMDYLRACKKRSPWDTCCCGNGEVAVSNDFLAGKKLLLPSFRDCLKERGTVQMLTIGREAAIEVQSLVRVLESSSGNTPCYSLVLFQDLLVSTSLSPDDTINLFTYAVLRLTPHALSSGTSSWSYLRKGSSASNVATESNMAHPSSLSESFYGSSDISSGEDNHYHVVRPLQSDKWSKGKDGYLVTDLWGAEVGTWVFASPTVWLQHTGEKMYLCVYQHRSLTLMLLIPVSSIPNGEQGVSAVRQQVVENASLKILKVEEKLSKGWGGDNAYHVSGYRYLLVDGDRNVSRASPATKVTTLTKESLLAMNKLRQEVELEKSRAKLDSRNCEKDLEELYMVLEKANETLLYASDAVEKFSDSLNCYPSCRKNDAENWGGG

SEQ ID NO: 144202 - protein, 332 aa, Glycine max
  Coding DNA Sequence Number=SeqID_52517
  Gene Ontology: Mol. function=voltage-gated anion channel activity; Cellular component=mitochondrial outer membrane; Biological process =anion transport
  Homolog annotation: Hit_ID=A7QSA0; Match level="QueryCoverage=94%, HitCoverage=88%, E-value=1e-126, Identity=74%"; Hit description =Chromosome chr3 scaffold_157, whole genome shotgun sequence
  Pfam annotation: Domain name=Porin_3; Domain location=28-332; Score =135.0; E_value=2.1e-37; Accession=PF01459.13; Description=Eukaryotic porin
MATPIPPPPAAAAAAAADTKVDYLNLPCPIPFEELHREAMMSLKPDLFEGMRFDFTKMLNQKFSLNHSVLMGPTEVPSQSTETIKIPTAHYEFGSTFIDHPRLLLWGRILTDGRLNARVKCDLSENLTFKANAQLTNEPHMSHAMINFDYKGKDYRTQFQLGNGALLGASYIQSLAAIGAAVVEKLIFADAFAVGIAGIALDSTACMSAAPLPFCYFVATAPSPSAVFWAGQHRKSGIGYAARYNTDKSVATGQVASTGMVLLSYVQKVSEKVSLASEFMCNYLSRDVTASFGYDYILRQCRLRGKIDSNGCVAAFLEERLNMGLNFILSAE

SEQ ID NO: 144203 - protein, 410 aa, Glycine max
  Coding DNA Sequence Number=SeqID_52518
  Gene Ontology: Mol. function=metal ion binding; Cellular component =nucleus; Biological process=regulation of transcription, DNA -dependent
  Homolog annotation: Hit_ID=A7PGY6; Match level="QueryCoverage=97%, HitCoverage=97%, E-value=1e-79, Identity=45%"; Hit description =Chromosome chr17 scaffold_16, whole genome shotgun sequence
  Pfam annotation: Domain name=PHD; Domain location=361-405; Score=3.4; E_value=0.0053; Accession=PF00628.20; Description=PHD-finger
  Pfam annotation: Domain name=zf-C3HC4; Domain location=362-402; Score= 37.2; E_value=5.9e-08; Accession=PF00097.16; Description=Zinc finger, C3HC4 type (RING finger)
  Pfam module annotation: Pfam domain module=PHD::zf-C3HC4; Domain location=361-405::362-402
MPVTNTTTPTVAEHIKWRRPRNQFNHHHHHHHHPISETDPNPQIPSIIQSTRCKSTISSLLLSTFSNNTSNNATAHSKKKSNFSASTFRGLGCTAGSSQQVSVPAVIRSSADWQGKKTRKKKHKRSNRSSKNKTFHGGVLEGSNPGCVDFQDVWCGPGIGFSTDAAASVDCVVARKNVSSARGKIDVDKITHRERSSYVGRRTETFTFLDSTDPDIFTPRSASDTYGTATYYRHVRDPSSDGFAEVASNIHIPFSLSLSSLMLSARVIPMDVSFGFKHLFSKSHIMMLQGSLLMGGQLNSHDHFRDWRLDVDNMSYEQLLELGERIGHVNTGLKEDEMGRNIRKTRIQFWDDTSKLQVDKECSICQEEYEAGDELGRLNCEHSYHFQCIKQWVAQKNFCPVCKQQVAARH

SEQ ID NO: 144204 - protein, 443 aa, Glycine max
  Coding DNA Sequence Number=SeqID_52519
  Gene Ontology: Mol. function=phosphatidylinositol binding; Cellular component=Golgi apparatus; Biological process=clathrin cage assembly
  Homolog annotation: Hit_ID=A5AH52; Match level="QueryCoverage=99%, HitCoverage=72%, E-value=1e-106, Identity=46%"; Hit description =Putative uncharacterized protein
  Pfam annotation: Domain name=ANTH; Domain location=29-310; Score =118.3; E_value=2.3e-32; Accession=PF07651.7; Description=ANTH domain
MQRRFRRVCTCLKERSCMSYAKIASASGFSDINLIIIKATAPDDLPLHEKYIQHLLKLFSISPSTCHSFAISFTRRFGTTRCWRVALKCLILLHRLLRSVPGNSSLWTELLWTRSNALISLYPCHFKDDSSSCPVSYTNFVISYARLLDEALNCVALDCTNLEDQDLEQNEEAMDETFREKMKEMGQVLEMLPQLQSLIDRVMECYPVGVAARSFIVQVAMKLIIRDSFVCYTKFRREIVTVLDNLLEMPYRNCIAAFNIYKKAAAQTNELYEFYEWCKAKGLCGMYEYPLVEPIPYIQIKALESFLSGMWQLTESSTSPTTSTSPSSSGDSPSNFSQGQIVMRRDVVNIKGEEEKPLIELELEEDNGDVSWETLLETSISFSHAYQRDLGSLFNHRGWEGGFHIEQHGFDANEGHDHERADATWNMAVNKNTTANNPFSEPY

SEQ ID NO: 144205 - protein, 665 aa, Glycine max
  Coding DNA Sequence Number=SeqID_52520
  Gene Ontology: Mol. function=microtubule motor activity; Cellular component=microtubule associated complex; Biological process =microtubule-based movement
  Homolog annotation: Hit_ID=A7PGT4; Match level="QueryCoverage=81%, HitCoverage=61%, E-value=1e-164, Identity=54%"; Hit description =Chromosome chr17 scaffold_16, whole genome shotgun sequence
  Pfam annotation: Domain name=Kinesin; Domain location=230-522; Score =412.6; E_value=5.8e-121; Accession=PF00225.14; Description=Kinesin motor domain
LSGPSIQVEKIKEEVKTENEKEIVRLMKEQEDKNLEISALKQELEKTKRTYEVQRSQLETEAKDAKAELTQKSQEYEHRLEELRNKAEKIREEEKEADEKEIIRLMKEQEDKNLEISSLEQKSQEYEHRLDELRNKIKELEVSSDSKDQKWNMKMNQMQTVINFQLSSLQKLELSWECIKQNVMKEQTVYAEDCDRLGVYLKPLLHAAENYHTLLAENKKMFNEIQELKGKKEKQSIVKLIGENDLVVANPSKEGKDALRSFKFNKVFGSATTQAEVYSDIQSFIRSVLDGYNVCIFAYGQTGSGKTYTMTGPNGATSETIGVNYRALNDLFKIATSRESLIDYEIGVQMVEIYNEQGLAVPDASLFPVKSPSDVIKLMDIGLKNRAIGATAMNERSSRSHSVVSIHIRGKDLKTGSTMVGNLHLVDLAGSERVDRSEVTGDRLKEAQHINRSLSALGDVIFALSQKSPHVPYRNSKLTQLLQTSLGDQAKTLMFVQINSDVSSYSETLSTLKFAERVSGVELGAARSSKESKDVRELMEQVSSLKNAIFAKEEEIERLQLLKGSVGSIVKRNQISRSRSIKHYEAFNQQPMDDHIHQNEFLHQSELHGGNIGKNIAAIAETSRFTDSDFDEKSSDLSDSAVAPGTETDGSENSSLTERTTSSDK

SEQ ID NO: 144206 - protein, 28 aa, Glycine max
  Coding DNA Sequence Number=SeqID_52521
MTPIEIERQLSKADGGGNTYRDFDTQMG

SEQ ID NO: 144207 - protein, 65 aa, Glycine max
  Coding DNA Sequence Number=SeqID_52522
MHKTPLTKTRSLPRPLTVEAQSVAASPQCLKSPNATRTEEEEVQSAARGRRHCGRKKKRTERDLL

SEQ ID NO: 144208 - protein, 866 aa, Glycine max
  Coding DNA Sequence Number=SeqID_52523
  Gene Ontology: Mol. function=histidine-tRNA ligase activity; Cellular component=cytoplasm; Biological process=tRNA aminoacylation for protein translation
  Homolog annotation: Hit_ID=Q9M8R8; Match level="QueryCoverage=56%, HitCoverage=97%, E-value=1e-179, Identity=66%"; Hit description =Putative histidyl tRNA synthetase
  Pfam annotation: Domain name=HGTP_anticodon; Domain location=775-863; Score=44.8; E_value=3e-10; Accession=PF03129.11; Description =Anticodon binding domain
  Pfam annotation: Domain name=PAL; Domain location=5-349; Score= -265.2; E_value=0.0027; Accession=PF00221.10; Description =Phenylalanine and histidine ammonia-lyase
  Pfam annotation: Domain name=tRNA-synt_2b; Domain location=432-595; Score=117.8; E_value=3.3e-32; Accession=PF00587.16; Description=tRNA synthetase class II core domain (G, H, P, S and T)
  Pfam module annotation: Pfam domain module=HGTP_anticodon::PAL::tRNA -synt_2b; Domain location=775-863::5-349::432-595
  Subcellular localization annotation: CTP_CleavageSite=44; ConfidenceScore=5.32e-01
MAEASVTVGGKASSLSSSSVFAVATGLAHVRIDSSALDRLSKTTATETTSSQHRICVPDFLTLEESRAFLLVLLNNLVLSNAPSRIPLLLSQTLNSNPPTFQFLDADVTQPDLLTSSTLLAVSAILDRQSAALSAFADVAAAFSCEALKADITPFNLMDSGDGHASKAEVAVAADMRVLLNGSKSVGKENIRSVARVPKVHGSVREQAKAVHSRMRVELNSGVKGVVVGSEEAVCTVLLPLAAALKELGECSFARAKSNSEVIGGDGLRLGIGEVFGKECPTQDGLSSGLNKAVNLFLGKEYAVTAVAVLEAAELNDVILGVKEMKVEGNTKVEEKKKKKKVVLGKGTSSILALIKERLLSGREIALGTWVADFLSLLDLAKPEFNEFLLKVKDVVESNESRRLPKIPKSYLEFHNITYQGTRDFAKEQMTIRKKAFLIIEEVFERHGATALDTPVFELRETLMGKYGEDSKLIYDLADQGGELLSLRYDLTVPFARFVAMNGLTSFKRYQIAKVYRRDNPSKGRYREFYQCDFDIGGTPTPSEIMGPDFEVVRILTELLDELDIGEYEIKLNHRKLLDSMMQICGVPPEKFRTICSSIDKLDKQSFQQIRKEMVEEKGLTAETADRIETFVKEKGSPLALLSKFKQEGSDFSKHKGASEALKELEILFIALEKSKRIDKVVFDLSLARGLDYYTGVIFEAVFKGGTQLLFRNGHMVFTQVGSIAAGGRYDNLIGMFGSRSVPAVGVSLGIERVFAIMEQQQKNLNQMARPTKTEVLVSIVGNDFTLAAELAGELWDARVKAEFLVNKRRAKHFEYAKESRIPWMVLVYEQEIKEGVVQLKNLEANIDIKISRAEFVEELRRRLYP

SEQ ID NO: 144209 - protein, 75 aa, Glycine max
  Coding DNA Sequence Number=SeqID_52524
MYATKKAMQTFTLHRDFNGEKRMQGMSNYMVGRQCITKKRKTLDETSLLSSESETNHDHRLTSTPYASHRPGYRA

SEQ ID NO: 144210 - protein, 100 aa, Glycine max
  Coding DNA Sequence Number=SeqID_52525
MVGYMPSSFADLVFAGERIEACLRKGKFNYVSFANPGNRGLGRSGERKKEGEPHVVAAVPAWPNFPIAPVTTYPSAGGRRGAHRRKVLAPHASITRDDSL

SEQ ID NO: 144211 - protein, 33 aa, Glycine max
  Coding DNA Sequence Number=SeqID_52526
MSEIGRFGGLGMEVRRKEEGAAQEILKTPSVLV

SEQ ID NO: 144212 - protein, 79 aa, Glycine max
  Coding DNA Sequence Number=SeqID_52527
MLKKILPAWLPYEGSTTIHNIHLGNDQVKVGVEEVRDANAHILVPTQEAYDCDTSASGECRCVWIPRATIHTEICAITI

SEQ ID NO: 144213 - protein, 113 aa, Glycine max
  Coding DNA Sequence Number=SeqID_52528
ETSLSTAIPLELEVIPQVKELLDEVLVRKSLTPCALLVPKIGIMRHRIPMVDATMNVLSGVPTNPKRIKVILEWPTPPTPLIELVRNHVPSWEDAREMGVEGRSPEFQESLDL

SEQ ID NO: 144214 - protein, 45 aa, Glycine max
  Coding DNA Sequence Number=SeqID_52529
VFLPRPTVFGGGWRTGARRVGSALAAELTAAEVVSQPTLRREGDA

SEQ ID NO: 144215 - protein, 49 aa, Glycine max
  Coding DNA Sequence Number=SeqID_52530
MSSIGTGESCPSMHSSSVIASLSSCARTVGPPPISGGGPGTVKRKLLVP

SEQ ID NO: 144216 - protein, 276 aa, Glycine max
  Coding DNA Sequence Number=SeqID_52531
MASNSQQFNARNDVIVLRGVHEVTTDSSSSTENKKLEGKLDALVNLVTQLAMNQKSAFAPVARVYGWRNLPNLRWTSPPQQQQHVLPFQNIAGPSKPYVPPPIQQQQQQSQQRQQAAEAPPQPTLEELVRQMTIQNMQFQQETRASIQSLKNQMRQMATQLNQAQSQNSNKLPSQTVQNPKNVSVITLKSGNQIQVPPTIAEPAPEPIKLHSTPEIEDKIVAQKRKLPVATYPSARGRRVTCGCVFQERNMCGVATNVYLRKTSEKLEKTWSTNFK

SEQ ID NO: 144217 - protein, 109 aa, Glycine max
  Coding DNA Sequence Number=SeqID_52532
RSTAGDLIPINLEINTTCRRGNIERIRKFLQDLEVAATPKEEPRSFEASSSFPIPGQSHTDLIEEVIMAEEPRRVTLEDYSSSIVPQFFSSIARPEVQAQTITYPPCLI

SEQ ID NO: 144218 - protein, 90 aa, Glycine max
  Coding DNA Sequence Number=SeqID_52533
MERSMIDAASGGALGDMTHAEARNLIEKMASNSQQFSARNDAIVLRVVHEQSGVNEQPEASAANIYNRPPQQRNQQQQNNYDLSRNRYNS

SEQ ID NO: 144219 - protein, 184 aa, Glycine max
  Coding DNA Sequence Number=SeqID_52534
MGDQEETQEQMKADMSALKEQMASMMEAMLSMRQLMEKNAATDTAASSAAEADPTLLATAHHPPSNIVGRGRDTLGHDGSPHLGYNRAAYPYGLPPNYSPPVLQDDAGHIASPVLEREPPQQPDEAHKDPQDYARRDVEFYPPIPEGPAPSTLPQPNIATQPIVLSTEGPSPATEERRKLDLLE

SEQ ID NO: 144220 - protein, 70 aa, Glycine max
  Coding DNA Sequence Number=SeqID_52535
MIMKGQDIYSSQDEVTTSPSSSESEEAKGEESSEEIDSQEEKDLLMVRRILGGQSCDLKNSNVKRLEQCI

SEQ ID NO: 144221 - protein, 68 aa, Glycine max
  Coding DNA Sequence Number=SeqID_52536
MGDIMFWFLPPKPLDPLPLPISITTKSAEKIKCFTLTNTSSITPYDMAMERSASCKVFASGKCTRSRK

SEQ ID NO: 144222 - protein, 76 aa, Glycine max
  Coding DNA Sequence Number=SeqID_52537
DPEQLGVSYYDLRNKGDQITSRDLKGALEVAAVHLLPVAGHAQAVVVSRPLPAWGVSYPNFVRGPLLDDMRPFFGP

SEQ ID NO: 144223 - protein, 111 aa, Glycine max
  Coding DNA Sequence Number=SeqID_52538
MWAVIDECKEKLNLAATHEQRLEDEYAKISAESEARERESRTSPIASQGQSNGGHLLRPQEDPRTSQLLSTYDRLNGPYDYETARNANQVTPHLSLACIVCGLVLCHGNPE

SEQ ID NO: 144224 - protein, 32 aa, Glycine max
  Coding DNA Sequence Number=SeqID_52539
MARNPRQDFSVSKESIFGVVKCVATSGTSKIQ

SEQ ID NO: 144225 - protein, 79 aa, Glycine max
  Coding DNA Sequence Number=SeqID_52540
MDQVRRQAFNKAYGKIWDLAMIEVFVEAIASRTQYYDRCFTFGDFQLAPTIEEFEGILGCPLGGRKPYLLLDSILLCQE

SEQ ID NO: 144226 - protein, 28 aa, Glycine max
  Coding DNA Sequence Number=SeqID_52541
MTTGDPPQQKTSQGNEKKKEDENITQDS

SEQ ID NO: 144227 - protein, 46 aa, Glycine max
  Coding DNA Sequence Number=SeqID_52542
MVAITPARIFKCKPLVSLLKQPALLSVDFQDRSIRDYSSCTLVGVP

SEQ ID NO: 144228 - protein, 24 aa, Glycine max
  Coding DNA Sequence Number=SeqID_52543
MSDLTSKWALAANKESVDDHCMPK

SEQ ID NO: 144229 - protein, 213 aa, Glycine max
  Coding DNA Sequence Number=SeqID_52544
MSLEIRRPWGRQVGRAPGSQQIKGTKTTKQGGLWWLASCEFCVIYGLWPLVIDYQGLENEVRKLGELLVIDYQGGRNGSLVIDYQRELGRPSKATRGADFGARFDSRLLHLVHPDEPVRTLQRTMEWILPTPTPYRLVEPVQVIEVTSSEEDPEEDPEELPPEPAVDALDFLEGDEDPVPEVDSPEDVMSASEADSTEDSGPGEMAISGGSSS

SEQ ID NO: 144230 - protein, 143 aa, Glycine max
  Coding DNA Sequence Number=SeqID_52545
MATQLIHDRVVMECLEGVWETLEGNERCRFRGTIRLTATSLVHPEQPARTLQQPVEWILPTPTPYRPVEPVPVIEVSSSEEDLDENLEELPPEPAMDAPDLPEDDEDPLSDVDSPEDFMSAFEADSTEESGPRGTVNSDDSSS

SEQ ID NO: 144231 - protein, 84 aa, Glycine max
  Coding DNA Sequence Number=SeqID_52546
  Subcellular localization annotation: CTP_CleavageSite=55; ConfidenceScore=5.16e-01
MIGTLHLSNVGNAFQWRWPRGNLSQRDPGRIKRPNEPVLLPSMIVTALGALNTSRASRPSRDGHFSGSDASSSGTTSIPISRRR

SEQ ID NO: 144232 - protein, 220 aa, Glycine max
  Coding DNA Sequence Number=SeqID_52547
LALVKEFYANLYSSKGPSPKQSKVRGHLVKIDADSLNTFLETPVVLAEGFILNTEGHPGKILRKDLTTLAQVWSVLSYSNLAPTSHTSDLTVDRARLIFGLVSHMDMNIGALISGQMTSIAQSNTSKLGFPALITALCRAREVVSDSLTFERLSPVINLAYIRKNCWNPEDLIVSIQGARRARARLAELPSTSVAPTPTSTSTTPFVPAQTYSQRFEAML

SEQ ID NO: 144233 - protein, 59 aa, Glycine max
  Coding DNA Sequence Number=SeqID_52548
  Subcellular localization annotation: CTP_CleavageSite=28; ConfidenceScore=5.16e-01
EPQHAEPGLRFFFMPYSRLVQGRGRMARGFARGPSRRGAPGSSRRWRGGPQGRGDGRFA

SEQ ID NO: 144234 - protein, 83 aa, Glycine max
  Coding DNA Sequence Number=SeqID_52549
MASNLATGVSYPNFVRGPLFGGMQPSLDRLEGVQIATKPTWAFQGVPTEGGEKGQSKNVQPFCDFVKIFTVHHRSSFVLRFST

SEQ ID NO: 144235 - protein, 115 aa, Glycine max
  Coding DNA Sequence Number=SeqID_52550
MVEVCAGVEMGGVGTVEEEGVVVSGATEVVGTSDLLPLAFLGPLNVTVGSSRFQQFFLMYAKLMAGLRLSRDLESDWTPLALHRAVIKINSALSNVTSDVWEVGIKLEKERTLHV

SEQ ID NO: 144236 - protein, 185 aa, Glycine max
  Coding DNA Sequence Number=SeqID_52551
  Homolog annotation: Hit_ID=Q2XNY0; Match level="QueryCoverage=89%, HitCoverage=40%, E-value=1e-07, Identity=23%"; Hit description =Putative uncharacterized protein
MTGRLLAGSLAFESRILHYLIVRILLPRSSNLAQVSEEDLIVMWAFHKGLQIDWAHLVRYRMHKALRLNAPLPYPHIVTLFLQHFNIPLDSEPYVPIKRSFLIGASVIARHVGEEGHDGEDSSLLSKILDRFDGLQTFVGERFDTLELQVEMRFNEIESRITKVEEDVSYIHSSFDLPPPPPPSS

SEQ ID NO: 144237 - protein, 379 aa, Glycine max
  Coding DNA Sequence Number=SeqID_52552
  Gene Ontology: Mol. function=signal transducer activity; Cellular component=membrane; Biological process=signal transduction
  Homolog annotation: Hit_ID=Q3SIB5; Match level="QueryCoverage=82%, HitCoverage=44%, E-value=3e-60, Identity=40%"; Hit description =Putative diguanylate cyclase/phosphodiesterase
  Pfam annotation: Domain name=GGDEF; Domain location=162-323; Score =175.3; E_value=1.6e-49; Accession=PF00990.12; Description=GGDEF domain
  Pfam annotation: Domain name=HAMP; Domain location=78-146; Score =23.5; E_value=0.00079; Accession=PF00672.16; Description=HAMP domain
  Pfam module annotation: Pfam domain module=GGDEF::HAMP; Domain location=162-323::78-146
MIADASNRPIANLGASFNIQETLPPQQDTVVMQQNTHDITMVKVFSTEPKHNLLGYVFVAIDKASLIEDHRQAFIKNVGYITLALMLCSILVSWVSRSISQPIRDMTAALKRFMIGSQQISHGKNTLPEIKSLQSTINQISREMQHVEADMRHRIQDAQAQLRYQARHDALTGLVNRQELERRLQQALQDVKLHRANHVFCYMDLDQFRVINDTCGHLAGDEMLRQISMILSQRIRAEDTFARLGGDEFGLLLSYCQVEKAIEIAAQLRQMVETFRFMHEGRLFQTGISIGIVEITSDLKDVGQITRHADAACYVAKDNGRNQIHLFHPEDDVLLKRHVEMEWVLRINEAIEHNEFVLYCQGIFPLQNTELPPFYEILI

SEQ ID NO: 144238 - protein, 407 aa, Glycine max
  Coding DNA Sequence Number=SeqID_52553
  Gene Ontology: Mol. function=nucleoside-triphosphatase activity; Cellular component=chloroplast
  Homolog annotation: Hit_ID=Q2PMM5; Match level="QueryCoverage=100%, HitCoverage=17%, E-value=0.0, Identity=96%"; Hit description=Protein ycf2
MSRENWIWLDNVWLVNKDRFFSKVRNVSSNIQYDSTRSSFIQVTGSSQLKGSSDQSKDYFDSIRNEDSKYHTLINQREIQQLKERSILCWDPSFLQTERTEIESERFPKILSGYSSMCRLFMEREKQMNNHLLPQEIEEFLGNPARATRSFFSDRWSELHLSSNPTERSTRDQKLLKKEQKKHLVLSRRSENKEIVNLFKIIMYLQNTVSIHPISSYPGCDMVPKGELDSSNKISFLNKNPFWGLFHLFHDRNSGRYTLHHDFESEEIFQEMADLFTLSITEPDLVYHKGFAFSIDSSGLGQKHFLNELFNSRDESKNHSLLVLPPLFYEENESFYRRIIKKWVQTSCGNNLEDPKPKIVVFTSNNIMEAVNQYRLIRNLIQIQYSTHGYIRNVLNRFNCNFEYGIQ

SEQ ID NO: 144239 - protein, 38 aa, Glycine max
  Coding DNA Sequence Number=SeqID_52554
MEILIANTSSTFHRDERLGNTHAMHGKEENARVTHEQT

SEQ ID NO: 144240 - protein, 60 aa, Glycine max
  Coding DNA Sequence Number=SeqID_52555
MWVEAIGLFAQATCAPEFGLPRPFNQRLLVLHVGGGLTMHIGTTLPLCSKIPYNKRPTVS

SEQ ID NO: 144241 - protein, 111 aa, Glycine max
  Coding DNA Sequence Number=SeqID_52556
MVHDIFIKVKLEVTRTLTVLNVFGNRRSSDRKAQGSCMSKHVEQKERYVHYDAEEMHDMNAFTNTRARTIISPYLRIWGRSAPCVQLKRRYGSSDFPRQKTRSTYNACVTT

SEQ ID NO: 144242 - protein, 177 aa, Glycine max
  Coding DNA Sequence Number=SeqID_52557
MFVFLVKKTPRLFQVSQVIQNYVDTAVSDGTQRQKLVILHPLSSRGGGPDDTRRQIGSFCTPLPFRHSRVRWRAETKIGHSAPFVIQRRRARRHAEKNLVISHPFAIQTQSCPMVRRDKIWSFCTLCPPEAAGPMTCGDKIWSFRTPLPFRHSRVRWRAETKIGHSAPFVIQRRRAR

SEQ ID NO: 144243 - protein, 115 aa, Glycine max
  Coding DNA Sequence Number=SeqID_52558
SEYQGSVWRKGQRPWKIKANGLSFIDILALLIFGVVLFPNMEGLVDLAAIDAFLAFHHGKESSVVAILAMSQELPRLLAKAKAVADTYSAPEEIHGLLSYCQHMIDLMDHMIGNR

SEQ ID NO: 144244 - protein, 299 aa, Glycine max
  Coding DNA Sequence Number=SeqID_52559
  Gene Ontology: Mol. function=serine-type endopeptidase activity; Cellular component=periplasmic space; Biological process=proteolysis
  Homolog annotation: Hit_ID=Q5PHP0; Match level="QueryCoverage=84%, HitCoverage=37%, E-value=1e-111, Identity=79%"; Hit description=Tail- specific protease
  Pfam annotation: Domain name=Peptidase_S41; Domain location=1-112; Score=65.6; E_value=1.7e-16; Accession=PF03572.9; Description =Peptidase family S41B
VRDNNGKFREDSDTDGVVYYKGPLVVLVDRFSASASEIFAAAMQDYGRALIVGEQTFGKGTVQQYRSLNRIYDQMLRPEWPALGSVQYTIQKFYRINGGSTQRKGVTPDIMMPTGKEDRDTGEQYEDNALPWDSIDPATYVKSGDMKPFEPELLKRHEDRIAKDPEFQYIMKDIARFNAMKDKRNIVSLNYAQREKENEEDDAIRLARVNDRLKREGKPLLKKIDDLPKDYQEPDPYLDETVHIAIDLAQQEKAQPPVEPPPDGDPVEQHDRPADHGAAVWFWRLDRFAVDVEMDGAEV

SEQ ID NO: 144245 - protein, 182 aa, Glycine max
  Coding DNA Sequence Number=SeqID_52560
  Gene Ontology: Mol. function=chitin binding; Cellular component =extracellular region; Biological process=chitin metabolic process
  Homolog annotation: Hit_ID=UPI00006A17C9; Match level="QueryCoverage =73%, HitCoverage=100%, E-value=2e-17, Identity=30%"; Hit description= UPI00006A17C9 related cluster
  Subcellular localization annotation: CTP_CleavageSite=21; ConfidenceScore=5.44e-01
ARTCNPLKARQCSPLKARACSPMKVRTCSPLKMRTCTPLKMRMFGPLKIRMLDPLKVRACSPLMARTCSPLKVRTCSPLKVRACSPQKVRVCSPLKARTCSPLKETTCSPLKARTCSPVKVRACSPTKAKARTCCPLKARTFMMQSYPARALDRRLQVEWAKDAREDPRVLMSLRVDFGLMG

SEQ ID NO: 144246 - protein, 150 aa, Glycine max
  Coding DNA Sequence Number=SeqID_52561
MARTRGLGRAIGFFRVVGRDRPADEDAGDVPERRSPTASARRLRVHQMTTEGRNMAEDVAAMTNDVPEQPTEAPEMRADAQGADSGEGSDGDDAAEGFPGGPRDPSVLTSFAEHVAHAVWSGQERPDLKLVSHGRKVTLIGRPVPEIEGL

SEQ ID NO: 144247 - protein, 69 aa, Glycine max
  Coding DNA Sequence Number=SeqID_52562
MGDQDETQEQMKADMSALKEQMASMMEAMLGIRQLMENNVATAAAVSSAAEADPTLPAIAHHPLLNAVG

SEQ ID NO: 144248 - protein, 371 aa, Glycine max
  Coding DNA Sequence Number=SeqID_52563
DKDYAEEENWTKVVSRRSMKVMQKSSLAGRQSQNLEIGDNNKHYRLNWRNNADITSFYFTHFPDEANEELLWRHFKNWGDVREVYIAKRLNKDARRYGFMRFKGVSDAKGLEKKNPIRRKYTDEARDKRADEAQTPTILINPDEGGEYWCNETWVGMLKKVMEVETLEDRITWELGYNVRTKFLGDDMVLLPGMSDDKAQLLIQSETESDDSLFYSLEKWTPKCRPNNRVVWLQLWGFLIQVWEMKNLRRDVAAIGDVIESDDDTEDRRRLDRARVLVRTPLPPLIRSEVIVRVGELEYRVWIVEETGFEGGSNRKGSSPSDGWSEMITSDDEGEVGDVLGDTNTNFSFSPELPNQKLSPSRTQRAEGGTD

SEQ ID NO: 144249 - protein, 60 aa, Glycine max
  Coding DNA Sequence Number=SeqID_52564
MNTGSFSLKSFEGPSKLEASLGEIGSRKTGRRLASVCKLTYSKASKGYGDLDDATSSEGR

SEQ ID NO: 144250 - protein, 70 aa, Glycine max
  Coding DNA Sequence Number=SeqID_52565
MARLAHISGFWLSASLLAQPRGCRRLLCAQPADVALSGLLAQRMKRLSKSMNSALHQSCPFYLKLKWNDH

SEQ ID NO: 144251 - protein, 352 aa, Glycine max
  Coding DNA Sequence Number=SeqID_52566
  Homolog annotation: Hit_ID=Q1RU92; Match level="QueryCoverage=34%, HitCoverage=25%, E-value=9e-08, Identity=32%"; Hit description=Non -LTR retrolelement reverse transcriptase-like protein, related
MSHTKCLIICRNAVLNLNLPPEVSCTLGDNDSTTDDDSSHSCGSKSSPQLDDNKAPTPWVNLFKDNRSPSKGFGMKFSPPPSDDEVLLEETDLQPLEEAWGHSLIGYVAGRFQGKKALLDCCQKWGVKFSYSAHESGWLVFKFESKDDLNQVLSHSLTLAMNSSARSLSGLTQKSTSGALESSSLREILSKIGSPIRSDHLTASKGSISFARALVEVNASLELIDEVRFRLPTGKTFVQKIEYENRPSFCTHYKMIGHRLTNCKAVTANKPVLITACPTLDQPQVGDSAMPPHTNTAGPSDNPKNVQTNLSVPHHRKHVLVANHVPVLQNSSDLKETGNTELDDPIEEGLFR

SEQ ID NO: 144252 - protein, 128 aa, Glycine max
  Coding DNA Sequence Number=SeqID_52567
MEGLVDLAVIDAFLAFHHGKESPVDAILAMYDTFDRGGEKSGARIVCCALALPRVAGFTPFFPRRMSKCSLDGTRGCINYNPVLAIRQLGYPMRGVPSDESITPFIARGFSDHNARVLQGVRKAWDAV

SEQ ID NO: 144253 - protein, 238 aa, Glycine max
  Coding DNA Sequence Number=SeqID_52568
  Homolog annotation: Hit_ID=O19115; Match level="QueryCoverage=96%, HitCoverage=36%, E-value=2e-07, Identity=28%"; Hit description=Muc1
  Subcellular localization annotation: CTP_CleavageSite=47; ConfidenceScore=5.53e-01
SPMNSVPSAVHVSSTFESGAPQIDCLALFANSPFSTFIRSPMNSLPSAVHVSSTFESGAPRIDCLALFANSPFSTFIRSPMNSLPSAVHVSSTFESGAPRIDCLALFANSPFSTFIRSPMNSLPSAVHASSTIESGAPPMNSLPSAVHVSSTFESGAPRIDCLALFANSPFSTFIRSPMNSLPSAVHVSSTFECGAPGIDCLALFANSPFSTFIRSPLNSLPSAVHVSSTFESVAPWN

SEQ ID NO: 144254 - protein, 110 aa, Glycine max
  Coding DNA Sequence Number=SeqID_52569
MGEVEEIQEKMKADVEAIKEKMATMMEAMMSVKKIMEANTVAIAATSKDLGSMGGLHDVQIQNEHAFLPYGLPLNYTPPNVAYTPNKNVNNSTPIPIESQQPQTDHAHVS

SEQ ID NO: 144255 - protein, 16 aa, Glycine max
  Coding DNA Sequence Number=SeqID_52570
MAIIMPIHACLIIFMK

SEQ ID NO: 144256 - protein, 70 aa, Glycine max
  Coding DNA Sequence Number=SeqID_52571
MNCVFVHASSAHEFGAMRTDCLVHFSILYLVLEPHELRFRFMHPPPTSFGSCVVIAYCNSPFSTPFFGAP

SEQ ID NO: 144257 - protein, 18 aa, Glycine max
  Coding DNA Sequence Number=SeqID_52572
MDSVLAQTSILVLAVSIK

SEQ ID NO: 144258 - protein, 358 aa, Glycine max
  Coding DNA Sequence Number=SeqID_52573
PEEDEEVRALKLELGKARLAKEKFKSAATHIRKECTELQEENAATARALEQETKRAHKEEYGREKFRGALSKRSLAQHLEATEQSMLAIIGQYKEELNQSTAHEQKLVEDFAQVYAKKEARGRVIDALHQEATIWMDRNFIITKKTPRHPYDTRSRKMDNEEGVQEQMKADLSALKDQMASISEVMLKLQKTIEDKATATASNTVREAELVLQPTFNPGLDRNTVVFGRRYSPQAYPYGLPPDFTPRATPEDLSQAPTFEGQLPPYEDYPGQDDAEGDTHLGPLLHLKDPSPHELPQPNIVRHIPASPTPVKEFVPFAEDKGKIEVLEERLRAVEGLGNYPFSDLADLCLVPNIVTLP

SEQ ID NO: 144259 - protein, 141 aa, Glycine max
  Coding DNA Sequence Number=SeqID_52574
PAINLARDKNATGFNRRYSPQAYPYGLPPDFTPRTAPDDLSQAPSFESQDGLQEDDEGDAHLGPLLPLKEPAPHELPQPNVVRHVPSPSAPVKELVCFAKDKGKIDLLEERLRAVEGLGSYPFSDLADLCLVPDIIIPPKF

SEQ ID NO: 144260 - protein, 115 aa, Glycine max
  Coding DNA Sequence Number=SeqID_52575
EFPQAADWLDQISKSKWTQAYDKGKWYDHMTTNLAEWHRYFRRRIFGKGTIIQLPHIMFLYGSTTAQHFVPGYEMRKSRFEAKFLTMRAEFPQAAYWLDQIPKSKWTQTYDERKM

SEQ ID NO: 144261 - protein, 165 aa, Glycine max
  Coding DNA Sequence Number=SeqID_52576
  Subcellular localization annotation: CTP_CleavageSite=72; ConfidenceScore=5.02e-01
YPELRRSEFLIGGYVGAGASLLSTAPLFVTMTQKLVARGDTLRLSAPRHSVTPSVIDERRPMWSSAPFPEVSAFSGGDFFKSHKIRRHAEPCILHPLCHPEAVGHDMRRQIMVIPHPFAIPTHLCPMARRDKLWSFCTLLSSRGGGPDDMRRQIMVIPHPFAIQT

SEQ ID NO: 144262 - protein, 24 aa, Glycine max
  Coding DNA Sequence Number=SeqID_52577
MHISDLRNEGNGPEEACLKEIHEG

SEQ ID NO: 144263 - protein, 106 aa, Glycine max
  Coding DNA Sequence Number=SeqID_52578
  Subcellular localization annotation: CTP_CleavageSite=30; ConfidenceScore=5.15e-01
MYPLLFSVTTTQVYVPSICTIKDVPSNVLRQSSQAVSPLKLCEGETKDISGVTGNRLSLRCVTTCPSWASEGEAHGCAFRRRKDARSRHQHLFVENVGKTEGNRSK

SEQ ID NO: 144264 - protein, 274 aa, Glycine max
  Coding DNA Sequence Number=SeqID_52579
  Gene Ontology: Mol. function=motor activity; Cellular component=cell projection
  Homolog annotation: Hit_ID=UPI00006A2D9E; Match level="QueryCoverage =51%, HitCoverage=76%, E-value=2e-10, Identity=18%"; Hit description =UPI00006A2D9E related cluster
GFRGLHVLAFRGLHALVFRRLHVLAFSGLHILAFRGLHVLAYRGLNIVTLSGLHALTFRGLHVLLFRGLHVLAFRGVHALAFRGLHVLALRGLHVLPFRGLHVLAFRGLHVLAFRGLHVLAMPSEDLTSSPSEDYTPSPSVDYTTTCPRLQRAARPRFQRAPHLRLQRSQGASSFHLSVAWPPPDLRGGPTVRAQPEREAIVQLLCISGIDFAQTATGRRLRIMRTTTTLIFPCRRITPTRHPVDPGKSNRVLRFPALVMGLCQSYRVSVPPSK

SEQ ID NO: 144265 - protein, 168 aa, Glycine max
  Coding DNA Sequence Number=SeqID_52580
  Gene Ontology: Mol. function=oxidoreductase activity, acting on the CH-OH group of donors, NAD or NADP as acceptor; Cellular component =integral to membrane; Biological process=lipopolysaccharide biosynthetic process
  Homolog annotation: Hit_ID=A6TF98; Match level="QueryCoverage=99%, HitCoverage=25%, E-value=1e-91, Identity=98%"; Hit description =Bifunctional polymyxin resistance protein arnA [Includes: UDP-4 -amino- ...
  Homolog annotation: Hit description=4-deoxy-L-arabinose formyltransferase (EC 2.1.2.n1) (UDP-L-Ara4N formyltransferase) (ArnAFT); UDP-glucuronic acid oxidase, UDP-4-keto- hexauronic acid decarboxylating (EC 1.1.1.n1) ...
  Homolog annotation: Hit description=(UDP-GlcUA decarboxylase) (UDP -glucuronic acid dehydrogenase) (ArnADH)]
MGPRLDNLNAARIGSSRAITQLILNLVEGSPIKLIEGGKQKRCFTDISDGIEALFRIIENKDGRCDGQIINIGNPENEASIKELAEMLLACFERHPLRDRFPPFAGFREVESSDYYGKGYQDVEHRKPSIRNAKRCLNWEPTVEMEETVEHTLDFFLRTVELTDDKNS

SEQ ID NO: 144266 - protein, 141 aa, Glycine max
  Coding DNA Sequence Number=SeqID_52581
MCQWACRPRLTNGAEDDVSLCVLSGFSSYRQQKVYTDNHSGISGRQRDSKVSMTDLVSAEDDVNLHVSTGLSAAIDEGRRRRRFSSYRQQKVYTNNHSGISARQRDSKVSMTDLVSAEDNVNLHVSTGLSAAIDEGRRRRR

SEQ ID NO: 144267 - protein, 21 aa, Glycine max
  Coding DNA Sequence Number=SeqID_52582
MWLKGMNALSGPCRAKRVHPY

SEQ ID NO: 144268 - protein, 151 aa, Glycine max
  Coding DNA Sequence Number=SeqID_52583
  Homolog annotation: Hit_ID=A6FJQ2; Match level="QueryCoverage=25%, HitCoverage=84%, E-value=3e-11, Identity=92%"; Hit description=50S ribosomal protein L5
MTVKTSDTCSSRRRSQLVCKRMPGADKPVRARQRMRKEKIPHQAPFAIQAAQLLGRAIGAGLFAITPAGERGMCCKAIKLGNARVFPVDSRGSRELDGFPLKRYKFVEFSNVIDGQFEPGLLVDIIGVVDEVVFHHVSSRSRRVVFKLRDL

SEQ ID NO: 144269 - protein, 64 aa, Glycine max
  Coding DNA Sequence Number=SeqID_52584
MGRDLKKAHCPTNESWPEKKSHEERRSKKAYIAWDDNDSSDGSEKEINLLSKDYESDENISQED

SEQ ID NO: 144270 - protein, 123 aa, Glycine max
  Coding DNA Sequence Number=SeqID_52585
MVLLTRHEESIKARLCFAFSINQSFNLSNLSISLNFFFFLLPKAFQEFSGYILCGTSRGYIYLGLTENKRGYISCGSVLVEGTSTRFKENKGGYIPCGSFLVKGFLQGWKRNLKDRRLLGDWM

SEQ ID NO: 144271 - protein, 83 aa, Glycine max
  Coding DNA Sequence Number=SeqID_52586
MGHPKRIKVIPEWPTPPSIKKIRGIHDLTYFYKRCPGVATYPSVGGRRGAHECVFQGRKACGVATNVYLRKTSEKPKHVVYEF

SEQ ID NO: 144272 - protein, 674 aa, Glycine max
  Coding DNA Sequence Number=SeqID_52587
MVEYNLSLFLPPTAAQHHRGIVTPGYAAPPAADNALFRPVFALSIHYPIGETLAARLQQFGARLDLRFFLPVDLLRFRQIALTQPRPAALVQQQQRLTQTALIARQQFRQLRLCLFRRQRGKAPGGVLAAIHAALAGAAGAAVHQVLQPQQYAIHRRQRRGPPAQQAVTLHLMQPAAEAHAGDIDIQLQAMALCAFRTHLLGQFAHLFLLLLPINFAEGAIGQAAGGAHPLEQPFGIVTVDQRIQQLAVELVAAEVIQREGLFVRQLGLFQDKTDAQPQLEKRANRMAVKPQQFIQRYLLQRFGGQRLVERRMRRTAPIGGGQPLGGIALLLRARQEVLGGERHARVPLQQVLTNPPGAVVCAKLFISRQAIALFQVLQQLSDQYRRVARAVVLNGTADEADIQPLLRGQNRFQEQITVVIAPAAVAAFDLLRHQIETQRRQRARIHAVVHAQQAHHLERNGTHRHQRTEVDLPGEEALADALLIEARRQIVPQNGQRHLIGIARRQAKIDGLLPLLFDQRQHHLGVAVRSEEGIQQLPAERQPRFERARFAQDLPPVAELRQQVCQLPRQFGDQSARFVVRQNALPIAGIAVHRVAKQHARDAKAPGMLAGSGQIQFAHVIVVQAPAHAGFTDPMAQQAQPLFANGETGGQGRHLKQRQHLFRGTTALRQIEQ

SEQ ID NO: 144273 - protein, 86 aa, Glycine max
  Coding DNA Sequence Number=SeqID_52588
  Homolog annotation: Hit_ID=UPI0000ECBAF8; Match level="QueryCoverage =47%, HitCoverage=48%, E-value=1e-16, Identity=100%"; Hit description= UPI0000ECBAF8 related cluster
DNNFTQETAYDHDYEFELGTSSPALKPAPTSSSSMQAWHWPSFYNVVTGKTLALPNLIALQHIPLSPAGVIAKRPAPIALPNSCAA

SEQ ID NO: 144274 - protein, 84 aa, Glycine max
  Coding DNA Sequence Number=SeqID_52589
MTTLASACQSNLGSPNDEVRITERCLRMLPDSWVMIAKGGVVDKSETFAPTVCGKLGFRLKACRTARLDIYQDVGLANGSGKKE

SEQ ID NO: 144275 - protein, 84 aa, Glycine max
  Coding DNA Sequence Number=SeqID_52590
  Gene Ontology: Mol. function=chitin binding; Cellular component =extracellular region; Biological process=chitin metabolic process
  Homolog annotation: Hit_ID=UPI00006A17C9; Match level="QueryCoverage =90%, HitCoverage=71%, E-value=4e-08, Identity=36%"; Hit description =UPI00006A17C9 related cluster
  Subcellular localization annotation: CTP_CleavageSite=75; ConfidenceScore=5.79e-01
MARACSPLKVRTCSPLMARACSPLKVRTCGPLKVRACSPTKVRTCSPLMARACSPLKVRTCSPLMARACSPLKVRVTSTQGEGG

SEQ ID NO: 144276 - protein, 294 aa, Glycine max
  Coding DNA Sequence Number=SeqID_52591
  Homolog annotation: Hit_ID=A0U0A1; Match level="QueryCoverage=81%, HitCoverage=49%, E-value=2e-27, Identity=31%"; Hit description =Putative uncharacterized protein
MSDGPDGNSVRACNLQRLMAGFVGQQQGDQRQRRHRRQVDTDSRQAVIALQPGGNIWCDRRAEDRRHVIGERGAGITYFRREQLRQQRAHRAEGQPHQAKAQQQEGEDQNRVAGTEQRFKSEQREQNNHRGDDNHAFTTAKGIRQQARHRHHHAETNDRHHQHPQHFGIGRQHDEGAEHGHAHVLSQQRAKRNFDLTDNDQYRREDERHAPAPFHKLLVAQQPRQQQEGARRPAPFAAKAETLTKARQRQQHRRQNANAFIARQQADDHGGDAHGQQRGDECDFTAYAVAKVAE

SEQ ID NO: 144277 - protein, 157 aa, Glycine max
  Coding DNA Sequence Number=SeqID_52592
MDMNMGYLISHRISMIAQHDSSRLGFLALITALYATCHDAEPTLRAGHYYAKLPYLGPTIYHEHGRLSHSGGLAKSPAFSFWRGETSTTQEPELAEEHTPAAEDELTSLEPFSFASDSVVAQEEVPSPELILEPSPAPISEDTLPSTPALEQEQPIS

SEQ ID NO: 144278 - protein, 211 aa, Glycine max
  Coding DNA Sequence Number=SeqID_52593
  Gene Ontology: Mol. function=helicase activity; Biological process =viral genome replication
  Homolog annotation: Hit_ID=Q2A9E0; Match level="QueryCoverage=94%, HitCoverage=13%, E-value=6e-42, Identity=45%"; Hit description =Putative uncharacterized protein
MSMQKVSEWPGTDSQLDNVKLRLIAGREKDGRTYNLPNVSEVVALIVGDFDADSRRDIIVETQNGELQRIHELHFSYLGLQYHLLFPYGEDGYRPDILHRSISSNRKRKRNHLTMREWFSYRLQSRSNEAQTLLHSKKLFQQFIVEAHTMVESERLSYIRNNQKKLRVDKYCSLQTSLDAGSSKGSSKGKRVILPSTFVGSPHYMDQLYFD

SEQ ID NO: 144279 - protein, 143 aa, Glycine max
  Coding DNA Sequence Number=SeqID_52594
MWPSSLMKNVQQHFRSPTESKLTTAPVMGEHIATRLLKVLNEAQLNYPRKGNSCVPWRSSMILAYRTDGSSYCKNLTSSSDKRGSENVVANHLSRLKNEEVTKEEPEVTTRPWFVDTANYKATGVIQRSTLGIRGEFYTTHAS

SEQ ID NO: 144280 - protein, 98 aa, Glycine max
  Coding DNA Sequence Number=SeqID_52595
MSSFRDLEQKWAPKVEALLGNNGGWEKRRRRLRERERASEIFLGLSEEREREISRMSHKELIKIFGMENSKHLATPMSTSCYLDKDESGQPVDAKQYR

SEQ ID NO: 144281 - protein, 106 aa, Glycine max
  Coding DNA Sequence Number=SeqID_52596
  Subcellular localization annotation: CTP_CleavageSite=83; ConfidenceScore=5.68e-01
MDVLRLVGTSAGKFLTPVQVATPSQRGAANTRRKDSFLPNSLLRGLLRPTSGSKFSSQCVVLIGTRSEANLKPLYVLEFCAPRSLTRKGDMLSSVGAPLMGYLVVL

SEQ ID NO: 144282 - protein, 55 aa, Glycine max
  Coding DNA Sequence Number=SeqID_52597
ERPELKLVSHGRKVEKFGRPAPEIAGLVAAIGLTPLIGCSVVTGDPGVISAFMER

SEQ ID NO: 144283 - protein, 75 aa, Glycine max
  Coding DNA Sequence Number=SeqID_52598
KGPVTRTMSKRLQEDWARAVEEGPRVLMNLRISELFLSTKFRALLSLSLHSSPSSSKLLSMASYGGKLLLDSSSP

SEQ ID NO: 144284 - protein, 313 aa, Glycine max
  Coding DNA Sequence Number=SeqID_52599
  Gene Ontology: Mol. function=catalytic activity; Cellular component =endoplasmic reticulum membrane; Biological process=meiosis
  Homolog annotation: Hit_ID=A6EBL8; Match level="QueryCoverage=96%, HitCoverage=69%, E-value=1e-116, Identity=62%"; Hit description =Putative uncharacterized protein
  Pfam annotation: Domain name=DUF1237; Domain location=42-313; Score =321.6; E_value=1.4e-93; Accession=PF06824.2; Description=Protein of unknown function (DUF1237)
NAFAKGLGVEEFPVVRVPKDKRHFTSEAVENAISAFKKKVKNKELTWLFENCFPNTLDTTVFYTENNGTPDTYVITGDIDAMWLRDSSAQVFPYLQFSKKDEKLHKLISGVIHKQTQFILKDPYANAFYNDDQKISKWKEYDHTDMKPGIHERKWEIDSLCYPIRLAYHFWKTTGDTKPFDNNWLQGIKLTLKTFIEQQRKTGLGPYQFERTTAWATDGIPMGGYGYPTKPVGLISSMFRPSDDATIYAFLIPSNLFAVPAAIKKYGIYDHPQYGKIYAFETNGFGSYNLMDDANCPSLLGLPYLDAVKADDP

SEQ ID NO: 144285 - protein, 106 aa, Glycine max
  Coding DNA Sequence Number=SeqID_52600
MRSPMIDGGNEYAQNTRETHKGVDHGRDSVAPRASFSLLSSSSLSILSISFNAEPWNPLLSPLHAYLYPKMAFGGPAAHPGKLRLSHEAIGSPRRARDWCRTTQFG

SEQ ID NO: 144286 - protein, 92 aa, Glycine max
  Coding DNA Sequence Number=SeqID_52601
QPTLLRLPSLSQFSIRFDYAHLCNYKVCKGVQSLKRYEPKDGELGNKHPKTEKRGHLIDCVFNKKIEVVIRKEANLTQLPTNDWKTGANEEG

SEQ ID NO: 144287 - protein, 175 aa, Glycine max
  Coding DNA Sequence Number=SeqID_52602
  Gene Ontology: Mol. function=DNA-directed RNA polymerase activity; Cellular component=chloroplast; Biological process=transcription, DNA-dependent
  Homolog annotation: Hit_ID=Q8HVY4; Match level="QueryCoverage=62%, HitCoverage=16%, E-value=2e-55, Identity=98%"; Hit description=DNA -directed RNA polymerase subunit beta'
  Pfam annotation: Domain name=RNA_pol_Rpb1_2; Domain location=2-78; Score=48.0; E_value=1.5e-11; Accession=PF00623.11; Description=RNA polymerase Rpb1, domain 2
MGILQEVMQDHPVLLNRAPTLHRLGIQAFQPILVEGRAICLHPLVCKGFNADCDGDQMAVHVPLSLEAQAEARLLMFSHTNLLSPAIGDPISVPTQDMLIGLYILTSGNRRGPIIVFQFLRKSSIKKSSFPIIDLIRGLIRKHFASNIGIAKSKFGKRPIVWEYFKKLCRDIPYC

SEQ ID NO: 144288 - protein, 116 aa, Glycine max
  Coding DNA Sequence Number=SeqID_52603
MGYMGVRELSWRWATGDDEPVRTLQRTVEWILPTPTPYRLVEPVQVIEVTSSEEDTEEDLEELPPEPVVDALDFLEGDEDPLLEVDSPEEVMSASEADSTEDSGPGEMAINGSSSS

SEQ ID NO: 144289 - protein, 162 aa, Glycine max
  Coding DNA Sequence Number=SeqID_52604
MRIAVERPGGTSGPSHGRKGDDHHDGYMPSSFADLVFTEERIAVGLKRGKFDYISSTSTHAKRVGATGAKRKEGDTHAVTSAPAWVKQPQTSCHTLISSRDHCFMACNLCLTSSWYLAPFVAQYMKFRDMPESKGSIATQSVKFRNMPEIKRKYCYAIREFP

SEQ ID NO: 144290 - protein, 273 aa, Glycine max
  Coding DNA Sequence Number=SeqID_52605
TSPSGRVKRVLAGVGGWLNYAASEQIVLRVHHMRCEIPHRCVRRKYRIRRHSPFRLRNCWEGRSVRASSLLRQLAKGGCAARRLSWVTPGFSQSRRCKTTASAKLACLQVDSRGSPKENQERQEKGNIRVEELSQDEREKIREEERRQIMKEMKREKYVSYSSHNSCKSLSEELCEYYEGRHRSHLRPQSHRRESERKSQEVNIKLPYFHGKDNVEANVDWEIRVEQQLRRKSTSESYGSHSYPKKDQGQGILGVRPSKPKDDTGTTIEKQAL

SEQ ID NO: 144291 - protein, 118 aa, Glycine max
  Coding DNA Sequence Number=SeqID_52606
  Homolog annotation: Hit_ID=A5BSZ8; Match level="QueryCoverage=87%, HitCoverage=10%, E-value=4e-16, Identity=44%"; Hit description =Putative uncharacterized protein
MLEEKFVTIIDASSNAKKVHYKAWERSNRLSLMLMRMTVADSIKTTLPKIESAKRFMGLVGECSQTADKSVAGILMSTLTTMKFDGSRTIMLVQEETRLKNQGSHSVHYVSHQGNQGA

SEQ ID NO: 144292 - protein, 111 aa, Glycine max
  Coding DNA Sequence Number=SeqID_52607
MRVTRFGSILGRIDSLLKGNPSLAQEGMDLFRFWRGSITMHIGWTSQKSGADIEEEELTDLRSNPLQGGGDDAILPRKEPVNRAMSKRLQEDWARAAEEGPTVLMNLRVDF

SEQ ID NO: 144293 - protein, 103 aa, Glycine max
  Coding DNA Sequence Number=SeqID_52608
  Subcellular localization annotation: CTP_CleavageSite=67; ConfidenceScore=5.69e-01
MSPPPLEPHNHSHTHLMLSGRLPRQARFSAGGFVCASALSTTMDRSTRISGFRLSTCFSRSVDGLKRCAQRDDPSLSEHAQLILLLDSSSHSTEECCAQRMAR

SEQ ID NO: 144294 - protein, 94 aa, Glycine max
  Coding DNA Sequence Number=SeqID_52609
MSVFRLTPKPRLPHNFVKFSFLPKPSLIPTCHLTCLRTLMILDSFTLLERRDWEKKDSHEDSTSGGFNLFSVSLTFVNSIGAVGGITEGISGNR

SEQ ID NO: 144295 - protein, 167 aa, Glycine max
  Coding DNA Sequence Number=SeqID_52610
  Homolog annotation: Hit_ID=Q1LCC9; Match level="QueryCoverage=56%, HitCoverage=64%, E-value=2e-19, Identity=46%"; Hit description =Putative uncharacterized protein precursor
MSNNLAKARPRALARMGRAMAVVAVAGLLGACAQQPKSMYSWQSYQPSVYAYLKDDGADYAAQSLAMEKNIETARASNAQLPPGFRAHLGMLYLKLGDGAKGLEQLEGEKAAFPESKPFMDFLLRNASKMADNAAPSEPASAAPSAAPAAPAAAPTPASAQPAKKGA

SEQ ID NO: 144296 - protein, 70 aa, Glycine max
  Coding DNA Sequence Number=SeqID_52611
MIVKETELCRSKLHDDEPSNFDDAKRPSLGSSSSMDSFASWKMNGSIMEKEEREETPLQGEDESRRSSPP

SEQ ID NO: 144297 - protein, 69 aa, Glycine max
  Coding DNA Sequence Number=SeqID_52612
  Gene Ontology: Mol. function=structural constituent of ribosome; Cellular component=ribonucleoprotein complex; Biological process =translation
  Homolog annotation: Hit_ID=Q2PMQ2; Match level="QueryCoverage=63%, HitCoverage=31%, E-value=1e-10, Identity=77%"; Hit description =Chloroplast 30S ribosomal protein S11
MEVSYRCHYCMPVRNVNHSIHSYVNGNESTRRGILFCPRNAAGNAIRTVSDQGMQRAEVMIKGPGLGID

SEQ ID NO: 144298 - protein, 68 aa, Glycine max
  Coding DNA Sequence Number=SeqID_52613
MFGASPSEICGNSCYMSPLSKTLPERLKTKVENQTGLKVKSLKSNNDGKYDSQEFKDFCSEPWKGQND

SEQ ID NO: 144299 - protein, 192 aa, Glycine max
  Coding DNA Sequence Number=SeqID_52614
MDIIPDKYPLSLQNIKFGSKLYVNADITEIHEFRQSLSVPFYSGGMINDKDGSQSQSSQSNVVEKFLQNAQVVSIGEINNLRQDCYCLTVGTVDEIIIDAPWSYDSCPNCTTTFDPLKGGSACRSCHTSVVDTVPRYKLNVKMEHNGDKGNFLLWDATCIKLFGKTAGECRDELIAVGDDIKVFPTCVDEIL

SEQ ID NO: 144300 - protein, 59 aa, Glycine max
  Coding DNA Sequence Number=SeqID_52615
MTLTIPELFLRPYQVTWDTTVFGVFNPDFSFYIEHEDRTSRKSHAVVNVSTYQCYSHGF

SEQ ID NO: 144301 - protein, 139 aa, Glycine max
  Coding DNA Sequence Number=SeqID_52616
MAVQLIHDQVEMECLEGVWETLEGNARCRFRGTIRLIATSLVHPEEPARTLQRTVEWILPTPTPYRLVEPTQVIEVSSSEEDPEELPPEPVVDALDFPEGDEDPLPDVDSPEDVMSASEVDSTEESGPGGIATSGDSSS

SEQ ID NO: 144302 - protein, 71 aa, Glycine max
  Coding DNA Sequence Number=SeqID_52617
  Subcellular localization annotation: CTP_CleavageSite=38; ConfidenceScore=5.15e-01
TYQGNPCGVYPDLSSFTGSGVYPDLSSFTGSGVYPDLSSFTGSGVIQTFVACIKRSAPTQVHIIWYQSFSS

SEQ ID NO: 144303 - protein, 90 aa, Glycine max
  Coding DNA Sequence Number=SeqID_52618
  Homolog annotation: Hit_ID=A5AV98; Match level="QueryCoverage=98%, HitCoverage=11%, E-value=3e-19, Identity=51%"; Hit description =Putative uncharacterized protein
MTVADGINTTLPKIDNAKEFMRLVGEHSQTTDKSLAGTLMSTLIIMKFDDSRTMHEHVIEMTNIATNLKTLGMTVNENFLIQLILNSLPS

SEQ ID NO: 144304 - protein, 156 aa, Glycine max
  Coding DNA Sequence Number=SeqID_52619
MTDLVSAEDDTAKKNVYTDNHSGISARQRDSNVSMTDLVSAKDDTAKKNVYTDNHSGISARQRDSNVSMTDLVSAKDDTAKKNVYTDNHSGISARQRDSNVSMTNLVSAKDDVNLRMLFVLQTAKKNVYTDNHSGISARQRDSNVSMTDLVSAKDD

SEQ ID NO: 144305 - protein, 35 aa, Glycine max
  Coding DNA Sequence Number=SeqID_52620
SVWASAAVEKSIDRAVAAPAKMALLVIDGPPPHEG

SEQ ID NO: 144306 - protein, 275 aa, Glycine max
  Coding DNA Sequence Number=SeqID_52621
  Gene Ontology: Mol. function=chlorophyll binding; Cellular component =integral to membrane; Biological process=photosynthetic electron transport
  Homolog annotation: Hit_ID=Q2MI75; Match level="QueryCoverage=99%, HitCoverage=53%, E-value=1e-148, Identity=93%"; Hit description =Photosystem II P680 chlorophyll A apoprotein
  Pfam annotation: Domain name=PSII; Domain location=1-267; Score =293.9; E_value=3.1e-85; Accession=PF00421.10; Description =Photosystem II protein
MKTVLSSSIAAVFFAAFVVAGTMWYGSATTPIELFGPTRYQWDQGYFQQEIYRRVGAGLAENQSLSEAWSKIPEKLAFYDYIGNNPAKGGLFRAGSMDNGDGIAVGWLGHPVFRDKEGHELFVRRMPTFFETFPVVLVDGDGIVRADVPFRRAESKYSVEQVGVIVEFYGGELNGVSYSDPATVKKYARRAQLGEIFELDRATLKSDGVFRSSPRGWFTFGHASFALLFFFGHIWHGARTLFRDVFAGIDPDLDAQVEFGAFQKLGDPTTKKQVV

SEQ ID NO: 144307 - protein, 76 aa, Glycine max
  Coding DNA Sequence Number=SeqID_52622
MWTTTGEELATQLGQASKVASSRSNSLLEEGSGRPKRARLLFLSKKLRKLTDYAKTPLFDFRHITEFHRSHKPASF

SEQ ID NO: 144308 - protein, 47 aa, Glycine max
  Coding DNA Sequence Number=SeqID_52623
MPWKICMDSLTHGVRNLFATKVGASCRVSFIERKIGNGSEEAIHEEV

SEQ ID NO: 144309 - protein, 122 aa, Glycine max
  Coding DNA Sequence Number=SeqID_52624
MSAKSSSGYTSKGGDEYAKFVLFPNMEGLVDLVVIDAFLAFQHGKESPVVAILAMYDTFDRGCEKSGTRIVCCALALYVWLVSHPFLQEGRPVYPLQGHRSCVEKGKANWTNSWLTWRASVN

SEQ ID NO: 144310 - protein, 104 aa, Glycine max
  Coding DNA Sequence Number=SeqID_52625
MRLPGKESLPMGSPITINEIVDVSISFLDDHLEETPGSTKIEENHSKCINLAQIMDYLHDHGSIGLPLGMGSFGGLDGRLLCVCGFRFYWLVLDLYKFGLVRGE

SEQ ID NO: 144311 - protein, 97 aa, Glycine max
  Coding DNA Sequence Number=SeqID_52626
  Homolog annotation: Hit_ID=A5AKH3; Match level="QueryCoverage=42%, HitCoverage=7%, E-value=7e-09, Identity=56%"; Hit description =Putative uncharacterized protein
MKDSLRQSWYIDSGCSKHMTRDASKFIHISPKNSGHVTYGDNNKVMRILKLAKYRLKAQLEKDEGPSGEGQSPRVEKDEGPKAETLSRLLIVAEGLD

SEQ ID NO: 144312 - protein, 68 aa, Glycine max
  Coding DNA Sequence Number=SeqID_52627
MKAARVPYQGLKSYFFKTKEENVQAADDSLSEANPLSEWHPLSEASNSLSGWETLEDDSQRCAHPVHS

SEQ ID NO: 144313 - protein, 88 aa, Glycine max
  Coding DNA Sequence Number=SeqID_52628
MMAHQNPPYLAFCTPGQNETKNKIQGYQRETNKNIHIFLNEHQGMKGMAHEDQKVFKVVMGPRTRYGEIWNKWLNPKGIEEQRGISAY

SEQ ID NO: 144314 - protein, 43 aa, Glycine max
  Coding DNA Sequence Number=SeqID_52629
MEFNIHLGSTFQPAIISPKLKFTIDTIIRNPKSSSKGSQSKTL

SEQ ID NO: 144315 - protein, 119 aa, Glycine max
  Coding DNA Sequence Number=SeqID_52630
MRGQWIPFDEDAINQFLGHPLVLEEGQRCEFSQRRSQASGFDEEAISQLLCVPGQDFAWSMAGRRVQIMHTSMTTLTQIWMTLLLNNILPSDHNSDLPLPKCQLVYAILTQGSHLVDTQ

SEQ ID NO: 144316 - protein, 173 aa, Glycine max
  Coding DNA Sequence Number=SeqID_52631
MAPRKLASKRSRKDKAAEETSSAPEYDIQRFRSVVHQQRFEAIKGWSFLRERRVQLRDDEYTDFQEEIGRRRWASLVTPMAKFDPEIVLEFYANAWPTEEGVRDMRSWVRGQWIPFDADAIVQFLGYPLVLEEGQECEYGQRRNRTDGIGEEAIAQLLCITGQDFARTAAGRR

SEQ ID NO: 144317 - protein, 58 aa, Glycine max
  Coding DNA Sequence Number=SeqID_52632
MGVKYLKAVKRRLHATKQWSPDEIRANNSWDSRLNDGGCMNNARQSIHGAPDLMVEDA

SEQ ID NO: 144318 - protein, 155 aa, Glycine max
  Coding DNA Sequence Number=SeqID_52633
  Homolog annotation: Hit_ID=Q2HUM1; Match level="QueryCoverage=37%, HitCoverage=74%, E-value=3e-08, Identity=51%"; Hit description =Putative uncharacterized protein
MQAQAQQQKNLEINGLKRIEEESNIILKEWQPKVTAISESKDLSSMSLATLFGKLQEHEIELQHLNQNEETDKRKRSIALKASSSIQEEEEEEEEEEEEEEEESDDEEDFSLFVKKFHKFVKNRRMERNHNFNNGKRSQEVSRHLNAISVINPVT

SEQ ID NO: 144319 - protein, 64 aa, Glycine max
  Coding DNA Sequence Number=SeqID_52634
MASSSSSSSHINIKSGPIDSDNMFGMGKKIGNYISDELSPRIKGKKKFQSKFFLFFDNLVSPGL

SEQ ID NO: 144320 - protein, 62 aa, Glycine max
  Coding DNA Sequence Number=SeqID_52635
SKLEDGGHMNENAIHGAPKKGLRMENCTKQSLRMAPNSKGLRMENCTKQSLRMAPNSKVEDT

SEQ ID NO: 144321 - protein, 65 aa, Glycine max
  Coding DNA Sequence Number=SeqID_52636
  Homolog annotation: Hit_ID=A6FJQ2; Match level="QueryCoverage=58%, HitCoverage=84%, E-value=3e-11, Identity=92%"; Hit description=50S ribosomal protein L5
MRKEKIPHQAPFAIQAAQLLGRAIGAGLFAITPAGERGMCCKAIKLALGNNLHGAPKKGENGGLP

SEQ ID NO: 144322 - protein, 213 aa, Glycine max
  Coding DNA Sequence Number=SeqID_52637
MAASDIAILRDRAHIPTKKSLLELTSQDALLAQNKLLSKKLEALTETLTHDSGCCIPSEKPIVHEVKYMGNQPRNTFNAGGFTGFQNGQQYQQHRQWQNHPSNQSNRDQNGQFNRPQQQGPSLYEHTTKLEETLAQFMQVSMSNQKSTKFAIKNLEVQVGQLIKQLADRPSSSFTANTEKNPKEECEAIMTRNRMATHVDEGKVEKKVEEQKQ

SEQ ID NO: 144323 - protein, 61 aa, Glycine max
  Coding DNA Sequence Number=SeqID_52638
VDSRGSPVRERAPRPRRGHQGAVGRQGPQPEVGPADAGAARARRRRLRPRLRAAAAPVLSP

SEQ ID NO: 144324 - protein, 131 aa, Glycine max
  Coding DNA Sequence Number=SeqID_52639
  Homolog annotation: Hit_ID=A5C7Z4; Match level="QueryCoverage=72%, HitCoverage=33%, E-value=3e-08, Identity=34%"; Hit description =Putative uncharacterized protein
MKSWMQSSKYDVYLGAYLNSGHWKMVIIMPKENLVVWFCSLHNRPDNYLKGIINSVLKGLDDTPQPKSKDGARWIIVKCYRQKGTTECGYYIMHWMSTIILGTFKNNWETYFNDVRPLEAERLKVLRIQRA

SEQ ID NO: 144325 - protein, 78 aa, Glycine max
  Coding DNA Sequence Number=SeqID_52640
MENWRTALRNNLAGLQTPLGNDIHGAPKKVENCRTALRNNFAGLQTRRWRMLEQRQAMPFMGLRKKVENGELANRAKQ

SEQ ID NO: 144326 - protein, 237 aa, Glycine max
  Coding DNA Sequence Number=SeqID_52641
  Subcellular localization annotation: CTP_CleavageSite=30; ConfidenceScore=5.73e-01
MASPPASPPPPCPPSPRPSAPPSDALASPSAVKRTRKASRLRSLYTRPPGADRPVVHVDPTTGKAGGPHMKKLKTYLGIVVRDKVDLTYENRKEAEFEIPKASDNRTKKKLLQTVADQDDVDDTVCEKYGINKEKWTQFCQTRRDPSWEDVRKKAQTIQKQNTTAHVLSRGGYEYLEQKLLAEKTKKKLEEAAQSGSLDGVIDPPSPVRRHVKWKMVRTKKTREMTTKAAKEITEKI

SEQ ID NO: 144327 - protein, 64 aa, Glycine max
  Coding DNA Sequence Number=SeqID_52642
MTKKRSHLSHTRGAERHPPISKSAEGAGVQASGSMNGRGKWSFLVTWVQPPIVNADSSNCSATE

SEQ ID NO: 144328 - protein, 171 aa, Glycine max
  Coding DNA Sequence Number=SeqID_52643
TKRARREEHGRNKFRGALWGSNNELKLRREERDQSRVDSLILRDELKACSRYKRSLSQQLCETETNMLAIITMYQEELNLATAHKHRVADQYAQVYTEKDARGRVIDSLHQEATMWMDRFSLTLNGSQELPRLLAKAKAMADTNSGPEEIHGFLGYCQHMIDLMAHIIRNR

SEQ ID NO: 144329 - protein, 24 aa, Glycine max
  Coding DNA Sequence Number=SeqID_52644
MSPVESPTVATLPFCGRPKGEGHG

SEQ ID NO: 144330 - protein, 111 aa, Glycine max
  Coding DNA Sequence Number=SeqID_52645
  Subcellular localization annotation: CTP_CleavageSite=74; ConfidenceScore=5.35e-01
MGIAHTKTPSGPEDVQQGPGVSSSGYGPLSALQGARSPQQGSRLQDTQWTRRSPTGSWSCQALITGLCRFYGVPVTSSKGIRPPTNRAFIKKYCVPRQAQGKTPQQHWDGR

SEQ ID NO: 144331 - protein, 60 aa, Glycine max
  Coding DNA Sequence Number=SeqID_52646
MEWFFRISHSFMIPTQEGDQPRDAPAADPEDYIQPPSPQVRVAFDPPPHVDDYEGYEAIA

SEQ ID NO: 144332 - protein, 62 aa, Glycine max
  Coding DNA Sequence Number=SeqID_52647
IAPARHPVDPKKSNRVLELSSSNYGSLASGPLLIELSSRSTASPGRRRAKHHSSLGMVGSGQ

SEQ ID NO: 144333 - protein, 165 aa, Glycine max
  Coding DNA Sequence Number=SeqID_52648
MPTGRKEAISFLWVLSLHDKSCQGSENLSTRVEPGKAKQKWSSRSTKEVFGAIDVFLAYHNHKESPVVAMPADLYDTFDRRCEESNARIVCCTPALYVGLVSHLFLQEGRPVYPLQGYRSCVEQGKANWDQLLASMEGRLLICSLARRKEESGFYLHATDVQMFP

SEQ ID NO: 144334 - protein, 248 aa, Glycine max
  Coding DNA Sequence Number=SeqID_52649
  Gene Ontology: Mol. function=glutamate-5-semialdehyde dehydrogenase activity; Cellular component=cytoplasm; Biological process=amino acid biosynthetic process
  Homolog annotation: Hit_ID=A6T561; Match level="QueryCoverage=99%, HitCoverage=59%, E-value=1e-104, Identity=77%"; Hit description =Gamma-glutamyl phosphate reductase
MGKAAREASYKLAELSTEQKNQVLLTIADRLEAESADILAANQQDLADARTNGMSAALLDRLTLNPQRLKGIADDVRQVCRLADPVGQLIDGGRLDSGLRIERRRVPLGVIGVIYEARPNVTVDVASLCLKTGNAAILRGGKETWRTNAATVRVIQNALIEHGLPAAAVQAIENPDRELVNQLLKLDRYVDMLIPRGGAGLHKLCRENSTIPVITGGIGVCHLYLDETMETDAALEVIVNAKKQRPSA

SEQ ID NO: 144335 - protein, 43 aa, Glycine max
  Coding DNA Sequence Number=SeqID_52650
MVQTSLAGRELSQKSFQRRPKNLGGVERTGEYYARLAEALAKW

SEQ ID NO: 144336 - protein, 81 aa, Glycine max
  Coding DNA Sequence Number=SeqID_52651
MKIYVSGRLGKKVVIIKKGEIVEAKLHDDDKGDEKKRKDQSKKNSSESRTIQEFKIRIKKNSRLKKKVKSQDSRFKNQEKA

SEQ ID NO: 144337 - protein, 110 aa, Glycine max
  Coding DNA Sequence Number=SeqID_52652
MVKVGTSYVPINVSFSPKVGPGLPGINRDTRIYLLWEVIFRHSCPSCSATDGVGASHSPFRLRNCWEGRSVRASSLLRQLAKGGCDARRLSWVTPGFSQSRRCKTTASEL

SEQ ID NO: 144338 - protein, 124 aa, Glycine max
  Coding DNA Sequence Number=SeqID_52653
MASMSASIYSCTSSALPITLALARERSRSLEPSSQEKYGSNANDAIVKYGARMFCTQDSPGLKSSRYQYLNISVGRMRSNDVDVDPLVAPRVDLLGMSNFDCQYFNNMSHRDERLGNTHAMHGK

SEQ ID NO: 144339 - protein, 94 aa, Glycine max
  Coding DNA Sequence Number=SeqID_52654
  Homolog annotation: Hit_ID=A0ST23; Match level="QueryCoverage=28%, HitCoverage=55%, E-value=2e-08, Identity=100%"; Hit description =Putative reverse transcriptase
MEDFCLTPTCCTSATASSVLEPVFRTFIKLIDTVDLEGGPVGKPVVPAALMNRPTRGERRFAYWALAECILAYYVGTDEGVSEVLHVAGEKRLH

SEQ ID NO: 144340 - protein, 260 aa, Glycine max
  Coding DNA Sequence Number=SeqID_52655
  Homolog annotation: Hit_ID=A6EU28; Match level="QueryCoverage=71%, HitCoverage=48%, E-value=2e-12, Identity=27%"; Hit description =Putative uncharacterized protein
  Pfam annotation: Domain name=TPR_1; Domain location=117-150; Score =7.5; E_value=0.67; Accession=PF00515.19; Description=Tetratricopeptid e repeat
  Pfam annotation: Domain name=TPR_1; Domain location=33-66; Score=1.2; E_value=3.8; Accession=PF00515.19; Description=Tetratricopeptide repeat
  Pfam annotation: Domain name=TPR_1; Domain location=77-110; Score =24.5; E_value=0.00041; Accession=PF00515.19; Description =Tetratricopeptide repeat
  Pfam annotation: Domain name=TPR_2; Domain location=117-150; Score =10.4; E_value=1.5; Accession=PF07719.8; Description=Tetratricopeptide repeat
  Pfam annotation: Domain name=TPR_2; Domain location=77-110; Score =20.4; E_value=0.0069; Accession=PF07719.8; Description =Tetratricopeptide repeat
  Pfam module annotation: Pfam domain module=TPR_1::TPR_1::TPR_1::TPR _2::TPR_2; Domain location=117-150::33-66::77-110::117-150::77-110
MELFSKSLETLNEADRYLERLPKESPEKLIETARSYAIRGMIYKSQSNSEIALEKFLISIGNFEKVKMKKTTFANMSVVYYNIGYCYLNLNEQEKARQAFIRSIQYAEKLNAKSLKAFALKGLAEMYKQNRENEKALGLLIQAESLSQNTGDLILNEGIYKEMSENYLAMGKPDLYQVYNKKYFEMRFKREQSELSSINHSINNHNRETQKKAKELRNKYNYLSIGIILSGSAIIAILIYFIHDQQKSIPKGMLNNVYYV

SEQ ID NO: 144341 - protein, 195 aa, Glycine max
  Coding DNA Sequence Number=SeqID_52656
NVKAKCKSLIGQKNASDYVMDNWGNLADCPSEQEFLEHLQRLQVVCSLWPMFVDYVCETWIVPHKEKFITAWTNKHTEIRASFETSTHVVGHVFKKTLYKRLLGMNHARSSLCMQATKGLCEAEVSIKEDMDRIYKIFEELDVCGKVTFKSKLREFTFPDETFMCPPPPKVKTKGSPKKVMKGSERLTKRDPSYW

SEQ ID NO: 144342 - protein, 18 aa, Glycine max
  Coding DNA Sequence Number=SeqID_52657
ERESMFSSTPGEPGSTTS

SEQ ID NO: 144343 - protein, 176 aa, Glycine max; identical to SEQ ID NO: 107417
  Coding DNA Sequence Number=SeqID_52658
  Homolog annotation: Hit_ID=Q8GEG1; Match level="QueryCoverage=57%, HitCoverage=75%, E-value=9e-53, Identity=94%"; Hit description =Putative uncharacterized protein

SEQ ID NO: 144344 - protein, 177 aa, Glycine max
  Coding DNA Sequence Number=SeqID_52659
MALTRHPLDPDKSNRTLGFPALITGLCQSFGVPVAPTKVIRPPITRAFIEKYCTQRQAQGDAPQAAGAPPPPHQAGPAGSFDMEQYLRHLVRQQAANHRAHVQTHDCLYQMSLSMQSQGFASFSCPTLDQFRAEVAWPRDWPEAQAGEAPPEVPGDGEEAHEDEEMADLLDWEIPRF

SEQ ID NO: 144345 - protein, 283 aa, Glycine max
  Coding DNA Sequence Number=SeqID_52660
  Gene Ontology: Mol. function=hydrolase activity, acting on ester bonds; Biological process=biosynthetic process
  Homolog annotation: Hit_ID=A4W7X0; Match level="QueryCoverage=100%, HitCoverage=21%, E-value=1e-133, Identity=83%"; Hit description =Amino acid adenylation domain
  Pfam annotation: Domain name=Thioesterase; Domain location=59-278; Score=159.4; E_value=9.5e-45; Accession=PF00975.11; Description =Thioesterase domain
  Subcellular localization annotation: CTP_CleavageSite=22; ConfidenceScore=5.12e-01
MRLAAQLSRTFARKVTPGQIMVASTVSKLSALLDSSMSDAQAQRLGYETLLPLRESDGPTLFCFHPASGFAWQFSVLARYLSPRWSITGIQSPRPDGPMQQCADLDEVIEHHLKTLRAQQPQGPYYLFGYSLGGTLAQGIAARLCAQGEVVAFLGLLDTWPPETQNWAEKEANGLDPAVLAEIERERQAFIAAQQGQGSSELFSAIEGNYADAVRLLTTAHSARFEGKATLFVAERTRTQDPQVAWVPWVGELEVYSQDCAHVDIISPQAFEKIGPVLREILG

SEQ ID NO: 144346 - protein, 184 aa, Glycine max
  Coding DNA Sequence Number=SeqID_52661
  Homolog annotation: Hit_ID=Q2HW90; Match level="QueryCoverage=57%, HitCoverage=20%, E-value=2e-11, Identity=39%"; Hit description =Putative uncharacterized protein
LKELEQLMGQLQRQAFRKAYGKIWDLAMVEVSTEAIASLTQYYDQPLRKQVKNGVVGIPRKYLEVKARILADKGEWVPFIDILALLIFGGVLFPNVDGLVGLAAIDAFLTYHNHKESPVVAMLADPYDTFDRRCEKSNTRIVCCTPTLYVWLVSHLFRQEVRHACPLESHRSCTEKGGRIGINS

SEQ ID NO: 144347 - protein, 42 aa, Glycine max
  Coding DNA Sequence Number=SeqID_52662
MMSMNKIMEANAVAVFATSAVAKVNPMPPSGLNQMNHPTLDM

SEQ ID NO: 144348 - protein, 192 aa, Glycine max
  Coding DNA Sequence Number=SeqID_52663
  Subcellular localization annotation: CTP_CleavageSite=52; ConfidenceScore=5.42e-01
MTDVWGANTFPMRKYNSRTFHLKVRRSRLFRFFRRFPQINVGGDSARIPFVEHASRESRVALPPKEEGVRDIRSWVRGQWIRFDADALSQFLGYPLVLEEGQECEYGQRRNRSDGFDEEAIAQLLCIPGQDFARTAAGRRVRIMRTNMTTLTQIWMTLLLSNIQPSDHNSDLPLLKCQLVYAILTRMSIHVA

SEQ ID NO: 144349 - protein, 84 aa, Glycine max
  Coding DNA Sequence Number=SeqID_52664
MASRDQVWSFCTHDTRRYLMVIRTPLLGRHSCVRWQAETKFGHSAPMIRGDTLRDQVGHSAPMIRGDTLWLFAPILLLSVRQNA

SEQ ID NO: 144350 - protein, 146 aa, Glycine max
  Coding DNA Sequence Number=SeqID_52665
ATLQELCSTPTYLALLILLPVAAASGDKSCLTGATLPEGRKADRYPVSGRVGTGERTRELPGGNACLWKNASNAAFLRFLAFCWPFAHMFFPALSPDSVDNRITAFEKRKSAQYANRLSPRVGRFINAAGTTGFPTGKRAVSATQL

SEQ ID NO: 144351 - protein, 351 aa, Glycine max
  Coding DNA Sequence Number=SeqID_52666
  Gene Ontology: Mol. function=transporter activity; Cellular component= membrane; Biological process=transport
  Homolog annotation: Hit_ID=Q7VW01; Match level="QueryCoverage=99%, HitCoverage=50%, E-value=1e-157, Identity=79%"; Hit description =Putative membrane transport protein
MGARYGGNLPRLAGVACAILCSFTYLVAQIYGVGIITTRMTGISFELGIFVALGGMLVCSFLGGMRAVTWTQVGQYIILVIAYLVPVVWLSIKHTDMPVPQLSAGVVLQEVTEKEVYLRNDPAEIEARRLWQERADEMAQRVHDLPESWALEKDKLRSRLAQLNASDAPMVEIRSVERELAAFPPTVEEARIAWSQAKATFEARAAPPTPHAEPFPSSDPDERRNMRINFLALVLCLMLGTAGMPHILMRSYTTSSVVEARRSVCWSLLFILLLYFMAPALALLVKYEVYTQVVGSNFLSLPNWVHAWSAVDSNLLDVTDINRDGVSSSAKSAWARTWCCWRCPRSAGCPM

SEQ ID NO: 144352 - protein, 120 aa, Glycine max
  Coding DNA Sequence Number=SeqID_52667
  Gene Ontology: Mol. function=RNA-directed DNA polymerase activity; Biological process=RNA-dependent DNA replication
  Homolog annotation: Hit_ID=Q5NRP4; Match level="QueryCoverage=66%, HitCoverage=5%, E-value=5e-09, Identity=37%"; Hit description =Putative gag-pol polyprotein, identical
  Pfam annotation: Domain name=Retrotrans_gag; Domain location=58-116; Score=0.1; E_value=0.053; Accession=PF03732.8; Description =Retrotransposon gag protein
MCLHSSSSVNGEGSTPKDPLYKILDELRSLKLWKEKQERKEKEGAIVHILNITPNEKKRIEGLKRIHRDPPVEYWKDLKSALRKKHIPSYYERELMDKLQRLRQGSMSVEEYRHKWDYSF

SEQ ID NO: 144353 - protein, 67 aa, Glycine max
  Coding DNA Sequence Number=SeqID_52668
MTFLNGKLHTTPEFQKHTIDNNEGSHGHVAPHAPGLLGHGNKKCGGRQKQGFCSYVSSICDEELRPT

SEQ ID NO: 144354 - protein, 167 aa, Glycine max
  Coding DNA Sequence Number=SeqID_52669
  Homolog annotation: Hit_ID=A0PAV3; Match level="QueryCoverage=22%, HitCoverage=17%, E-value=6e-07, Identity=76%"; Hit description =Restriction endonuclease
MVKVGTSYVPINVSFSPKVGPGLPGINRDTRIYLFCEVIFRHSCPSCSATDGVGFPSHDVVKRRPVNCNTTHYRANWSSTAVAAALELVDPPGCRNSIDWRRDQFRRVAGGAYRRRGRRDRAGPDHPHGRARAGGQGADPAHGRSSLSIPSTSRGGPVPAFVPFSEG

SEQ ID NO: 144355 - protein, 76 aa, Glycine max
  Coding DNA Sequence Number=SeqID_52670
  Homolog annotation: Hit_ID=B0HC01; Match level="QueryCoverage=40%, HitCoverage=65%, E-value=1e-09, Identity=100%"; Hit description =Putative uncharacterized protein
MEKRQQRGLFTVLAFCWPFAHMFFLRYPLILWITVLPPLSELIPLAAAERPSAARNSYDHDYEFELGTLILSVNFG

SEQ ID NO: 144356 - protein, 80 aa, Glycine max
  Coding DNA Sequence Number=SeqID_52671
MEKSEKKNHSEKKLKKAYITWDENDLESSEDSENEEINLCLMAKIYESDEEVCLRKKWYIDSGCSKHMTGDASNFTHISP

SEQ ID NO: 144357 - protein, 186 aa, Glycine max
  Coding DNA Sequence Number=SeqID_52672
RDSNVSMTDLVIAEEDAFRLTDTKNNVYTDNHSGISAHQRDSNVSMTDLVSAEDDNVYTDDHSGISARQRDLNVSITDLVSAEDDTAKKNVYTDNHSGISARQRDSNVEAQKRTLVSACYQAFRLTDEQKRKLIRITTPGFPLLSRDSNETTLVSGCYQAFCLTTAKKNGYTGDHSGISARQRDLN

SEQ ID NO: 144358 - protein, 178 aa, Glycine max
  Coding DNA Sequence Number=SeqID_52673
MASRKRKSIGSRPTSQYDTRRFSSLDAWTRYTDNVLGRNILPERKVELYHTERDDLKAELERRNFHKCLTNLVDGSIDLALMKEFYANLYSSKDHPPKQSRVKGHLVKIDADSLNTFLETPVVLAEGETLPTYSRYCRFPTDFREIEAALCIPGRGFILNSEGHPGKILRKDLTTLAQ

SEQ ID NO: 144359 - protein, 170 aa, Glycine max
  Coding DNA Sequence Number=SeqID_52674
  Homolog annotation: Hit_ID=Q7VVV6; Match level="QueryCoverage=48%, HitCoverage=95%, E-value=1e-15, Identity=56%"; Hit description =Integral membrane protein
  Subcellular localization annotation: CTP_CleavageSite=23; ConfidenceScore=5.01e-01
MAGLRTAAPCTGREALGRGAFCNAAGAPVPVCGPRNGRAPQLAMSLRRSCPASHAMARYPRIVALCGSLDTVTLIHRERRTAVSGYLQRQAGQGMTEYIVIVALVAIAAIAVYQHFGQVVRAQTAAMARELAGEDGSAQTRAAAAAVKKAAGQVSTRTLKSFAGNAVGGK

SEQ ID NO: 144360 - protein, 149 aa, Glycine max
  Coding DNA Sequence Number=SeqID_52675
  Subcellular localization annotation: CTP_CleavageSite=34; ConfidenceScore=5.83e-01
MGSPPASTTPPPPPPPPPSPPSPPPPPPPTSNASASTSAVKRTREASRLRSVSTKPPGVERPVVHVDPAIGKADGPHKKKLRTYLGIVARDKVDITYENWKEVPTAQKDPIWEDIQQNLISQRLLTGGRKGSYYRTLGRDGSSLIQTSL

SEQ ID NO: 144361 - protein, 312 aa, Glycine max
  Coding DNA Sequence Number=SeqID_52676
  Pfam annotation: Domain name=GRP; Domain location=239-298; Score= -24.9; E_value=0.027; Accession=PF07172.2; Description=Glycine rich protein family
MSTPLQSELFRRAAEARFEECAGVDDGEPIPVDAVQFWTRQAAEGGDLEALVIAGLQFSDETVDESLLWDRVIAEGNGTALYLMADLAGSPEFARRFGGLVDQDDARLVTSMVACELGLDCGSGSRLMMSLCVDSLQCSDGSYEEWAMDTQVASSRRGEIRAQARSQCCVRMRHLVKPSRSPRGIRHTPAALRSIKLMCPQEAEHRINAGWAAWGRYTSLNGIFSLPKGSLIELTYIDGSKETLLVSCTNSQMCVQPVPGTQKPAPAKSGGSGGGGRPASGGGSGGGYVGGSGCFGNCTGVVTVGPFQQNER

SEQ ID NO: 144362 - protein, 73 aa, Glycine max
  Coding DNA Sequence Number=SeqID_52677
MTPPATAEAEHALPLAAQKLALIDSLQALLTSPAQPLAAMAPPSRAHHVSPNVHSSADWQAAIHGIRAGPFIA

SEQ ID NO: 144363 - protein, 194 aa, Glycine max
  Coding DNA Sequence Number=SeqID_52678
  Gene Ontology: Mol. function=oxidoreductase activity; Cellular component=integral to membrane; Biological process=nucleotide metabolic process
  Homolog annotation: Hit_ID=Q6D0J7; Match level="QueryCoverage=85%, HitCoverage=47%, E-value=5e-82, Identity=90%"; Hit description=GMP reductase
  Pfam annotation: Domain name=IMPDH; Domain location=1-187; Score =89.9; E_value=8.3e-24; Accession=PF00478.16; Description=IMP dehydrogenase  GMP reductase domain
MVEELILSGADIVKVGIGPGSVCTTRVKTGVGYPQLSAVIECADAAHGLGGQIVSDGGCAVPGDIAKAFGGGADFVMLGGMLAAHDECEGTLVEEQGEQFMLFYGMSSESAMKRHVGGVAGYRAAEGKTVRLPLRGPVAETVKDILGGLRSACTYVGAERLKELTNAPPLFVWQNRKTASLTADVPQRAPRAPV

SEQ ID NO: 144364 - protein, 148 aa, Glycine max
  Coding DNA Sequence Number=SeqID_52679
  Gene Ontology: Mol. function=nicotinate-nucleotide diphosphorylase (carboxylating) activity; Cellular component=cytoplasm; Biological process=pyridine nucleotide biosynthetic process
  Homolog annotation: Hit_ID=A6T4Q0; Match level="QueryCoverage=66%, HitCoverage=33%, E-value=2e-22, Identity=56%"; Hit description =Nicotinate-nucleotide pyrophosphorylase
  Pfam annotation: Domain name=QRPTase_C; Domain location=10-148; Score= 86.0; E_value=1.2e-22; Accession=PF01729.10; Description=Quinolinate phosphoribosyl transferase, C-t
  Subcellular localization annotation: CTP_CleavageSite=30; ConfidenceScore=5.18e-01
MWRFLSGSNTPAAGYAQNPARACAPRSSMRCCAAAGRIIAWACPTRFLIKENHIIASGSVSKAVEKALWLHPDVPVEVEVESLSELQLALAAGADIIMLDNFTLAMMQQAVTLTAKRALLEVSGNVTETTLPQIAATGVDYVSVGRAD

SEQ ID NO: 144365 - protein, 427 aa, Glycine max
  Coding DNA Sequence Number=SeqID_52680
  Gene Ontology: Mol. function=amino acid transmembrane transporter activity; Cellular component=integral to membrane; Biological process=amino acid transport
  Homolog annotation: Hit_ID=Q8FL49; Match level="QueryCoverage=99%, HitCoverage=93%, E-value=0.0, Identity=88%"; Hit description =Aromatic amino acid transport protein aroP
  Pfam annotation: Domain name=AA_permease; Domain location=17-427; Score=517.3; E_value=1.8e-152; Accession=PF00324.12; Description =Amino acid permease
  Pfam annotation: Domain name=Spore_permease; Domain location=18-351; Score=-169.7; E_value=0.049; Accession=PF03845.4; Description=Spore germination protein
  Pfam module annotation: Pfam domain module=AA_permease::Spore _permease; Domain location=17-427::18-351
MEQQHGETLHRGLKNRHIQLIALGGAVGTGLFLGSASVIKSAGPAVILGYAIAGFIAFLIMRQLGEMVVEEPVAGSFSHFAYKYWGNFAGFASGWNYWVLYVLVAMAELTAVGKYIQFWWPEFPTWATAAIFFVVINAINLTNVKVFGEMEFWFAIIKVVAVIGMILFGGWLLFSGNGGPQASVSNLWNQGGFLPHGVSGLVMMMAIIMFSFGGLELVGITAAEADNPQESIPKATNQVLWRILIFYIGSLAVLLSLLPWTRVTEETSPFVLIFHELGDALVANALNVVILTAALSVYNSCVYCNSRMLFGLAQQGNAPKALLKVDRRGVPVATILVSAVATALCVLINYLMPGEAFGLLMSLVVSALVINWAMISLAHLKFRKKKDQQGVTTRFRAVLYPLGNWICLLFLAAILVIMLMTPGMAIS

SEQ ID NO: 144366 - protein, 211 aa, Glycine max
  Coding DNA Sequence Number=SeqID_52681
  Gene Ontology: Mol. function=transcription factor activity; Cellular component=intracellular; Biological process=regulation of transcription, DNA-dependent
  Homolog annotation: Hit_ID=A9R1I5; Match level="QueryCoverage=100%, HitCoverage=75%, E-value=1e-101, Identity=89%"; Hit description =Pyruvate dehydrogenase complex repressor
  Pfam annotation: Domain name=FCD; Domain location=99-211; Score=60.0; E_value=7.9e-15; Accession=PF07729.3; Description=FCD domain
  Pfam annotation: Domain name=GntR; Domain location=11-74; Score =101.4; E_value=2.8e-27; Accession=PF00392.12; Description=Bacterial regulatory proteins, gntR fam
  Pfam module annotation: Pfam domain module=FCD::GntR; Domain location= 99-211::11-74
MAYSKIRQPKLSDAIEQQLESLIMEGTLQPGEKLLPERELAKQFDVSRPSLREAIQSLEAKGLLLRRQGGGTFVQQNLWQSLSDPLVGLLAEHPESQFDLLETRHALEGVAAYYAALRGTDEDLQRIRDCHVNIQQAQDSGDLDAEADAVMKYQIAVTEAAHNVVLLHLLRSMGPMLEQNVRQNFELLYARREMLAKVSGHRASIFEAIVA

SEQ ID NO: 144367 - protein, 727 aa, Glycine max
  Coding DNA Sequence Number=SeqID_52682
  Gene Ontology: Mol. function=dihydrolipoyl dehydrogenase activity; Cellular component=cytoplasm; Biological process=cell redox homeostasis
  Homolog annotation: Hit_ID=P0A9P2; Match level="QueryCoverage=63%, HitCoverage=97%, E-value=0.0, Identity=90%"; Hit description =Dihydrolipoyl dehydrogenase
  Pfam annotation: Domain name=2-oxoacid_dh; Domain location=36-262; Score=334.4; E_value=2e-97; Accession=PF00198.14; Description=2 -oxoacid dehydrogenases acyltransferase (catalytic domain)
  Pfam annotation: Domain name=GIDA; Domain location=268-592; Score= -238.0; E_value=0.023; Accession=PF01134.13; Description=Glucose inhibited division protein A
  Pfam annotation: Domain name=Pyr_redox; Domain location=430-525; Score=87.2; E_value=5.3e-23; Accession=PF00070.18; Description =Pyridine nucleotide-disulphide oxidor
  Pfam annotation: Domain name=Pyr_redox_2; Domain location=268-572; Score=234.8; E_value=1.9e-67; Accession=PF07992.5; Description =Pyridine nucleotide-disulphide oxidore
  Pfam annotation: Domain name=Pyr_redox_dim; Domain location=600-709; Score=187.3; E_value=3.8e-53; Accession=PF02852.13; Description =Pyridine nucleotide-disulphide oxidored
  Pfam module annotation: Pfam domain module=2-oxoacid_dh::GIDA::Pyr _redox::Pyr_redox_2::Pyr_redox_dim; Domain location=36-262::268 -592::430-525::268-572::600-709
AYVKDAVKRAEAAPAAAAGGGIPGMLPWPKVDFSKFGEIEEVELGRIQKISGANLSRNWVMIPHVTHFDKTDITDLEAFRKQQNAEAEKRKLDVKFTPVVFIMKAVAAALEQMPRFNSSLSEDGQKLTLKKYINIGVAVDTPNGLVVPVFKDVNKKGITELSRELMATSKKARDGKLTASDMQGGCFTISSLGGLGTTHFAPIVNAPEVAILGVSKSAMEPVWNGKEFTPRLMMPISLSFDHRVIDGADGHQEPGKGSLLTAGNLTRGPAGYSAAFRCADLGLETVLVERYSTLGGVCLNVGCIPSKALLHVAKVIEEAKALEEHGIVFGQPQTDINKIRTWKEKVITQLTGGLAGMAKGRKVKVVNGLGKFTGANTLVVEGEGGATTINFDNAIIAAGSRPIELPFIPHNDPRVWDSTDALELKEVPKRLLVMGGGIIGLEMGTVYHALGSEIDVVEMFDQVIPAADKDVVKVFTKRISKKFNLMLETKVTAVEAKDDGIYVSMEGKKAPAEPQRYDAVLVAIGRVPNGKGLDAGKAGVEVDDRGFIRVDKQMRTNVPHIYAIGDIVGQPMLAHKGVHEGHVAAEVISGLKHYFDPKVIPSIAYTEPEVAWVGLTEKEAKEKGISYEVSTFPWAASGRAIASDCADGMTKLIFDKETHRVIGGAIVGTNGGELLGEIGLAIEMGCDAEDIALTIHAHPTLHESVGLAAEVFEGSITDLPNPKAKKK

SEQ ID NO: 144368 - protein, 71 aa, Glycine max
  Coding DNA Sequence Number=SeqID_52683
  Homolog annotation: Hit_ID=P59396; Match level="QueryCoverage=100%, HitCoverage=59%, E-value=9e-27, Identity=74%"; Hit description =UPF0231 protein yacL
  Pfam annotation: Domain name=UPF0231; Domain location=1-71; Score =59.0; E_value=1.6e-14; Accession=PF06062.2; Description =Uncharacterised protein family (UPF0231)
MEYEFLRDVTGQVRVRMSMDHEAVGHWFNEEVKENFALLDEVEAAVRAVKGTQQQWQRVGHEYTLWLDEEE

SEQ ID NO: 144369 - protein, 308 aa, Glycine max
  Coding DNA Sequence Number=SeqID_52684
  Gene Ontology: Mol. function=glycerol-3-phosphate dehydrogenase activity; Cellular component=glycerol-3-phosphate dehydrogenase complex; Biological process=glycerol-3-phosphate metabolic process
  Homolog annotation: Hit_ID=Q5KQQ0; Match level="QueryCoverage=79%, HitCoverage=56%, E-value=1e-138, Identity=98%"; Hit description =Tyramine oxidase
  Pfam annotation: Domain name=DAO; Domain location=1-207; Score=-6.7; E_value=3.1e-05; Accession=PF01266.15; Description=FAD dependent oxidoreductase
MGGGQIHSLNMLLGSAQAAHSLGVKIFESSPVVEVNYGKQVQVRTAMGSVKAAKLLWACDSFLNNMEPEIYNKTLVTYSYQVSTEPLSDELIERISPLRGAFSDIRPVINYYRVTRENRLLFGSATRFLEYTPNDFAAWNRTLLAEVFPYLKDVKIDFAWGGPMACSANLFPQIGTLRDHNNVFYVQGYSGFGVTPSHIVCKILAEGINGGSDRYRLLSSIPHATIHGRDSLRLLLVTAGKLMHQTAADRQRQPARRDADRRRPAGSGRDDLRRAAGRLYLRTVFVHRRELYHDLSVYRTRHRAGGRS

SEQ ID NO: 144370 - protein, 43 aa, Glycine max
  Coding DNA Sequence Number=SeqID_52685
GEVKEVSSTTTYTKGGIYEEWFQPVSIDLEALSMDSLLISTVP

SEQ ID NO: 144371 - protein, 258 aa, Glycine max
  Coding DNA Sequence Number=SeqID_52686
  Gene Ontology: Mol. function=motor activity; Cellular component=cell projection
  Homolog annotation: Hit_ID=UPI00006A2D9E; Match level="QueryCoverage =67%, HitCoverage=85%, E-value=9e-16, Identity=15%"; Hit description =UPI00006A2D9E related cluster
MIGTSKPYTGAMRGTVHEPQANLGENQNTLTFRALHAALAIRGLHVLAFRGLHALTFRGLPVLVFRRLHALAIRRLHAFAFRGLHVLAFRGLHVLAFKGLHALAFRGLHPLAFIGLHVLPFRGLHAFAFRGIHVLSFRGLHALAFRGLHVLTFRGLHALTFTGLPVLVFRRLHTLAIRGLHAFAFRGLHVLAFRGLHVLAFKGLHAPAFRGLHPLAFRGLHVLPFRGLHAFAFRGIHVLAFRGLHALAFRGLHVFAFR

SEQ ID NO: 144372 - protein, 156 aa, Glycine max
  Coding DNA Sequence Number=SeqID_52687
MPSPSEDCTPPWVLVTLIGLHALAIRGLHVLTFSRAARPHLSRGPHVLAFREGYTPSGTSYPLRGLHVLAFVEATRPQRTDMSSPSEGYTPSPSEDCISPRLEGLHALTFRGLHVLVNRELYPSPSEDYTSSPQREHARPSPSRGLHVLAQRHLPL

SEQ ID NO: 144373 - protein, 173 aa, Glycine max
  Coding DNA Sequence Number=SeqID_52688
  Homolog annotation: Hit_ID=A5AZG1; Match level="QueryCoverage=27%, HitCoverage=14%, E-value=8e-08, Identity=55%"; Hit description =Putative uncharacterized protein
MSHHSSSVNDEDTSHKDPLSRILNELSSLKLWKEKLERKEKVKKREEINQDEREQIREEKRRKIIKELRKEKHASCSSHDSCKSLSEELHDYYEGRHRSRLRPHFHMREKERKPQEAKINLPYFHGKYNVEAYLDWEMKVEQLFACHHISEERKVPLAALSFQGSEGFMGILQ

SEQ ID NO: 144374 - protein, 104 aa, Glycine max
  Coding DNA Sequence Number=SeqID_52689
  Subcellular localization annotation: CTP_CleavageSite=68; ConfidenceScore=5.40e-01
MVKVGTSYVPINVSFSLKSWPRAVPVSTGTPDYFFCRSVSESNHQAYSQYVRLEGCSSGVSVSISCPSCSATDGVVRHNSTKHTAGHQRASVAGCTAELTHTAA

SEQ ID NO: 144375 - protein, 29 aa, Glycine max
  Coding DNA Sequence Number=SeqID_52690
MASRSIHMPERVPDVVDIQKPHKIPWALF

SEQ ID NO: 144376 - protein, 101 aa, Glycine max
  Coding DNA Sequence Number=SeqID_52691
MATHTVRQPWANEPIDAQRLTSSSAPFVVLTREVRGKQARWRAEINIVLDTFFRLDPLTSSAAPLVVLTREVKGKRARWRAETNIIFYTICRLTREVKVTC

SEQ ID NO: 144377 - protein, 83 aa, Glycine max
  Coding DNA Sequence Number=SeqID_52692
PLGPSRIFLQKAVASGGSNLARLGELGGKHLPYFAINRGGSEEEKAEALPKRFRNVFREEFRKGFDRSSTFFIRSSSFFDLQQ

SEQ ID NO: 144378 - protein, 151 aa, Glycine max
  Coding DNA Sequence Number=SeqID_52693
MAAVSPMKNQLMKSTIWGTSQDKISMQMDIPNFSMASHIIHNKDNGKITLVSMSNHKSTESTIKNLEVQVGQLAKQLADRLSSSFTANTEKNPKEECKALMIRRKMTIQADEGKAEKKAEGYKQQSAVEPALEPVSDFVELEEVVEDEDDQ

SEQ ID NO: 144379 - protein, 180 aa, Glycine max
  Coding DNA Sequence Number=SeqID_52694
MTAETKFGHSAPLYHPEAAGPMIRGDTLRLFAPFCHPEAAGPMTSRDQVWSFCTLVSSRGGGPDDTRRYLTVIRTLLSSRGGGPDDKQRPKAAGPMIRGDTLRLFAPFCHPEAAGPMTSRDQVWSFCTLVSSRGGGPDDARRYLTVIRTLLSSRGGGPDDKQRPSLVILHPCIIQRRRAR

SEQ ID NO: 144380 - protein, 150 aa, Glycine max
  Coding DNA Sequence Number=SeqID_52695
MGAVEEVQEQMKADTKALKEQMATMMEAMMSIKEIMEVNAVAIAATSTIVEVDLTPPYGLNQINHPTSDMVGLEGKELGGVGSPRLVRKTSMPSHHMAYLPTIHHPMWRTLPMRMSITPPLYSLRANNLNLIMHMSLDPLGRHMKRPTTI

SEQ ID NO: 144381 - protein, 76 aa, Glycine max
  Coding DNA Sequence Number=SeqID_52696
MGITFLPFCPSCSDPSSVGTCGGDVIELPSLQTYLCCQLSLIGSCRNLPFGGRATRDSRDACSTKGIRAESPPTFI

SEQ ID NO: 144382 - protein, 84 aa, Glycine max
  Coding DNA Sequence Number=SeqID_52697
MEKGLKPPLVLSSCDSFFSLHEHYLTNPNVNETGMIILLRPFGVSAGKEKATMRKVRWPAGKREDFGRREKKRNCEAQEAEESV

SEQ ID NO: 144383 - protein, 150 aa, Glycine max
  Coding DNA Sequence Number=SeqID_52698
  Homolog annotation: Hit_ID=A5AV98; Match level="QueryCoverage=100%, HitCoverage=23%, E-value=3e-21, Identity=34%"; Hit description =Putative uncharacterized protein
  Pfam annotation: Domain name=zf-CCHC; Domain location=127-144; Score =22.0; E_value=0.00071; Accession=PF00098.14; Description=Zinc knuckle
MTVEDNIKVALPEINSAKEFMGLVGELSQIANKSLAGTLMSTLTTMKFDGSCTMHEHVVDMTNIETRHKTLRMTVNENFLEITVHYVSHQGNQGAGKKFVKKHGKGQGPIEINDGSVQIQKKASKGNNCHFCGKSGHFHKDCPKCKSWFE

SEQ ID NO: 144384 - protein, 77 aa, Glycine max
  Coding DNA Sequence Number=SeqID_52699
MSSWHRDRARKTLCGPGEVQQGLGVASSKYGSLSVIGSACRPQQGHQPPPTNRAFIKKYCVSRQAQGETPHQHWDGR

SEQ ID NO: 144385 - protein, 152 aa, Glycine max
  Coding DNA Sequence Number=SeqID_52700
  Gene Ontology: Mol. function=tetracycline:hydrogen antiporter activity; Cellular component=integral to membrane; Biological process=response to antibiotic
  Homolog annotation: Hit_ID=Q8GEG0; Match level="QueryCoverage=73%, HitCoverage=96%, E-value=4e-24, Identity=54%"; Hit description =Putative uncharacterized protein
  Subcellular localization annotation: CTP_CleavageSite=46; ConfidenceScore=5.44e-01
MTMITPSSKLTLTKGNKSWYRAPPRGGRSNSCSPGDPLVLERPPPRWSSNSPYSESYYNSLAVVLQRRDWENPGVTQLNRLAAHPPFASWRNNEEARTDRPSQQLRNLNGEWDAPCSGALSAAGVVVTRSVTATLASADVRRCFCRYAPPRQ

SEQ ID NO: 144386 - protein, 143 aa, Glycine max
  Coding DNA Sequence Number=SeqID_52701
MEAQLIHDRVVMECLEGVWETLEGNQRCRFRGTIRLTATSLVHPEEPARTLQQPVEWILPTPTPYRLVEPVQVIEVSSSEEDLEEDLEELPPEPDMDALDLPEDDEDPLHDVDCPEDIMSASEADSTEESGPGGTANSDDSSS

SEQ ID NO: 144387 - protein, 198 aa, Glycine max
  Coding DNA Sequence Number=SeqID_52702
  Homolog annotation: Hit_ID=A5B6Y9; Match level="QueryCoverage=20%, HitCoverage=7%, E-value=1e-10, Identity=77%"; Hit description =Photosystem I P700 chlorophyll A apoprotein
DILYYPLCPEGREARLAERWYRFKDASAEVIHAILPGKARTTFNKWVPVPETDTGVPPHKGGRSDQARATVYQKHRSPQSREPTTEAPVNGGRNYNGPKVAKFLVGLGEIDMSVKMRTTCTWTERPYEASLFPGIGFGLFLRSLGGGQRRPPSGGARAISLPKGNGRVQRFPRARLRLALECQGRRELDCKTHPSSMD

SEQ ID NO: 144388 - protein, 93 aa, Glycine max
  Coding DNA Sequence Number=SeqID_52703
MSSVDRTIDVRHRPIDGGEISFSFLHEKRHHPDRTEAIVITSPKTTIDWQDTAREQKESGGEAYASMPTAPTLYYWWLIGPFAYPVFWLASKE

SEQ ID NO: 144389 - protein, 157 aa, Glycine max
  Coding DNA Sequence Number=SeqID_52704
MQSQLQSQMQSQGLALPPEPEVGPSTARVSTKDSCVDPSGNDPDTGDSDKCGLYIKENPPCLVALGRVYEGSIIVHNIPLLHDQVKVDVEEVKDADAPVPVPTDKGVVGPTKPADRPDHEVDDPLYLMTLTIPQLFLKPLQVMWYAIVFGVFNQDFP

SEQ ID NO: 144390 - protein, 306 aa, Glycine max
  Coding DNA Sequence Number=SeqID_52705
  Gene Ontology: Mol. function=motor activity; Cellular component=cell projection
  Homolog annotation: Hit_ID=UPI00016621D1; Match level="QueryCoverage =65%, HitCoverage=40%, E-value=4e-18, Identity=30%"; Hit description =UPI00016621D1 related cluster
GLHVLTFRGLHALAFIGLHALTFRGLHILTFRRLHALAFIGLHTLAFRGLHVLPFRGLHILAIRGLHVLAFRGLHVLAFRGLHALEFRGLHVLTFRELHALAFKGLHVFAFRGLHVLPFRGLHVITLIRLHTLTFRVLHVLPFIGLHALAIRGLHVLAFRGLHVLTFRGLHVLAFRGLHALSLIGLHALAFIGLHICSFRELKREAILLLLCIPGQDFTQSLQGDEYGSCIPPQCRSPPAEVSVGLCRHDIGPWGFQLWLWAFVSPTGDHARKTPSGPGEVQQGPGVSNSDYGPLSVLRSVRRSQQ

SEQ ID NO: 144391 - protein, 22 aa, Glycine max
  Coding DNA Sequence Number=SeqID_52706
MVIRTLFAIKRQSSPMARGDKQ

SEQ ID NO: 144392 - protein, 114 aa, Glycine max
  Coding DNA Sequence Number=SeqID_52707
MLTSPERAQMTILVSASQSHLGSLNDEVRITVRCLRRLLALESWQQKAVWSTVATYPSAGGRRVTRGMRVPRKEYARSRHQRLFEENVGKTGKDAIYELLSERLGSCIYARGRY

SEQ ID NO: 144393 - protein, 85 aa, Glycine max
  Coding DNA Sequence Number=SeqID_52708
MVMQSYPAWALGRRLQVDWARDPREGPRVLMSLRVDFEPMGYDASSIGACRPRIFFINGFLCFLEDEWQRNGEGREGGDATSRRR

SEQ ID NO: 144394 - protein, 135 aa, Glycine max
  Coding DNA Sequence Number=SeqID_52709
MGEVEEVQEKMKADMEAMKEQMAMMMEAMMIMKRIMEASAVAVAVTNTVAKVNPMPQSGLNQMNHPTSAIVGKDLGSMGGPHDVQIQNEHAFPPCGLPLNYTPPNRAYTPNKNVNNSTPIPIESQQPQADHAHVS

SEQ ID NO: 144395 - protein, 118 aa, Glycine max
  Coding DNA Sequence Number=SeqID_52710
  Gene Ontology: Mol. function=hydrolase activity, hydrolyzing O -glycosyl compounds; Cellular component=beta-galactosidase complex; Biological process=carbohydrate metabolic process
  Homolog annotation: Hit_ID=Q8GEG0; Match level="QueryCoverage=50%, HitCoverage=47%, E-value=3e-25, Identity=94%"; Hit description =Putative uncharacterized protein
MSSFLSGSAIGISNPWWTESESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 144396 - protein, 146 aa, Glycine max
  Coding DNA Sequence Number=SeqID_52711
MAPTRHPLDPDKPNRALGFPALITGLCQSFGVPVIPSKVIQPPITRAFIEKYCTQRQATNHRAHVQTHDCLYQMSLSLQSQGFTSFPCPTPDQFRAEVAWLGDWPEARAGEAPAEAPAEAPDEADEAREDEEMTDLLDFLGGSGAT

SEQ ID NO: 144397 - protein, 226 aa, Glycine max
  Coding DNA Sequence Number=SeqID_52712
PGPPPDIGGGPTVQAQPEREAITQLLCIPGQDFTCAAAKRQVWFVHTNMTNLTRIWMTLLFSILLPSDHNADLPLQKYQLGSRPQDTCGPGEVQQGPGVSSSGYGPLSVLQGARTPRQGHAIMTGIAPAGHPMDPKKSNRVLGFPALITGLCQFYRVPVIPSKVIRPPTNRAFIKKYCGPVQAEDETPQQPGEGQQQATNAPPPPPEPLSSSTKRLEYCLRHMADQ

SEQ ID NO: 144398 - protein, 123 aa, Glycine max
  Coding DNA Sequence Number=SeqID_52713
  Pfam annotation: Domain name=G-patch; Domain location=21-68; Score =19.3; E_value=0.00089; Accession=PF01585.14; Description=G-patch domain
IGSCEQCLRGVSHGKPRSSGAALMVARVMLRHGYEPEMGLGRNRNGVASLVEFAENRGRVDVQGKGFRNTRRNHSRATKSNNESYDSSDTEDLNIDFEQLISQAKEGEDEDWGFPPELRRMVK

SEQ ID NO: 144399 - protein, 163 aa, Glycine max
  Coding DNA Sequence Number=SeqID_52714
  Homolog annotation: Hit_ID=A0ST23; Match level="QueryCoverage=16%, HitCoverage=55%, E-value=2e-08, Identity=100%"; Hit description =Putative reverse transcriptase
RKIQLNGVVIGTLSKRLKCLKMFFTMPLGYINGVGTSYVPINVSFSPKVGPGIPGINRDTRIYLFCEVIVRHRYLFGASASGDAANLIKLIDTVDLEGGPVGKPVVPAALMNRPTRGERRFAYWALAECILAYYVGTDEGEKKGCTGASAEYVIQDIFRFLAH

SEQ ID NO: 144400 - protein, 254 aa, Glycine max
  Coding DNA Sequence Number=SeqID_52715
EGRIRILSSCEGCPMRGVPSDESITPFIARGFSDHNARVLQGVRKAWDAAYHKWLRVRTQGLDWLPNLKTVRDDEVKASEESDEVQALKAELERAWVVEEKFKAAIVSSSSEEVKGIITGQSMILKDELKVCLRSKRNLSQQLSETEGNMWAIIDKCKEKLNLAATHEQRLEDEYAKISAEREARERVIDSLHQEATMWTDRFALTLNRSQELPPLLAKAKAVADTYSAPEEIHGLLSYFQHMIDLMDHMIRNR

SEQ ID NO: 144401 - protein, 140 aa, Glycine max
  Coding DNA Sequence Number=SeqID_52716
  Homolog annotation: Hit_ID=UPI00006A2D9E; Match level="QueryCoverage =95%, HitCoverage=77%, E-value=2e-07, Identity=17%"; Hit description =UPI00006A2D9E related cluster
MPSPLEDYTSSPLEDYTSSPSEDYTGLLVLAFRGLHALTFRGLHVLAFRGLHPLSFRGLQVLVFRGLHAHAFRVLHVLAFIGLHVLTFRGLHVVAVSGIHALVFRGLHILAFRGLDALAFRGLHVLPIRGLHVLPFRGLH

SEQ ID NO: 144402 - protein, 194 aa, Glycine max
  Coding DNA Sequence Number=SeqID_52717
  Gene Ontology: Biological process=transposition, DNA-mediated
  Homolog annotation: Hit_ID=Q1J7G7; Match level="QueryCoverage=20%, HitCoverage=70%, E-value=2e-11, Identity=73%"; Hit description =Transposase
VLQWLLFLSAVPPVQLLTGWCVTAKAPPDISAGKCSGRVPFAIQAAQLLGRAIGAGLFAITPAGERGMCCKAIKLGNARVFPVTTLANWSSTAVAAALELVDPPGCRNSMLNFACKKVKMLLQYCHQIKLIDTVDLEGGPVGKPVVPAALMNRPTRGERRFAYWALAECILAYYVGTDEGVSEVLHVAGEKRLH

SEQ ID NO: 144403 - protein, 183 aa, Glycine max
  Coding DNA Sequence Number=SeqID_52718
MGEAEEVQEKMKADMEAMKEQMATMMEAIMSMKKIMEANEVIVAATSAVAKVNPMLPSGLKQMNHPTSNMVGKDLGSTDDPMMCKFKTSTPSRPMACLPNYTPPNVAYIPNGDVNNSTPILIKSQQPQSDHAHVSRPMEETHEIPHHNLADFEPWLGYATEGQAVGGIPMPNTLESPQFRPQP

SEQ ID NO: 144404 - protein, 82 aa, Glycine max
  Coding DNA Sequence Number=SeqID_52719
  Gene Ontology: Mol. function=strictosidine synthase activity; Cellular component=membrane; Biological process=biosynthetic process
  Homolog annotation: Hit_ID=A7PDV0; Match level="QueryCoverage=93%, HitCoverage=20%, E-value=8e-26, Identity=68%"; Hit description =Chromosome chr11 scaffold_13, whole genome shotgun sequence
  Pfam annotation: Domain name=Str_synth; Domain location=6-82; Score =37.6; E_value=4.5e-08; Accession=PF03088.7; Description =Strictosidine synthase
MESVDDAIKEASDGNIYFSVLTTKFDMQNWYLDVLEARSHGQVFKYNPTSNETVIFLDNVAFANGVALSKDEDYLVVCETWK

SEQ ID NO: 144405 - protein, 69 aa, Glycine max
  Coding DNA Sequence Number=SeqID_52720
MAGEESKGRHTRQRGCPWVIVMHVAVGGDWVALSGCGGGVWVEVGCCDHGGLGRGGHGCLLGRKSRGDF

SEQ ID NO: 144406 - protein, 63 aa, Glycine max
  Coding DNA Sequence Number=SeqID_52721
MLIIAYFSKSAQKWHKTLDFVKIAIELLHQQGKHECYWVSTVDSRILVSFHEPGLLPMPIFFL

SEQ ID NO: 144407 - protein, 614 aa, Glycine max
  Coding DNA Sequence Number=SeqID_52722
  Gene Ontology: Mol. function=binding; Cellular component=protein phosphatase type 2A complex; Biological process=ethylene mediated signaling pathway
  Homolog annotation: Hit_ID=Q38950; Match level="QueryCoverage=100%, HitCoverage=99%, E-value=0.0, Identity=87%"; Hit description =Serine/threonine-protein phosphatase 2A 65 kDa regulatory subunit A beta isoform
  Pfam annotation: Domain name=HEAT; Domain location=156-192; Score =23.1; E_value=0.001; Accession=PF02985.13; Description=HEAT repeat
  Pfam annotation: Domain name=HEAT; Domain location=195-231; Score =17.2; E_value=0.061; Accession=PF02985.13; Description=HEAT repeat
  Pfam annotation: Domain name=HEAT; Domain location=234-270; Score =31.6; E_value=2.9e-06; Accession=PF02985.13; Description=HEAT repeat
  Pfam annotation: Domain name=HEAT; Domain location=273-309; Score =30.3; E_value=7.2e-06; Accession=PF02985.13; Description=HEAT repeat
  Pfam annotation: Domain name=HEAT; Domain location=312-348; Score =21.8; E_value=0.0026; Accession=PF02985.13; Description=HEAT repeat
  Pfam annotation: Domain name=HEAT; Domain location=370-406; Score =29.2; E_value=1.5e-05; Accession=PF02985.13; Description=HEAT repeat
  Pfam annotation: Domain name=HEAT; Domain location=409-445; Score =26.1; E_value=0.00013; Accession=PF02985.13; Description=HEAT repeat
  Pfam annotation: Domain name=HEAT; Domain location=41-76; Score=0.4; E_value=24; Accession=PF02985.13; Description=HEAT repeat
  Pfam annotation: Domain name=HEAT; Domain location=448-484; Score =25.2; E_value=0.00024; Accession=PF02985.13; Description=HEAT repeat
  Pfam annotation: Domain name=HEAT; Domain location=487-523; Score =13.5; E_value=0.26; Accession=PF02985.13; Description=HEAT repeat
  Pfam annotation: Domain name=HEAT; Domain location=526-562; Score =17.1; E_value=0.066; Accession=PF02985.13; Description=HEAT repeat
  Pfam annotation: Domain name=HEAT; Domain location=575-611; Score =23.3; E_value=0.00091; Accession=PF02985.13; Description=HEAT repeat
  Pfam annotation: Domain name=HEAT; Domain location=79-115; Score =19.8; E_value=0.01; Accession=PF02985.13; Description=HEAT repeat
  Pfam annotation: Domain name=HEAT_PBS; Domain location=100-133; Score= 7.7; E_value=7.4; Accession=PF03130.7; Description=PBS lyase HEAT -like repeat
  Pfam annotation: Domain name=HEAT_PBS; Domain location=177-207; Score= 6.3; E_value=12; Accession=PF03130.7; Description=PBS lyase HEAT-like repeat
  Pfam annotation: Domain name=HEAT_PBS; Domain location=216-246; Score= 3.9; E_value=27; Accession=PF03130.7; Description=PBS lyase HEAT-like repeat
  Pfam annotation: Domain name=HEAT_PBS; Domain location=255-293; Score= 2.0; E_value=53; Accession=PF03130.7; Description=PBS lyase HEAT-like repeat
  Pfam annotation: Domain name=HEAT_PBS; Domain location=391-417; Score= 0.8; E_value=80; Accession=PF03130.7; Description=PBS lyase HEAT-like repeat
  Pfam annotation: Domain name=HEAT_PBS; Domain location=469-499; Score= 0.9; E_value=76; Accession=PF03130.7; Description=PBS lyase HEAT-like repeat
  Pfam module annotation: Pfam domain module=HEAT::HEAT::HEAT::HEAT::HEA T::HEAT::HEAT::HEAT::HEAT::HEAT::HEAT::HEAT::HEAT::HEAT_PBS::HEAT _PBS::HEAT_PBS::HEAT_PBS::HEAT_PBS::HEAT_PBS; Domain location=156 -192::195-231::...
  Pfam module annotation: Domain location=234-270::273-309::312 -348::370-406::409-445::41-76::448-484::487-523::526-562::575-611::79- 115::100-133::177-207::216-246::255-293::391-417::469-499
MADEPLYPIAVLIDELKNDDIQLRLNSIRRLSTIARALGEERTRRELIPFLSENNDDDDEVLLAMAEELGVFIPYVGGVEHASVLLPPLETLCTVEETCVRDKAAESLCRIGSQMRESDLVEYYIPLVKRLAAGEWFTARVSACGLFHIAYPSAPETSKTELRSIYSQLCQDDMPMVRRSAASNLGKFAATVEYAHLKADLMSIFDDLTQDDQDSVRLLAVEGCAALGKLLEPQDCVAHILPVIVNFSQDKSWRVRYMVANQLYELCEAVGPEPTRTELVPAYVRLLRDNEAEVRIAAAGKVTKFCRILNPDLSIQHILSCVKELSSDSSQHVRSALASVIMGMAPVLGKGSVQSMGTYLRGFKQFRNQEATIEQLLPIFLSLLKDEFPDVRLNIISKLDQVNQVIGIDLLSQSLLPAIVELAEDRHWRVRLAIIEYIPLLASQLGVSFFDDKLGALCMQWLQDKVHSIREAAANNLKRLAEEFGPEWAMQHIIPQVLEMNNNPHYLYRMTILRAISLLAPVMGPEITCSNLLPVVVAASKDRVPNIKFNVAKVLESIFPIVDQSTLTVNIIVIQVVEKTIRPCLVELSEDPDVDVRFFSNQALQAIDHVMMSS

SEQ ID NO: 144408 - protein, 598 aa, Glycine max
  Coding DNA Sequence Number=SeqID_52723
  Gene Ontology: Mol. function=binding
  Homolog annotation: Hit_ID=Q535K6; Match level="QueryCoverage=100%, HitCoverage=100%, E-value=0.0, Identity=92%"; Hit description =Nitrate and chloride transporter
  Pfam annotation: Domain name=Lig_chan; Domain location=344-549; Score= -134.5; E_value=0.044; Accession=PF00060.17; Description=Ligand-gated ion channel
  Pfam annotation: Domain name=MFS_1; Domain location=33-484; Score =12.8; E_value=0.0071; Accession=PF07690.7; Description=Major Facilitator Superfamily
  Pfam annotation: Domain name=Nodulin-like; Domain location=27-272; Score=462.8; E_value=4.6e-136; Accession=PF06813.4; Description =Nodulin-like
  Pfam module annotation: Pfam domain module=Lig_chan::MFS_1::Nodulin -like; Domain location=344-549::33-484::27-272
MVVGGSNTGVHGWRDIKSLTVQVITGRWFVVFASFLIMAAAGATYMFGLYSSDIKTTLGYDQTTLNLLSFFKDLGTNVGVISGLINEVAPPWVVLAIGAILNFFGYFMIWLSVTQKIAKPKVWQMCLYICIGANSQTFANTGSLVTCIKNFPERNGVVLGILKGYLGLSGAIITQLYSAIYYDDTRALILLIAWLPAAISFASLRTIRYMKPVRQPNELNVFYKFLYISLGLAGFLLVMITVQKRVNFTQSEFGVSSAMVLFLLLLPLAVVSMEEYKVWQSKRLALVDPSPVKIVTDQGEKVKPNETTDGSSNSLSSNDTRWWENVFSPPARGEDYTILQALFSIDMWILFICSIFGIGGTLTAIDNLGQIGKSLRYPKKSISTFVSLVSIWNYLGRVFAGFVSEHYLQKYKFPRPLMLTLTMLLSCAGHLLIAFDVPNGLYAASVIIGFCFGAQWPLLFAIISELFGHKYYATLYNFGSAASPLGLYVLNVVMTGHLYDKEAKKQLAELGLERKEGQELNCIGIHCFKLSFIIITAATFFGVIVSLILVARTRTFYKSDIYKRYRDAAATVTEAEMAKVENGNNAKKDEKHVVPTQE

SEQ ID NO: 144409 - protein, 536 aa, Glycine max
  Coding DNA Sequence Number=SeqID_52724
  Gene Ontology: Mol. function=protein phosphatase type 2A regulator activity; Cellular component=protein phosphatase type 2A complex; Biological process=signal transduction
  Homolog annotation: Hit_ID=A7PHZ0; Match level="QueryCoverage=90%, HitCoverage=99%, E-value=1e-164, Identity=59%"; Hit description =Chromosome chr13 scaffold_17, whole genome shotgun sequence
  Pfam annotation: Domain name=B56; Domain location=65-474; Score =874.6; E_value=4.9e-260; Accession=PF01603.11; Description=Protein phosphatase 2A regulatory B subunit (B56 family)
MFNKIIKLAHKKCSKLEFLENGQQFYEVVIKHASRSATATPATVNSDSQNPPPSSLLPNPTAIESLPPLRDVDVSERPALFLRKIQVCCFLCDFSDVLKYVYEKETKRQTLEELVEIIQSGSFGFTENQEDLINMVSVNIFRCFPPSSLNTQNVDPEDDEKYQEPSWPHLQLVYEILLRYIVSPETDIKTSKRYIDHIFVLKLIELFDSEDQHEREYLKTILHRIYGKFMVHRPFIRTAINNVFYRFIFETQRHNGIAELLEILGSIINGFALPMKEEHKLFFIRTLIPLHYPKTFSSYNQQLSYCVVQFVEKDNRLADPVIKGMLKYWPVTNYQKEVFFLAELEEIIEAIQYPEFVHCTVSLFRQIGRCLNSPHFQVAERALYLWKNEQIISIVSQNRNVILPVIFEALENNLKSHWNRAVLGLTANVRKMFLEMDAELFEECQKQYLEKEARARELEEKRELTWKKLEAVAAQAVRDDMVLNGRWWRCLAAAAAAAATSEYHPEEVPPIVTAGPVSVAFAGGSGHGPTAVEAGI

SEQ ID NO: 144410 - protein, 419 aa, Glycine max
  Coding DNA Sequence Number=SeqID_52725
  Gene Ontology: Mol. function=pectate lyase activity; Cellular component=anchored to membrane; Biological process=pathogenesis
  Homolog annotation: Hit_ID=Q9SCP2; Match level="QueryCoverage=99%, HitCoverage=85%, E-value=1e-151, Identity=64%"; Hit description =Probable pectate lyase 12 precursor
  Pfam annotation: Domain name=Pec_lyase_C; Domain location=153-338; Score=325.1; E_value=1.3e-94; Accession=PF00544.10; Description =Pectate lyase
MLPITCILFMCLLSSFSPPINALLNLNLTLPHQYPHPESVVQDIQRKVNASLRRREMLSKDEQQGMSSCLTGNPIDDCWRCEPNWAAERQKLAECGLGFGKYAMGGKGGQIYIVTDSSDRDPANPIPGTLRHAVIQDEALWIVFAADMTINLKHELIFNSYKTLDGRGANVHVTGHGCITLQYVSNIIIHNIHIHHCTPSGNTNIRASPTHVGWRGKSDGDGISIFGSRKIWIDHCSLSYCTDGLIDAIMGSTGITISNSHFAHHDEVMLLGHDDKYLVDRGMQVTIAFNHFGEGLVQRMPRCRLGYIHVVNNDFTQWRMYAIGGSANPTINSQGNRYTAPGDPDAKEVTKRVDTDDREWSGWNWRTEGDIMVNGAFFVPSGAAGQSGQYQEATSVQAKSAVQIDQLTMYSGVLGDPRY

SEQ ID NO: 144411 - protein, 63 aa, Glycine max
  Coding DNA Sequence Number=SeqID_52726
MVLVIVKHFRWYLVALCDCNKDECSEGDNNEVMMEEENYEGGEKWGDGDGDLVVPYWQCYWLK

SEQ ID NO: 144412 - protein, 77 aa, Glycine max
  Coding DNA Sequence Number=SeqID_52727
  Gene Ontology: Mol. function=protein tyrosine/serine/threonine phosphatase activity; Biological process=protein amino acid dephosphorylation
  Homolog annotation: Hit_ID=A7QUX1; Match level="QueryCoverage=77%, HitCoverage=23%, E-value=2e-23, Identity=80%"; Hit description =Chromosome chr13 scaffold_181, whole genome shotgun sequence
MREAYLKVKLSYPWVLTYGHGRSVAVMCALLVARGITEDWKNAEKLIKQKRPYIRMNALHRKALEEWSRHQLSAPRK

SEQ ID NO: 144413 - protein, 273 aa, Glycine max
  Coding DNA Sequence Number=SeqID_52728
  Gene Ontology: Biological process=intracellular signaling cascade
  Homolog annotation: Hit_ID=A9P8C0; Match level="QueryCoverage=77%, HitCoverage=97%, E-value=8e-95, Identity=77%"; Hit description =Putative uncharacterized protein
  Pfam annotation: Domain name=DUF231; Domain location=115-273; Score =182.0; E_value=1.6e-51; Accession=PF03005.6; Description=Arabidopsis proteins of unknown function
MAKPKLHLLSFLLCTILLSFFHCTFSLINPEDETSWIDMETEDINVVQSLFFNGFPCYVQLQDFETSIEFFWAPLLVELKKGAGNKRILHLDLIEENARCWKGVDVLVFDSAHWWTHSGQTRSWDYYMEGNSIITNMNPMVACQKGLSTWARWVDLNLDPRRTRVIFRSMSPRHNRLNGRKCYKQRKPLQFFSHIHVPEPLVVLKGVLKRMRFPVYLQDITTMTAFRRDGHPSVYSKAMSEERQKGTGLSSDCSHWCLPGVPDIWNEMLSTLI

SEQ ID NO: 144414 - protein, 541 aa, Glycine max
  Coding DNA Sequence Number=SeqID_52729
  Gene Ontology: Mol. function=nucleic acid binding; Cellular component= intracellular; Biological process=regulation of transcription
  Homolog annotation: Hit_ID=A7QBW3; Match level="QueryCoverage=79%, HitCoverage=88%, E-value=1e-64, Identity=52%"; Hit description =Chromosome chr1 scaffold_75, whole genome shotgun sequence
  Pfam annotation: Domain name=RS4NT; Domain location=103-140; Score =17.0; E_value=0.015; Accession=PF08071.3; Description=RS4NT (NUC023) domain
  Pfam annotation: Domain name=zf-C2H2; Domain location=118-140; Score =20.5; E_value=0.0063; Accession=PF00096.17; Description=Zinc finger, C2H2 type
  Pfam annotation: Domain name=zf-C2H2; Domain location=145-166; Score =15.8; E_value=0.17; Accession=PF00096.17; Description=Zinc finger, C2H2 type
  Pfam module annotation: Pfam domain module=RS4NT::zf-C2H2::zf-C2H2; Domain location=103-140::118-140::145-166
  Subcellular localization annotation: CTP_CleavageSite=56; ConfidenceScore=5.24e-01
MAASSSSASLFGFREEDQQNQMKQQHSLTPSPSTTPAAPPPQKKKRNQPGTPCKSRCRGDSTISQDPNGNKQKTTKEPKRKVYLCPEPTCVHHDPSRALGDLTGIKKHYSRKHGEKKWKCDKCSKKYAVQSDWKAHSKTCGTREYRCDCGTLFSRRDSFITHRAFCDALAQESARQPPSLSGGGIGSHLYGSTTNMALNLSQVGSQIQDPSNAQPTELLRLGATSGRTGHFDHILGSPFRPSNQQQQPFFMSEQPNQTYHHPDQNKPFQQGLMQQLSDHHHLNNNNSPFNLPFLSSNTANASFSEHFNNANGGGNNNNNNEGTNYFATSSAPSLFSNSANANANALSHMSATALLQKAAQMGATSSNGTASLLKSFGSASSSSGGGSKSEQQHRVPPLVNAANYVGGMFGGNHVNEQQSNSNLQDLMNSFAVGGNSSIFEAGGFEAYDHSNNNNNRDPKVLAMSGSNSVGGSDRLTRDFLGVGQIVRGMSGSGGVAQREQQQQHGFNLSSLEAERNNNNNNSNNAAPSSGQAFGGGGGNFQ

SEQ ID NO: 144415 - protein, 556 aa, Glycine max
  Coding DNA Sequence Number=SeqID_52730
  Gene Ontology: Mol. function=zinc ion binding; Cellular component =endoplasmic reticulum; Biological process=ER to Golgi vesicle -mediated transport
  Homolog annotation: Hit_ID=Q9M291; Match level="QueryCoverage=95%, HitCoverage=47%, E-value=0.0, Identity=69%"; Hit description=Protein transport protein Sec24-like CEF
  Pfam annotation: Domain name=Gelsolin; Domain location=458-528; Score= 38.2; E_value=3e-08; Accession=PF00626.13; Description=Gelsolin repeat
  Pfam annotation: Domain name=Sec23_BS; Domain location=244-328; Score= 146.9; E_value=5.4e-41; Accession=PF08033.3; Description=Sec23Sec24 beta-sandwich domain
  Pfam annotation: Domain name=Sec23_helical; Domain location=340-441; Score=120.9; E_value=3.6e-33; Accession=PF04815.6; Description =Sec23Sec24 helical domain
  Pfam annotation: Domain name=Sec23_trunk; Domain location=4-239; Score=257.9; E_value=2.2e-74; Accession=PF04811.6; Description =Sec23Sec24 trunk domain
  Pfam module annotation: Pfam domain module=Gelsolin::Sec23_BS::Sec23 _helical::Sec23_trunk; Domain location=458-528::244-328::340-441::4 -239
MSWKGLLMEWLTRKVEWSIVEGPRTLVGVATFDSTIHFYNLKRALQQPLMLIVPDVQDVYTPLQTDVIVPLSECRQHLELLLESIPTMFQNNRTSESAFGAAIKAAFLAMKDTGGKLLVFQSVLPSIGIGALSAREAEGRTNISAGEKFLYILQRNPILVEFQEAHKLLQPADKAFKELAVEFAEYQVCVDVFVTTQTYVDIASISVIPRTTGGQVYYYYPFSALSDTAKLYNDLRWNITRPQGFEAVMRVRCSQGIQVQEYYGNFCKRIPTDVDLPGIDCDKTFMVTLKHDDKLQDGSECAIQCALLYTTVYGQRRIRVITLSLPVTSMLSNLFRAADLDTQFCCFLKQAASEIPSKPLPLVREQVTNLCINALFSYRKFCATVSSSGQLILPEALKLLPLYTLALTKSTGLRTEGKIDERSFWINYVSSISAPLAIPLVYPRMMAIHDLDSKEDEDSVIPPFLPLSSEHVSDDGIYLLENGHDCLIYVGDSVNPDIVQKLFGVATVDKVPTLQYDNPLSKKLNEVINEIRRQRCCYLRFKLCRKGDPSGWIFKY

SEQ ID NO: 144416 - protein, 620 aa, Glycine max
  Coding DNA Sequence Number=SeqID_52731
  Gene Ontology: Mol. function=aspartic-type endopeptidase activity; Cellular component=small subunit processome; Biological process=DNA integration
  Homolog annotation: Hit_ID=A5ARL5; Match level="QueryCoverage=39%, HitCoverage=16%, E-value=3e-31, Identity=30%"; Hit description =Putative uncharacterized protein
MEDADAYAVGMNPWEQHSGVIKLPRYDYNSPSSLLFSSLLRNSHSDFLITCTISSVNSLTSLHSHSSPSNLPFHFFNSSFHSATKEAISILHKFVAYDSSNNPKEEGTSSKKRKLCTQDTADECFDHKDTESASANSAEDGVKAEGEKDGVACLSLVKLTRNGLLLLNFPSNTPPNTVNIVSNIIQALESGTVTLPVIQSLSNKREIVSSDFRIKKIEYARADVPQPRKIPLPPSYKPKLKVLGSNCKNPIMMGQGCGAWCDVKFNCKSVEPAILTNFRAFKTCYSFWKKAQSVFANDIQQLYDVAKKLATLKQTNHDMVAYVLKAQSAVEELKLSLEANKLEDIKTKLNNLYMVLVLRGMHPDFDHIRDQVLTSQEVPSLENLITRLLRVPSPKIGGNSVDNIETSVMVSNRGGQGGRGNQGGRAGRGDTCYSIHGFPGKSVNISKSETSEIKFLEADYQEYLQLKATKESQTSSVISGHNSTACISQVGNNQSPWIIDSADGSRVATTGIGHKEVDVAFPFPSFLLSRLRLPQDESYTNKLPMFLVSWVPSSAGGHGKLGVFGNRWQQPAVKHFPYAACELERTIIPKGNFEMIGNTYFNTLLCLVFKTAHQPLPEIT

SEQ ID NO: 144417 - protein, 53 aa, Glycine max
  Coding DNA Sequence Number=SeqID_52732
MVGILVLLHWLALTVGANRIFPIQATCNLNEKELQEVVSRLVKKFLADKQDKL

SEQ ID NO: 144418 - protein, 482 aa, Glycine max
  Coding DNA Sequence Number=SeqID_52733
MKCSDSGSLCLGNEMTKQKGILIARDSDCDSLVSSPSLLSNSEKVKEVFVGGGDEVEFCAQKDRGEEKLKKGIDMTIINDAELLIVELCNADESVFREGDERELFFKEDEETSKFPFYWQRFPFKFKSRAHQILWPEENRDIKIIGKPRKIEEVKAGQRFFLVRCAKNIQGASGGRRRRWGGHPHGWARGKGTKMEVETTITEELVAAAKENGVEAMKTEVGKTKQLSLELTKSMGTVKNLQEDLDKHVAYLSSKVEENKALSVQVADPEQQMNDIGKKMKDLTSEKKTTKAELGTVRDEMAEMKEALAKMEIELREKEEVESTLKAELNEAKRLIVINHLEGDDLSCDVFKPIHPILQGLDDVEWAFPVWCKFSFQVVLPGISSEPPNQFVGLEAMSNSTTKDYELLAMLTMLLRSEVVPPKHARELIHPQSLGDFGQSFAQHDKDDLVCDFLLPIGQGMLNQGCEMLDTKLLKELFIALF

SEQ ID NO: 144419 - protein, 625 aa, Glycine max
  Coding DNA Sequence Number=SeqID_52734
  Gene Ontology: Mol. function=hydrolase activity; Cellular component =mitochondrion; Biological process=lipid metabolic process
  Homolog annotation: Hit_ID=A7P389; Match level="QueryCoverage=57%, HitCoverage=82%, E-value=1e-133, Identity=67%"; Hit description =Chromosome chr1 scaffold_5, whole genome shotgun sequence
  Pfam annotation: Domain name=Abhydrolase_1; Domain location=168-388; Score=40.3; E_value=6.9e-09; Accession=PF00561.11; Description =alphabeta hydrolase fold
  Pfam annotation: Domain name=DUF292; Domain location=310-445; Score =8.8; E_value=4.8e-06; Accession=PF03398.5; Description=Eukaryotic protein of unknown function, DUF292
  Pfam module annotation: Pfam domain module=Abhydrolase_1::DUF292; Domain location=168-388::310-445
  Subcellular localization annotation: CTP_CleavageSite=54; ConfidenceScore=5.58e-01
MEASATLRFVTHTLSLFPHTPISSISVSPKFSSNTTLSVAKKKSSIEGVSEELNAMTSQNLDFAPSRRRVRAAFTEVHQQLDHFLFKNQSLILMFQSLHVFVFGWQTRLLLPGSELRKNSRGLEIFCKNWMPEPGVPLKAALCFCHGYGSTCTFFFDGIAKRIDASGYGVYAMDYPGFGLSEGLHGYIPKFDDLVDDVIEHYTKIKARPEVRGLPRFILGQSMGRAIALKFHLKEPNTWDGVILVAPMCKVAEGMLPPMAVLKVLNLLSKVMPKAKLFPHRDLSALTFREPGKRKVAGYNVISYDHPTGLKTGMELLSATQEIESLLHKVSAPLLILHGADDLVTDPLVSQFLYEKASSKDKTLEIYEGSYHGILEGEPDDRIFAVHNDIISWLDFRECPTELREAIASIIFAAPRCSDVPDLLHIKNLFTTKYGKEFVSAVSELRPDSGVNRTIIEKLSVSAPSGEVKLKVLREIAEEYNIAWDSSKTEAEFRKNHEDLLGGAKQVSAGATLSHTPNRNGSNNPSPRITEPSIKSVHAKQEYKPLEAPSPSNNNSLLNTNEIEHSHENNDVPAGDAKSEIRFQSSDVLEKARAAIASADRASAAARAAAALVQSNFGSLKLGGK

SEQ ID NO: 144420 - protein, 96 aa, Glycine max
  Coding DNA Sequence Number=SeqID_52735
  Homolog annotation: Hit_ID=Q9LUA1; Match level="QueryCoverage=76%, HitCoverage=69%, E-value=3e-08, Identity=43%"; Hit description =Genomic DNA, chromosome 3, P1 clone: MPE11
MLFAGGKKLLYVCVVVMLVVLHICHTCQVGAIRVFPGNAAANVEFSHGNMDNNKSKEDLFKKYFGGRTHLRPSNTTQKGFDDSKRRVPSCPDPLHN

SEQ ID NO: 144421 - protein, 328 aa, Glycine max
  Coding DNA Sequence Number=SeqID_52736
  Gene Ontology: Mol. function=transcription factor activity; Cellular component=nucleus; Biological process=regulation of transcription, DNA-dependent
  Homolog annotation: Hit_ID=A7P376; Match level="QueryCoverage=99%, HitCoverage=91%, E-value=8e-47, Identity=38%"; Hit description =Chromosome chr1 scaffold_5, whole genome shotgun sequence
  Pfam annotation: Domain name=AP2; Domain location=93-144; Score=70.6; E_value=5.2e-18; Accession=PF00847.11; Description=AP2 domain
MRKLRIICDDPEATDSSEDESERVQKPRRVKRSVLEMSLPPLPQTFTTTTPDTSSCEVNSSKNATLKVCTEGQPQSKKRVLTHTPSTRRSTCGKYRGVRQRKWGKWAAEIRDPFQCTRIWLGTFNTAEEASKAYETRRLEFEAMAKTQTLKTGSEPLSTTSDKSNCCNSSAAAAADVSVSEKFSTTSDDSEESMLSHNSPSSVLELDTSASKSVEKGNGSTEEATGANNLVAELAGLEIPDLSLLNLPPPPSVAADAAGIEPNFGLDFDWLSFNDYGQGFEDFGGLENIHIGGFDDTEPSELPDFDFGDFGADEFAGWIEEPLNIPCA

SEQ ID NO: 144422 - protein, 925 aa, Glycine max
  Coding DNA Sequence Number=SeqID_52737
  Gene Ontology: Mol. function=hydrolase activity, hydrolyzing O -glycosyl compounds; Cellular component=cellulose and pectin -containing cell wall; Biological process=carbohydrate metabolic process
  Homolog annotation: Hit_ID=A7P375; Match level="QueryCoverage=96%, HitCoverage=96%, E-value=0.0, Identity=77%"; Hit description =Chromosome chr1 scaffold_5, whole genome shotgun sequence
  Pfam annotation: Domain name=Glyco_hydro_31; Domain location=275-766; Score=897.6; E_value=5.7e-267; Accession=PF01055.17; Description =Glycosyl hydrolases family 31
MASSIRLVTLCLSYLLLTWLLHVTAEEATSSSNKIGLGYRLISIKDAPDGSLVGLLQVKQNNNVYGPDLPLLRFYVKHETENRLRVHITDAKKQRWEVPYNLLPREQPPALNQYIVWSRKKNLVSVSEYSGSGSDLVFSYISDPFSFSVKRKSNGDTLFDSNSNEFNSLVFKDQYLEISTKLPKDASLYGLGENTQPHGIKLYPNDPSTLYTTDVSAINLNTDLYGSHPVYMDLRNEGGKPYAHGVLLLNSNGMDVFYRGTSLTYKIIGGVLDFYFFAGPTPLNVVDQYTSLIGRPAPMPYWAFGFHQCRWGYHNLSVVEDVVENYKKAKIPLDVIWNDDDHMDGHKDFTLNPVNYPHSKLLDFLDRIHSIGMKYIVIIDPGIAVNSSYGVYQRGIADDVFIKYEGEPFLAQVWPGAVYFPDFLNPKTVSWWVDEIRRFHELVPVDGLWIDMNEASNFCSGKCTIPKGKVCPSGTGPGWICCLDCKNITSTRWDDPPYKINASGVQAPIGFKTIATSAVHYDGVLEYDAHSIYGFSQAIATHKALQGLKGKRPFILSRSTYVGSGKYAAHWTGDNKGTWEDLRYSISTMLNFGIFGVPMVGSDICGFYPAPTEELCNRWIEVGAFYPFSRDHANFYSPRQELYQWESVAESARNALGMRYKLLPYLYTLNYEAHVSGAPIARPLFFSFPTYTECYGLSTQFLLGSSLMISPVLEQGKTQVTALFLPGTWYNLFDLTQTIVSKDGNYVTLDAPLHVVNVHLYQNSILPMQQGGMISKDARMTPFSLIVTFPAGATDGEAKGNLFLDDDELPEMKLVNGYSTYIDFHATIKEGTVKIWSEVQEGKFALDKGWVIDTINVLGLNRNGALPKIEIDGEPLMSLSNVQVSTTQHKYLYGQGDGDKILMVGLKGLNIPVGKNFNVTWKMGS

SEQ ID NO: 144423 - protein, 199 aa, Glycine max
  Coding DNA Sequence Number=SeqID_52738
VKALADQGEWASFIDILALLIFGVILFPNMEGLVVLAAIDAFLAYHHSKESPVIAILVDVYDTPTYPLQGHRLCAKKGKKNWEQLWASVERRRRKASRLSSPRVLVTLMQEYFKESARHEVQCKLKATREEKAETPKESEEVQTLKAELERAQVVKEKFKSTAIKVWKEYDELRDINMATVEALERETKRARKEEHDRN

SEQ ID NO: 144424 - protein, 251 aa, Glycine max
  Coding DNA Sequence Number=SeqID_52739
  Homolog annotation: Hit_ID=A5AZ88; Match level="QueryCoverage=56%, HitCoverage=12%, E-value=4e-08, Identity=33%"; Hit description =Putative uncharacterized protein
MERSMIDATSGGALGDMTPAEARNLIEKMASNSQQFSARNDAIVIRGVHEVATNSAASSETKKLEGKLDALVNLVCGLCSSADHHTDLCPSMQQPGAIEQPEAYAANIYNRPPQPQQQNQPQQKNYDLSSNRYNPGWRNHPNLRWSSPQQQQQQPAPSFQNAAGPSRPYIPPPIQQQQQPQKQPTVEAPPQPSLEELVRQMTMQNMQFQQETRASIQSLTNQMGQLATQLNQQQSQNSDKLPSQAVQNPKN

SEQ ID NO: 144425 - protein, 163 aa, Glycine max
  Coding DNA Sequence Number=SeqID_52740
  Homolog annotation: Hit_ID=UPI00006A2D9E; Match level="QueryCoverage =55%, HitCoverage=84%, E-value=2e-08, Identity=19%"; Hit description =UPI00006A2D9E related cluster
AARPRLERATSPRLQRSTRPHLQRTTCLHLLRTTRLHALAFRGLDVLAYRGLHAIAFRRLRLHTLTFRGLHPLAFRGLHVLIFRGLHVLTFRGLHVLTFRGLHVLAFRGLHVLAFRGLHAFSLRGLHAVTFSGLHALTFRGLHILTFRGLHTLAFRGQHVLAY

SEQ ID NO: 144426 - protein, 74 aa, Glycine max
  Coding DNA Sequence Number=SeqID_52741
  Gene Ontology: Biological process=transposition, DNA-mediated
  Homolog annotation: Hit_ID=Q1J7G7; Match level="QueryCoverage=44%, HitCoverage=47%, E-value=3e-11, Identity=93%"; Hit description =Transposase
MVWPRASRYQQGHQDLFILRSDLPSQVLQWLLFVSAVPPVQLLTGWCVTAKAPPDISAGKCSGHAARNHHTRRA

SEQ ID NO: 144427 - protein, 29 aa, Glycine max
  Coding DNA Sequence Number=SeqID_52742
MFVFNNALKGVDDTPQSKSKVAARWMVVK

SEQ ID NO: 144428 - protein, 275 aa, Glycine max
  Coding DNA Sequence Number=SeqID_52743
MAAGAGAEVAPRSREAARRRLVSRRRDGPGRRATRPGLGRAAPGHPAFLDDGVAIRGGQQRLQVLVDAQHRQPGALEAFQRLPDLFAHHRRQPFRGLVQDQQARIRQQRAADGQHLLLAARQVAAQVARAFGQPREQRVDAFQRPGLRQPLAIVRGGHQVLAHRQVGEHVPALGHQADAALRHLIGRQGGDVAAVERDGAAAGAVQAHDGLDRGRLAHAVAAQQRHELARGDIQVDAEQRLAGAVMRGHAAQRQQRAHAGAPCARRPAWPRSLPR

SEQ ID NO: 144429 - protein, 32 aa, Glycine max
  Coding DNA Sequence Number=SeqID_52744
MVKLAKINTKSGVKDKAALEHKEKKTSKKPKR

SEQ ID NO: 144430 - protein, 63 aa, Glycine max
  Coding DNA Sequence Number=SeqID_52745
  Subcellular localization annotation: CTP_CleavageSite=38; ConfidenceScore=5.02e-01
MVKVGTSYVPINVSFSPKVGPGLPAVPPVQLLTGWCVRANAPPDISAGKCSGHAARNHHTRRG

SEQ ID NO: 144431 - protein, 207 aa, Glycine max
  Coding DNA Sequence Number=SeqID_52746
  Subcellular localization annotation: CTP_CleavageSite=84; ConfidenceScore=5.69e-01
HVLTVRGLHVFTFKGLHIFTFRGTRPRFQRTTSSPLEDYTSFTFRGLSRPRLQRTTPSPFRGLHALAFRGLHVPSEFSEGLHALAFSKGYAPHPSEDYTSSPSRTTRPHYRGTRRLRGLHPRLQKGHAPHLQRDYTPSLAEDYTSSPSGGVLLAFQRDYTPLPLEGLHALTFQRTRHVLAFRGLHALALPSEGLHVLGFRGYTSSVS

SEQ ID NO: 144432 - protein, 37 aa, Glycine max
  Coding DNA Sequence Number=SeqID_52747
MASFRDLEHKWCAKVGALMELQCPSRFSAPVKASFRK

SEQ ID NO: 144433 - protein, 74 aa, Glycine max
  Coding DNA Sequence Number=SeqID_52748
MAEEDALSLDNIECGVCAEYTDAGVYGRRNSGSNKEAFEMGERRLHLSWTHSERNYGTLLNPSIWQKMPQVTNS

SEQ ID NO: 144434 - protein, 169 aa, Glycine max
  Coding DNA Sequence Number=SeqID_52749
  Gene Ontology: Mol. function=aspartic-type endopeptidase activity; Cellular component=intracellular; Biological process=RNA-dependent DNA replication
  Homolog annotation: Hit_ID=Q0KIL1; Match level="QueryCoverage=63%, HitCoverage=12%, E-value=9e-09, Identity=33%"; Hit description =Gag/pol polyprotein, 3'-partial, putative
  Pfam annotation: Domain name=G-patch; Domain location=67-106; Score =25.4; E_value=0.00016; Accession=PF01585.14; Description=G-patch domain
MVVRAFDGTSPRGEEDILVSCPSSMPYVEAAEESLETAFQSFEVVSISSMDSFSGQACLSDAAVMMARVMLGNGYEPGMGLGKDNGGITSLINAKGNRGKYGLGYKPTQADMKRSIAGRKSGGQSSRWRQEGGGSPPCHISRSFISAGLGDEGQVVAIYEDDVPSTLDL

SEQ ID NO: 144435 - protein, 67 aa, Glycine max
  Coding DNA Sequence Number=SeqID_52750
MALRKRDREWRIALSNHYAWLQTRGGRERRIALSNHYAWLQTRGWRMHERKPNSWGSEKGVENGELH

SEQ ID NO: 144436 - protein, 179 aa, Glycine max
  Coding DNA Sequence Number=SeqID_52751
  Gene Ontology: Mol. function=DNA-directed RNA polymerase activity; Cellular component=mitochondrion; Biological process=transcription
  Homolog annotation: Hit_ID=O47884; Match level="QueryCoverage=91%, HitCoverage=21%, E-value=6e-22, Identity=58%"; Hit description=DNA -directed RNA polymerase
MVMLTKNNLPSAKEFLRGKYLMDKEYPGRMTIYAESRSGDRLETSGSELCDEENKNLRCVLSESDKSLLVELGEHSIECLLVHTLGHLFNLENIVSLASLVDRIERNVRDYASSSTLYYNSRGHNYYRSSLVYAECLFNPALLPIKLNLPMVFPPKDWEPHKPEQKPTLRAKSTALNGV

SEQ ID NO: 144437 - protein, 694 aa, Glycine max
  Coding DNA Sequence Number=SeqID_52752
  Gene Ontology: Mol. function=NAD+ nucleosidase activity; Cellular component=integral to membrane; Biological process=metabolic process
  Homolog annotation: Hit_ID=Q4K3M9; Match level="QueryCoverage=98%, HitCoverage=61%, E-value=8e-82, Identity=29%"; Hit description=Rhs family protein
  Pfam annotation: Domain name=RHS_repeat; Domain location=159-201; Score=2.5; E_value=20; Accession=PF05593.5; Description=RHS Repeat
  Pfam annotation: Domain name=RHS_repeat; Domain location=206-243; Score=32.7; E_value=1.3e-06; Accession=PF05593.5; Description=RHS Repeat
  Pfam annotation: Domain name=RHS_repeat; Domain location=248-285; Score=13.9; E_value=0.6; Accession=PF05593.5; Description=RHS Repeat
  Pfam annotation: Domain name=RHS_repeat; Domain location=290-327; Score=21.3; E_value=0.0036; Accession=PF05593.5; Description=RHS Repeat
  Pfam annotation: Domain name=RHS_repeat; Domain location=332-369; Score=8.9; E_value=2.9; Accession=PF05593.5; Description=RHS Repeat
  Pfam annotation: Domain name=RHS_repeat; Domain location=378-416; Score=13.0; E_value=0.86; Accession=PF05593.5; Description=RHS Repeat
  Pfam annotation: Domain name=RHS_repeat; Domain location=430-466; Score=29.4; E_value=1.3e-05; Accession=PF05593.5; Description=RHS Repeat
  Pfam annotation: Domain name=RHS_repeat; Domain location=492-528; Score=9.5; E_value=2.4; Accession=PF05593.5; Description=RHS Repeat
  Pfam annotation: Domain name=RHS_repeat; Domain location=565-602; Score=19.4; E_value=0.014; Accession=PF05593.5; Description=RHS Repeat
  Pfam annotation: Domain name=RHS_repeat; Domain location=616-656; Score=28.3; E_value=2.9e-05; Accession=PF05593.5; Description=RHS Repeat
  Pfam module annotation: Pfam domain module=RHS_repeat::RHS _repeat::RHS_repeat::RHS_repeat::RHS_repeat::RHS_repeat::RHS _repeat::RHS_repeat::RHS_repeat::RHS_repeat; Domain location=159 -201::206-243::248-285::290-327::...
  Pfam module annotation: Domain location=332-369::378-416::430 -466::492-528::565-602::616-656
MAGGGMLADMSINAIFSALHPVHAATGVKVLNDDAERDFSLPGRFPLRWQRSYNSLTQRVGLFGRGWSTVFDSYLTLEGNQATWFDDNGRELRFLPGEKEVLYSISEGLMVRRNAHGDVAIADDDGAVWRLYKPTARNPQLLRLASLSDEYGNALEMGWDEQSRLVRIHDEPLAIDVTLHYNDERHPQRVTAAKIDAAGNRYRREYNDAGQVIRETDCSGQTTRYRYHPLGWLSCVTAADGEETRYYYDAAGRPRQMERAEGWEERLEWSERGLPVAYASADGKRSEFAYDQAGRLTLSRNAQGEEVQRRWDSRGRLISLQNQNGESYHFEWGADSLLLAQVGLDGVATSYDYDAAGRAVARTFAAGHPQAITHRFAFSPAGQLMARITPEGQTRYDYTAAGQLASVAQHLPLGENQWSREAEQAITFAYDKAGRVIAEQGDQGSLAWQYDALGNCTALTLPDGRQLKQLYYGSGHLLSIALDNLPVSEFTRDTLHRELSRSQGGLTTRSDYDRLGRLVRRDVFDGEAQRPAPRRWSRRRDFDYGNNLIREQRDDNPFSQTLWHYDSAGRLLAQEGVQPGNDTWQWDGAGNPLDRSAAAAVTYNRVTQLNGIRWRYDVHGRTSEKDDGQTRWRYRYDDEHRLIEVVSEPRDRNKPQVQVSFRYDPLGRRISKRVQRLLHGKPAGAATLTRFVWD

SEQ ID NO: 144438 - protein, 276 aa, Glycine max
  Coding DNA Sequence Number=SeqID_52753
  Homolog annotation: Hit_ID=UPI00006A2939; Match level="QueryCoverage =56%, HitCoverage=100%, E-value=3e-11, Identity=29%"; Hit description= UPI00006A2939 related cluster
MLQVLTFRGLHVLAIRGQHALAYRGLHVLAIRGLHALAIRGLHVLAITWLHALTIKELHVLAFKGLHALAFRGLHVLAIRGLHVRAFRGLHALTLGGLHVLTIRGLHALAITRLHVLAFKGQHVQTFRGLHVLPIKGLHPSPSELLHCPHLRELHVLTFKGSTPSPSEDYTSSAFRMLQVLTFRGLHVLAIRGQCTSWPLEGSTPSPSEDYTSSPLEGCKPSPLEDYTSSPLVDFRSSPSKGCMPSPSKNYTSSPSEGCTPSLSEDYTVLVFRGLH

SEQ ID NO: 144439 - protein, 44 aa, Glycine max
  Coding DNA Sequence Number=SeqID_52754
MAKLRDSEASPEIMDTNQQRRRVSEAKRKKGFGVSEAKKLKGFL

SEQ ID NO: 144440 - protein, 201 aa, Glycine max
  Coding DNA Sequence Number=SeqID_52755
  Pfam annotation: Domain name=Transposase_23; Domain location=36-106; Score=-2.3; E_value=0.0021; Accession=PF03017.5; Description =TNP1ENSPM transposase
MASFNQMQSQMQSQGLALPLEPLGSCVDPSRNDPETGDSDRCGLYIKADPACLVALGRVYEGSTGFHNTPLLPDQVKVGVEEVTDADAPVPVPTDEVSLVGQAIHTFFAWPTHLVKSLSQQTVVSPAKPPQKPDLEVDDPLYLMTLTIPEIFLRPYQVTWDATVFGVFNLDFPLYIKHEDLSEIAHDGQCLSISMLQLWIL

SEQ ID NO: 144441 - protein, 68 aa, Glycine max
  Coding DNA Sequence Number=SeqID_52756
MASSSSCSSSIQTRSGPIDSDVLWMQSKHVSEHAWNREPDRKLHIRRAVPTYQGEEQIPEEIVPLLRQ

SEQ ID NO: 144442 - protein, 113 aa, Glycine max
  Coding DNA Sequence Number=SeqID_52757
  Gene Ontology: Cellular component=chloroplast
  Homolog annotation: Hit_ID=Q7Y618; Match level="QueryCoverage=54%, HitCoverage=82%, E-value=1e-20, Identity=83%"; Hit description =Putative uncharacterized protein
MTSKELNEEPYEVKISCTATMRQKIFFLKKFDSELRYVQGPIWKEFQRFSLTLSVSTNNSKCLDFFRIGPSQIAMIRSTLHYFGNPRTQSYGYVKYRISNPSRKGGERILNFK

SEQ ID NO: 144443 - protein, 61 aa, Glycine max
  Coding DNA Sequence Number=SeqID_52758
  Subcellular localization annotation: CTP_CleavageSite=31; ConfidenceScore=5.11e-01
MAPKTCLIAASAPDRTSSIKWIVKPNPDQASSSNSSCWTKLDQNRIKTNIQTTRLLYPDSS

SEQ ID NO: 144444 - protein, 86 aa, Glycine max
  Coding DNA Sequence Number=SeqID_52759
MDIAPLWHFFISNSFAIYTILFNSPNNFRLSWFLPSSEELKGGLMNQLSGIVAFEIEYGHGLKSKKGGMKNLDMHFKRKHLMYSST

SEQ ID NO: 144445 - protein, 107 aa, Glycine max
  Coding DNA Sequence Number=SeqID_52760
MAPKKLLSKRARKDAVGEGSSVTPQVDMEFDGHWFQSKEHQHRFEAIKGGSGLTMAKCDLEIVMEFYANVRPTEEGVWDKCSWSPTVRSGAGLHPKCDREMGADHAH

SEQ ID NO: 144446 - protein, 46 aa, Glycine max
  Coding DNA Sequence Number=SeqID_52761
MGEVGSSRGKAQVVEEGRDYAFTDVEELFLVPKHGSFPSSRCPDFD

SEQ ID NO: 144447 - protein, 139 aa, Glycine max
  Coding DNA Sequence Number=SeqID_52762
  Homolog annotation: Hit_ID=Q3R8Y4; Match level="QueryCoverage=46%, HitCoverage=100%, E-value=7e-14, Identity=56%"; Hit description =Putative uncharacterized protein
MTGSNRRPPACKAGALPAELIPQYSVVGLVGLEPTTPALSRRQVIFSRKEVIQPHLPIRLPCYDFTPVMNTTVVIVPLAVRLTTSGPGTYSPRHADPRLLAIPTSCSRVAENNPDYDRLSEISSPSRVGNSLYRPLYYV

SEQ ID NO: 144448 - protein, 89 aa, Glycine max
  Coding DNA Sequence Number=SeqID_52763
MLRKLGRIDGDPVLRETRIWATWKYVSSVGGGQQGMVGLCTLCGCGNLLCTIARPPPSTTCDGVVPGDMSRGSGDLGDVRWGAIAQNQA

SEQ ID NO: 144449 - protein, 42 aa, Glycine max
  Coding DNA Sequence Number=SeqID_52764
MDKSLKLEEDEWRERERRAQNFCASNEPTNPRSSPRFSSKCA

SEQ ID NO: 144450 - protein, 285 aa, Glycine max
  Coding DNA Sequence Number=SeqID_52765
  Gene Ontology: Mol. function=heme transporter activity; Cellular component=mitochondrion; Biological process=respiratory chain complex IV assembly
  Homolog annotation: Hit_ID=Q04647; Match level="QueryCoverage=100%, HitCoverage=49%, E-value=1e-140, Identity=87%"; Hit description =Probable cytochrome c biosynthesis protein
  Pfam annotation: Domain name=Cytochrom_C_asm; Domain location=17-211; Score=6.2; E_value=7.8e-06; Accession=PF01578.11; Description =Cytochrome C assembly protein
MMNGIVALHSPPMRKDAAEKKGTLLRSAGCVGSRITSELFTKKFKHVVAKCYPALLLRSNRSLLMLLWRRFFAFSSLWTGALVDTGGEQAKRVVRNEQKDTTTSPLCWSAGANTVVSDQDQKQIRIWILTCRWFLTVGIMPGSWWAHHELGRGGWWFRDPVENASFMPWVLATARIHSVILPLLHSWISFLNIVTLPCCVSGTFSIRSGLLASVHSFATDDTRGIFLWRFFLLMTGISMILFSQMKQQASVRRTSKKEMVVARSTLVHLRHSARAQPRPVMLWKN

SEQ ID NO: 144451 - protein, 284 aa, Glycine max
  Coding DNA Sequence Number=SeqID_52766
  Gene Ontology: Biological process=transposition, DNA-mediated
  Homolog annotation: Hit_ID=Q6UUU1; Match level="QueryCoverage=21%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPVTTLNSIRKLLEKTGIHSPYLEQVETIGNQHRDPREEALQLELAIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 144452 - protein, 171 aa, Glycine max
  Coding DNA Sequence Number=SeqID_52767
  Homolog annotation: Hit_ID=A0ST23; Match level="QueryCoverage=15%, HitCoverage=55%, E-value=2e-08, Identity=100%"; Hit description =Putative reverse transcriptase
VPPVQLLTGWCVTAKAPPDISAGKCSGHAARRVPFAIQAAQLLGRAIGAGLFAITPAGERGMCCKAIKLGNARVFPTLVLSEQSALSAKIGTCAERAEHAKCEYIKLIDTVDLEGGPVGKPVVPAALMNRPTRGERRFAYWALAECILAYYVGTDEGVSEVLHVAGEKRLH

SEQ ID NO: 144453 - protein, 69 aa, Glycine max
  Coding DNA Sequence Number=SeqID_52768
MVQDDMSNEVYHNDDDPKGYEEPMRSSYCNKWQKAMESEIESIKRLEQMERSRPIKLALLLKDIVNRKE

SEQ ID NO: 144454 - protein, 119 aa, Glycine max
  Coding DNA Sequence Number=SeqID_52769
MSGNLSVPTALEANARAIGRLCVFRALRRSVHTGLLCWVTEQGVSRSVHVAEKKLHRSAIPVELLRSVVMRRRESGYPTGRNCQRRRPHDEDILYREVRAAAAKPFFHRLRPPDKHHEI

SEQ ID NO: 144455 - protein, 115 aa, Glycine max
  Coding DNA Sequence Number=SeqID_52770
MIMRGQDIYSSQDDATTSPSSSESEKAKGEESSEEIYPQEEGKPLVVKEKFKEVSVSSKSDQRVPMNPKRIKVIPKWPTPPSVEGRSPEYDEPQDLRSNPFQGGGNDAILPCKGI

SEQ ID NO: 144456 - protein, 83 aa, Glycine max
  Coding DNA Sequence Number=SeqID_52771
MSRSLAFPRVDPWVLVPITFRGLHVLTIKGLHALTSRGLHVLALRGLHVLSTRGLHALTSRGLHVLALRGLHALTLGTSYPHQ

SEQ ID NO: 144457 - protein, 230 aa, Glycine max
  Coding DNA Sequence Number=SeqID_52772
MGEVEEIQEKMKADMEAIKEKMATMMEAMMSVKKIMEANAVAIAATSVVAKVNPTSPSGLEQMNHPTSNMVGKDLGSTGGPHDVQIQNEHAFPSYGLPLNYTPPNVAYTPNKNVNNSTPIPIESQQPQTDHAHGKQLVVYPYKTLWRALSITHNCTSCIPQRLKTLMTMAGMGKLDHLEERLRAIEGGEDYAFANLEELFLIPKHGHSQVQGAGLWQVQGDYSLQEPSKD

SEQ ID NO: 144458 - protein, 66 aa, Glycine max
  Coding DNA Sequence Number=SeqID_52773
MGVSQRALSGRARVRLTGALPKGGKMRGVATNVYLWKTSEKTKETGRQKRGFCSYVPSFGEEIRPT

SEQ ID NO: 144459 - protein, 89 aa, Glycine max
  Coding DNA Sequence Number=SeqID_52774
MTEACMDETQRRTINRSNSNQLNNVQDSGKKVRSQESIQGIYQMISGNQDSRFKISRIKTRFKTQDSRIKRRLNPKISMKSFSQKLNST

SEQ ID NO: 144460 - protein, 213 aa, Glycine max
  Coding DNA Sequence Number=SeqID_52775
  Homolog annotation: Hit_ID=Q6WAY6; Match level="QueryCoverage=82%, HitCoverage=36%, E-value=4e-14, Identity=29%"; Hit description =Putative uncharacterized protein
MANQEERVPFMDVLALLIFGVVLFQNMDSLVDLAAIDAFLTYHHSKESPVVAILADLFDTFDRRKSRLDQPLAGIGGRTINWFPRWKEGKEGVLFSCGDYPNILLIGTRGCINYNPALAIRQLGYPMRGAQTEESLSYFLVRDFGAQSFKIIKRVHKAWESPLRKDKELRGIRNDIIGGYHEWLKVCTRGLDWLSKLKIIDEENFEAPEEDEE

SEQ ID NO: 144461 - protein, 64 aa, Glycine max
  Coding DNA Sequence Number=SeqID_52776
  Homolog annotation: Hit_ID=A7PUZ6; Match level="QueryCoverage=70%, HitCoverage=18%, E-value=7e-11, Identity=71%"; Hit description =Chromosome chr4 scaffold_32, whole genome shotgun sequence
MLMLTSLLLLVHRMREKKYFGARMFNLESTRGGSPYCAGVFVGDGTRQASEMELELAEYHGKYI

SEQ ID NO: 144462 - protein, 76 aa, Glycine max
  Coding DNA Sequence Number=SeqID_52777
MAPRKLSAKRSRRDAAAEGTSAAPEFDSHRFRSAEHQQCFEATKGWSFHRERRVQLRDDEYIDFQEEIARQHWTSL

SEQ ID NO: 144463 - protein, 239 aa, Glycine max
  Coding DNA Sequence Number=SeqID_52778
  Gene Ontology: Biological process=transposition, DNA-mediated
  Homolog annotation: Hit_ID=Q6UUU1; Match level="QueryCoverage=25%, HitCoverage=40%, E-value=3e-18, Identity=78%"; Hit description =Putative uncharacterized protein
DLPSQWLLFLSAVPPVQLLTGWCVTAKAPPDISAGKCSGRVPFAIQAAQLLGRAIGAGLFAITPAGERGMCCKAIKLGNARVFPVTTFLELGIIALKSNQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 144464 - protein, 259 aa, Glycine max
  Coding DNA Sequence Number=SeqID_52779
MGTRGCISYNPVLVIKQLGYPMRGAPLEDELAPVISRGFKKTNMETLQKVRKAWEVALRTELEQAQTVKERFKSVALRIRKENAELRDVNVATTKALEQETKRSRREEHGRHKFRGALWDSNSEPRLRREERDQSRVDSLILKDELKACSRSERSLSQRLCETETNMLAIITKYQEELNLAAAHEHRVVDEYARVYAEKEARGREIDSLHQEATMWMDRFALTLNGSCRNLPFGGRATRDSRDACSTKGIRAESPPTFI

SEQ ID NO: 144465 - protein, 110 aa, Glycine max
  Coding DNA Sequence Number=SeqID_52780
MTRGNPSDLQPFDPEIDRTFHRLVRHHFIPFDHSEHSITGEFVHSVIGDFEHPDLEHYNFEHSDSEHSDFAHSENMAQPPPRERTLREMAAPDFTYESLCIQYPDEDVPY

SEQ ID NO: 144466 - protein, 148 aa, Glycine max
  Coding DNA Sequence Number=SeqID_52781
  Homolog annotation: Hit_ID=A7PLS4; Match level="QueryCoverage=47%, HitCoverage=32%, E-value=2e-07, Identity=40%"; Hit description =Chromosome chr14 scaffold_21, whole genome shotgun sequence
MVYPSGTRHESLKHVVKGLNPDECVYGENLVEREIPLMSANRIFYKKVEYVLEDCNEVLVKINKFVVNKEGLVCVETLCMPVTKPERFELDAFELDDPEDAGRYIVRKSIKSAKDIVRFPFQQNATILYLLHTVYRGTENLPLLTVHY

SEQ ID NO: 144467 - protein, 225 aa, Glycine max
  Coding DNA Sequence Number=SeqID_52782
  Homolog annotation: Hit_ID=A0PAV3; Match level="QueryCoverage=28%, HitCoverage=31%, E-value=7e-07, Identity=52%"; Hit description =Restriction endonuclease
  Subcellular localization annotation: CTP_CleavageSite=96; ConfidenceScore=5.15e-01
MVKVGTSYVPINVSFSPKVGPGLPGINRDTRIYLFCEHRRTSALASVAVTLRVTTTPAALNAPLQGASHSPFRLRNCWEGRSGFPSHDVVKRRPVNCNTTHYRANWSSTAVAAALELVDPPGCRNSIQTSVEVTITRRQSCQAIIATGFAVAAPDRTPEILFGLLILSLTFVSTGANQTRLSALRIFVQRMCAFQSLSGIRHRLRIKLIDTVDLEGGPGTSFCSL

SEQ ID NO: 144468 - protein, 112 aa, Glycine max
  Coding DNA Sequence Number=SeqID_52783
MSKSCGFGMTGPLDESISCFLIRGGYTPSPSEDYTSSPLEDYASSPSEDYMFPIFKGGHALTFRGLHVLAIIGLHSLAFERRHVLNFRGLHALAFRGLRVLTFSGLHIHTLR

SEQ ID NO: 144469 - protein, 92 aa, Glycine max
  Coding DNA Sequence Number=SeqID_52784
MVEKEFDAKIKCLRSDNGEQQGEESIESAEIDAEEKNKSKDAYFMRIQDEQKRYLLRTKLLVLYRLTEVAKTEIQLKYYTDDISDALESSSS

SEQ ID NO: 144470 - protein, 125 aa, Glycine max
  Coding DNA Sequence Number=SeqID_52785
  Gene Ontology: Mol. function=transporter activity; Cellular component= membrane; Biological process=oligopeptide transport
  Homolog annotation: Hit_ID=A7Q2Q4; Match level="QueryCoverage=74%, HitCoverage=15%, E-value=1e-20, Identity=45%"; Hit description =Chromosome chr1 scaffold_46, whole genome shotgun sequence
MAFQMFKSIASMKICIRMFTLVGHIQFYNTESLDKMKSIGNSLQYLVVVFSIYVGTLLVNVVHQLTRKHGGIDWLNDDINAGRLDYYYFLMAGLALINLVYILFCVKHYRYKVNVEEKVVEKLEP

SEQ ID NO: 144471 - protein, 127 aa, Glycine max
  Coding DNA Sequence Number=SeqID_52786
MIMRGQDIYSSQDEATTSPSSSESEEAKGEKSSEEIYPQEDGQPLVVKEKCKEVSVSSKRNPLGSVATYPSAGGRRETRGMRVPRKEYERSRHQRLFEENVGKTGKDAIYELLSERFGSCIYARGRY

SEQ ID NO: 144472 - protein, 68 aa, Glycine max
  Coding DNA Sequence Number=SeqID_52787
  Gene Ontology: Cellular component=integral to membrane
  Homolog annotation: Hit_ID=Q3Z572; Match level="QueryCoverage=89%, HitCoverage=13%, E-value=1e-26, Identity=90%"; Hit description =Putative uncharacterized protein yahG
STLEDPRFMGIPTAIDITRVGSSGILPVINTAIAHKDAGIGMIGAGIVHPPFACFEKAILSWCDRYDV

SEQ ID NO: 144473 - protein, 340 aa, Glycine max
  Coding DNA Sequence Number=SeqID_52788
  Gene Ontology: Mol. function=aminoacyl-tRNA ligase activity; Cellular component=cytoplasm; Biological process=tRNA aminoacylation for protein translation
  Homolog annotation: Hit_ID=Q8FAT5; Match level="QueryCoverage=100%, HitCoverage=67%, E-value=1e-172, Identity=89%"; Hit description =Lysyl-tRNA synthetase, heat inducible
  Pfam annotation: Domain name=tRNA-synt_2; Domain location=1-338; Score=388.2; E_value=1.3e-113; Accession=PF00152.11; Description =tRNA synthetases class II (D, K and N)
RYRQRYLDLIANEESRHTFRIRSQILATMRQFMVARGFMEVETPMMQVIPGGASARPFITHHNALDLDMYLRIAPELYLKRLVVGGFERVFEINRNFRNEGISVRHNPEFTMMELYMAYADYKDLIELTESLFRTLAQTVLGKTEVPYGDQVFDFGKPFEKLTMREAIKKHRPETNMADLDNFDAAKALAESIGIQVEKSWGLGRIVTEIFDEVAEAHLIQPTFITEYPAEVSPLARRNDVNPEITDRFEFFIGGREIGNGFSELTMRKIRLSASRIRFNAKAAGDDEAMFFDEDYVTALEHGLPPTAGLGIGIDRMVMLFTNSHTIRDVILFPAMRPVK

SEQ ID NO: 144474 - protein, 153 aa, Glycine max
  Coding DNA Sequence Number=SeqID_52789
MAPTRHPLDPDKSNRALGFPSLITGLCQSFGVPVAPTKAAGAPPPPHQAGQAGSSDMEQYLRHLVRQQAANHWAHVQTHDCLYQMSLSMQSQGFASFSCPTPDQFRAEVAWPRDWPEAQAGEAPPEAPDGGEEAHEDEEMADLLDLLGGSGAT

SEQ ID NO: 144475 - protein, 127 aa, Glycine max
  Coding DNA Sequence Number=SeqID_52790
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=40%, HitCoverage=50%, E-value=4e-24, Identity=100%"; Hit description=LacZ protein
MNPTYLLKEEATGLSQIYSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVR

SEQ ID NO: 144476 - protein, 222 aa, Glycine max
  Coding DNA Sequence Number=SeqID_52791
MDIAGYPHGQVRPRHSPGILCQCLAYTGGRAGYAILGEGSVDSFRCGCPQLVPGIPFSAGGGPGDFAWTTAGRRVQIMRTSMTTLTQIWMTLLLSNIQPCDHNSDLPLPKCRLVYAVLTQMSIHVAQLIADAIYLFAGMAPTRHPLDPDKSNRALGFPALITGLCQSFGVPVAPSKVIRPPITRAFIEKYCTQRQAQSDAPQATGAPPPPHQADPAGSFDTE

SEQ ID NO: 144477 - protein, 122 aa, Glycine max
  Coding DNA Sequence Number=SeqID_52792
  Homolog annotation: Hit_ID=A0PAV3; Match level="QueryCoverage=53%, HitCoverage=31%, E-value=3e-07, Identity=52%"; Hit description =Restriction endonuclease
  Subcellular localization annotation: CTP_CleavageSite=84; ConfidenceScore=5.10e-01
MVKVGTSYVPINVSFSPKVGPGLPGINRDTRIYLFCEHRRTSALASVAVTLRVTTTPAALNAPLQGASHSPFRLRNCWEGRSVRASSLLRQLAKGGCAARRLSWVTPVFSQSRRCKTTASEL

SEQ ID NO: 144478 - protein, 21 aa, Glycine max
  Coding DNA Sequence Number=SeqID_52793
MPVGLHYLDPGITPPRHPVDP

SEQ ID NO: 144479 - protein, 299 aa, Glycine max
  Coding DNA Sequence Number=SeqID_52794
MEENLSPFLVRDFGAQSLEVVQRVHKAWRSPLRKDKELRGIRNGVIGGSHEWLRAHTRGLDWLSKLKFIDEKNFEAPKEDEEVQALKLELGKARLAKEKFKTAATNIRKECTELREENAATARALEQETKRARKEEHGQDKLRGSLWGSNNELKLQREERDKSRVHGMILKDELAACSRSKRSLAQHLEATEQSMLAIIGQYKEELNQSLTHEQKLVEDFAQAYAEKEARGRVIDALHQEATMWMDRFALTLNGSQDLPQLLAKAKAIAEVCIAPEEIHELINYCQHMIDLMAHIIRNC

SEQ ID NO: 144480 - protein, 48 aa, Glycine max
  Coding DNA Sequence Number=SeqID_52795
MFLLINALKGFNDSQGSKSKAAARWIVVKYFTGQRPLEPERMMAIRIQ

SEQ ID NO: 144481 - protein, 134 aa, Glycine max
  Coding DNA Sequence Number=SeqID_52796
  Homolog annotation: Hit_ID=Q5XM22; Match level="QueryCoverage=76%, HitCoverage=57%, E-value=3e-24, Identity=52%"; Hit description =Resistance-like protein HAAS-2
MKLRAGTIQCHGAYVRLSWLQEIYHSKCEAGHWTVVAQVYLLHLLGCILFANKSTTHVHVVFLDAFRDLSQSGSYAWGAAAQLHMYDNLNDACKSYNRQLAGYITLLKIMMKGHHVPTAGHLRRHYQHRHIGSI

SEQ ID NO: 144482 - protein, 157 aa, Glycine max
  Coding DNA Sequence Number=SeqID_52797
QQKLYTDNHSGISGRQRDSKVSMIDLVSAEDDVEEDDVSLCVLSGFSSYRMQNVYTDNHSGISGRQRDSKSGAEDDVSLCVLSGFSSYRQQKVYTDNHSGISGRQRDSKVSMTDLVSAEDDDFRHTECKKFIRITTRVFPAVSVTQSQYDRSCERGG

SEQ ID NO: 144483 - protein, 205 aa, Glycine max
  Coding DNA Sequence Number=SeqID_52798
MTTLTQIWMTLLLSNILPIDHNSDLPLPKCQLVYAILTRMSIHVAQLIADAIYIFAGMAPTRHPLDPDKSNRALGFPALITGLCQSFGVPVAPTKVIRLPITRAFIEKYCTQRQAQGNAPQAAGAPSSPHQAGPAGSFDMKQYLRHLVRQQAANHRAHVQTHDCLYQMSLSMQSQGFASFSCPTPDQFRAEVAWAGDWPEAQAGE

SEQ ID NO: 144484 - protein, 73 aa, Glycine max
  Coding DNA Sequence Number=SeqID_52799
MGSYDGHSSTGEGATTVWVHSEHPSAAVSASLSYDDINDRWMHFSDHVVAAGDQPIHAPAPDHEDYMQADIPE

SEQ ID NO: 144485 - protein, 90 aa, Glycine max
  Coding DNA Sequence Number=SeqID_52800
MQDKIDCNNINEIREERNANSIYTGSATSRAYAQSSSNPLEIFHYLCKSFTDFEHTLGSLTLVFKDSPRGNPSLDYNSHYPRDNQSLDYN

SEQ ID NO: 144486 - protein, 15 aa, Glycine max
  Coding DNA Sequence Number=SeqID_52801
MSYRMSQHHASEHAA

SEQ ID NO: 144487 - protein, 292 aa, Glycine max
  Coding DNA Sequence Number=SeqID_52802
  Homolog annotation: Hit_ID=Q2HW90; Match level="QueryCoverage=90%, HitCoverage=61%, E-value=1e-28, Identity=32%"; Hit description =Putative uncharacterized protein
MGSSQKPSLKKRFYQVKIKSLEVTSLRKLGQLMGQLQRQAFRKAYGKIWDLARVEVSMEPIASLSQYYDQPLRCFTFEDFQLVPTVKEFEEILGCPLGRRKPYLFSGFYPSTTRVAKYQGSVWRKGQRPWQIKANGLSFIDILALLIFGVVLFPNMEGLVDLAAIDTFLAFHHGKESPVVAILAMYDTFDRGCEKSSARIVCCALALYVWLVSHLFSKKGHLLIGSLARRKEESGLYLHAKDVPNVPWMGTWGCINYNPVLAIRQLGFPIRGATLDESITPFITRGFSDPNA

SEQ ID NO: 144488 - protein, 112 aa, Glycine max
  Coding DNA Sequence Number=SeqID_52803
  Subcellular localization annotation: CTP_CleavageSite=50; ConfidenceScore=5.30e-01
MWLHQGISKRSLSLTANNFVVVNILSLSWFRVGGLRFMVGGLGFSDVAPCGASEWRRKRERRCHFKEKMSLEEAHHYKRPWIRAWRKKEMNEGRGREEHEILCSKSALKSEV

SEQ ID NO: 144489 - protein, 97 aa, Glycine max
  Coding DNA Sequence Number=SeqID_52804
MNAYCAIKILMFPTNANANVLKNITDLLIIRLRDAETLATVCYFRWTFILYVQGEVVIKHPKHGSIPHNLQQLKKRLWDGQCHHIQGIIDVMIQPIW

SEQ ID NO: 144490 - protein, 104 aa, Glycine max
  Coding DNA Sequence Number=SeqID_52805
MEALLYVFCMHAAPKPPEPLASLVSMNKSPFPLAIYACIGNRQRSGRAVQVQGQQSKSSSILAVCVSQESPVWLAGCALFFTWFRSLCVVSLLFMLRDFCVWFS

SEQ ID NO: 144491 - protein, 80 aa, Glycine max
  Coding DNA Sequence Number=SeqID_52806
MMVAWVMLGHGYELGMGLGKNNGGSTGLVRVRGNHEKFGSDDESREGTNTGDPTVDFEQEVSRTEDEKDEDIRLPPELKG

SEQ ID NO: 144492 - protein, 155 aa, Glycine max
  Coding DNA Sequence Number=SeqID_52807
ELEQENETLKGKIAQQSREFFIQNQRMIEKDDLLRRKDALLHRDARRKRRFMDLFSRAHSDSEDPSTPGVDDHDECTPVSPELSSCRRYCRAALGEHNPAIYSDFSTPLFASKPAVSEVPPPFAQQSAPVPQPNTSFPQAAMTYSAPLIHTINRG

SEQ ID NO: 144493 - protein, 121 aa, Glycine max
  Coding DNA Sequence Number=SeqID_52808
  Homolog annotation: Hit_ID=A5B0V4; Match level="QueryCoverage=80%, HitCoverage=5%, E-value=1e-07, Identity=37%"; Hit description =Putative uncharacterized protein
IPDLDKVEQEIELATTAMVLHSPLEKALINHVECLTKEEEHEVQTCIKELDGAGENSEGQTTFEELKNGGKIEKPTVELKTLPVHLKHKAAIGWHISDLKGISPSYCMHKINMEADYKLVR

SEQ ID NO: 144494 - protein, 93 aa, Glycine max
  Coding DNA Sequence Number=SeqID_52809
MLDQFHLCIHDSIENNIDVKADGNCAYRAIAALLGMGEESWSLVTMDKWMKITDMGYVIASRYNVIIVSLSRQQSMTFFLLEVSCHHILLCIV

SEQ ID NO: 144495 - protein, 88 aa, Glycine max
  Coding DNA Sequence Number=SeqID_52810
MWNFEASMFVYEEGKYEKSRNADGTITNKGIIIDGRYIELYDSQLKKIQEAHLNIEWSKMELSYVGTGIDVSKAGSYNFVSNCMLENE

SEQ ID NO: 144496 - protein, 183 aa, Glycine max
  Coding DNA Sequence Number=SeqID_52811
  Homolog annotation: Hit_ID=Q6WAY4; Match level="QueryCoverage=89%, HitCoverage=29%, E-value=5e-20, Identity=36%"; Hit description =Putative uncharacterized protein
MGTNQTGKRFYQVKIKGLDITSIKELGRLMGPLQMQAFRKVYGKILDLTIAEISMEVVVSLTQYYDQPLRCFTFGDFQLVPTVEEFEEILGCPLGGRKPYLFSWFLPSLSKIAVVVRDSARELDRVKQTRNGVVGLPRNYLEGQARDMVNQEEWVPFMDVLALLIFGVVLFPNMDGLVDLAAN

SEQ ID NO: 144497 - protein, 191 aa, Glycine max
  Coding DNA Sequence Number=SeqID_52812
MLQKLLLQSAPRLDKERAIDGFVGHLHAPLLWVGPFEPTGDLLRRPSMLQFASHDLRQGWIARQLARLGAVRTLPGCFIGARSPVATLATVAVKLTADSGCSSPQARGNAVDGFARSQCPRDLLALSETCRSGAGYRPCSSDPTSSPSVLRCSRSEVVASWPALLAPGAVIVLHRPVEFTAGSGPSQSCGG

SEQ ID NO: 144498 - protein, 107 aa, Glycine max
  Coding DNA Sequence Number=SeqID_52813
  Subcellular localization annotation: CTP_CleavageSite=36; ConfidenceScore=5.56e-01
MKVRTCSPLKMRMFGPLKVRACCPLKVRTCSPQKVRACSPLKARTCSPLKVRACSPLMGRTCSPLKVIGTSTQGYPYEKARDRLMERAGHPKFKILDIRCRKSMQLT

SEQ ID NO: 144499 - protein, 99 aa, Glycine max
  Coding DNA Sequence Number=SeqID_52814
  Homolog annotation: Hit_ID=A4EB57; Match level="QueryCoverage=55%, HitCoverage=34%, E-value=4e-16, Identity=70%"; Hit description =Putative uncharacterized protein
MWFNSMQSEEPYQGLTCRESSEREGCLRERGHRWCMAVVSSCLWNPEQTAGDKPEEGEDDVKSSCPLCPGRHTCYNGRDKGSRSREGELTPKTRPQFGL

SEQ ID NO: 144500 - protein, 192 aa, Glycine max
  Coding DNA Sequence Number=SeqID_52815
MVLENKLKACQRAKRSLMEQLRRTEENMLTIIHQYKKKVNLAASHRQRLEDEHAKVSALHIEREVRDRVIESLHGEAMKWMDRFTPTLNGSQELPRLLARAKAMVDTYSTPDEVHGLFDYYQHMNERALRHPYQTRARARIMSEVEEVQEQMKADMEAMEDQIATMMEAMLSMKKIMESNVVAVVTTSAAVE

SEQ ID NO: 144501 - protein, 180 aa, Glycine max
  Coding DNA Sequence Number=SeqID_52816
GEDEGEAHVVTAIPIWPSFPPTRQCHYLANNDPSPYPPPSYPQRPSLNQTTLPMLNTTFSANQNTNQEMNFAVKEPLEFTPISVSCADLLPYLLDNSMVAITPTKVHQPPFLREYDSNATCACHGEAPGRSIEHCRAPKHKVQGLIDAGWLKFEKNRVWVPTLTSDTTHGAILKAAVRCL

SEQ ID NO: 144502 - protein, 116 aa, Glycine max
  Coding DNA Sequence Number=SeqID_52817
MVLGTSRPFILVEVRYFEFRRDNNIGYQAEIRHVRERIVTKSFHGPQSLLKEIEFPPFFSCRGRSFHGQNYWLCRGVALRQRVGCRPLGDRGIELDIPSGIVLRIFDAILPRKGIG

SEQ ID NO: 144503 - protein, 83 aa, Glycine max
  Coding DNA Sequence Number=SeqID_52818
SLPDDADISRKGADEHIGLCLSIGLGTLGSLDNKGCLRVTIGCLRMPPDSWVMVTKGGVVNKSRAFAPMYPQFVMRNSDLRSS

SEQ ID NO: 144504 - protein, 147 aa, Glycine max
  Coding DNA Sequence Number=SeqID_52819
  Subcellular localization annotation: CTP_CleavageSite=40; ConfidenceScore=5.00e-01
MTLLLSNILPSDRNANLPLQKYQLVCVVPTWGSHPQRHPVDLKKSNRALRFPALVTGLCRPYRAPVPPSKFMSSWHRDRARKTLWTREKSNGVLGLPALITGLCRFYGVPVAPSKVIRPPINQAFIKKYCAPRQAQGETPQQHWDGR

SEQ ID NO: 144505 - protein, 303 aa, Glycine max
  Coding DNA Sequence Number=SeqID_52820
  Homolog annotation: Hit_ID=Q6WAY6; Match level="QueryCoverage=96%, HitCoverage=49%, E-value=4e-38, Identity=35%"; Hit description =Putative uncharacterized protein
MGQLERQAFRKAYGKIWDLAMVEVSTEAIASLAQYYDQPLRCFTFEDFQLSPMVEEFEEILGCSLGGRRPYLFSGFYPSLARISKIVQILAQELDHRKQVENGVVGIPRKCLEVKARILAGRGEWAPFIDILALLIFEGVLFQNVDGFVDLAAIDAFLAYHNHKESPVVAMLADLYDTFDRRCEKNNTRIVCCTPALYVWLVSRLFCPEVRHACPLESHHSCIEKGRANWDQLLASKEGASVNCFPRWKEGRTEVLISCGGFPNVPLMGTRGCISYNPVLAIRQLGYPMRGTPLEEEIVPVIS

SEQ ID NO: 144506 - protein, 87 aa, Glycine max
  Coding DNA Sequence Number=SeqID_52821
  Homolog annotation: Hit_ID=A5BI38; Match level="QueryCoverage=73%, HitCoverage=6%, E-value=4e-19, Identity=68%"; Hit description =Putative uncharacterized protein
MTLFFMVYPQEWRASQTVSFSNIQCDVPKFKGDNYKIWKERILLQLGWMDIDYAIRKDKSPAITDESSPTDVALYERWEPMAQRDVH

SEQ ID NO: 144507 - protein, 120 aa, Glycine max
  Coding DNA Sequence Number=SeqID_52822
MIENPLNQEIAPKKLPAKRSRKDAVGEGSSLAPQVDVEFDGHRFRSEEHQRSFEAIKGWSFLKERRVQLRDGEYVEFQEEITRRQWAQLVSTMAKYDPEIVMEFHANAWPTEEGVRDKCS

SEQ ID NO: 144508 - protein, 305 aa, Glycine max
  Coding DNA Sequence Number=SeqID_52823
ECPPPPLLLAIAATDLLKHPTAPIHPSLSSPRSSTLFSLDDQCLRYNSQFSSRIILDPKYRDTDFFNDETFDYYQVFQNSGLVHGISMIIDQSLFLSLTKLLSQGAPFEGTIVDDWKFDYSSHDACRMVCNDQAEMTAFEEDLILMWAFLTGRQIDSAHLVRYRMHKALRANEPLPYPQLVTLFLCHFQIPLYDEPFVQVKRSFAIGAGVVTSFGYHKDRDGQWLKKDALPQQDEHTPSPPPQRDDSSALMNEVLSELRGLCTYVGERFDSLDGRFEGMDTCITQLEEDVTYLRRCFDLPPPSKS

SEQ ID NO: 144509 - protein, 255 aa, Glycine max
  Coding DNA Sequence Number=SeqID_52824
  Gene Ontology: Mol. function=phosphatidylglycerol-prolipoprotein diacylglyceryl transferase activity; Cellular component=integral to membrane; Biological process=lipoprotein biosynthetic process
  Homolog annotation: Hit_ID=A9I4M7; Match level="QueryCoverage=34%, HitCoverage=27%, E-value=3e-41, Identity=92%"; Hit description =Prolipoprotein diacylglyceryl transferase
  Pfam annotation: Domain name=LGT; Domain location=1-131; Score=-39.7; E_value=3.2e-06; Accession=PF01790.9; Description=Prolipoprotein diacylglyceryl transferase
MSFHGGLIGVIVVMLLFARKKGLPFFAVSDFIAPLIPLGLGFGRLGNFINGELWGRPTDVPWAMVFPSSGDGIARHPSQLYELGLEGIQAAPAGAGERGLPDGLRNVPFPGGVHPRAGQLPGPARGRTEHGTVAVPADGRPGRHHVRAYCKTIVPLTATLTAVARKAEGVGGSQRAILEGLRGFLEQLAFLGLAHGARQREADVGNGGLVGQLGRERGGGREILGFEDDLALAAPGGAGLAFAAAGGIGPDVEAA

SEQ ID NO: 144510 - protein, 114 aa, Glycine max
  Coding DNA Sequence Number=SeqID_52825
MPISPCESISWDHTHKTLSGPREVQQGPGVSSSGYGPLSVLPGARSPQQGIAPTRHPVDPEEFNRARGFPTLIMGLCQFYGEPVAPNKVIRPPINRAFIKKYYAPRQAQGEASQ

SEQ ID NO: 144511 - protein, 300 aa, Glycine max
  Coding DNA Sequence Number=SeqID_52826
  Gene Ontology: Biological process=transposition, DNA-mediated
  Homolog annotation: Hit_ID=Q6UUU1; Match level="QueryCoverage=20%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPVTTLANWSSTAVAAALELVDPPGCRNSMIIMEHVDHVVEEDQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 144512 - protein, 109 aa, Glycine max
  Coding DNA Sequence Number=SeqID_52827
  Subcellular localization annotation: CTP_CleavageSite=63; ConfidenceScore=5.05e-01
MCKCRSHGTFPLFGLQSSHLNIATTTKICTDDRSARARALGFAATAAPSYSSGLGPCPDGRVSAQLGTVTQLPVHPASPVLLTKNGPLGALDSMARLNRAAAPSYLFKV

SEQ ID NO: 144513 - protein, 111 aa, Glycine max
  Coding DNA Sequence Number=SeqID_52828
  Subcellular localization annotation: CTP_CleavageSite=47; ConfidenceScore=5.08e-01
MKKRETPKVHTCTFEKQTHLAKSSWKMPKHLTLVSHANSLRLLSNPRVALLRKFCQDQPLPSSFSGVNRPLASLYDLKSRKFQLVIHQSVTIHCHPSNGACDRSRAISLDL

SEQ ID NO: 144514 - protein, 73 aa, Glycine max
  Coding DNA Sequence Number=SeqID_52829
  Subcellular localization annotation: CTP_CleavageSite=15; ConfidenceScore=5.07e-01
MARACSPLKVRTRSPLMARTCSPLKVRTCSPLKVRTHSPLKIDCPFEKGDNSCNLILSFCKSLRELPQSVCSF

SEQ ID NO: 144515 - protein, 83 aa, Glycine max
  Coding DNA Sequence Number=SeqID_52830
  Subcellular localization annotation: CTP_CleavageSite=35; ConfidenceScore=5.35e-01
MENTRTALSNNIHVAPKNALSVATYPSAGGRRVTRGMRVPRKEYARSRHQRLFEENVGKTGKDAIYELLSERFGSCIYARGRY

SEQ ID NO: 144516 - protein, 141 aa, Glycine max
  Coding DNA Sequence Number=SeqID_52831
  Gene Ontology: Biological process=transposition, DNA-mediated
  Homolog annotation: Hit_ID=Q1J7G7; Match level="QueryCoverage=27%, HitCoverage=55%, E-value=9e-14, Identity=92%"; Hit description =Transposase
MVKVGTSYVPINVSSSPKVGPGLPVYDGVFEVLQWLPFLSAVPPVQLPTGWCVTAKAPPDISAGKAEVTLRVTTTPAAINAPLQGAFHSPFRPGNCWEGRSVRASSLLRQLAKGGCAARRLSWVTPGFSQSRRCKTTASEL

SEQ ID NO: 144517 - protein, 172 aa, Glycine max
  Coding DNA Sequence Number=SeqID_52832
  Gene Ontology: Mol. function=gamma-glutamyltransferase activity; Cellular component=periplasmic space; Biological process=glutathione biosynthetic process
  Homolog annotation: Hit_ID=P18956; Match level="QueryCoverage=72%, HitCoverage=21%, E-value=3e-64, Identity=96%"; Hit description=Gamma- glutamyltranspeptidase precursor (EC 2.3.2.2) [Contains: Gamma- ...
  Homolog annotation: Hit description=glutamyltranspeptidase large chain; Gamma-glutamyltranspeptidase small chain]
  Pfam annotation: Domain name=G_glu_transpept; Domain location=1-172; Score=-260.9; E_value=0.00024; Accession=PF01019.12; Description =Gamma-glutamyltranspeptidase
MPPPSSGGIHIVQILNILENFDMHKFGFGSADAMQIMAEAEKRAYADRSEYLGDPDFVKVPWQALTNKAYAKSIADQIDINKAKPSSEIRPGKLAPYESNQTTHFSVVDKDGNAVAVTYTLNTTFDLAGDGQSGRQPDYHHRTADGGEQYRLWDERRGSDQCATFPSPVAAG

SEQ ID NO: 144518 - protein, 252 aa, Glycine max
  Coding DNA Sequence Number=SeqID_52833
  Subcellular localization annotation: CTP_CleavageSite=52; ConfidenceScore=5.12e-01
MAPRKLASRGPGRTRRPKELVPLLSMTVTALGALYTSSTSRPSRDGHFSGSDASRRWASLVTPMAKFDPDIVLEFYANAWPTEEGVRDMRSWVRGQWIPFDADAIGQLLGYPLVLEEGQECEYGQRRNRSDGFDEEAIAQLLCIPGQDFARTAAGRRVRIMRTNMTTLTQIWMTLLLSNILPTDHNSDLPLLKCQLVYAILTRMSIHVAQLIADAIYIFASMAPTRHPLDPDKSNRALGFPALITGLCQSFG

SEQ ID NO: 144519 - protein, 72 aa, Glycine max
  Coding DNA Sequence Number=SeqID_52834
MPIGWTSQKSGADIEKEELTNLRSNPLQGEGNDAILPRKGPVTRAMSKRLQEDWARAAEEGPRILMNLRVDF

SEQ ID NO: 144520 - protein, 42 aa, Glycine max
  Coding DNA Sequence Number=SeqID_52835
MLVKNLVGHPGVQDKTDHTLVSQVTLTRLKGTLKPGIFTPKD

SEQ ID NO: 144521 - protein, 29 aa, Glycine max
  Coding DNA Sequence Number=SeqID_52836
MALTNVDRKTLVDVDSLAEVGWKNLADVS

SEQ ID NO: 144522 - protein, 124 aa, Glycine max
  Coding DNA Sequence Number=SeqID_52837
MEFDNHRFWSAEHQQRFEAIKGWSFHRERQFQLREDEYPNFQEEIAHRHWKRLVTPMAKFDPEIGVQDMRSCVRGHWIPFDADALSQFLGFRPNRCAEVGADHAHQHNYPNPDMDDTGAQQRLA

SEQ ID NO: 144523 - protein, 257 aa, Glycine max
  Coding DNA Sequence Number=SeqID_52838
PRIQWQYLGVAVLSPFQRLVRIADLALARQEDQHVAACIQAGNLVDSRHDGIVDGTFALVFTLAFQRAVAHLHRVGAALNADHRRIVEMLGEASGVDGGRSDDQLQVGALAQQLLQVAQQEVDVEAALVRLVDDDRVVVRQPTVAGDLRQQDAVGHELDAAVFADLVVEAHLVADQLAQFALQFLRHAAGHRTCGNPSRLGAADHAGLATACGQAQFRQLGGLARTGFTGDHHDLVVADQPDDRRRLHAQSAAAGPE

SEQ ID NO: 144524 - protein, 123 aa, Glycine max
  Coding DNA Sequence Number=SeqID_52839
MPPTRHPLDPDKSNRALGFPALITGLCQSFGVPATASKAANHRGQVQTHECLYQLSLSLQSQGFAPFACPTSDQFRAEVAWPGDWPEAQAGEAPVEAPGDAEEVCMDEEMSDLLGFLGGSGAT

SEQ ID NO: 144525 - protein, 121 aa, Glycine max
  Coding DNA Sequence Number=SeqID_52840
  Pfam annotation: Domain name=G-patch; Domain location=1-42; Score =24.2; E_value=0.00022; Accession=PF01585.14; Description=G-patch domain
MVARVMLKHGYEPGMGLGKDDLGNADVVDIRGNPYKYGLGYEPGMPGRRNAPSRFWADRAWPGHVSQCFTSAGIMFEEEVAAIGEEFPQDPPNFVRPCHPDSQVGNWRVISQSEVYTADSM

SEQ ID NO: 144526 - protein, 52 aa, Glycine max
  Coding DNA Sequence Number=SeqID_52841
MEDWGNFLHQILEEDSEDSTPIKVFLLVWGFGSKQRRLAAAIDGLGWWRNLA

SEQ ID NO: 144527 - protein, 339 aa, Glycine max
  Coding DNA Sequence Number=SeqID_52842
  Gene Ontology: Mol. function=signal transducer activity; Cellular component=membrane; Biological process=signal transduction
  Homolog annotation: Hit_ID=Q6D251; Match level="QueryCoverage=59%, HitCoverage=36%, E-value=3e-46, Identity=45%"; Hit description =Methyl-accepting chemotaxis protein
  Pfam annotation: Domain name=HTH_AraC; Domain location=29-74; Score =10.3; E_value=0.19; Accession=PF00165.14; Description=Bacterial regulatory helix-turn-helix proteins, araC family
  Pfam annotation: Domain name=HTH_AraC; Domain location=80-124; Score =41.6; E_value=2.7e-09; Accession=PF00165.14; Description=Bacterial regulatory helix-turn-helix proteins, araC family
  Pfam module annotation: Pfam domain module=HTH_AraC::HTH_AraC; Domain location=29-74::80-124
MSLADNPVLHTHLPGSPGMGKSSTPFLVRAQEIIRLENPAINAAQLAAALNVTGRTLQRRMKALSQETPKEFITRIRIELACTILASTDVSVRQTAMQCGYSEDTAFRKAFHQVMAMTPAQYREWIAHRKAQMMNITQRLTLAFILLSASLVVTGIISVRLLGGFQDRFEYVQANAIPSIRDLSELIDRSNKLSLSLYKHQSQTDNARMPPVEKEIAQRLADIKTLAEYYLANDISSDEDKQITIKGLATLRLVESRLPAFLAASHAHQDDVTLGMLEAESGIGGAISQLKNDYRQQMALNLSLGDGLRVVNQEIYHRTFWGLSAGVAVTLLLLVRSPR

SEQ ID NO: 144528 - protein, 319 aa, Glycine max
  Coding DNA Sequence Number=SeqID_52843
  Gene Ontology: Mol. function=acetolactate synthase activity; Cellular component=plasma membrane; Biological process=acetoin biosynthetic process
  Homolog annotation: Hit_ID=P27696; Match level="QueryCoverage=89%, HitCoverage=50%, E-value=1e-123, Identity=77%"; Hit description =Acetolactate synthase, catabolic
  Pfam annotation: Domain name=TPP_enzyme_C; Domain location=153-299; Score=181.0; E_value=3e-51; Accession=PF02775.12; Description =Thiamine pyrophosphate enzyme, C-termina
  Pfam annotation: Domain name=TPP_enzyme_M; Domain location=4-91; Score=12.6; E_value=1.6e-05; Accession=PF00205.13; Description =Thiamine pyrophosphate enzyme, centra
  Pfam module annotation: Pfam domain module=TPP_enzyme_C::TPP_enzyme _M; Domain location=153-299::4-91
TYQGGGRGAAGALLTLCRAGWPVNNQAGDRLLQQADLIITIGYSPVEYEPAMWNSSNALLVHIDVLPAETDNHYQPDAELVGDIAGTVRKIAAQITSPLQLSDAAATILQDRQQQRQLLAMQGASLDQFALHPLRIVRAMQDIINSDVSLTVDMGSFHIWIARYLYSFRARQIMISNGQQTMGVALPWAIGAWLVDPSRKVVSVSGDGGFLQSSMELETAVRLKANILHIIWVDNGYNMVAIQEEKKYQRVSGVNFGPVDFKAYAQAFGAAGFSVNSAAELEPTLRRAIEVEGPAVVAIPVDYSDNPLLMGQLHLSQLL

SEQ ID NO: 144529 - protein, 212 aa, Glycine max
  Coding DNA Sequence Number=SeqID_52844
  Gene Ontology: Mol. function=two-component sensor activity; Cellular component=membrane; Biological process=two-component signal transduction system (phosphorelay)
  Homolog annotation: Hit_ID=A7YIW0; Match level="QueryCoverage=49%, HitCoverage=17%, E-value=5e-38, Identity=76%"; Hit description =Limonene hydroxylase CD6-1
  Pfam annotation: Domain name=EAL; Domain location=4-171; Score=-22.0; E_value=4e-09; Accession=PF00563.11; Description=EAL domain
SGPVAGVPAEDLPEQWPARWPGGTGALAASAARRTRSRSVYPAGGTDRAAQCFNQLGDRQGDWQTEQIINSPAALQGLEMLKLRGFGISLDDFGTGYSNIGYLRRMPLDVIKLDRALISEIASDTASRIIARSIITMLKQLDYTVLAEGVENVDTVAALAEYGCDQAQARGTKLRYGSVYAGERLEQIQWQYDESVGLKQNDTLKVKQKYPA

SEQ ID NO: 144530 - protein, 800 aa, Glycine max
  Coding DNA Sequence Number=SeqID_52845
  Gene Ontology: Mol. function=transferase activity, transferring glycosyl groups; Cellular component=intracellular; Biological process=carbohydrate metabolic process
  Homolog annotation: Hit_ID=A7ME77; Match level="QueryCoverage=100%, HitCoverage=100%, E-value=0.0, Identity=67%"; Hit description =Phosphorylase
  Pfam annotation: Domain name=Phosphorylase; Domain location=91-800; Score=1476.3; E_value=0; Accession=PF00343.11; Description =Carbohydrate phosphorylase
MALPTFDPDRFSAALVRQWQRFGLPDAQEMSPDQWWHALSGALAELLADIPVQPAAGGQRHVNYLSMEFLLGRLTGNNLLNLGWYDGVKATLAAAGVTLSDVLERETDPALGNGGLGRLAACFLDAMATTGQPAIGYGLNYQYGLFRQHFVGGAQHEQPDDWQRDRYPWFRHNAALDVQVGLGGSVTSIDGVTHWQPAFVVQGEAWDLPVVGFRNGITQPLRLWQAKHARPFDLQRFNNGDFLRAEQQGIEAEKLTKVLYPNDNHQAGKKLRLMQQYFQCACTLADILRRHQAAGRAIETLADYEVIQLNDTHPTLAIPELLRLLLDEHRLSWQDAWRITQRTFAYTNHTLMPEALECWNLRLVRSLLPRHLLIINTLNAQLKQQVEARWPGNQAIWSKLALVHDQQLRMANLCVVGSFAVNGVAVLHSRLVVQDLFPEYHALWPEKFHNVTNGITPRRWINQCNPALAALINKTLQRPWLNDLDALQDLTPFADDAAFRAEYRAIKQHNKQALTEWIASRTGIAVQPDALFDVQIKRLHEYKRQHLMLLHMIALWQTLVSDPQANLAPRVMLFGAKAAPGYALAKNIIYAINKVAETINHDARVGDRLKIVFIPDYNVSVAEHLIPAADLSEQISTAGKEASGTGNMKLALNGALTIGTLDGANVEIAQQVGEENIFIFGHTVEQVSALKQAGYSPLNWRSKDAQLDRALTALEDGTFSNGDRTAFSDLVNSLGAQGGDPYLVLADFRHYLNAQQQVEALWADPEAWTRAAILNTARCGMFSADRAIRDYQQRIWQASR

SEQ ID NO: 144531 - protein, 305 aa, Glycine max
  Coding DNA Sequence Number=SeqID_52846
  Gene Ontology: Mol. function=sugar:hydrogen symporter activity; Cellular component=periplasmic space; Biological process =carbohydrate transport
  Homolog annotation: Hit_ID=P03841; Match level="QueryCoverage=75%, HitCoverage=75%, E-value=2e-73, Identity=61%"; Hit description =Maltose operon periplasmic protein precursor
  Pfam annotation: Domain name=MalM; Domain location=13-305; Score =332.1; E_value=1e-96; Accession=PF07148.3; Description=Maltose operon periplasmic protein prec
MSGPFGAQKEILVRAADRRHCASPGRHQSGAAESFRGAVHSHRAAAAAQLAAGGCNACTNHHADTKRNAAGCTWRNTGAIAAYSLPANQGELKVTLSSEVVHNQVFAPNVLVLDENLQPAAWFPSRFFSYQQPGVMSADRLEGVMKLTPVPGQQKIYLLVFTTDQDLTQTTTLLDPAKAYAKGTGHAVPDIPDPVARHSRDGKIKLKVATSSGSSILVGPLFGSAAPAAVTVGSTRPAMAATTARAPAPEPAPLVNETESYFNQSIRQAVQQGNIDKALKLLDEAERLGSTSARQTFISSVKGKG

SEQ ID NO: 144532 - protein, 380 aa, Glycine max
  Coding DNA Sequence Number=SeqID_52847
  Gene Ontology: Mol. function=sugar:hydrogen symporter activity; Cellular component=integral to membrane; Biological process =carbohydrate transport
  Homolog annotation: Hit_ID=Q8FB38; Match level="QueryCoverage=75%, HitCoverage=55%, E-value=1e-124, Identity=75%"; Hit description =Maltose transport system permease protein malF
  Pfam annotation: Domain name=BPD_transp_1; Domain location=84-313; Score=45.0; E_value=2.6e-10; Accession=PF00528.13; Description =Binding-protein-dependent transport s
MSSLRQFSGTRPLYVLDAPGQLRNQQNGARYQANRDTGFYQQINADGSWASEQLSPGFTVGAGWKNFARVFTDEGIQKPFLAIFGWTLLFSLLTVLLTVAVGMVLACLVQWEALRGKAIYRVMLILPYAVPAFISILIFKGLFNQSFGEINVMLNALLGFKPAWFSDPTLARAMLVIVNTWLGYPYMMILCMGLLKAIPDDLYEASAMDGAGPLQNFFLITLPLLLKPLLPLMIASFAFNFNNFVLVQLLTNGGPDRLGTTTPAGYTDLLVNYTWRIAFEGGGGQDFGLAAAIATLIFLLVEAASAADASAAAAVYRGNSVPAADGDCHLATQRQFRHRQSDPGTDFMGTLAAGARVQRHPCRWSRDAAALPGAAMAVGF

SEQ ID NO: 144533 - protein, 159 aa, Glycine max
  Coding DNA Sequence Number=SeqID_52848
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=32%, HitCoverage=50%, E-value=5e-24, Identity=100%"; Hit description=LacZ protein
  Subcellular localization annotation: CTP_CleavageSite=30; ConfidenceScore=5.55e-01
MQCGDMNPSPMPSHASFLFQKTRENSGLLSSSYLGSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 144534 - protein, 73 aa, Glycine max
  Coding DNA Sequence Number=SeqID_52849
  Subcellular localization annotation: CTP_CleavageSite=49; ConfidenceScore=5.50e-01
MGVQIAPRPTWALQNIPPEGCCFWRKQPGSPGKSKPRRFRNVSVTFSVRNFAKVLTVLRRSSFVLHRSSIFNG

SEQ ID NO: 144535 - protein, 79 aa, Glycine max
  Coding DNA Sequence Number=SeqID_52850
  Subcellular localization annotation: CTP_CleavageSite=60; ConfidenceScore=5.43e-01
MTATTLWRSCLWRSPYPLRSKKSRKGKSPGKGTPWACFSFCMSSCLSQIGLRFRHCNHIVEFAFVEFVSALPSKLGTKG

SEQ ID NO: 144536 - protein, 155 aa, Glycine max
  Coding DNA Sequence Number=SeqID_52851
  Homolog annotation: Hit_ID=Q2HTA0; Match level="QueryCoverage=79%, HitCoverage=19%, E-value=1e-17, Identity=41%"; Hit description=IMP dehydrogenase/GMP reductase, related
  Pfam annotation: Domain name=DUF1723; Domain location=97-146; Score =57.9; E_value=3.4e-14; Accession=PF08330.1; Description=Protein of unknown function (DUF1723)
MAPADSKDIVADIPADTGAEAAEAEHEGFPGGPSDPSVLTQYADHVACSVWTREECPELKLSSHGRKVHSLGRSVLAIEGLVVGTELSPLIMCSVDTGDRGLLSSFVERWHRETSSFHLPVGELTITLDDVSSLLHLPVVGDLHAFQPLHVDDTV

SEQ ID NO: 144537 - protein, 76 aa, Glycine max
  Coding DNA Sequence Number=SeqID_52852
MSKNGWKSSRNYSRKRYESASAWTFFTETIFLSNFERIRSAKKAEPQLSQASKVASWRMKLESPSGPDCYLYPPFY

SEQ ID NO: 144538 - protein, 274 aa, Glycine max
  Coding DNA Sequence Number=SeqID_52853
  Homolog annotation: Hit_ID=Q6WAY4; Match level="QueryCoverage=79%, HitCoverage=39%, E-value=2e-19, Identity=31%"; Hit description =Putative uncharacterized protein
MGSSQKPSFKKRFYQVKIKSLEVTSLRELGQLMGQLQRQAFRKAYGKIWDLARVEVSTESIASLAQYYDHPLRCFTFGDFQLSPMVEEFEEILGCPLGGRKPYLFSGFYPSLARISKIFQILAKELDHQKQVENGVVGIPRKCLEAKARILAGRNEWAPFIDVLALLIFGGVLFSNVDGLVDLAAIDAFLAFITRKARSSPLHVADLYDTFDRGCEKSSARICLLCTGSLCVAGFTPFFSKKVGPSIRYKVTARASKRERVIDSLHQEATMWMD

SEQ ID NO: 144539 - protein, 88 aa, Glycine max
  Coding DNA Sequence Number=SeqID_52854
  Subcellular localization annotation: CTP_CleavageSite=51; ConfidenceScore=5.13e-01
LTKARNQSWKPQGPVGLLRSLGRMLLSSNIIHICVRVVMLVRMIRTRLFAVAQVKSCPGMHSSCVIASLSGGARTVDPLPGSGGGPRN

SEQ ID NO: 144540 - protein, 45 aa, Glycine max
  Coding DNA Sequence Number=SeqID_52855
  Homolog annotation: Hit_ID=UPI00005F8F73; Match level="QueryCoverage =100%, HitCoverage=36%, E-value=2e-11, Identity=64%"; Hit description= COG3784: Uncharacterized protein conserved in bacteria
  Pfam annotation: Domain name=DUF1318; Domain location=1-45; Score= -1.2; E_value=0.00095; Accession=PF07027.3; Description=Protein of unknown function (DUF1318)
QQYQRVAQQNNLTTAEVARIAGEKLVNRAGSGEYVRGINGQWVQK

SEQ ID NO: 144541 - protein, 81 aa, Glycine max
  Coding DNA Sequence Number=SeqID_52856
MEEDSLHVPVMERSCTTDGDILHLVRDAFENENEINVYFHHEVDPILEEVPQMLYLECDPIPKAIENEDDLDDVPVAGHEE

SEQ ID NO: 144542 - protein, 62 aa, Glycine max
  Coding DNA Sequence Number=SeqID_52857
MTDLVSAEDDANLRVSSGLSAAIDEGMTIICLRMSSGPPPLDEKRVQNDHNLSLRAIGHDCV

SEQ ID NO: 144543 - protein, 108 aa, Glycine max
  Coding DNA Sequence Number=SeqID_52858
  Gene Ontology: Mol. function=phosphoprotein phosphatase activity
  Homolog annotation: Hit_ID=A5C0F5; Match level="QueryCoverage=84%, HitCoverage=14%, E-value=3e-17, Identity=42%"; Hit description =Putative uncharacterized protein
MASDSVEHCRFKLDTMKRGEFLWVPYFEEVQALLSHLCFVGSAIWRCVVSMICFNVVEWHHPDRVMRQFGLQQPIHGPLLQPSNIHGLTLKGKNGHNWRRLQQPVLNE

SEQ ID NO: 144544 - protein, 164 aa, Glycine max
  Coding DNA Sequence Number=SeqID_52859
  Gene Ontology: Mol. function=intramolecular transferase activity; Cellular component=mitochondrial matrix; Biological process =metabolic process
  Homolog annotation: Hit_ID=A7HNV2; Match level="QueryCoverage=99%, HitCoverage=39%, E-value=2e-72, Identity=71%"; Hit description =Methylmalonyl-CoA mutase, large subunit
  Pfam annotation: Domain name=MM_CoA_mutase; Domain location=1-158; Score=-216.0; E_value=0.00013; Accession=PF01642.13; Description =Methylmalonyl-CoA mutase
TQPMNNIIRVTIQALAAVLGGTQSLHTNSYDEALALPTEESARIALRTQQIIAYESGVADTIDPLAGSYVIEAMTNEIEKRAMEYIEKIDQLGGMVKAIEMGYVQKEIHESAYKHQLAVEKEVAATDENLFPYVLEAVKAYATVGEISNALREVFGEYTETVIV

SEQ ID NO: 144545 - protein, 67 aa, Glycine max
  Coding DNA Sequence Number=SeqID_52860
PHLRIRRSKSLAFIDHTAFCYHDPRAEANYGHSAPFCHPEAAGPMTCGDKLWSFRTPFAIQTQSCPM

SEQ ID NO: 144546 - protein, 33 aa, Glycine max
  Coding DNA Sequence Number=SeqID_52861
MVIIGLASILQNPGIEYLTCVVAYVVHFGYCIE

SEQ ID NO: 144547 - protein, 235 aa, Glycine max
  Coding DNA Sequence Number=SeqID_52862
  Gene Ontology: Mol. function=nucleoside-triphosphatase activity; Cellular component=chloroplast
  Homolog annotation: Hit_ID=Q2PMM5; Match level="QueryCoverage=80%, HitCoverage=18%, E-value=3e-65, Identity=77%"; Hit description =Protein ycf2
PKGFLIDDSDDIDDSYDSDDIDRDLDMELELLTMMNTLTMDMMPEIDRFYITFQFELAKAMSPCIIWIPNIHDLDDHGILFYQIGRAVSQNVLLSNCSIDPISIYMKKKSCDGGDSYCTNGTRTGTSMKKLTILLYLLSCSAGSVAQDLWSLPGPDEKNGITSYGLVENNSDLVHGLLEVEGALVGSSRTEKDCSQFDKDRVTLLLRSFRDKRIIYDEEDELQENDSEFLQGGTM

SEQ ID NO: 144548 - protein, 315 aa, Glycine max
  Coding DNA Sequence Number=SeqID_52863
MRSWVRCQWIPFDADAISQFLGYPLVLEEGQEYEYGQRRNRSDGFDKEAITHLLCIPGQDFARTAAGRRVRIMRTNMTTLTQIWMTLLLSNIQPNDHNFDLPLLECQLVYVILTRMSIHVAQLIANAIYLFAGMAPTRHPLDPDKSNRALGFPALIIGPCQSFGVPVAPSKVIRPPITRAFIEKYCTQRQAQGDAPQAADAPPPHQAGPAGSFDTEQYLRHLVRQQAANHRAHVQTHDCLYQMSLSLQSQGFTSFLCPTPDQFRAEVAWPGDWPEARAVEAPAETPAEAPDEADEAREDEEMADLLDFLGGSGAT

SEQ ID NO: 144549 - protein, 79 aa, Glycine max
  Coding DNA Sequence Number=SeqID_52864
MAAEWRRKRKRKRRFKEKMSLEEAHHHRRPWIRAWRKKEMNEGREGEEHEILCSKRALKFEVNIQIIKVEKMHTHGLYI

SEQ ID NO: 144550 - protein, 200 aa, Glycine max
  Coding DNA Sequence Number=SeqID_52865
  Gene Ontology: Mol. function=protein binding; Cellular component =integral to membrane; Biological process=defense response to fungus
  Homolog annotation: Hit_ID=Q1SWI6; Match level="QueryCoverage=95%, HitCoverage=82%, E-value=5e-38, Identity=46%"; Hit description =Leucine-rich repeat, plant specific
  Pfam annotation: Domain name=LRRNT_2; Domain location=3-43; Score =49.3; E_value=1.3e-11; Accession=PF08263.3; Description=Leucine rich repeat N-terminal domain
  Pfam annotation: Domain name=LRR_1; Domain location=128-151; Score =13.2; E_value=0.96; Accession=PF00560.24; Description=Leucine Rich Repeat
  Pfam annotation: Domain name=LRR_1; Domain location=153-175; Score =14.4; E_value=0.43; Accession=PF00560.24; Description=Leucine Rich Repeat
  Pfam annotation: Domain name=LRR_1; Domain location=96-126; Score =9.0; E_value=6.5; Accession=PF00560.24; Description=Leucine Rich Repeat
  Pfam module annotation: Pfam domain module=LRRNT_2::LRR_1::LRR_1::LRR_ 1; Domain location=3-43::128-151::153-175::96-126
VCIPSERETLLKFKNNLIDPSNRLWSWNHNHTNCCHWYGVLCHNLTSHLLQLHLNTSDSAFYHDHDGYLYSDFDEEAYEKSQFGGVISPCLADLKHLNYLDLSGNGFLGEVRVSANGTVPSQIGNLSKLRYLDLSYNDFEGMAIPSFLCAMTSLTHLDLSHTGFMGKIPSQIGNLSNLVYLDLGNYFSEPLFAENVEWVS

SEQ ID NO: 144551 - protein, 18 aa, Glycine max
  Coding DNA Sequence Number=SeqID_52866
MSGRSSTRQFPNWNQEGK

SEQ ID NO: 144552 - protein, 109 aa, Glycine max
  Coding DNA Sequence Number=SeqID_52867
MTPAKARNLIEKMVSNSQGVHEVATNSSSSAETKKLEGKLDALVNLVTQPALNQKSVPVARVCGLCSSADHHTHLCPFMQHSGATEQRKAYAANIYNRPPQPQQQKQPQ

SEQ ID NO: 144553 - protein, 90 aa, Glycine max
  Coding DNA Sequence Number=SeqID_52868
MTFFLGRPHCSFFRGQGWKILILGQGLWWFEVLGQKACRMAGHDVSQHALLRASEGEAHGCAFQRRKDTRSRHQRLFVENVGKTEGNRSK

SEQ ID NO: 144554 - protein, 222 aa, Glycine max
  Coding DNA Sequence Number=SeqID_52869
  Pfam annotation: Domain name=Transposase_23; Domain location=13-83; Score=-4.6; E_value=0.0037; Accession=PF03017.5; Description =TNP1ENSPM transposase
GSCVDPSGNDPETDDSDRCSLYIEADPARLVAMGRVYEGSTVVHNTHLLPGQVKVSVEEVTDADAPMPVPTNEVSLVGQALHTFLAWPTHLVKSLSQQDATVFGIFHPDFPLYIKHEDLSEIAHNGQCLSISVLQLWILHLTETCMRAGNSDIYGFLEPQSIQSGHWQMVVIVPKEHLVVWFCSLHNRPDNYLKGIINSVLKGLHDAPQPKSKAPARWIVFK

SEQ ID NO: 144555 - protein, 139 aa, Glycine max
  Coding DNA Sequence Number=SeqID_52870
  Subcellular localization annotation: CTP_CleavageSite=40; ConfidenceScore=5.76e-01
MDTPIASPPPSPCPSPPLPPALASESTSSLKRTRKPTRVRSFATRTSVIERPVVHVDPATCKAEGPHRKKLRTYLGIVTRDKVDVTFENWKEVPTTQKDLIWENIQANFTIRLNWISLKHVMVGQRRKYFRLSGAVETV

SEQ ID NO: 144556 - protein, 69 aa, Glycine max
  Coding DNA Sequence Number=SeqID_52871
MNCVFVQASSTHEFGAMRSDCLLQFSILNPFSEPMNCVFVHASSTHEFGAMRSDCLVQFSILNPFFEPP

SEQ ID NO: 144557 - protein, 190 aa, Glycine max
  Coding DNA Sequence Number=SeqID_52872
  Homolog annotation: Hit_ID=B0HC01; Match level="QueryCoverage=17%, HitCoverage=72%, E-value=2e-11, Identity=100%"; Hit description =Putative uncharacterized protein
MRKRHASRREKGGQVSGKRQGRNRRAHEGASRGKRLGGGAYGKTPATRPFYGSWPFAGLLLTCSFLRYPLILWITVLPPLSELIPLAAAERPSAASHWHDRFPDWKAGSERNAINETAMTMITNSSSVPFAPDIFRFNTRCAPLTGLSAPGIRLQTSCDRLRELHVSEVFTVITETRETKGPRDTPIFIG

SEQ ID NO: 144558 - protein, 192 aa, Glycine max
  Coding DNA Sequence Number=SeqID_52873
MGKAEEVQEQMKADMKAMKEQMATMMKAMMSMKKIMEANAVAVAATSAVAKVNPMPPSDLNQMNHPTSDMHAFPPYGLPPNYTPPNVAYTPNENVNNSTPIPIESRQPHRVHVSQPMGETHEIPNHNLADFEPCLGYATEGQVVGGIPLQNTLEGPQYHPQTHPLHSTAGKNPHAMAEMGEVGSSRGKAHGR

SEQ ID NO: 144559 - protein, 265 aa, Glycine max
  Coding DNA Sequence Number=SeqID_52874
  Gene Ontology: Mol. function=unspecific monooxygenase activity
  Homolog annotation: Hit_ID=Q5CEG7; Match level="QueryCoverage=39%, HitCoverage=99%, E-value=4e-44, Identity=84%"; Hit description =Senescence-associated protein
  Subcellular localization annotation: CTP_CleavageSite=52; ConfidenceScore=5.26e-01
MIGRADIEGSKSNVAMNAWLPQASYPCGNFSDTSSFKFRRTKGSIGHAFTVRIRTGNQNQTSFYPFVPHEISVLVELILGHLRYLLTDVPPQPNSPPDNVFRPDRPAEADLGSKKRGSAPLPIHGITPTYPTPLKSFHKVGLESSSTGSSFPADSAKPVPLAVVSLDSRQGHRIPLVRTSSELTVPPPGKRPRRARSQSVPRPARDDPLSPRKQLEQSTDSRRVRDWDPRAQPSKPIFFPRLLIHFAYFPCLLCSIDHRLFALET

SEQ ID NO: 144560 - protein, 29 aa, Glycine max
  Coding DNA Sequence Number=SeqID_52875
MQAPGGPAGNQQARVETTRVVSSSARGIG

SEQ ID NO: 144561 - protein, 79 aa, Glycine max
  Coding DNA Sequence Number=SeqID_52876
  Subcellular localization annotation: CTP_CleavageSite=36; ConfidenceScore=5.50e-01
MARLYKGEATSSMARRYRANTAARSSASCRSCAAPSAAQVMRRPCPGAATENTSPARTCHPREARASTCGWLSALHGSH

SEQ ID NO: 144562 - protein, 108 aa, Glycine max
  Coding DNA Sequence Number=SeqID_52877
MTGPLDGPTSCFLIKVDPWVLVPIFFRGLHILAIRGLHVLAFRGPHALAFRGLHVFNFRGLQVLVVKGSCTFTFVGLHALTFRGLHVLAFRGLHVLAIRDYMSPIFKG

SEQ ID NO: 144563 - protein, 155 aa, Glycine max
  Coding DNA Sequence Number=SeqID_52878
PPTYLALLILLPVAAASGDKSCLTGATLPEGRKADRYPVSGRVGTGERTRELPGGNACLWKNASNAAFLRFLAFCWPFAHMFFPALSPDSVDNRITAFEKRKSAQYANRLSPRVGRFINAAGTTGFPTGKRAVSATQLIYDHDYEFELGTPDDAD

SEQ ID NO: 144564 - protein, 162 aa, Glycine max
  Coding DNA Sequence Number=SeqID_52879
MLGKLGRIDGDPVLRETRIWATWEYVSSVGGGQQGMVGLCAICGCGKTCCAPSPDRHLVPHVMEWYLEICRGGQETLGTSGGVLLPKTKLDQSRPNPGIVSQLENEVRKLGELLVIDYQASKGNWKAVEASGNRLPVCVIDYTEEWVTGNRLPDRDGGAANP

SEQ ID NO: 144565 - protein, 270 aa, Glycine max
  Coding DNA Sequence Number=SeqID_52880
  Gene Ontology: Mol. function=4 iron, 4 sulfur cluster binding; Cellular component=nucleus; Biological process=regulation of transcription, DNA-dependent
  Homolog annotation: Hit_ID=P36979; Match level="QueryCoverage=100%, HitCoverage=70%, E-value=1e-145, Identity=95%"; Hit description =UPF0063 protein yfgB
  Pfam annotation: Domain name=Radical_SAM; Domain location=47-224; Score=62.5; E_value=1.5e-15; Accession=PF04055.12; Description =Radical SAM superfamily
EVAEIRAPEVVEEQRSSDGTIKWAIAVGDQRVETVYIPEEDRATLCVSSQVGCALECKFCSTAQQGFNRNLRVSEIIGQVWRAAKIVGAVKTTGVRPITNVVMMGMGEPLLNLNNVVPAMEIMLDDFGFGLSKRRVTLSTSGVVPALDKLGDMIDVALAISLHAPNDTIRDEIVPINKKYNIETFLNSVRGYISKSNANQGRVTIEYVMLDHVNDGTEHAHELAALLKDTPCKINLIPWNPFPGAPYGRSSNSRIDRFSKVLMEYGFTTI

SEQ ID NO: 144566 - protein, 182 aa, Glycine max
  Coding DNA Sequence Number=SeqID_52881
HPGRVRAAGAGVTIKQYFGSTSRTSHNSSFMPPEDLQLLTQQIRDQLEESITEKGFALPPEPEVGPSGAHVSTKESCVALSGNDPETGDSDKCGLYIEENSSRLVALGRLYEGSTAVHNIPLLHDQVKVGVEEVKDAETLIPVPTDEVVVSPAKPPESPDHDVDDPLHLMTLTIPQLFLKPL

SEQ ID NO: 144567 - protein, 145 aa, Glycine max
  Coding DNA Sequence Number=SeqID_52882
SMMIGCGISWMSWELERIDGDPVLRGTRIRATWEYVSSVGGGQQGMVGLYVICGYGELSCTIARPPPSTTCDGVVPGDMSRGSGDLGDVRRAPGSQQIKGTKTTKQGGLCGGWPGNWKIVEASGNRLPVCVIDYTEEWVTGNRLP

SEQ ID NO: 144568 - protein, 134 aa, Glycine max
  Coding DNA Sequence Number=SeqID_52883
  Pfam annotation: Domain name=Transposase_23; Domain location=47-117; Score=10.8; E_value=7.8e-05; Accession=PF03017.5; Description =TNP1ENSPM transposase
  Subcellular localization annotation: CTP_CleavageSite=30; ConfidenceScore=5.08e-01
MASFSQMQSQIQSLGLAVPPEPLVGPSGPRVSTKGSCVDPSGNDPETGDSDRCGLYIEADHARLVALGRVYEGSTIVHNTPLLPNQEKVAVEEVTDADAPVLVPTNEVSLVGQALHTFLAWSTHLVKSLSQQVL

SEQ ID NO: 144569 - protein, 93 aa, Glycine max
  Coding DNA Sequence Number=SeqID_52884
MSVAAAEKLCPCSPNECGASNCYKEAKYDAAEFGVLKSMPNKSVIHSWMVAVTDSPETYFKTAQLFAIRGRLTQAMINSGSQYSEVISDAMNN

SEQ ID NO: 144570 - protein, 145 aa, Glycine max
  Coding DNA Sequence Number=SeqID_52885
  Homolog annotation: Hit_ID=A5AEM4; Match level="QueryCoverage=85%, HitCoverage=17%, E-value=1e-12, Identity=37%"; Hit description =Putative uncharacterized protein
GYKCFHPPSRRFYVSRDVTFNEQESYFKQPHLQRENVIEEDEPLMLPNMTFGPEIGTTSTAVPETERSPDSAEQSTDSTAGPIPQPKINGGKFGKNLVYSRREKAIPDSIHVQESDPPSLHEVTSSNPINNSNEFVAEISEVQVN

SEQ ID NO: 144571 - protein, 173 aa, Glycine max
  Coding DNA Sequence Number=SeqID_52886
  Homolog annotation: Hit_ID=A6FJQ2; Match level="QueryCoverage=21%, HitCoverage=84%, E-value=3e-11, Identity=92%"; Hit description=50S ribosomal protein L5
MTVKTSDTCSSRRRSQLVCKRMPGADKPVRARQRMRKEKIPHQAPFAIQAAQLLGRAIGAGLFAITPAGERGMCCKAIKLGNARVFPVTTLSTLEDPQSKPLRRVLMNLRPQILFEGPINNLGFAVHLRVVRRAHTELRTTELEQLTSKMADKHRVSVRHDTTGKPVKLADAI

SEQ ID NO: 144572 - protein, 138 aa, Glycine max
  Coding DNA Sequence Number=SeqID_52887
  Homolog annotation: Hit_ID=A0ST23; Match level="QueryCoverage=32%, HitCoverage=91%, E-value=1e-11, Identity=73%"; Hit description =Putative reverse transcriptase
MTVKTSDTCSSRRRSQLVCKRMPGADKPVRARQRMRKEKIPHQAPFAIQAAQLLGRAIGAGLFAITPAGERGMCCKAIKLGNARGLSKACSTGTELEFVIMVIAVSFGKPVVPAALMNRPTRGERRFAYWALFRFLAH

SEQ ID NO: 144573 - protein, 95 aa, Glycine max
  Coding DNA Sequence Number=SeqID_52888
MRDSLPLWFYVLAQLVALQYQGVAQDLIKGNYWPLNQECNTLKMRMRGPLKARNVQSSEGEGVQSSDGEGVQPSDGEDVQPSEGEGVQPSESEGL

SEQ ID NO: 144574 - protein, 219 aa, Glycine max
  Coding DNA Sequence Number=SeqID_52889
  Homolog annotation: Hit_ID=A0ST23; Match level="QueryCoverage=20%, HitCoverage=91%, E-value=3e-11, Identity=73%"; Hit description =Putative reverse transcriptase
MTVKTSDTCSSRRRSQLVCKRMPGADKPVRARQRMRKEKIPHQAPFAIQAAQLLGRAIGAGLFAITPAGERGMCCKAIKLGNARVFPVTTLSTLEDPRPDFRNNYEICSFVDFMDSLIDHPGDVKELRSAKILLNALMSKEVAKIFNFVSTYLVSNMKGNPWAIIGFIVAIFAGTELEFVIMVIAVSFGKPVVPAALMNRPTRGERRFAYWALFRFLAH

SEQ ID NO: 144575 - protein, 106 aa, Glycine max
  Coding DNA Sequence Number=SeqID_52890
  Subcellular localization annotation: CTP_CleavageSite=44; ConfidenceScore=5.41e-01
MATQLNQAQSQNSDKLPSQTVQNSKNVSAITLRSGKQIEVPPPVAAPAPEPVKLHSTPEKEDDLAAQKRKLPDHEGANKNFHAGGPSSSSSDMQQPPIPLPNKGLT

SEQ ID NO: 144576 - protein, 186 aa, Glycine max
  Coding DNA Sequence Number=SeqID_52891
MEGSSTIEESKLRSDLKLHITKLASTQSVLDRLRQENEKLVSSYKATGCVCASISLNMEDYKYLQTEFEKFKEDYCAERMKLQTEFSYLKDLSRKMNKGKSDLSHLLSVQNHTSNKTGLGYNKQTTFSNKTKFASSKRANPNKVSKKKNTMHSKPNAKTYHYCMKRGHTSYKCYVMRFDVPRGKCV

SEQ ID NO: 144577 - protein, 122 aa, Glycine max
  Coding DNA Sequence Number=SeqID_52892
ATLPEGRKADRYPVSGRLGTGERTRELPGGNACLWKNASNAAFLRFLAFCWPFAHMFFPALSPDSVDNRITAFEKRKSAQYANRLSPRVGRFINAAGTTGFPTGKRAGELSSEDVCKGVECG

SEQ ID NO: 144578 - protein, 17 aa, Glycine max
  Coding DNA Sequence Number=SeqID_52893
MGEVEEVQEQMKANMEA

SEQ ID NO: 144579 - protein, 131 aa, Glycine max
  Coding DNA Sequence Number=SeqID_52894
  Gene Ontology: Mol. function=helicase activity; Biological process =viral genome replication
  Homolog annotation: Hit_ID=Q2A9I1; Match level="QueryCoverage=95%, HitCoverage=8%, E-value=1e-20, Identity=40%"; Hit description =Putative uncharacterized protein
MGFLQDDKEFIEAIKEAKDWGSTHYIRKLFVLLLLTATMRKPEQVWDQTWHWMADDIVYNYKKSSTSPALQFDDRTLQNLVLLEMEELLQANQRSLKDYPSMPYSEDANCTTYLDNSLILADLNYNNQEIR

SEQ ID NO: 144580 - protein, 112 aa, Glycine max
  Coding DNA Sequence Number=SeqID_52895
  Pfam annotation: Domain name=G-patch; Domain location=1-37; Score =3.1; E_value=0.078; Accession=PF01585.14; Description=G-patch domain
MLGHGYEPGMGMGKNNGGRTSLVSTRGNRGKFRLGYKPTQADIRKNISKRKNKGQGPQSGQRAKEAPPCHISRSFISAGLRRKGQVAAICDDDSLRRSDLVRPCPAGFQLGY

SEQ ID NO: 144581 - protein, 366 aa, Glycine max
  Coding DNA Sequence Number=SeqID_52896
GLGWLSKLKVVDEENFEAPEEDEEVRALKLELGKARLAKEKFKSAATHIRKECTELQEENAATARALEQETKRARKEEHGREKFRGALWDSNNELKLRREERDRSRVHGMILKEKLVACARSKRSLAQHLEATEQSMLAIIGQYKEELNQSMAHEQKLVEDFPQVYAEKEAKGRVIDALHQEATMWMDRFALTLNGSQDLPRLLAKAKAMAEEQMKADLSALKDQMASISEVMLKLQKTIEDKATATASSTVRETKPVLYSPQAYPYGLPPDFTPRATPKDLSQAPTFEGQLPPYEDYPGQDDGEGDTHLGPLLHLKDPSPHELPQPNIVCHIPASPTPVKESVPFAEDKGKIEALEERLRAVEGL

SEQ ID NO: 144582 - protein, 204 aa, Glycine max
  Coding DNA Sequence Number=SeqID_52897
MNSGAVAMGPSVAIENAELRDINIATTKALEQETKRARREEHSPNKFRGALWSSNNELKLRKEERDQSRVDSLILKDELKVCSRSKRNLSKRLCETETNMLAIVSKYQEELNLATAHEHKVADEYARVYAKKEARGRVIDSLHQEATMWMDRFVLTLNGSQELPRLLAKANAMADTYSAPEEIHRLLSYCQHMIDLMAHIIRNY

SEQ ID NO: 144583 - protein, 61 aa, Glycine max
  Coding DNA Sequence Number=SeqID_52898
MSNAKYPQESLHSVSNGNGSKGSLNCKHHEPHDEGSNIKSMLYKLLVNLRSGVFMLQIDGF

SEQ ID NO: 144584 - protein, 147 aa, Glycine max
  Coding DNA Sequence Number=SeqID_52899
DVRKKAQAIQKQNTTPHVLSRGGYDYLEQKLLAEKTKKKLEEVAQTGSVDGIIDPPSPVRCHVKWKMARTKKSGDMTTEAAKEIVAKIATQGSFVPHGRQDVLAAAIGRPEYPGRVRAVGAGVTIKQYFGSAPRTSCSSSSLISEEL

SEQ ID NO: 144585 - protein, 72 aa, Glycine max
  Coding DNA Sequence Number=SeqID_52900
MDSVATCPFAGEQGEAHGCAFQRRKDARSRHQRLFVENVGKTEGNRSTKAGLLLLRTLHQRGNQTYVVLSYA

SEQ ID NO: 144586 - protein, 227 aa, Glycine max
  Coding DNA Sequence Number=SeqID_52901
  Homolog annotation: Hit_ID=Q84VH5; Match level="QueryCoverage=81%, HitCoverage=39%, E-value=7e-58, Identity=90%"; Hit description =Envelope-like protein
MDLIKAAGLLKTVTKLGDCYESLVREFIVNIPSDITNRKSDEYQKVLSEENVLDSPCCNHKYLGRPTEGVVDIAVSEHQIAKEITAKQVQHWPKKGKLSAGKLSVKYAILHRIGAANWVPTNHTSTVATDIVSTSGKAAASGAVSKDALIAELKDTYKVLEATIKATTEKKMELERLIKRLSDSGIDDGEAAEAEEEADEEEEEAAEEEEDAAEDTESDDDDSEATP

SEQ ID NO: 144587 - protein, 221 aa, Glycine max
  Coding DNA Sequence Number=SeqID_52902
MRGAPTEESLLPFLVRGFGAQSFKIVQIVHKAWESPLRKDKELRGIRNGIIGGYHEWAKKFIHEAPEEDEEVRALKTELGKARLAKEKFKLVATDVRKECAELREENAATARALEQETKRACKEEHGRDKFRGALWGSNNEVKLRRKEGDQSRVHSMALKEELAACSRSKKSLAQHLEATEQSMLAIIEDFAQAYAEKEARGRVIDALHQEATMWMVSVIP

SEQ ID NO: 144588 - protein, 171 aa, Glycine max
  Coding DNA Sequence Number=SeqID_52903
MLGFTRNSPQISASPYQLDFTLYASGSYNAQWNAPGLLHDKHTLHSSRILRKVEVDEPWLGLWLPLNYQVDVGASQHRTLELGWCSSLEVQTDFVVDLGMAFVDNWVVGMAVTAWVSPLSSPSLFAPVFSVVLTHIDPFTGKDQILKALKNTGHVSTIIVIISYSVFGGAT

SEQ ID NO: 144589 - protein, 140 aa, Glycine max
  Coding DNA Sequence Number=SeqID_52904
  Homolog annotation: Hit_ID=A0ST23; Match level="QueryCoverage=32%, HitCoverage=91%, E-value=1e-11, Identity=73%"; Hit description =Putative reverse transcriptase
MTVKTSDTCSSRRRSQLVCKRMPGADKPVRARQRMRKEKIPHQAPFAIQAAQLLGRAIGAGLFAITPAGERGMCCKAIKLGNARVFPGIFNKHMGTELEFVIMVIAVSFGKPVVPAALMNRPTRGERRFAYWALFRFLAH

SEQ ID NO: 144590 - protein, 114 aa, Glycine max
  Coding DNA Sequence Number=SeqID_52905
MHENELHGACLLFAPIWEPIGQYLGVSNNYSPTIHNSHGCFLENRPNSQKGPQWSRQLSQHALLRASEARLMGALSKGGKMRGVATNVVLWKTSEKSKETGQNENSKFGSCIYV

SEQ ID NO: 144591 - protein, 67 aa, Glycine max
  Coding DNA Sequence Number=SeqID_52906
MARNVLALCPYFRDLYGRELKGILTIIPNVVISLLMVSRGIIPFEERIAAIGTTSNNMLSKRKTLDE

SEQ ID NO: 144592 - protein, 114 aa, Glycine max
  Coding DNA Sequence Number=SeqID_52907
DAGSRQARQGASAGVGGCRGWLNYAASEQIVLRVHHMRAIGAGLFAITPAGERGMCCKAIKLGNARVFPVTTLLKAQVEKDEGPSGEGQSPRVEKDEGPEAETLSRLLVPSSNS

SEQ ID NO: 144593 - protein, 131 aa, Glycine max
  Coding DNA Sequence Number=SeqID_52908
  Homolog annotation: Hit_ID=Q84VH5; Match level="QueryCoverage=100%, HitCoverage=19%, E-value=2e-46, Identity=74%"; Hit description =Envelope-like protein
  Subcellular localization annotation: CTP_CleavageSite=21; ConfidenceScore=5.16e-01
MATSPKETSAPGSPVVPSSPSSTKAPSNQERLEFNIQPIQMIPGQAPVPEKLVPKRQQGVKISENPSLATSPREVDTEMDKKIRSIVSNILKNAYADEDVPTSSTPNVSVPDVDKDVPTSSAPNAEALPSP

SEQ ID NO: 144594 - protein, 247 aa, Glycine max
  Coding DNA Sequence Number=SeqID_52909
  Homolog annotation: Hit_ID=Q2HW90; Match level="QueryCoverage=90%, HitCoverage=43%, E-value=5e-26, Identity=36%"; Hit description =Putative uncharacterized protein
MDILELLIFGLVLFPNVDGLVDRAAIDAFLAFYDRKESPVVAILADLYDTFDRRCEKNNARIVCCTPALYVWLVSHFFRQKMGHVCPLEGHHSCTEKKEANWDRLLASKEGASINWFPRWKEGRIEILISCGKFPNVPLMGTRGCINYNPVLAIRQLGYPMKGAPSEEGLTPFITQGFNSTNAGVLQRVHKAWEMSQRKDKELRRSSNRPIDGYHRWLKAYAQDLDWLPGLRTTKGMEGEASKEDEE

SEQ ID NO: 144595 - protein, 70 aa, Glycine max
  Coding DNA Sequence Number=SeqID_52910
MTSRGTVWLSTPLVIQRRQIEEAKEHHLDEDAMIPHDVTPCRACRPWIFFINEFFCFLKINGSGMEKEEK

SEQ ID NO: 144596 - protein, 157 aa, Glycine max
  Coding DNA Sequence Number=SeqID_52911
MGGTKRLLVIIPKVVISLLMVSRGIIPFKKHIAVVGTTSNNMLSKRKTLDEGSLLSSKSKTQHDHRFTSTPYVPMDPGKPTKEEVMILHEIRRPNSLKTVPSGVANCRNLPFGGRATRGLTGASSKNGKCAESPPTFIRGKRRKNRKRMWSTNFKCE

SEQ ID NO: 144597 - protein, 101 aa, Glycine max
  Coding DNA Sequence Number=SeqID_52912
MDVASNGRNFKTIVKKTENVVIVEEQRVETRGPKGICISPSAKKPVENMPFEITSDEPLKCMSLSSSSNAYNVPWVEKYRPIKVADIVVNEDAISRKLFSN

SEQ ID NO: 144598 - protein, 76 aa, Glycine max
  Coding DNA Sequence Number=SeqID_52913
MADEHQQRVTLENYSSSSMPQFFTSIARLEVQAHNINYPHSLIHLIQGNLFQGLPNKDPYAYLATFIEICNTVKIA

SEQ ID NO: 144599 - protein, 69 aa, Glycine max
  Coding DNA Sequence Number=SeqID_52914
MGEMLATQLAQTSWVASSRSNCLLEEFSGRPKWASFRHVTELHELPNDGCQVPRSGQTRVASQQRMVPG

SEQ ID NO: 144600 - protein, 136 aa, Glycine max
  Coding DNA Sequence Number=SeqID_52915
MTSKVILMMPKNQELRKVSSKDSRIKLQVSRLEIQESRFKYQDQDSRLKIQESREDSIKIRYILCGTSRGYIYLGIVMLRTREGTSLVDQFKWRVHPLGYSKRIREGTSLVDLWLVKDFTTLKRNLKNRRLLGDWM

SEQ ID NO: 144601 - protein, 75 aa, Glycine max
  Coding DNA Sequence Number=SeqID_52916
MSHAVKDNRGKWAPNYEGPFVVNRAFSGGALGQDHLELPSGVGTKHGQQKPIKVLRNGCKWGWGHDRLIVALSLR

SEQ ID NO: 144602 - protein, 148 aa, Glycine max
  Coding DNA Sequence Number=SeqID_52917
MPAKLNFAEAEFSATSAKWPYVSLSGNNVLGRNILTERKVEIYHTKFDDFKAELERHSLHKHLTNLVDGSIDVSSVKEFYANLYNSEGPSPKQARVRGHLVKIDADNLNTFLETPMVLAEGETLPTYSRYCRLPSDPREIEATLCRPG

SEQ ID NO: 144603 - protein, 238 aa, Glycine max
  Coding DNA Sequence Number=SeqID_52918
MAFNGRWLADTPNGSSSSSASESQDKKIGHQGKRQQAAEQVNGALQDQGIGERHRRAGEPFTAAEGVGQLAQLVVEQLEGDVAQQPPSAQLADLLAQHQQDAVGRHRAGDHLRQLFAAEVVVQIGGRIGGAQLMLQAPAEGDQQLGDLLVHRRFVRQQAFYLAQQGSLGNQQRAPQVARFDKAAVAGVIAKAEKNGDGDAQQAERRDGQMHAELFVPLIADHRHYRHQHVQRQAKGDL

SEQ ID NO: 144604 - protein, 133 aa, Glycine max
  Coding DNA Sequence Number=SeqID_52919
MAAQLIHDRVEMECLERVWETHKGNARCRFRGTIRFTATSLVHPEEPARTLQRTVEWILPTPTPYRLVELVQVIEVTSSEEDPEEDPEELPPEPAMDALDFPEGDEDVMSASEADSMEESGPEGIATSGGSSS

SEQ ID NO: 144605 - protein, 188 aa, Glycine max
  Coding DNA Sequence Number=SeqID_52920
MVIDQSLFYDLTQLPNEGVPFEGTLIDYWKYEFSVHDARRLVCTNQADMTGRLLAGSLAFESRILHYLIVRILLPRSSNLAQKSFLIGTAVIASFGYRKVHDGSWVKNGAQPIDEEGHLHGGEDSFLLQTILDRFDGLQTFVGERFDTLELQVDMRFNEMESRITKVEEDVSYIRTNFDLPPPPAPSS

SEQ ID NO: 144606 - protein, 54 aa, Glycine max
  Coding DNA Sequence Number=SeqID_52921
MGSTINPKVHENPRAFFSSSSPSLLESSIQYPWGAELSLSLVPNALFRLSQNLE

SEQ ID NO: 144607 - protein, 33 aa, Glycine max
  Coding DNA Sequence Number=SeqID_52922
MAGVGRYMAPTDIFQPTLRNFFYKRWPIMFIHL

SEQ ID NO: 144608 - protein, 85 aa, Glycine max
  Coding DNA Sequence Number=SeqID_52923
  Subcellular localization annotation: CTP_CleavageSite=53; ConfidenceScore=5.30e-01
MGPKSTLRLMRTLRLSRASLAQSSWSLLSNALAGKKKKNSPFAKRKPRPKRISVHALSPESQALSTQPLHLRLIWSTKLAKVELR

SEQ ID NO: 144609 - protein, 258 aa, Glycine max
  Coding DNA Sequence Number=SeqID_52924
MGNPLRKDQELRGIRNGIIDWLAKLKVVSEESFEAPEEDEEVQALKSELGKAKLAKEKFKLAATHVRKECAGLREENAITARALEQETKRARKEEYGRNKFRGALWGSNSELKLRREERDQSRAHSMVLKEELIACSRSKRSLSQRLCETETNMLAIIAKYQEELGLAMAHEHRIADEYAQVYAEKEARGRVIDSLHQEATMWMDRFALTLNGSQELPRLLAKAKAMADTYSTPEEIHGLLGYCQHMIDLMAHIIRNH

SEQ ID NO: 144610 - protein, 124 aa, Glycine max
  Coding DNA Sequence Number=SeqID_52925
SFGVPVAPTKVIRPPITRAFIEKYCTQRQAQGDAPQAAGAPPPPHQAGPAGSFDMDQYLRHLVRQQAANHRAHTSSGVEVAWPGDWPKAQAGEAPPEAPDDGEEAHEDEEMADLLDFLGGSGAT

SEQ ID NO: 144611 - protein, 158 aa, Glycine max
  Coding DNA Sequence Number=SeqID_52926
MAPPKEIVTIIYQNGHIVDNLVQGSMYTSANPIFFYINRSITFTQFIQKINNRLPARATEQVAQLLFRIPISFHLGQTHFISAQLFDNDDLRGAIETIFHNPQLNFAEFYVVTDLIHQPHPLSPQPSSPQLQVPPPQQLPYNNIDLNNPVSSYNNLES

SEQ ID NO: 144612 - protein, 170 aa, Glycine max
  Coding DNA Sequence Number=SeqID_52927
  Homolog annotation: Hit_ID=UPI00006A2939; Match level="QueryCoverage =60%, HitCoverage=75%, E-value=3e-09, Identity=33%"; Hit description =UPI00006A2939 related cluster
  Subcellular localization annotation: CTP_CleavageSite=61; ConfidenceScore=5.09e-01
MSKSCGFGMTGPLDESISCFLIRRTTRPRQQRVARPHHQRTTRPHHQRAARPHLQRTTRPRLGGLPVLTFRGLHALAIRELHVLTFVGLHALTFRGLHALAIRGLHVLTFVGLHALTFRGPHVLTFRGLHALAIRGLHVLTFRGLHALAIRGLHVLTFVGLHALTFRGLH

SEQ ID NO: 144613 - protein, 88 aa, Glycine max
  Coding DNA Sequence Number=SeqID_52928
MKKILGLLAPMEHTSVFLPLEKDLTSNPEVLETSWILSSTPVKRIKTYVLVMLGILEYDIGSPQISLILGGVGHSGMTFILLGSMRSP

SEQ ID NO: 144614 - protein, 214 aa, Glycine max
  Coding DNA Sequence Number=SeqID_52929
  Homolog annotation: Hit_ID=Q2HW90; Match level="QueryCoverage=71%, HitCoverage=30%, E-value=3e-12, Identity=28%"; Hit description =Putative uncharacterized protein
MVEEFEEILGCPLGGRKPYLFSGFYPSLARISKKVQISAQELDRQRQVENGVVGIPRKYLEVKARILADKGEWTPFIDILTLLIFEGVLFPNVDGLVDLAAIDVFLAYHNHKESPVVAMLADLYDTFDRRCEESNARIVCCTPALYVGLVSHLFLQEGRPVYPLQGYRSCVEKRKANWDQLLASMGGHLLIGSLARRKEEIRFYLHAKDVQMFP

SEQ ID NO: 144615 - protein, 132 aa, Glycine max
  Coding DNA Sequence Number=SeqID_52930
  Subcellular localization annotation: CTP_CleavageSite=53; ConfidenceScore=5.24e-01
MAIQNMQFQQETRAFIQSLTNQMGQMATQLNQAQSQNSDKLPSQAVQNPRNVSAITLRSGKQTEVPIPVAEPTPEGEKEIDAQKRQPPDQAGPSSSNSDVRQPPIPLPFPPRPIPNKKMEEIDKEILETFRK

SEQ ID NO: 144616 - protein, 114 aa, Glycine max
  Coding DNA Sequence Number=SeqID_52931
MTTGAEDDVSLCASTGSFPLVDERMTETVCIDNRLGISACHLTSRVMMIETVCTDNRLGISIRHLNSQARMTETVCTVNRLGISIRHLTSRVRMAESAEDDVSLHVSTGLLAPD

SEQ ID NO: 144617 - protein, 474 aa, Glycine max
  Coding DNA Sequence Number=SeqID_52932
  Homolog annotation: Hit_ID=Q6WAY6; Match level="QueryCoverage=76%, HitCoverage=63%, E-value=2e-20, Identity=25%"; Hit description =Putative uncharacterized protein
MANQEEWVPFADILALLIFGVVLFPNVDDLVDLAAIDAFLAYHHSKESPVVAILADLFDTFDRRCEKNSAQIVCCLPALCVWLVSHLFQQDIRHPCLLQIYRSCVEKRRVDWDQYLAGIGGSTINWFPRWKEGKEGVLFSCGDYPNVPLIGTRVCINYNPALAIRQLGYPMRGAPTEESLLPFLVRDFGAQSLKIVQRVHKAWESPLRKDKELRGIRNGVIGGYHEWLRVHTRGLDWLSKLKIINEENFEALEEDEEVRALKTELGRARLVKEKFKLVATDVWKECAELREENAATARALEQETKRARKEEHGRDKFQGALWGSNSELKLRREERDQSRAHSMVLKEELAACSRSKRNLSQRLCETETNMLAIVSKYQEELNLATAHEHKVVDEYAQVYVQKEARGRVIDSLHQEATIWIDRFALTLNGSQELPRLLAKAKAMADTYSAPEEIHGLLSYCQHMIDLMVHIIRNR

SEQ ID NO: 144618 - protein, 74 aa, Glycine max
  Coding DNA Sequence Number=SeqID_52933
MVDAFHRRFYSVARKVTYMELAATKHMREPHTWLELANNLALANTATPAGIGTHPNLQLLIELQNQVYIEGARI

SEQ ID NO: 144619 - protein, 86 aa, Glycine max
  Coding DNA Sequence Number=SeqID_52934
MGAYAKDEELLIHSFQESLTGVAVTWWRDLAAQVAPPMMEKEMITIIVDTLPVFYYEKMVAYAPSKLCGFGLHREKDQSGLEKRKI

SEQ ID NO: 144620 - protein, 41 aa, Glycine max
  Coding DNA Sequence Number=SeqID_52935
MEEKLACEASMEAGSLSFNGDFPPWRCSGRQRRRGEGRHHP

SEQ ID NO: 144621 - protein, 130 aa, Glycine max
  Coding DNA Sequence Number=SeqID_52936
MAFQIGDGFDRAVFRHQDHLRLRFGRLNADIQQVRASGLREDRRNIAGAAQIDAADVQGLEHLRAGGKLDPADAGSGETFLQQPVALRQHQADRSFLVADAELRRILRGGGSGPNQRQQAGEGSGAQPAP

SEQ ID NO: 144622 - protein, 46 aa, Glycine max
  Coding DNA Sequence Number=SeqID_52937
MDTRLRGIDDPMNGVQQSGGHKQLFEDSPSECGGGAATVRYELISK

SEQ ID NO: 144623 - protein, 377 aa, Glycine max
  Coding DNA Sequence Number=SeqID_52938
MRVKIKAVDEDVIKEYHDIFPRKWVECIVHGSLESRRSIAKAKWHDPELIVALVSSECHFMDICLGHSYLVKSLAQIELRKPGCLAQIIKQLINGKHREIVFNGDGVVCGRRWKVFVRGEDGEEWAGVMVIWSRAEMLWVWASLLSWWAEADEGREGASTLKGEEFGHARLDEFMGVVAIDEDDNLMAAQRAQKTKCLWSRDRVRGELKVLVRDKKATRVNRESKDCASHDGGPTSYPLGGERARSPEAKKEGAEPELPGEVPELTLRRSNSARRKGQGPQFDSPIQTAILEPEAWPAKKGKTHFETSTGTTTKRAHPSEGVVAIKAGHIELHVRTMNWRMRRMSGGSGRGWSDNDGGKAINNRVYLGGEGEKLGLG

SEQ ID NO: 144624 - protein, 230 aa, Glycine max
  Coding DNA Sequence Number=SeqID_52939
  Gene Ontology: Mol. function=helicase activity; Biological process =viral genome replication
  Homolog annotation: Hit_ID=Q2A9E0; Match level="QueryCoverage=98%, HitCoverage=15%, E-value=3e-50, Identity=47%"; Hit description =Putative uncharacterized protein
MWYNERISKDKNTASPKFSLCCGDVKVELPLLQNPLKYLERLLFDDNATDSKNYQHNIRTYNMMFSFTSVGIKLDKTINETREPPTIRIQGQPCHRISSLLPMPGKQPKFAQLYMFDTQNEVENRINTMSQHAAIQPHIVSTLSQMLDDHNVHAKSFRMARDRLADIQVDNVKLRLIAVREKDGRTYNLPNVSEVAALIVGDFDANSRRDIIAETQNGELQRIHELNLAI

SEQ ID NO: 144625 - protein, 396 aa, Glycine max
  Coding DNA Sequence Number=SeqID_52940
  Homolog annotation: Hit_ID=Q3EAU3; Match level="QueryCoverage=40%, HitCoverage=36%, E-value=4e-09, Identity=25%"; Hit description =Uncharacterized protein At3g31990.1
MASVPDKIKSIDGSRETLKLSVRIINLWFIGIPEKSEQVEMVIVDFDGDEIHVVCKQDQLKSWKADLKENLTYVMHNFKVMKNDGQFRICDHEYKLSFTGVTVVSGQVLSCPLWENYCLQFLSYLNEVEDERRIVILLTHARIKEGQGSYPPLVSNSLKASKLMINELVLEIQEFRERLSDLWIEVRSVLTPIRQGSSQVSGSSQLSSKDVFLSKAEAKKYVRLMPFPSQCHIKTDIETMPFMCPCGKDNHQPVLRSLVHCSIGITFINYFFLHWLLGCFLAFKVKVQPRFRNDVVLKYSDELDLINVVLDMLPDTEVVFCQPCCKIESSMLDSTDPTELESQSVSVTVNHDPLLRIPLTPTKHLSSDELDDEPKNFEISPAQVSSNKLPTHYQAE

SEQ ID NO: 144626 - protein, 52 aa, Glycine max
  Coding DNA Sequence Number=SeqID_52941
SGARIIGGRGRVEPRKTTMAVWDLRTKVEMGVEEGWWMTVFVVVVGGDMRVP

SEQ ID NO: 144627 - protein, 188 aa, Glycine max
  Coding DNA Sequence Number=SeqID_52942
MEVTNRSVFPIWDPTNIWNPESVQALPVRRCTHAVNPRRSPDQYWTLRLRESAHISSTTEQCDVTVKLSAAADKDIIQVVVHMHQRSYSLSVPPGLIEQTEYNPEDEEDTRESQLSNDLPGIDARRYHVPITCVCTVHDTILSQPCQPLQRPSISPPASEPHNPRARDDRRASRQPQADAIATRRRPT

SEQ ID NO: 144628 - protein, 653 aa, Glycine max
  Coding DNA Sequence Number=SeqID_52943
  Gene Ontology: Cellular component=nucleus; Biological process =multicellular organismal development
  Homolog annotation: Hit_ID=A5B440; Match level="QueryCoverage=100%, HitCoverage=100%, E-value=1e-156, Identity=74%"; Hit description =Putative uncharacterized protein
  Pfam annotation: Domain name=Frigida; Domain location=158-569; Score =294.5; E_value=2e-85; Accession=PF07899.2; Description=Frigida-like protein
MEDSDSVATLIDSTTSKIQQLQKAFAELESYRAVTLNLKWKELEEHFHGLEKSLKRRFHELEDQEKEFENKTRKAQEILEKRQAAVYAKEQATLQRLQEKRDAAVFDIVNAREKQRKVTISDLAIVSNGGKGTFHVEDKPVDAVSFAANGNVEEVVLSPENGNVELSYPDLVKLCKEMDAAGLHKFISDNRKNLAAVREEIPHALRAAPNAACLVLDSLKGFYCTEVSNQDVKKDANLLGVRRTCIMLMECLCDFLSNSGCVSNVISEDIKDRAKAVAEEWKPRLDALDMDASNVNSLEAHAFLQLLASFGIASGFNEEELSRLIPMVSRRRQTADLCRCLGLSEKMPGVIEVLVNSGRQIDAVNLAFAFDLTEQFSPIPLLKSYLKDARKISSPVRSVNSSPTAQVTVSNDSMIQQLFSLHTSEPNLYQNPVEAPCRLSLQGHLGMRSRYVDVILDNPDLQQSREALSVLSLSRGVKLEMRCTWFYANPTDKSTLKVKIYIFSMNIPNYLLLPQIDVNDRELIALKAVIKCIEDHKLDDQYPLDPLQKRATQLEKAKADKKRVTEATKPQPKRPRANGVGYGPRVTNILSDKTSYARVADRYPQYVYDRPYMYPAPTDNHCPPLMGSATYNISPNPGNYFGNGYQYQATYLH

SEQ ID NO: 144629 - protein, 97 aa, Glycine max
  Coding DNA Sequence Number=SeqID_52944
MKWKMTCMKKSGQMTYEAAKEIAGRIVCDSHLTVVIFNNNCWMSKPNVFHLLTTRFPRRAGLTGKLCRSWTSGCTDYCHWATKTPWSCSCYWSQRHD

SEQ ID NO: 144630 - protein, 167 aa, Glycine max
  Coding DNA Sequence Number=SeqID_52945
  Gene Ontology: Mol. function=protein serine/threonine kinase activity; Cellular component=integral to membrane; Biological process=protein amino acid phosphorylation
  Homolog annotation: Hit_ID=A7PNC8; Match level="QueryCoverage=50%, HitCoverage=13%, E-value=3e-29, Identity=76%"; Hit description =Chromosome chr1 scaffold_22, whole genome shotgun sequence
MNLVPSLRRNSWLLNLITRLFSLNPQRFFLHVYRIILLLMCLGFLLYQAMLWMIRRGDTKDHPLTQWFLNFSEADELLKLAAARQQPSQLWTGQQGKKIALGAGRGLLYLHEQCDPKIIHRDVKAKNILLDDYCEAVVGDFGLAKLLDHMDSYVTTTVRGTVGAHSP

SEQ ID NO: 144631 - protein, 79 aa, Glycine max
  Coding DNA Sequence Number=SeqID_52946
MDEDQWTHDYTMSQEVHMDYDYDNEEECGVNEPHVDCSNALNTSQVFGIKNSLEETLGVGNVVVPSGFVGNQCMEGKVG

SEQ ID NO: 144632 - protein, 87 aa, Glycine max
  Coding DNA Sequence Number=SeqID_52947
  Subcellular localization annotation: CTP_CleavageSite=51; ConfidenceScore=5.31e-01
MILPDDPLFHPKEPYFRKFSGRTSSGSFERSLHDSSGNSHRNKFALSPFFSASSTLRFHYPRLNATTIIDIKSNGELGRPTSKAKHV

SEQ ID NO: 144633 - protein, 78 aa, Glycine max
  Coding DNA Sequence Number=SeqID_52948
  Homolog annotation: Hit_ID=A7PJH7; Match level="QueryCoverage=84%, HitCoverage=7%, E-value=4e-09, Identity=46%"; Hit description =Chromosome chr12 scaffold_18, whole genome shotgun sequence
MQETRLKELFDSIPTLDELHALGGEGFKANIILVDSKKDKKLSIVSHSEPNIAIAFGRHSRRKVIVEQRTTSSRFSQK

SEQ ID NO: 144634 - protein, 145 aa, Glycine max
  Coding DNA Sequence Number=SeqID_52949
MENVFMQFMESQARFKANQNSIQNLEIQVGKSYSMENCQWEQELQPHNQYEEEIISNLDNLLMEENFVEVEAHDECLVEDHDSREKDEKRHGEWDKSLSVILSLISSTSLAMIWEDFPGYMSFMKSLAKRQKCKEDVFYVTFMLP

SEQ ID NO: 144635 - protein, 176 aa, Glycine max
  Coding DNA Sequence Number=SeqID_52950
  Gene Ontology: Mol. function=diacylglycerol kinase activity; Cellular component=mitochondrial inner membrane; Biological process=activation of protein kinase C
  Homolog annotation: Hit_ID=A7R0D7; Match level="QueryCoverage=87%, HitCoverage=20%, E-value=3e-44, Identity=55%"; Hit description =Chromosome chr6 scaffold_305, whole genome shotgun sequence
MEHYHCIIDLYSHAGMLEKAMDIINEMPFPLDATPWRIILAGFRVHYNIELGKLATKKVVSLVPQDSAAYVLLANMYAAAGRGLIEEKNKTYTFLAGDSSNPLSGLIYSKHQSELNIWLRDVGYQPDKKCVVCDIDEDEQKETILSHHSERLAIVNERVLADLMQILIFFLLIEFY

SEQ ID NO: 144636 - protein, 277 aa, Glycine max
  Coding DNA Sequence Number=SeqID_52951
  Gene Ontology: Mol. function=methyltransferase activity; Biological process=tRNA modification
  Homolog annotation: Hit_ID=A7PSK6; Match level="QueryCoverage=44%, HitCoverage=33%, E-value=2e-29, Identity=52%"; Hit description =Chromosome chr6 scaffold_28, whole genome shotgun sequence
  Subcellular localization annotation: CTP_CleavageSite=45; ConfidenceScore=5.68e-01
MASSYCCSRLLLQSQSSRLMLRFSPFLATPPTPSSLSFSSNCHVSSSAQATLQQQHEQQPLPQSSQLVALEYADLNLSYNLDLGHVRIRQHVNPLSSSFSVPAQVPDWNHAFADPTLPLMVDIGCGNLNLNDNLFDAFSVSVKDWHRSCSGRFLMWLAKRTPKERNFLGLEIRERIVKRAESWAKDLALDNMYYPKTTYIDGGTFLVCKRDNFFQAVGRIISRALGLSFSIGCHLHFYSTKLVGPIEQPKAVQQEGECFLGQLRPLWSIARQEGLVD

SEQ ID NO: 144637 - protein, 129 aa, Glycine max
  Coding DNA Sequence Number=SeqID_52952
MYFEGYDNDLEYGVNDAFDWDFGLDNGQSSVKQKAKKKVANEDPLEMSGDNEVDPPHRLVMTLGIMEFSVLNGYQVNYPKNDCVKIGSGVFNKGCKNESKDTKKLILGMQLGDWLLIVEAKVEVHLGEK

SEQ ID NO: 144638 - protein, 82 aa, Glycine max
  Coding DNA Sequence Number=SeqID_52953
MVLLLLGRSSEQKPLPERNRVETTSPERNGVTETEDAGVAMLQSSGAKNRSRTCVAPPRATATQNRSATEVPIADGGRYDLY

SEQ ID NO: 144639 - protein, 177 aa, Glycine max
  Coding DNA Sequence Number=SeqID_52954
MRSFNGDFPPWRCSGRQRRRGERRRHPLGNKPWKKELHHQDEPWIRNLEGCFNGGKERGREREREEHEIEGIKEGEKWNFEVCLTRLSFIKVTTSVTHASIYRLAHGLEIYPKAHENPRAFPWISGPIYLESSIQCPCGVGLHHSLHLGKDLTSNLEVLHTLGIKTQTHCYWLPCVY

SEQ ID NO: 144640 - protein, 289 aa, Glycine max
  Coding DNA Sequence Number=SeqID_52955
MQEIQNYNDCPHLLSRGGYDLLEKKILDEKMKKRQHEAMMTENTPHLEDPLSPIERHVKWKLARTKRYGQMTSQAAQEIFDKIGTFVPHGHDDILNIAIGRLDHGGPVHAIAFGVTISQYYGRTSRASSSSSTSISQQQGSQFSTPIKGDIHVLGARVSTKGSNVETAVNPSGEEHVAYVILTMGFVAYADDVVRVSVDKVINGDAEVPLSTSEIKYVSAIAPNKVTEDVQPVNDVAVDDPLGIWMNGAIAWVMDRCMDSLSRSQYSMQRIDVANVKITSRNGLRNLTE

SEQ ID NO: 144641 - protein, 177 aa, Glycine max
  Coding DNA Sequence Number=SeqID_52956
MQEIQNYNDCPHLFSRGGYDLLEKKILDEKMKKRQHEAMMTENTPHLEDPLSPIERHVKWKLARTKRYGQMTSQAAQEISDKIMSWLFNFYYNYLNFGLIGTFVPHGHDDILNIAIGRLDHGGRVHAIGSGVTISQYYGRTSRASSSSSTSISQQQLVEIIGSLKEEWRNEFPEENK

SEQ ID NO: 144642 - protein, 326 aa, Glycine max
  Coding DNA Sequence Number=SeqID_52957
  Gene Ontology: Mol. function=aspartic-type endopeptidase activity; Cellular component=chromatin; Biological process=chromatin assembly or disassembly
  Homolog annotation: Hit_ID=A2XQK1; Match level="QueryCoverage=92%, HitCoverage=11%, E-value=2e-34, Identity=36%"; Hit description =Putative uncharacterized protein
VLGNLTAVHSYFDLFTRKIDQDDMELEEAELELDIIQKEHALPGRMDDSKDWNQIPGLPSYRKDVSRLQQIRECIRSLEKSKLKEDIIARRQKKLLMRHARQKHLEEAALREADLLQELDRERTAEMEKELERQRLLEIERAKTKELRHNLDMEKERQTQRELQREIEQAESGLRPSRRDFPSSTHTSRPRDRFRERENGRSGNEGSTRAGSGSLQSEIPSTSSSMAPLPTIVLSGSRTLSGQLPTILQSRDRQDDTGSMYEENVDGSKDSGDTGSIGDPELVSAFDGQPGGYGSQRHSSRGSKSRQLGERRDRDSRREGKWERKH

SEQ ID NO: 144643 - protein, 204 aa, Glycine max
  Coding DNA Sequence Number=SeqID_52958
  Gene Ontology: Mol. function=aspartic-type endopeptidase activity; Cellular component=chromatin; Biological process=chromatin assembly or disassembly
MQDILIKGLTDGAEDEKQSIGDHLQLYRDLLTFLANADPFLRELQREIEQAESGLRPSRRDFPSSSRPRDRFRERENGRSGNEGSIRAGSGSLQPEIPSTSSSMAPLPTIVLSGSRTLSGQLPTILQSRDRQDDTGSMYEENVDGSKDSGDTGSIGDPELVSAFDGQPGGYGSQRHSSRGSKSRQLGERRDRDSRREGKWERKH

SEQ ID NO: 144644 - protein, 30 aa, Glycine max
  Coding DNA Sequence Number=SeqID_52959
MDCCYSNIRRISFAGSCLCWLSVFILTISC

SEQ ID NO: 144645 - protein, 287 aa, Glycine max
  Coding DNA Sequence Number=SeqID_52960
MKKALEPETMTIVINADQTKTCHKTYKDSVSPNVPEPINSLSLDNFKKIQKLLFRKFGCTNKTSFYEDKTNCPCKIKFLFRKARLDLDQFKSFRYEDLAISTKSLLDFGCLESILIPPLDRFEGFNPSINEAINLIQTYIMDYISIKIITCPSNFSAQNYPCHVMKLLLEDHRGFLCLFNDEYETWDVHGNIQYQYILMRAQIQGYQWFFSDSDKREFDLIRETHDTKLFQPSYNEKFSFLSQLIKTINWFNFSKKIRKIKRSMKLADVMDSKLLFFHPLIFLWKTH

SEQ ID NO: 144646 - protein, 76 aa, Glycine max
  Coding DNA Sequence Number=SeqID_52961
  Homolog annotation: Hit_ID=A7PVN8; Match level="QueryCoverage=78%, HitCoverage=22%, E-value=5e-12, Identity=40%"; Hit description =Chromosome chr9 scaffold_33, whole genome shotgun sequence
MYCGQSRTARFQLSKTMFRSSLAANEKMSCDLHEMLNLLIDYENQIATEKKKGTVIAIKKELQEERQSTKKEASLT

SEQ ID NO: 144647 - protein, 55 aa, Glycine max
  Coding DNA Sequence Number=SeqID_52962
  Gene Ontology: Mol. function=aspartic-type endopeptidase activity; Biological process=DNA integration
  Homolog annotation: Hit_ID=A5B2I2; Match level="QueryCoverage=100%, HitCoverage=10%, E-value=3e-16, Identity=63%"; Hit description =Putative uncharacterized protein
MKKECPKYAAWHVKKDTWWVDSGATTHISMTMQGCLWSRPPSDDERFIFVGDGKK

SEQ ID NO: 144648 - protein, 303 aa, Glycine max
  Coding DNA Sequence Number=SeqID_52963
  Gene Ontology: Mol. function=protein serine/threonine kinase activity; Cellular component=plasmodesma; Biological process=protein amino acid phosphorylation
  Homolog annotation: Hit_ID=A7NXD5; Match level="QueryCoverage=90%, HitCoverage=66%, E-value=4e-59, Identity=45%"; Hit description =Chromosome chr5 scaffold_2, whole genome shotgun sequence
MLQENLSSFRLVSTPPSPSSTSSFDGRKVYIIDHGLAKKYRDLQTPRHIPYKENKNLTGTTQFASVKTHLGIEQSRRDDLESLGKLFAHVLLKRKGLKATTKKQKYDKISEKKMSTPIEYVKWLQIYLDIVSAGYQFDYIFYWTIWKYPQIGGSSSKGRWKAMHARPSVRKPEKVSVGKEIREKFSGAVEAFSRRNPTSPSPRGDHSKHRSFEEVAVHKDVYHDQEKGRNSSRYGSSSRRPIIPSSTRPSSSGDHTDSHTGQLSSSGNRPSTSHRNIQPMYETKQPTYMHSRSTRGNRDAAVK

SEQ ID NO: 144649 - protein, 72 aa, Glycine max
  Coding DNA Sequence Number=SeqID_52964
MEIYQQQTPRSYCSSSILMQHKIVEFLFMKASKERSFEIIVIIVAVKVAEVGSATGGIIGNEEGFAAVIPER

SEQ ID NO: 144650 - protein, 365 aa, Glycine max
  Coding DNA Sequence Number=SeqID_52965
MEDSVHITNLWEVRKQNSKQAIEMVLMDQTGTNISVTLWQELFAEFRHTLHCGSSYLIQNLRIVDNQSKYRVTQFHFWMTVKLRDNRLATTNMDYAIQLHHVIDKNLLLQEPLIVMLSLGKIKDATDKYPLSVQNIKYGTRLYVNTDIAEIQQFCDSLCVPFYSGGIIDDRGGSQSQSSQSNLVEKFLHNAQVDCYYLTVGTVDEIIIDAPWSYDSCPYCTTTFDPSKVGSACRSCQNRVNDTVPRYKLNVRMEHNGNKGNFIFWDATCIKMFGKTVAKCRDELIAAGDDIKVFPSCVDEILSKTWAIRFKYHSQLRQSCVLDASEEPYHIQTLTTTLGLKGEARMGKTIVVEPESSPPIYHPTD

SEQ ID NO: 144651 - protein, 91 aa, Glycine max
  Coding DNA Sequence Number=SeqID_52966
MALIFFTCFPLLDFTWIKIEFKLPLFLCAAFQPRSGADSEVAGSSIQNSEHWSEAYTYHQVQENEYSCKTDKELCLCTYIFSGYIGQIQEN

SEQ ID NO: 144652 - protein, 326 aa, Glycine max
  Coding DNA Sequence Number=SeqID_52967
  Homolog annotation: Hit_ID=Q9SH74; Match level="QueryCoverage=79%, HitCoverage=57%, E-value=5e-07, Identity=22%"; Hit description =Putative replication protein A1
MEDSVHITNLREVRKQAIEMVLMDQTVIVVFFLFVVISHFYYNLWGGATPYFSGQDIVGVVADLIDVKTVNPPHKMTVRLRDNRLATTNMEDYTIQLHHAIDKNLLLQEPLIVMLSLGKIKDATDKYPLSIQNIKYGSRLYVNTDIAEIQQFRDSLCVPFYSGGIIDDKGGSQSQSSQINLVEKFLHNAQVVSIGEINNLKQDYYCLTVGTVDEIIIDAPWSYDSCPYCTTTFDPSKVGSACRSCQNRVNDTIPRYKLNVRMKHNGDKGNFLFWDATCIKMFGKTVAKCRDELIAAGDDIKVFPPCVDEILSKTWTIRFKYHSQLR

SEQ ID NO: 144653 - protein, 364 aa, Glycine max
  Coding DNA Sequence Number=SeqID_52968
  Gene Ontology: Mol. function=oxidoreductase activity; Cellular component=cytosol; Biological process=metabolic process
  Homolog annotation: Hit_ID=A5BKL3; Match level="QueryCoverage=99%, HitCoverage=98%, E-value=1e-137, Identity=67%"; Hit description =Putative uncharacterized protein
  Pfam annotation: Domain name=ADH_zinc_N; Domain location=152-321; Score=80.0; E_value=7.9e-21; Accession=PF00107.17; Description=Zinc -binding dehydrogenase
MTQVRNKQVVLRDYVTGFPKESDMNIVEGTIILKVPEGSNDVLLKNLYLSCDPYMRLLMAKDRSFGDGSFTLASPLKGYGVSQVLESGRPDYKKGDLVWGITKWEEYSLVPSSLIHFKIEHTDVPLSYYTGILGMPGMTAYAGFFEVGSPKKGDTVFVSAASGAVGQLVGQFAKLTGCYVVGSAGSKEKVDLLKNKLGFDEAFNYKEEPDLNAALKRSKVTVPSNMIKQLKVDINIQIRYFPEGIDIYFENVGGKTLDAVLPNMKFHGRIPVCGMISQYNLTQFDGVTNLANLIFKRVKMEGFIATDFYHLYPKFLEFVLPHIREGKVVYVEDIAEGLENGPAALVGLYTGRNVGKQVVVVTHK

SEQ ID NO: 144654 - protein, 92 aa, Glycine max
  Coding DNA Sequence Number=SeqID_52969
MVNPTQFQAKEEKVKATDDSLSKVDPLSKMHPLSEASSSLSGWETLEEDKPEICMPSTQPACPVRTLSLLTLSAPILAKQKFTNSRLVSHAR

SEQ ID NO: 144655 - protein, 88 aa, Glycine max
  Coding DNA Sequence Number=SeqID_52970
  Homolog annotation: Hit_ID=A5BPC1; Match level="QueryCoverage=50%, HitCoverage=3%, E-value=2e-09, Identity=70%"; Hit description =Putative uncharacterized protein
MVVVTIGRRTQGMLPLFKMMAKSAEALVVSEKNPETKWIMDSENGIARHRIVAGTPQQNGLAKRFNMTILERVGCMLLSAGLPKIFLG

SEQ ID NO: 144656 - protein, 58 aa, Glycine max
  Coding DNA Sequence Number=SeqID_52971
MSGEANDHGVTWSWRWRRALFKREEVVVQQMEALLSMVDPGKATYSCGSSEDGGYGGG

SEQ ID NO: 144657 - protein, 312 aa, Glycine max
  Coding DNA Sequence Number=SeqID_52972
  Gene Ontology: Mol. function=oxidoreductase activity; Cellular component=cytosol; Biological process=metabolic process
  Homolog annotation: Hit_ID=A5BKL3; Match level="QueryCoverage=99%, HitCoverage=98%, E-value=1e-126, Identity=67%"; Hit description =Putative uncharacterized protein
  Pfam annotation: Domain name=ADH_zinc_N; Domain location=153-298; Score=88.3; E_value=2.4e-23; Accession=PF00107.17; Description=Zinc -binding dehydrogenase
MAEVRNKQVVLRDYVSGFPKESDMNIVEGTTILKLPQGSNDVLLKNLYLSCDPYMRMLMTKVEGLDVFGTYTPGSPLTGYGVSKVLESGHPDYKKGDLVWGSTKWEEFSLVSPTQILFKIEHTDVPLSYYTGILGMPGMTAYAGFFEVGSPKKGENVFVSAASGAVGQLVGQFAKLTDCYVVGSAGSKEKVDLLKNKLGFDEAFNYKEESDLNATLKRYFPEGIDIYFENVGGKTLDAVLPNMRVLGRIPVCGMVSQYNLTQPEGVTNLANLIFKRIRMQDIAEGLENGPAALVGLYSGRNVGKQVVVVARD

SEQ ID NO: 144658 - protein, 111 aa, Glycine max
  Coding DNA Sequence Number=SeqID_52973
  Homolog annotation: Hit_ID=A7QVN6; Match level="QueryCoverage=100%, HitCoverage=77%, E-value=3e-17, Identity=40%"; Hit description =Chromosome chr14 scaffold_190, whole genome shotgun sequence
  Subcellular localization annotation: CTP_CleavageSite=71; ConfidenceScore=5.31e-01
MYLAAIADSQPQPSPLAGQPFSVLQQQQGMHNQLGMSSSGSQGLHMLQSEATNVGGNATIGTGEGFLDFVRIGSGKQDIGISGEGRGENSSGHSGDGGETLNYLKAAGDGN

SEQ ID NO: 144659 - protein, 185 aa, Glycine max
  Coding DNA Sequence Number=SeqID_52974
  Gene Ontology: Mol. function=cellulose synthase (UDP-forming) activity; Cellular component=membrane; Biological process=cellulose biosynthetic process
  Homolog annotation: Hit_ID=A7PBB7; Match level="QueryCoverage=90%, HitCoverage=17%, E-value=6e-64, Identity=65%"; Hit description =Chromosome chr16 scaffold_10, whole genome shotgun sequence
MNWSDPCLQDLRDKIFPFEEQNASVKLNIYRKKNFSQNIKISGTIHPQMAGAKGSSCAILGCDSKVMSDERGVDILPLKIGGGICPGCKEPYKNTKLDEVAVDNGRPLPLPPPSGMSKMERRLSMMKSTKSALVRSQTGDFNHNRWLFETKGTYGYNNAIWPKEGSFGNEKEDDFVQPNELMNKP

SEQ ID NO: 144660 - protein, 111 aa, Glycine max
  Coding DNA Sequence Number=SeqID_52975
MGDIDVLHELYYNECKKFSQERKVFSFQLPLEQLVNDKHKHKPHITKVYTCKHPRGANHPTVTTHPKGARSEDVNQGDMTLGNSHNQPKGDMTLENSHNQSKKCESRGHDP

SEQ ID NO: 144661 - protein, 573 aa, Glycine max
  Coding DNA Sequence Number=SeqID_52976
  Gene Ontology: Mol. function=heat shock protein binding; Biological process=protein folding
  Homolog annotation: Hit_ID=A7QN73; Match level="QueryCoverage=15%, HitCoverage=69%, E-value=1e-29, Identity=63%"; Hit description =Chromosome undetermined scaffold_131, whole genome shotgun sequence
MTADTFTIVSQKLILTLVVAPTVAVATKKATEGVPGVGRLVQKIPNSVYASLVTIAADAQVRKNKLQCYADIDSGLWGWSCKSTMIARENCALRCLSPACYELIYESDPLEEGEKDFIRSQEYKYCMHKKLDDKNFLLWRQEIEPAIIALGLNHFVAKTRSVSPCLASVYAFELNACLSSWIETLVSELRHTMLDYRPVSDFLSWIKALIDALASVVIYHTSPLKKLKDRFLSGSYVFANTPDLNLEVTSSRQHILQIREVLVAIMAVAEAVSTVVVVVAVGAQSCVKLVNHNHTALTCYNRFNPQYQAANGGNNSNYGNNNNGNYGNNENHNNWSHNQNQNQNWEKSESQLQNSNSRPPQAMVANLLGDCAGSGDCETAMSELGDSIEEKDAVGTELEEVRFTVGMKQLLEDSSLVYLRSRSSCARMYPLASSMVMCGRRLSIRGNGRVKIPRKSFLNPIHMLAIASCDRALIGAVTPMLASSDENTCVFCLIPDTSVSIQELKQASSLKRRLKPNKEKLILFLPHQEKRIVAIFVGKVSRRDLRTRNKVIESKRSDRWLDLLSPQQEVLII

SEQ ID NO: 144662 - protein, 154 aa, Glycine max
  Coding DNA Sequence Number=SeqID_52977
  Pfam annotation: Domain name=zf-GRF; Domain location=42-77; Score= -0.7; E_value=0.038; Accession=PF06839.3; Description=GRF zinc finger
MILNPKGGIWEFQTLKEALGMMGERMNGKGGLSSSSSSPAMVKCKCEVPTIMLMLRGVNHLGRRFWRCPYCNEAKTNAKEITDLRGKIVAQEEECHASSVEVVQLKSKIGRKKKNLVAERNRMKLLGFVVVVLWVFISLLSIVIAMNVGGHRRN

SEQ ID NO: 144663 - protein, 185 aa, Glycine max
  Coding DNA Sequence Number=SeqID_52978
  Gene Ontology: Mol. function=signal transducer activity; Cellular component=integral to membrane
  Homolog annotation: Hit_ID=A7QDS1; Match level="QueryCoverage=92%, HitCoverage=27%, E-value=3e-48, Identity=58%"; Hit description =Chromosome chr15 scaffold_82, whole genome shotgun sequence
MQVIAEAEKGESVAMLLSPSCSPALSDCSHNSNGSLFTMFLTAPLQAFCMLLGLSGTDIDLDTFNKAEMLLSSSLNNWGLALATSDTLNPVWGQILGDPFIRRLLLRFIFCQAVLTLYAPVYNDNKFLPTCVPSLPTPVLPPSYSYQSVILNLASMFGATKRFIFSEDVLPESFVPMTRKPLTWI

SEQ ID NO: 144664 - protein, 229 aa, Glycine max
  Coding DNA Sequence Number=SeqID_52979
MHYKNKKRMQKKGKVVYVCCSRVYDEVGSLFIAEEEKVHKKNLETYELLIRLTHTDHQSVWPYELAIRMQAERRSNVREKQKEEAEEQEAEDEEEEADVAQVTHMDKSLLLFILNRCLSKNAGCPKQHSHIKGSSELLVLTSATRPTCICMPPPQALSAAVKVKVPASSVTVVGGGKRGTQMVVSVADMDEDEWMYEIMSERADMDYENVESCGANEPHVDCSNAFKTS

SEQ ID NO: 144665 - protein, 231 aa, Glycine max
  Coding DNA Sequence Number=SeqID_52980
METLSQMLVHSKFWSLPTIMRNDDVAQQESPNWVISRCWTKLWVFPPLTRSTTWWLEMRPTNRIASGAKWPAKKFRLIWAGVFCLRDEKENPRGTTVTSVGESVIMVEGVLREEETQWLDWVSCEEETKGVAERVATATDEHPRASLPAASPVRQLGLESGAGEPAPLDESPGLNKALVGSSYCDGAKRVCKACRNPGQEEQRAGDGGLVVVVQWKMELTEKLCEGAHPFL

SEQ ID NO: 144666 - protein, 90 aa, Glycine max
  Coding DNA Sequence Number=SeqID_52981
MGRTSTWVVVINTLEGTSFVVQVEDTSTWVVVTENKRGYISCGLVQVEGTSTWLFKENKGGYIPCGSLLVKDFTRLKRNLKDRRSLGDWM

SEQ ID NO: 144667 - protein, 80 aa, Glycine max
  Coding DNA Sequence Number=SeqID_52982
MSDQVGKEGASASNPLRDWGLGFPPMRETTVKECGWARVRGACLFNKCIAKEKMSDQVGKEGASASNPLRDWGLGFPPMR

SEQ ID NO: 144668 - protein, 75 aa, Glycine max
  Coding DNA Sequence Number=SeqID_52983
MAIVESWTWGSLELKVFLVDDSMHGGLVAIMWKRLIIEGEIVGVQFDLVTGLDEYDAVGGVSMDMGICCIESLLG

SEQ ID NO: 144669 - protein, 121 aa, Glycine max
  Coding DNA Sequence Number=SeqID_52984
MGDLLGSFPESVTNQAKAGGHVIPKTPELDGSGGYAGMDSIVDDDLKELIGTTYTNKMHLLFSSILHKNSIVKHVWHGVVMGWVTFWEVSQKAFIDPESMRNILFRSQKGLSRRALTGERF

SEQ ID NO: 144670 - protein, 424 aa, Glycine max
  Coding DNA Sequence Number=SeqID_52985
  Gene Ontology: Mol. function=asparaginase activity; Cellular component=cytoplasm; Biological process=glycoprotein catabolic process
  Homolog annotation: Hit_ID=A7PZ85; Match level="QueryCoverage=99%, HitCoverage=98%, E-value=1e-143, Identity=61%"; Hit description =Chromosome chr15 scaffold_40, whole genome shotgun sequence
  Pfam annotation: Domain name=Asparaginase_2; Domain location=4-346; Score=7.2; E_value=3e-12; Accession=PF01112.9; Description =Asparaginase
  Subcellular localization annotation: CTP_CleavageSite=26; ConfidenceScore=5.02e-01
MEGKRYFVAVHVGAGYHSPSNDKALRSAMNRACLAAASVLSNGSGTRLDAVVAAIQVLEDDPCTNAGRGSNLTEDGGVECDASVIDGKSGAFGAVGAVAVYYARGTLAKANALFLPLLLLSGVRNAIQIAALLAKEQMMGSPLLGRIPPIFLVGEGACKWAKSKDIALPPSIEEANEWLVTERAKAQWIKYKSMVESARSKTENTPEGDSSVYQNATVPDCALEDRVMDTVGVICIDNEGHVASGASSGGIALKVSGRIGLAAMYGSGCWASSKGPFGAPFMAGCCVSGAGEHLMKGFAARECCVSLSLKSREYIIDEYQSSQSGAASACTKILRSVVEDGRQCGTDSSAGILVVQSDASLTDQGKSSRLKAVEIAAAYTSLSFGVGYFGSSMERPKVSILRSTKQQSKTAIDQFGARIDLSNG

SEQ ID NO: 144671 - protein, 311 aa, Glycine max
  Coding DNA Sequence Number=SeqID_52986
  Gene Ontology: Mol. function=hydrolase activity; Cellular component =soluble fraction; Biological process=proteolysis
  Homolog annotation: Hit_ID=A7R164; Match level="QueryCoverage=95%, HitCoverage=80%, E-value=1e-128, Identity=71%"; Hit description =Chromosome undetermined scaffold_339, whole genome shotgun sequence
  Pfam annotation: Domain name=Abhydrolase_1; Domain location=118-310; Score=19.4; E_value=0.00014; Accession=PF00561.11; Description =alphabeta hydrolase fold
MVTKYVLVQDYLLDAPVSVGDGFSFSGGKYSDGPSPSDEWFKQGKKVKAYSIPGTGEKAKDPIFGLAMGSGSQATGDRFRWFCVESGSADNPSVILIHGFPSQAYSYRKVLPVLSKDYHVIAFDWLGFGFSDKPQPRYGFDYTLDEYVSSLESLIDELAATKVSLVVQGYFSPVVAKYASIHQEKVRNLILLNPPLTAQHAKLPPTLSIFSNFLLGEIFSQDPLRASDKALTSCGPYKMKEEDAMVYEDPILHLRYVEDMQTILKDKNWKVQTTICWGQRDRWLSYDGVEDFCKDSNHKLIDVPTARSMHS

SEQ ID NO: 144672 - protein, 259 aa, Glycine max
  Coding DNA Sequence Number=SeqID_52987
  Gene Ontology: Mol. function=protein binding; Cellular component =intracellular; Biological process=protein transport
  Homolog annotation: Hit_ID=Q3EBA7; Match level="QueryCoverage=91%, HitCoverage=96%, E-value=2e-54, Identity=49%"; Hit description =Uncharacterized protein At3g07525.2
  Pfam annotation: Domain name=Autophagy_C; Domain location=107-252; Score=38.7; E_value=8.1e-09; Accession=PF03987.6; Description =Autophagocytosis associated protein, C-terminal domain
MDLKDDAVKGIVPWDGTLSSFDFSLSAHTFSDKWKRFNPSFPAWQWITCPKQHHLVASHKVEGYLSLENMCHIKSSQEQESDRSLTWKEESNISQREEPFDKATLVCPEHEVNHYDFHIVYSASYRVPVLYFRSYRSDVDTRNASYINNPAQFIAYDGQLLPFNEIEKDLPGHSAKLRSESKWTFITHEEHPYLNRPWYKLHPCGTSDWMKLLFHSDSSLNKNGFVIEQYLISWFSVIGQVVGLKIPLEMLDTVVSNDS

SEQ ID NO: 144673 - protein, 193 aa, Glycine max
  Coding DNA Sequence Number=SeqID_52988
MATSSPVPSPSSPTPDSIQIQTKVVAGELIAGEGEVLEVLPGAVLGRDLVGEEVADEVKVAEEGHGKKLRVLFELKLKRKTMFKGNNNKEFQFLGGDENFAPKDFPLPMLSPVKDIELDIGLGWDGEKKTIAASDEWWEAKIQAEASRTCLRTFASSSDILCARSAIRYKLAAKKIVANANTPATENNPSLML

SEQ ID NO: 144674 - protein, 147 aa, Glycine max
  Coding DNA Sequence Number=SeqID_52989
MTRDNPSNLQPFDPEIDRKFHRLVRHHFVPFEHPEHSVIGETEHFVVGNFEHPGFEHYSFEYSDFEHSENMTKPPPRERTLREMAAPDFTYESLCIQYPDEDVPYVLKTGLIHLLPKFHGLAGFSSFSGGSGKGLAILPCSKIHHEL

SEQ ID NO: 144675 - protein, 90 aa, Glycine max
  Coding DNA Sequence Number=SeqID_52990
MDEDQWRYLVLEMMFCSGLAHENGFVAVIMRFDTETGSKGRNSFVLIGCERSGTYKCRNKEFVRKDTGSRKCGCPFRLVGNQCMEGKVGR

SEQ ID NO: 144676 - protein, 70 aa, Glycine max
  Coding DNA Sequence Number=SeqID_52991
MESGGRRRYLMVIRTFRNQGQKSQLVFALVVQKTFKPNDARDSSLMGGDDQVRWRREVSWLSPLYRFQRH

SEQ ID NO: 144677 - protein, 97 aa, Glycine max
  Coding DNA Sequence Number=SeqID_52992
NRKSAQYANRLSPRVGRFINAAGTTGFPTGKRAVSATQLIYDHDYEFELGTPGELEQEALAQNESNANAPTRPEKYKPEGKKAVGCICVHIYTQGIL

SEQ ID NO: 144678 - protein, 106 aa, Glycine max
  Coding DNA Sequence Number=SeqID_52993
  Subcellular localization annotation: CTP_CleavageSite=79; ConfidenceScore=5.14e-01
MPISPCKSISWDRTQETPSGPGKVQQGPGVSSSGYGPLSVLQGARTPPTRSHHHRDRACKTPSGPEEVQQGLGVVRDLQAIMRPAKDVKEALLGGNLVPFESVLVI

SEQ ID NO: 144679 - protein, 93 aa, Glycine max
  Coding DNA Sequence Number=SeqID_52994
  Subcellular localization annotation: CTP_CleavageSite=66; ConfidenceScore=5.40e-01
MGKDRTHKTPSGPGKVQQGPGVSSSGYGPLSVLQGARTPPARSCHPDIVLRSACRPNKVIRPRINRAFIKKYCAPDGRRARHHSSIGMAGSGQ

SEQ ID NO: 144680 - protein, 70 aa, Glycine max
  Coding DNA Sequence Number=SeqID_52995
MEVDEPWLGLWPPLNYQVVFVIGSAVEDFVVDLGMAFVDKWAAGTAVIAWVSPSSSPSSFAPVFSFVQAG

SEQ ID NO: 144681 - protein, 107 aa, Glycine max
  Coding DNA Sequence Number=SeqID_52996
MPAVRGEKVASAQDFGWQSKGDGHFGSWFPFFFVYLVTILYCSDIVWSEDLSGWQGLTFSPWVKVYDKLGFWLKACRTVGHHICQGFASGSGIKGMSYIISMIHMQQ

SEQ ID NO: 144682 - protein, 192 aa, Glycine max
  Coding DNA Sequence Number=SeqID_52997
  Homolog annotation: Hit_ID=UPI0000ECBAF8; Match level="QueryCoverage =21%, HitCoverage=48%, E-value=2e-16, Identity=100%"; Hit description= UPI0000ECBAF8 related cluster
FQLVPTIEEFEEILGCPLGGRKPYLSSGCLPSLSRIATVVKDSARGLDRIKQTRNGITGLPQKYLEDKARGMAHQGDWVPFMDVLALLIFGVVLFPNVDGLIDLAAIDAFLAYHHSKESPVVAVLADLFDTFDRRVDLQGMQAWHWPSFYNVVTGKTLALPNLIALQHIPLSPAGVIAKRPAPIALPNSCAA

SEQ ID NO: 144683 - protein, 81 aa, Glycine max
  Coding DNA Sequence Number=SeqID_52998
MLQCEGFSSKLRYDFEISNGENVQNLVVNMILKFHDDPTVNEFEIVVFLRQVWWAAGKRKGFERRRGKTKMRQKKEATDLT

SEQ ID NO: 144684 - protein, 164 aa, Glycine max
  Coding DNA Sequence Number=SeqID_52999
MDLIENKAASDIAILRDRAHIPTKKSLLELTSQDALLAHNKLLSKQLEALIETLRCAICGRAHNSGCCIPNEEQAHEVNYMRNQPRLNFNAGGYSEFQHGQPYNSQQRQWQNHPGNQFKKDQGGPSTRPQQQRPSLYDRTTKLEETLAQFMQYLCLTRRAWSLP

SEQ ID NO: 144685 - protein, 297 aa, Glycine max
  Coding DNA Sequence Number=SeqID_53000
  Homolog annotation: Hit_ID=Q6Z8F0; Match level="QueryCoverage=21%, HitCoverage=58%, E-value=4e-21, Identity=79%"; Hit description =Putative uncharacterized protein P0459B01.18
  Subcellular localization annotation: CTP_CleavageSite=79; ConfidenceScore=5.43e-01
MTSPRAYQQPGLGPPSQSASVNVPSRSADRLSPFHIRPGHIAGPHPLPSRQFQALFDSLFKVLFIFPSRYLFAIGLSPVFSLGRNLPPDWGCIPKQPDSPTAPRGATGSGHDGALTLSGAPFQGTWARSATEDASPDYNSDAEGDRFSWWAFPGSLAVTKGILRVAPPDLRSRWERACTQRVVDGSRTDRLARDWSRAWLIHHFITAKSAMNPDFKPTTRRVLAGGRRALGLMASGATCVQRLDGSRDSAIHTKYRISLRSSSMQEPRYPLPRVIVCKCCVVTTPAGHRLRAPGSRT

SEQ ID NO: 144686 - protein, 183 aa, Glycine max
  Coding DNA Sequence Number=SeqID_53001
MAPNNNRRAPVVGARKKEGDAHAVTTAPTPRRDPYKYAQHPKDNFPPIPMAYSELWPSLLENHLVVAIPGKEEGPNVKTNPLASHGGASVNVIEEDGPSRTKRLGDVATSRRFIYQSLQAACMVSRGGGERDECLFHLGESHDMETCPAVEELLQRLMDCGQLEVSIGGREEPQICMQSEEKK

SEQ ID NO: 144687 - protein, 58 aa, Glycine max
  Coding DNA Sequence Number=SeqID_53002
MDTSKPYTGAMRGTIRSSHPIGSLLHGHDERQRLVTSKPYTGAMEGTVHEPQANLEAD

SEQ ID NO: 144688 - protein, 69 aa, Glycine max
  Coding DNA Sequence Number=SeqID_53003
MKVSKDYLNFQPYTLEGAEANKWRWFEGVYFYVDAASRIGEIAVPPSALVRMLLTCTDAAIHNSEKLVD

SEQ ID NO: 144689 - protein, 61 aa, Glycine max
  Coding DNA Sequence Number=SeqID_53004
MENCTKQSLHMAPKLEEINTHGSKLEGGGHMNENANSWGSEKRLRMENCTKQSLRMAPKLE

SEQ ID NO: 144690 - protein, 173 aa, Glycine max
  Coding DNA Sequence Number=SeqID_53005
  Subcellular localization annotation: CTP_CleavageSite=41; ConfidenceScore=5.61e-01
MAEPSKKRKRSSSTAAVAAHRRHKPSKASTAPIHPSLSSPRSSTLFSSDDQRLRYLSQFSSRIILDPKYLDVEFFNDEMFDCYQVFQNSGLVDFMSLKLPHYPELVKVFYCNLKIQDGIISSEVHGIPMIIDQSLFFSLTHLPSQGAPFEGTIVDDWKFDYSSHDARRMVCDD

SEQ ID NO: 144691 - protein, 309 aa, Glycine max
  Coding DNA Sequence Number=SeqID_53006
MVLAEGETLLAYSRYCRLPTDFREIEAALCIPGRGFILNSEGHPGRILKKDLTTLAQVWSVLSYSNLAPTSHTSDLTVNRARLIFGLVSHLDMNIRALISGQITSIAQSNTSRLGFPALIIALCRARGVVSDSLTFKRLSPVINLAYIRKNNWNPEDLTVSIRGARRARARLAKLPSTSAAPTPTSTSAAPSIPAQTNSQCFEAMLQSIHQGKIILLQSLQMMAPPDSIPTVEQFNEMVVWTGTQSSLHKEDKGPTAQVPQHMEDESSEATIPKPFDIGEEVEETQVRQVATTIPERSLEATSEPFSPV

SEQ ID NO: 144692 - protein, 231 aa, Glycine max
  Coding DNA Sequence Number=SeqID_53007
  Gene Ontology: Mol. function=nucleic acid binding
  Homolog annotation: Hit_ID=Q2AA09; Match level="QueryCoverage=72%, HitCoverage=54%, E-value=1e-09, Identity=29%"; Hit description =Retrotransposon gag protein
MDISMIDAANGGALGDMTPAEARNLIENMASNSQQFSARSDAIVIRGVHEVATNSSSSAETKKLEGKLDALVNLVSQLAMNKKSAPVARLGGLYSSADHHIDLCPSVQQSEAIEQPEAYAATSITDLLNLSSKISHTNNYDLSSNRYNPGWRNHPNLRWLNPSQQQQQQPYFQNAAGPSRPYVPPPIQLQQQQQPQKQQTVEAPLQPSLEELVRQITMQNMQFQQETRAFI

SEQ ID NO: 144693 - protein, 374 aa, Glycine max
  Coding DNA Sequence Number=SeqID_53008
  Homolog annotation: Hit_ID=A2Q186; Match level="QueryCoverage=35%, HitCoverage=38%, E-value=9e-16, Identity=28%"; Hit description =Reverse transcriptase-beet retrotransposon, putative
GGTDVRCCDLRPLGNIQADVTPKEKSKGTVEGMLGSSFGKLNLGDSFAGTEEEAANTKEVTCYNTLHDDRRHRNHIEGKYLNGGAKVAADQTFIGEEEGHVTQSLSPSLSGQIQQGIGPGCIKGPISTQGGCNKEDIHPVELLGVQAVQNKKEGGLSNDLGPILKTDGCHKKESLPIEEKHPQLQDGIQALADQLANQDKVKNQSYVDSERRLKSIIECSDKVLQEAQQLWHLGENLGMETALWGQSDFDWKWFPAVNTAGGLFCVRNNNNFQGVWLVESQRVVVANIYASCELESKRQLWQRLYLMKNQSQVQCWCLVGDFNCIKHPAERMGSTLCNADTNLIAEFNEWLAEMEVDDIPCLGKPFTWVRPNGS

SEQ ID NO: 144694 - protein, 312 aa, Glycine max
  Coding DNA Sequence Number=SeqID_53009
MAPRKLTSKRSRKDKAVEGTSSAPEYDSHRFRSAVHQQRFEAIKGWLFLRERRVQLRDNEYTDFQEEIGRRRWASLILGKGVSGSRLMPTLSPTPRISVGVEEGQECEYGQRRNRSDGFDEEAIAQLLCIPGQDFARTAAGRRVRIMRTNMTTLTQIWMTLLLSNILPTDHNSDLPMPKCQLVHPLDPDKSNRALGFPALITGLCQSFGVPVAPTKVIRPPITRAFIEKYCTQRQAQGDAPQAAGAPPPPHQAGQAGAFDMEQYLRHLVRQQAANHRAHVRTHDCLYQMSLSMQSQGFAPFSCPTPDQFRAE

SEQ ID NO: 144695 - protein, 67 aa, Glycine max
  Coding DNA Sequence Number=SeqID_53010
  Homolog annotation: Hit_ID=A5AYU6; Match level="QueryCoverage=79%, HitCoverage=9%, E-value=3e-09, Identity=49%"; Hit description =Putative uncharacterized protein
MAKNYESDEEDSLKKSWYIDSGCSKHMTGDASKFTHISPKKSGHMTYGNNNKVKMMILGYGIKGLPI

SEQ ID NO: 144696 - protein, 354 aa, Glycine max
  Coding DNA Sequence Number=SeqID_53011
  Gene Ontology: Mol. function=hydrolase activity, hydrolyzing O -glycosyl compounds; Cellular component=outer membrane; Biological process=peptidoglycan turnover
  Homolog annotation: Hit_ID=Q1GXY9; Match level="QueryCoverage=91%, HitCoverage=77%, E-value=5e-98, Identity=54%"; Hit description=MltA
  Pfam annotation: Domain name=3D; Domain location=297-354; Score=57.8; E_value=3.8e-14; Accession=PF06725.2; Description=3D domain
  Pfam annotation: Domain name=MltA; Domain location=119-276; Score =295.1; E_value=1.4e-85; Accession=PF03562.8; Description=MltA family
  Pfam module annotation: Pfam domain module=3D::MltA; Domain location =297-354::119-276
  Subcellular localization annotation: CTP_CleavageSite=32; ConfidenceScore=5.05e-01
CQSVPPATQSHPPSTEKPASVTPPVPPPAQPYALLKAASWTDLPGLESEDWLTSWNAWLQSCQGLKNKPDWQLVCAAAQNVNKDAQAIQAYWQQYFNVYQTQQVDGAQQGLITGYYQPVLKGARHASARYPVPLYKAPSDLITVNLSALFPELKYKRVRGRLQGQSLIPYYTRSEIEQSQSPLAGNELLWVNDPVEAFFLQVQGSGIVELENGERLPVGYADQNGHPYQSIGKLLVDRGEMVASEASMQGIKIWAAQHPEQLRGLLDANPSYVFFKLLPAGLSGPLGALGVPLTAARSLAVDPFYIPLGAPVYLASTYPNSQALLQQLMMAQDTGGAIKGGARADVYWGDGESA

SEQ ID NO: 144697 - protein, 124 aa, Glycine max
  Coding DNA Sequence Number=SeqID_53012
  Homolog annotation: Hit_ID=A5C5C1; Match level="QueryCoverage=30%, HitCoverage=4%, E-value=2e-10, Identity=76%"; Hit description =Putative uncharacterized protein
MDKCQRRSPQTRSPQCGCSHGSAGDFDTRRKKKNDRVQAQGERRRTIGFKRGLCNFKSLIYNDNNIGFLKLTDVNINYVTSKAVILVVRQLDRNVKIIRYDRCGEYYGRYDETGQHPGPFAKLL

SEQ ID NO: 144698 - protein, 127 aa, Glycine max
  Coding DNA Sequence Number=SeqID_53013
MPPTRHPLDPDKSNRALGFPALITGLCQSFGVPVTPSKVIRPLITQAFIEKYCTPRQAANHRGQVQIHECLYQLSLSQQGAEVALSGDWPEAQAGEAPAGSPSDLEEACMDEEMTDLLDFLGGSGAT

SEQ ID NO: 144699 - protein, 85 aa, Glycine max
  Coding DNA Sequence Number=SeqID_53014
  Homolog annotation: Hit_ID=A6FJQ2; Match level="QueryCoverage=44%, HitCoverage=84%, E-value=2e-11, Identity=92%"; Hit description=50S ribosomal protein L5
MTVKTSDTCSSRRRSQLVCNRMPGADKPMRKEKIPHQAPFAIQAAQLLGRAIGAGLFAITPAGERGMCCKAIKLGNARVFPVTTL

SEQ ID NO: 144700 - protein, 152 aa, Glycine max
  Coding DNA Sequence Number=SeqID_53015
GTGRLWRPLVIDYQSVYSITQRNGSLVIEYQIVMAAQLIHDRVEMECLGGSLGDPRRQYEGADFGARFRFYGYFIGCITDEPGTHASAYCGVDTTHAYTILSSGARPSDREGDEDPLPEVDSPEDVMSASEADSTEDSGPGEMAISGGSSSL

SEQ ID NO: 144701 - protein, 17 aa, Glycine max
  Coding DNA Sequence Number=SeqID_53016
MNDAMRMHETERKQHKG

SEQ ID NO: 144702 - protein, 232 aa, Glycine max
  Coding DNA Sequence Number=SeqID_53017
  Gene Ontology: Mol. function=motor activity; Cellular component=cell projection
  Homolog annotation: Hit_ID=UPI00006A16D8; Match level="QueryCoverage =90%, HitCoverage=95%, E-value=2e-15, Identity=31%"; Hit description =UPI00006A16D8 related cluster
MTDPLNESISCFLIRVDPWVLLPIAIRGLDILAFRGLHTLAFVGLHALTFRGLHVLAFRGLHILAFRGLHVLTFRGLHVLTLRGLHALAFRGLHALAIRGLPVHALRGLHVLTFRGLRAFPFVGLHALTFRGLHVLVFRGLHALTIRGLHVLASRGLHVLAFRGLHVLAFRGPHALAFRGLHALSFRGLHALALRGLHVLAFRGLHAVALTFRGLHALAFIGLHALTFRGLH

SEQ ID NO: 144703 - protein, 150 aa, Glycine max
  Coding DNA Sequence Number=SeqID_53018
  Homolog annotation: Hit_ID=UPI0000ECBAF8; Match level="QueryCoverage =27%, HitCoverage=48%, E-value=1e-16, Identity=100%"; Hit description= UPI0000ECBAF8 related cluster
  Subcellular localization annotation: CTP_CleavageSite=59; ConfidenceScore=5.00e-01
GKRLVIFIVLSGFATSDLSVDFCDARQGGGAYGKTPATRPFYADTARRSRTTERSESVSEEAEERPIRKPPLPAPDNNFTQETSYDHDYEFELGTPHCMQAWHWPSFYNVVTGKTLALPNLIALQHIPLSPAGVIAKRPAPIALPNSCAA

SEQ ID NO: 144704 - protein, 338 aa, Glycine max
  Coding DNA Sequence Number=SeqID_53019
MAPRKLASKRSRKDKAAEGTSSAPEYDSHRFRSAVHQQRFEAIKGWSFLRERRVQLRDDEYTDFQEEIGRRRWTSLVTPMVKFDPEIVLEFYANAWPTEEGQECEYGQRRNRSDGFDEEAIAQLLCIPGQDFARTAAGRRVQIMRTNMTTLTQIWMTLLLSNILPTDHNSDLPMPKCQLVYAILTRMSIHVAQLIVDAIYIFAGMAPTRHPLDPDKSNRALGFPALITGLCQSFGVPVAPTKVIRPPITRAFIEKYCTQRQAQGDAPQAAGAPPPPHQAGQAGAFDMEQYLRHLVRQQAANHRAHVQTHDCLYQMSLSMQSQGFASFSCPTPDQFRPE

SEQ ID NO: 144705 - protein, 107 aa, Glycine max
  Coding DNA Sequence Number=SeqID_53020
GKRPLSLTIAARICTKLLKVHACRSKDFAFDVLMMPYDNDVLMPYENSLLKFNSRQKSKNTRYNIKKISSVLGGEFQIETTKGLAKKFKQKCLFQEIYSLVIDYQRM

SEQ ID NO: 144706 - protein, 144 aa, Glycine max
  Coding DNA Sequence Number=SeqID_53021
  Gene Ontology: Mol. function=RNA-directed DNA polymerase activity; Biological process=RNA-dependent DNA replication
  Homolog annotation: Hit_ID=Q0ZCC8; Match level="QueryCoverage=95%, HitCoverage=19%, E-value=6e-16, Identity=34%"; Hit description =Integrase
MEEAKKEILETFRKVEVNITLLDAIKQIPRYAKFLKELSISKSLKEVKDRLVWAEMFPIEFGSTHTSDFLYELQVEKPSLSTIIQPPTPELEPLPSTLKYAYLDESKSFPVIISASLADEQKEKLLSVLKKHKKAIGWALADIH

SEQ ID NO: 144707 - protein, 151 aa, Glycine max
  Coding DNA Sequence Number=SeqID_53022
MVRWRTDSFKVDGEQREQESLDGEEDSEKEKTARRRRNIPRYGGEGEEAETCDDARVRRTRCSTLDKTMLRWRTDSFEVDEEQREQESLDEEEDSEKEKIARRRRNIPRYGGEGEEAETCDDARVRRTRCSDADRDLQGKRRLKEEESAKA

SEQ ID NO: 144708 - protein, 93 aa, Glycine max
  Coding DNA Sequence Number=SeqID_53023
  Homolog annotation: Hit_ID=A5AV98; Match level="QueryCoverage=100%, HitCoverage=12%, E-value=2e-21, Identity=52%"; Hit description =Putative uncharacterized protein
MTVEDNIKTTLPKTDNAKEFMRLMGECSQTADKSLVRTLMSTLTTMKFNGLRTMHEHVIEMTNIATRLKTLGMTVNENFLVQFTLNSLPSESG

SEQ ID NO: 144709 - protein, 322 aa, Glycine max
  Coding DNA Sequence Number=SeqID_53024
MDFFSNESFECIQAFQNSNLIPFMSLKLPVYSELVKAFYSNLEIQESTLISEVYGIKMVIDQSLFYDLTQLSNEGVPFEGALNDDWKFDYSVHDARRLVCTNQADMTGRLLAGSLAFESRILHYLIVRILLPRSSNLAQRSFLISAAVIASFGYRKEHDDSWVKKCAQPIDDEANLPVGEDSSLLQKILDRFDGLQTYVGERFVIIKKREILEASFMMMNQVDSSSFDDDKDDDKKPKEMISRLSQQGTSFVVQVEGTSTWVVVTENKRGYISCGSVQVEGTSTWLFKENKGGYIPCGSLLVMAFTRLKRNLKDRKSLGDWM

SEQ ID NO: 144710 - protein, 220 aa, Glycine max
  Coding DNA Sequence Number=SeqID_53025
MALRKLSAKRSRNDAAAEGTSAAPEFDSHRFRSTEHQQRFEAIKGWSFHRERRVQLRDNEYTDFQEEIAHRRWTSLVTPMAKFDPDVVLEFYANAWPTEEGVRDMRSWVRGQWIPFDEDTLSQFLGDPLVLEEGQECEYSQRRNRADGFDEEVIAQLLCIPGQDFARTAAGRRVRIMCTSMTTLTQTWMTLLLSNILPSDHNSDLPLPKCQLVCRLPGTL

SEQ ID NO: 144711 - protein, 64 aa, Glycine max
  Coding DNA Sequence Number=SeqID_53026
MWTTTGEVVAAQLAQASSARPGEPGCFLQKQQPSGGIFLEGPSGPGCYLHPPFLLSTPPSAVFW

SEQ ID NO: 144712 - protein, 56 aa, Glycine max
  Coding DNA Sequence Number=SeqID_53027
MRHQSRCTESAPYAAAQLLGRAIGAGLFAITPAGERGMCCKAIKLGNARVFPVTTL

SEQ ID NO: 144713 - protein, 132 aa, Glycine max
  Coding DNA Sequence Number=SeqID_53028
MAPRKLASKRSRKDKAAEGTSSAPEYDSHRFRSAEHQQRFEAIKGWSFLRERRVQLRDDEYTDFQEEIVRRRWASLVTSMAKGGRTRYAILGEGSVDPVRCGCSQPVPGIPFSAGGGPGMRVWPEECECMYT

SEQ ID NO: 144714 - protein, 157 aa, Glycine max
  Coding DNA Sequence Number=SeqID_53029
  Homolog annotation: Hit_ID=Q2A9Z4; Match level="QueryCoverage=57%, HitCoverage=15%, E-value=2e-08, Identity=39%"; Hit description=Zinc knuckle family protein
MTIEESIHVSFDESNAILPRKDFLDDISDSLEDTHIHGNHSKEKDEGRYEDSQDNGARGNNELPREWKASRDHPLDNIIGDISKGVFQNSGLVDFMSLKLPHYPELVKVFYCNLKIQDGIISSEVHGIPMIIDQSLFFSLTHLPSQGAPFEGTIVDD

SEQ ID NO: 144715 - protein, 131 aa, Glycine max
  Coding DNA Sequence Number=SeqID_53030
MVAITPARFPQPPFFRGYDSNATCACHGEAPGHSIEYCMTSKRKDFQVYSSVTALNKWINLTSLSLILSVATYPTAGGRCETRGMRVPRKEYVRSRHQRLFEENVGKTGKDAIYELLSERLGSCIYARGRY

SEQ ID NO: 144716 - protein, 144 aa, Glycine max
  Coding DNA Sequence Number=SeqID_53031
DAGSRQARQGASAGVGGCRGWLNYAASEQIVLRVHHMRAIGAGLFAITPAGERGMCCKAIKLGNARVFPVTTLRAPGSQQIKGTKTTKQGGLCGGWPAVNFDLYVRYGLWLQKGNWEIVEASGNRLPVCVIDYTEEWVTGNRLP

SEQ ID NO: 144717 - protein, 83 aa, Glycine max
  Coding DNA Sequence Number=SeqID_53032
MTRGNPVRDSVHPGHSVHFEHSVEVDSEYSDFEHSTTNFYIENMAQPPPREWNLREMATLISLMKACAFNILMRVFHMFSRLD

SEQ ID NO: 144718 - protein, 114 aa, Glycine max
  Coding DNA Sequence Number=SeqID_53033
MCPPPSRLEPRELISPSACSPILHPQSYSETHELIALALIHVSSTIEAGAPRIDLPSACSPILNTLNSYSETHAIDCLALVHVCSPSIRAGAPRIDCRSAVRLSSTLNSYSETL

SEQ ID NO: 144719 - protein, 55 aa, Glycine max
  Coding DNA Sequence Number=SeqID_53034
MEVKDLIWARLDEGKCDFRNLHFVQNFAVKFVQQDFCTSAEKCYVFAGCGKSNVE

SEQ ID NO: 144720 - protein, 117 aa, Glycine max
  Coding DNA Sequence Number=SeqID_53035
MVAITPSRFPQPPFFRGYDSNAMCAYHGGAPGHSIEHCMTLKRKDFQVYAIIVNHSYNAKMDEFDILVSLILSQTHLCLFNFHRNVSVVKTKMDTSEPYTGAMRGIMHKPQVNLEAD

SEQ ID NO: 144721 - protein, 155 aa, Glycine max
  Coding DNA Sequence Number=SeqID_53036
MTTFTWIWITLLFRASVVLRVPVPPAVVCHRDIGITPTKTPSGPEEVQQGPGGSCLQDTQWTQRSSAGSWSCQALITGLCQFYGVPVTSSKGIRPPTNRAFIKRYCVSRQAQGETPQQPGDGQQRATDTPPSPLDFTSAHPTKRLECCLRPMADQ

SEQ ID NO: 144722 - protein, 107 aa, Glycine max
  Coding DNA Sequence Number=SeqID_53037
MILKDELKAYLRSKRSLSQQLSETEGNMWAVIDECKEKLNLAATHEQRLEDEYAKISAESEARERESRTSPIASQGQSNGGHLLRPQEDPRTSQLLSTYDRLNGPYD

SEQ ID NO: 144723 - protein, 73 aa, Glycine max
  Coding DNA Sequence Number=SeqID_53038
ASQKVTEACKGFLGPDGDWPSSAKAEGSLTARHTRRAGIVVKFEYHVRNPIPNILTVGNFKIISELKRKPFAL

SEQ ID NO: 144724 - protein, 90 aa, Glycine max
  Coding DNA Sequence Number=SeqID_53039
MSLLGDGCPVGQIEIRNQSWKPRALLDFFRVVMLVRMIRTCLFAAVRVKSCPGMHSSSVIASLSGCARTVGPPPISGGGPGTVKRKLLAP

SEQ ID NO: 144725 - protein, 52 aa, Glycine max
  Coding DNA Sequence Number=SeqID_53040
GQNLEVLKGAVVLSGPCRLRAHALLSAASVWLSARLAPSPNPLTHAKREGST

SEQ ID NO: 144726 - protein, 227 aa, Glycine max
  Coding DNA Sequence Number=SeqID_53041
MPLQKDECGIMRTNMTTLTWIWMTLLFSNILPSNHNANLPLQMYQFGLCRHDIGKDCAHKTPSGPEEVQQGPGGFQLLVMGLCQSYRVPVPPARSCHRDIGIAPTRHPVDPKKSNRALGFPPLVTGLCQSYRVPVPPARSCHRDIGIASARHPVDPKKSNRVLELPSSNYESLKVIRPPTNRAFIKKYCVPRQAQGETPQQPGDGRQRATDAPPSPLEFTSAHPQKG

SEQ ID NO: 144727 - protein, 186 aa, Glycine max
  Coding DNA Sequence Number=SeqID_53042
SQLRPHSHRREKERKPQKANINLLYFYGKDNVEAYLDWEIMVEQQLKRKSTSKSYGSHSYPKKDQGSRHLRGHLLSPKMIRGHITSQCPTTKPMIMRGQDIYSSQDEATTSPSSSESEKTKGEESSEEIYPQEEGQPLVVKEKCKEALASIATPLGFEFIPQVKKLLDEGLVHKSLNPCALLVPKI

SEQ ID NO: 144728 - protein, 80 aa, Glycine max
  Coding DNA Sequence Number=SeqID_53043
MGEGCKSSVKQATNCGCCLSYHKDSFHQKQEQALGSLAHPQTLDTNDQLSSTVANRQDVTVINQIFGHPNAMKGFLHHVH

SEQ ID NO: 144729 - protein, 50 aa, Glycine max
  Coding DNA Sequence Number=SeqID_53044
MWDRHRLKRALKPSVFTPKAYTPKSPLGPLPPDLDIAHELYNTHDLTLVF

SEQ ID NO: 144730 - protein, 165 aa, Glycine max
  Coding DNA Sequence Number=SeqID_53045
MFASDHAILRDRVHQPTKRSLLDLSSQDVVLAQNKLLSRKLEILTKTLSKFPTNLSNGQALHPSILQVTGCTICGGTHESGLCIPFEEQTQEVSYMGNQQRQGYNQGGFSGFQHGPYNQQGQWRSHPGNQFNKDQSGPSNRLPQQGPNIFQRTTKLEETLTQFMQ

SEQ ID NO: 144731 - protein, 212 aa, Glycine max
  Coding DNA Sequence Number=SeqID_53046
  Gene Ontology: Mol. function=helicase activity; Cellular component =chromatin; Biological process=protein amino acid phosphorylation
  Homolog annotation: Hit_ID=Q2R1R7; Match level="QueryCoverage=98%, HitCoverage=15%, E-value=6e-39, Identity=37%"; Hit description=AT hook motif-containing protein, putative
IPPTMSKPEQVWDQTWHWMADDIVYNCKKSSTSPVLQLDDRTLQNLVLLEIEELLQANQRSLRDYPSMPYPEDANCPAYLDNSLILAELNYNNQELRSEFEHLFSHMTDEQASIYNQIVEVVNKDEGASSGIASLLLPGGRTAHSKFKISVPVFEDSTCNIHQGTQLAELLNQTSLIIWDEAPMAHKFCFEALDHSLRDIIKHNSKDNKIFG

SEQ ID NO: 144732 - protein, 71 aa, Glycine max
  Coding DNA Sequence Number=SeqID_53047
  Subcellular localization annotation: CTP_CleavageSite=26; ConfidenceScore=5.35e-01
IGFRLLNCSKLLHGRAKASWVTKLTNASSLASRFLVSDDAAEFVATSCTPLMTMASFLALNCWGVGSHLLN

SEQ ID NO: 144733 - protein, 207 aa, Glycine max
  Coding DNA Sequence Number=SeqID_53048
  Gene Ontology: Mol. function=chitin binding; Cellular component =extracellular region; Biological process=chitin metabolic process
  Homolog annotation: Hit_ID=UPI00006A17C9; Match level="QueryCoverage =92%, HitCoverage=100%, E-value=4e-29, Identity=33%"; Hit description= UPI00006A17C9 related cluster
  Subcellular localization annotation: CTP_CleavageSite=19; ConfidenceScore=5.70e-01
MARACSPLKVRTCGPLKVRACSPTKVRTCSPLKVRACSPLKVRACSPTKVRTCSPLMARACSPLKVRTCGPLKVRACSPTKVRTCSPLMARACSPLKVRMCSPLKVREVRACSPLMVRTCSPLKARTCSPTKVKVHDPLKARMCSPQKVRACSPTKVRTCSPLMARACSPLKVRTCGPLKVRACSPTKVRTCSPLKVMVTSIQGEGG

SEQ ID NO: 144734 - protein, 111 aa, Glycine max
  Coding DNA Sequence Number=SeqID_53049
MTNLWLSQCCLAKPRWHPGKGRALLLSHRLSMIPGDSNPWNIDNIMDRRILPERNVKIYHTEFDEFKEELERRNLHKCLTNLQEGSIDVAMVKEFYDKLYNSEDQVPKCAR

SEQ ID NO: 144735 - protein, 53 aa, Glycine max
  Coding DNA Sequence Number=SeqID_53050
  Subcellular localization annotation: CTP_CleavageSite=45; ConfidenceScore=5.28e-01
MHFGYFGQKTRFREEKSSRSASVSKFVKIFLRSSPFFVHSSFVLRSSTVFNVL

SEQ ID NO: 144736 - protein, 305 aa, Glycine max
  Coding DNA Sequence Number=SeqID_53051
  Gene Ontology: Mol. function=transcription factor activity; Biological process=regulation of transcription, DNA-dependent
  Homolog annotation: Hit_ID=Q6DAH7; Match level="QueryCoverage=99%, HitCoverage=97%, E-value=1e-134, Identity=76%"; Hit description =Putative temperature-dependent LysR-family regulator A
  Pfam annotation: Domain name=HTH_1; Domain location=4-63; Score=69.8; E_value=9.2e-18; Accession=PF00126.18; Description=Bacterial regulatory helix-turn-helix protein, lysR family
  Pfam annotation: Domain name=LysR_substrate; Domain location=87-293; Score=153.4; E_value=6.3e-43; Accession=PF03466.11; Description=LysR substrate binding domain
  Pfam module annotation: Pfam domain module=HTH_1::LysR_substrate; Domain location=4-63::87-293
MERLKGMSIFAKVVELGSFTAAARQLQLSVSSISQIVARLEDELQVKLLNRSTRSLGLTEAGKIYYQGCRRMLAEASQVHEQLYAFNNTPIGILRIGCSTTMAQNVLSAMTSEMLHEYPGLSVNLMTGIPAPDLIANGLDVVIRVGELQDSNLFSRRLGAMPMVVCAAKSYLAQHGTPEKPAEIDNFSWLEYSVRPDNTFELVAPEGLVTRLTPQGRFVTNDSQTLIRWLKAGCGIAYVPLMWVIDEINAGEIDILFPQYHSEPRPVYAVYTEKDKLPLKVQVCINYLTEYFRQVARQYQQHRKS

SEQ ID NO: 144737 - protein, 537 aa, Glycine max
  Coding DNA Sequence Number=SeqID_53052
  Gene Ontology: Mol. function=oxidoreductase activity, acting on the CH-OH group of donors, NAD or NADP as acceptor; Cellular component =lipid particle; Biological process=tricarboxylic acid cycle intermediate metabolic process
  Homolog annotation: Hit_ID=A4WF48; Match level="QueryCoverage=54%, HitCoverage=93%, E-value=1e-137, Identity=84%"; Hit description =Malate dehydrogenase
  Pfam annotation: Domain name=Ldh_1_C; Domain location=148-310; Score =249.6; E_value=7e-72; Accession=PF02866.9; Description=lactatemalate dehydrogenase, alphab
  Pfam annotation: Domain name=Ldh_1_N; Domain location=1-145; Score =232.7; E_value=8.1e-67; Accession=PF00056.14; Description =lactatemalate dehydrogenase, NAD bind
  Pfam module annotation: Pfam domain module=Ldh_1_C::Ldh_1_N; Domain location=148-310::1-145
MKVAVLGAAGGIGQALALLLKTQLPAGSALSLYDIAPVTPGVAVDLSHIPTAVKVEGFSGEDATPALHGADVVLISAGVARKPGMDRADLFNVNAGIVRNLIEQVATTAPKALIGVITNPVNTTVAIAAEVLKKAGVYDKNRLFGVSTLDVIRANTFVAALKGKQPTEIEVPVVGGHSGVTILPLLSQVKGVSFSEQEIADLTKRIQNAGTEVVEAKAGGGSATLSMGQAAARFGLSLIRALQGEANVVECAYVEGDGEYARFFSQPLLLGKNGIAERRPLGPLSDFEQQALNGMLETLKKDIAQGEEFVSNSRVKKKRPAHAGRFVLKATGFESPAGSRTVAGRRFAPQRFHPYLERRERHLNAMLFKAAQNQLMQLMTQRHTMAHLRRVHAQLKQLNALLQIHQEHIRRWHIQHVGTAIGRLLQDGRHLFAVNVGRCRNGQHHARHRIRQRPVDELLGDKGLVRHNNLFAVPVGYGGGARIDAGDAAGQIANGHGIADTNRFLKQDDQAGDKVGKDLLHPKAQSQTQRRYQPLQF

SEQ ID NO: 144738 - protein, 477 aa, Glycine max
  Coding DNA Sequence Number=SeqID_53053
  Gene Ontology: Mol. function=phosphatidylserine decarboxylase activity; Cellular component=plasma membrane; Biological process =phospholipid biosynthetic process
  Homolog annotation: Hit_ID=A7MMA5; Match level="QueryCoverage=48%, HitCoverage=72%, E-value=4e-99, Identity=75%"; Hit description =Phosphatidylserine decarboxylase proenzyme (EC 4.1.1.65) [Contains: Phosphatidylserine ...
  Homolog annotation: Hit description=decarboxylase alpha chain; Phosphatidylserine decarboxylase beta chain]
  Pfam annotation: Domain name=Lectin_N; Domain location=226-339; Score= -62.7; E_value=0.049; Accession=PF03954.5; Description=Hepatic lectin, N-terminal domain
  Pfam annotation: Domain name=PS_Dcarbxylase; Domain location=15-249; Score=331.6; E_value=1.4e-96; Accession=PF02666.6; Description =Phosphatidylserine decarboxylase
  Pfam module annotation: Pfam domain module=Lectin_N::PS_Dcarbxylase; Domain location=226-339::15-249
MAEASKPHTGSYRTFNDFFVRPLKEGARPIDPDASLLALPADGAISQLGRIAGDQIFQAKGHTYSLQALLAGNDDLAEKFVDGEFVTTYLAPRDYHRVHMPCNGILREMIYVPGDLYSVNPLTARNIPNLFARNERVICVFDTDHGPMVQILVGATIVGSIETVWAGTVTPPREGVIKRWRYPSADHDGAVVLLKGQEMGRFKLGSTVINLFAPNRVKLAESLEAESKTRLARRQRSAHRLIPGNTAVRASLFLLLSLVLSSTVFAATVPPASQLKQDLETAKSAKSSPSQAEQVQALEAAINFLSERDNSLERAKQYQQVIDDFPRLARELRQQIATLTDSSKPVRSNMSNAELDQEILQLPQQQTDARRAMTESERRAQGVAAAATPLAQAQIYARQTESAASKARVDELELAQLSANNRQELARMRAEVHQRKATQLDNYLALRQPSGAKPNWTWSAPNSACWRTAASWAKRWR

SEQ ID NO: 144739 - protein, 77 aa, Glycine max
  Coding DNA Sequence Number=SeqID_53054
RKERDGSWVKKDIPAQAAKDRSPSPPPQRDDSSSLMKSILDRLDGLHTYVDMDTHIDRLEEDVSFIRQCFDLPPPPS

SEQ ID NO: 144740 - protein, 137 aa, Glycine max
  Coding DNA Sequence Number=SeqID_53055
EIKDVFPKEIPHGMPPSRSIEYQVDLLPEASLANLQQQAPKTQHKDAQTKVEYVKRLYDQVKVQIAKKNESYAKQANMKRKEVVLEPGDDPGHLRANVFQEGGNDENLETGQIQAKGSSGEGRRPKWRRTKPPSGEG

SEQ ID NO: 144741 - protein, 254 aa, Glycine max
  Coding DNA Sequence Number=SeqID_53056
  Gene Ontology: Mol. function=DNA-directed RNA polymerase activity; Cellular component=chloroplast; Biological process=transcription, DNA-dependent
  Homolog annotation: Hit_ID=Q8HVY5; Match level="QueryCoverage=100%, HitCoverage=34%, E-value=4e-90, Identity=80%"; Hit description=DNA -directed RNA polymerase subunit beta
  Pfam annotation: Domain name=RNA_pol_Rpb2_6; Domain location=1-163; Score=-66.0; E_value=5.1e-10; Accession=PF00562.19; Description=RNA polymerase Rpb2, domain 6
  Pfam annotation: Domain name=RNA_pol_Rpb2_7; Domain location=165-242; Score=144.1; E_value=3.8e-40; Accession=PF04560.11; Description=RNA polymerase Rpb2, domain 7
  Pfam module annotation: Pfam domain module=RNA_pol_Rpb2_6::RNA_pol _Rpb2_7; Domain location=1-163::165-242
MTSYGSERITNKIPHLEAHLLRNLDKNGIVILGSWVETGDILVGKLTPQMAKESSYSPEDRLLRAILGIQGYLSRMNVGQIFECSLGLAGASKQTSNPWIFEPEYPGKSKIFDGRTGNSFKQPAIMGKPYILKLIHQVDDKIHGRSSGHYALVTQQPLRGRAKQGGQRVGEMEVWALEGFGVAHILQEMLTYKSDHIKTRQEVLGTTIIGGTIPKPTDAPESFRLLVRELRSLAMELNHFLVSEKNFRIHRKEA

SEQ ID NO: 144742 - protein, 52 aa, Glycine max
  Coding DNA Sequence Number=SeqID_53057
MMQFYPARALDRRLQEDRAKDAREGPRVLKSLRVRNPRNVRFFSPCILGHLD

SEQ ID NO: 144743 - protein, 117 aa, Glycine max
  Coding DNA Sequence Number=SeqID_53058
MQRRSTAGDLIPIDLEINANRIRKLLQDLEAAATPGEELRSSEASSSFPILGQSHTDLIEEVIMAEEPRRVTLEDYSGSIVPQFFSSIVRLEEKLRGGFTRSKATVLRLGMKWLRNF

SEQ ID NO: 144744 - protein, 431 aa, Glycine max
  Coding DNA Sequence Number=SeqID_53059
  Gene Ontology: Mol. function=penicillin binding; Cellular component =integral to membrane; Biological process=peptidoglycan-based cell wall biogenesis
  Homolog annotation: Hit_ID=Q2NVV7; Match level="QueryCoverage=56%, HitCoverage=41%, E-value=1e-122, Identity=88%"; Hit description =Penicillin-binding protein 3
  Pfam annotation: Domain name=FtsL; Domain location=87-157; Score =70.2; E_value=6.7e-18; Accession=PF04999.4; Description=Cell division protein FtsL
  Pfam annotation: Domain name=PBP_dimer; Domain location=193-349; Score=218.6; E_value=1.5e-62; Accession=PF03717.6; Description =Penicillin-binding Protein dimerisation domain
  Pfam module annotation: Pfam domain module=FtsL::PBP_dimer; Domain location=87-157::193-349
FQAIRIWINSELEEIDIALKGALTVLAPGGRLSIISFHSLEDRLVKRFMRDQSRGPQVPAGIPMTESQLKALGGQNRIVIGNERHSLPGVIGGDLLRFGKIPLLLLIAVLVSSVLVVTTTHKTRLLTAQREQLVLERDALDIEWAQPDPRRECAGRSQPGIADLNERRRQNAEVISPDKLVKEGDLRSLRVQEVPTARGMISDRAGRPLAVSVPVNAIWADPKELTEHGGVTVDSRWKALSDALSIPLDLLAARVNANPKGRFIYLARQVNPAIGEYVKKLKLPGIYLRQESRRYYPAGQVTAHLIGFTNIDGQGIEGIEKSFDKWLTGEPGERTVRKDRYGRVIEDISSVDSRAAHNLTLSIDERLQALVYRELNNAVAFNKAESGTAVLVDVNTGEVLAMANSPAYNPNNLSIRRKTSWRNALLPTLQP

SEQ ID NO: 144745 - protein, 105 aa, Glycine max
  Coding DNA Sequence Number=SeqID_53060
  Subcellular localization annotation: CTP_CleavageSite=37; ConfidenceScore=5.37e-01
CSSGVSGFYQLSFLFSTDGVVPLQFGTQAYRAGSIALASVAGANAGRSSAALRIAGAKGRMCHTGDYYVGVTPGSRYRSVVTAASVKVAYNGAEFGLDARILNRE

SEQ ID NO: 144746 - protein, 140 aa, Glycine max
  Coding DNA Sequence Number=SeqID_53061
  Homolog annotation: Hit_ID=A2Q4S5; Match level="QueryCoverage=67%, HitCoverage=14%, E-value=3e-13, Identity=43%"; Hit description=IMP dehydrogenase/GMP reductase, putative
TLQDLSQTGRYAWGAAALVHMYDHLNDACINSSRQLAGYATLLQHFPSVAECIADPDYDEVSPHACRWISMKKTVKTISTKTYRQHLDRLRILDVCWMPYGEHRLFGYIQSIPAQLVNSWESFDEIDDRWMHYSDHLAPA

SEQ ID NO: 144747 - protein, 148 aa, Glycine max
  Coding DNA Sequence Number=SeqID_53062
MVKVGTSYVPINVSFSPKVGPGLPAYRPDISAGKCSLGCDAELTHHPPLNAPLRAALSIRNLSGCATVKTANARAIEAAFAYYARALRGSVILALLCWHDNARVSSRMRSVAEKKRTGASVRICRYRTHIPGIPRSLSSLRSVVTAAT

SEQ ID NO: 144748 - protein, 231 aa, Glycine max
  Coding DNA Sequence Number=SeqID_53063
  Subcellular localization annotation: CTP_CleavageSite=61; ConfidenceScore=5.09e-01
MVKVGTSYVPINVSFSPKVGPGLPVNSYGQVQADFFTFTLEAYRYRRPGFGAKASVSQLIDSSVVMVFFELQWLHVSISCSSCSATDGELVRVQFHTSIRAGHSGQVAKPVVPFAHSDVPTVREGRSVRAFAIPGAKGGCVNWRLLCWVTGRVSSECVLWREKGCTGPRIPSELLPLGRHAAALELVVIPTGRNFRGRKCLPEDKPATASERAAAKPFFHRLRPPDKHHEI

SEQ ID NO: 144749 - protein, 55 aa, Glycine max
  Coding DNA Sequence Number=SeqID_53064
MPTSLERAQMTTLAFAHQSHLGFWVMVTKSGAVDKSEAPAPTYPPMRNSDLRSSG

SEQ ID NO: 144750 - protein, 129 aa, Glycine max
  Coding DNA Sequence Number=SeqID_53065
  Subcellular localization annotation: CTP_CleavageSite=29; ConfidenceScore=5.33e-01
SVTSGKGLALRAGHGGPSPEPVGCRWTARAASAARAGRRVPVGGRIGNGPFGASSPGVEQSTQNCALNVKVKKFNQARVNGGSNYDSLKRGTAPLFGPKVGFGRSIRAEDIVSGEFGWGGTSVKDNAVS

SEQ ID NO: 144751 - protein, 84 aa, Glycine max
  Coding DNA Sequence Number=SeqID_53066
MQKGLWTRQYLNNTELSPSKQGKKGNHDLKWSPLFDCQPKSCLGSSSSMDSLASWKMNGSGMEKEEREETPLQGEDESRRSSPP

SEQ ID NO: 144752 - protein, 169 aa, Glycine max
  Coding DNA Sequence Number=SeqID_53067
KTARKLGGSSTRPQQQMPSLYDRTTKLEETLAQFMQVSMSNQKSTESTIKNLEVQVGKLAKQLAERPSSSFTENTEKNPKEECKVVMTRSRMATQAEEGRSNKKVEGFKQQLADHPALELVDDLVELEEVVEEAKGDEEEETPIRDCQERIKKKEEKQKEIKEEEEKKS

SEQ ID NO: 144753 - protein, 70 aa, Glycine max
  Coding DNA Sequence Number=SeqID_53068
MDWSSSDYDFGLSYHPGVISHAMMTKPVQFLGHVSKDGVAVDNKVESVMEWTTTDKSNGGSKFLGVSWLL

SEQ ID NO: 144754 - protein, 80 aa, Glycine max
  Coding DNA Sequence Number=SeqID_53069
MGSGNAMWLDSHVDLNESSFHGGAWKHIRTLELKWKNRCNSSYFGNVLFLDGGKGYNSAVECHLDVVEVISSSLIIPKPN

SEQ ID NO: 144755 - protein, 79 aa, Glycine max
  Coding DNA Sequence Number=SeqID_53070
MVPPLTSSPLSSTASPWWKITIEGPHLSSKIQPPLKLHKQASIKWYQSTRASNFPPIKLAIEARFDFLWFKFLVLVLEP

SEQ ID NO: 144756 - protein, 88 aa, Glycine max
  Coding DNA Sequence Number=SeqID_53071
MPLSGRARRVRFPKEENARSRHQRLFVENVGKTEGNRSTKAGLLLLRTLHRRGNQTYVVLFKRESSDSFYLEGDHFKVLDLKNDPFTW

SEQ ID NO: 144757 - protein, 16 aa, Glycine max
  Coding DNA Sequence Number=SeqID_53072
LFWLVRYLSRPLANGH

SEQ ID NO: 144758 - protein, 90 aa, Glycine max
  Coding DNA Sequence Number=SeqID_53073
MVKVGTSYVPINVSFSPKVDSGLPGINRDTRIYLFCEVIFRHRYFSAQIASAVLPVQLLTGWCVTAKAPPDISACKCSGHAARNHHTRRA

SEQ ID NO: 144759 - protein, 99 aa, Glycine max
  Coding DNA Sequence Number=SeqID_53074
  Subcellular localization annotation: CTP_CleavageSite=78; ConfidenceScore=5.28e-01
MVKVGTSYVPINVSFSPKVGPGLPAYTPEASAASVAGCQAAANSPPAALNAPLQGALSQFGPCQAAQLLIGKRGRSVRALRVFQGAKGGCVNWRLLCWH

SEQ ID NO: 144760 - protein, 42 aa, Glycine max
  Coding DNA Sequence Number=SeqID_53075
  Homolog annotation: Hit_ID=Q1H399; Match level="QueryCoverage=97%, HitCoverage=21%, E-value=6e-07, Identity=60%"; Hit description =Phosphoheptose isomerase
MAMFQALEPLFPLISDVGNLLRDCIQRGGKVLLCGNGGSAAD

SEQ ID NO: 144761 - protein, 361 aa, Glycine max
  Coding DNA Sequence Number=SeqID_53076
  Homolog annotation: Hit_ID=Q6WAY6; Match level="QueryCoverage=83%, HitCoverage=58%, E-value=3e-36, Identity=29%"; Hit description =Putative uncharacterized protein
MGPLQMQAFRKTYGKILELTLAEVSIEAIASLTQYYDQPLRCFTFGDFQLVPTIEEFEEILGCPLGGRRPYLSSGCLPSLSRIATVVKDSARGLDRIKQTRNGIAGLPRRYLEDMARGMANQGDWVPFVDVLALLIFGVVLFPNVDGLVDLAAIDAFLAYHHSKESPVVAVLADLFDTFDRRRIDWDQLLAGIGGRTINWFPRWKEGKEGVLFSCGGYPNIPLVGTRGCINYNPALAIRQLGYPMRGAPTEESMSPFIVMDFGAQNFKAIQRIHKAWETPLKKDQELRGIRNGIIGGYHQWLKVHIRGLDWLTKLKVVSEESFEAPEEDEEVQALKSELGKAKLAKEKFKLAATHIRKECA

SEQ ID NO: 144762 - protein, 317 aa, Glycine max
  Coding DNA Sequence Number=SeqID_53077
  Gene Ontology: Mol. function=DNA binding; Biological process =regulation of transcription, DNA-dependent
  Homolog annotation: Hit_ID=Q2TTW2; Match level="QueryCoverage=98%, HitCoverage=96%, E-value=1e-93, Identity=57%"; Hit description=ParB
  Pfam annotation: Domain name=ParB; Domain location=186-313; Score =97.1; E_value=5.3e-26; Accession=PF08775.1; Description=ParB family
  Pfam annotation: Domain name=ParBc; Domain location=45-130; Score =45.4; E_value=2.1e-10; Accession=PF02195.9; Description=ParB-like nuclease domain
  Pfam module annotation: Pfam domain module=ParB::ParBc; Domain location=186-313::45-130
MGRTLGNSSFSKMLSETESARTFTLKSGATARFTLTKILHDDIETQTYVDATINGRDQAFLTEESVSDISRTIKLQQFFPAIGREVDGRIEVLDGSRRRAACLYSGMPFEVLVTKDGLSLSDARQLAIDIQTAKEHTLRELGNRLKLMYPEHMNQSDIAAAEGLSPAKVTRAFQAASVPDEMIAVFPSVGELSINDYKTLLDIAEKAASRQISVQELAEGVRERIALDALTEHDDPAVKAKIIGYFRAASAEPKSTRDAKKVVTEKIAEFGDKKQFARKKTDAEKRLVTYEFSRLPVAWQAELDDAVKAVIEKMLAK

SEQ ID NO: 144763 - protein, 172 aa, Glycine max
  Coding DNA Sequence Number=SeqID_53078
MDNEEGVQEQMKADLSALKDQMASILEVMLKLQKTIEDKATTTASSTVREAEPVLQPALNLGRDRNTTVFGRRYSPQAYPYGLPPDFAPCAAPEDLSQAPTFEGQLPPYDDYPEQDDKEGDTHLGPLLHLKDPSPHELPQPNIVRHVPASPTPVKESVPFAEDKGKIEALEE

SEQ ID NO: 144764 - protein, 72 aa, Glycine max
  Coding DNA Sequence Number=SeqID_53079
MFSEGTDWKNNKKPYFPVTGGSALDNGGHMNSARQSIHGALNRMVEDTRTALGNHIRGAPDKIRWLGMHEQR

SEQ ID NO: 144765 - protein, 141 aa, Glycine max
  Coding DNA Sequence Number=SeqID_53080
FSSYRQQKVYTDNHSGISARQRDSKVSMTDLVSAEDDGAEDDISLCVLSGFSSYRQQKVYTDNHSGISARQRDSKVSMTDVVSAEDDAFRLTDNKKFIRITTGLFVLQTAKSVYTDNHSGISARQRDSKVSMTDLVSAEDD

SEQ ID NO: 144766 - protein, 88 aa, Glycine max
  Coding DNA Sequence Number=SeqID_53081
MPTFENRPRRVQRNTRNWNQRGGTQTEAKGRPTLRRKGDAGLTGASSMGGKCVESPPTFIRGKRQKNWKRVFPSLLRILNCDEEIRPT

SEQ ID NO: 144767 - protein, 90 aa, Glycine max
  Coding DNA Sequence Number=SeqID_53082
  Subcellular localization annotation: CTP_CleavageSite=13; ConfidenceScore=5.12e-01
MTIQNMQFQQETRASIQSLTNQMGQMATQLNQACRNMPFLRTSEARLTGALSKGGKMHGVATNIYLWKTSGKPKETGQNENSKFGSCIYV

SEQ ID NO: 144768 - protein, 150 aa, Glycine max
  Coding DNA Sequence Number=SeqID_53083
  Homolog annotation: Hit_ID=A0PAV3; Match level="QueryCoverage=43%, HitCoverage=31%, E-value=3e-07, Identity=52%"; Hit description =Restriction endonuclease
  Subcellular localization annotation: CTP_CleavageSite=96; ConfidenceScore=5.15e-01
MVKVGTSYVPINVSFSPKVGPGLPGINRDTRIYLFCEHRRTSALASVAVTLRVTTTPAALNAPLQGASHSPFRLRNCWEGRSGFPSHDVVKRRPVNCNTTHYRANWSSTAVAAALELVDPPGCRNSIVLQGHITNCLPFSGLSEARLEVG

SEQ ID NO: 144769 - protein, 42 aa, Glycine max
  Coding DNA Sequence Number=SeqID_53084
MSLPSAVHASSIYESGDRIPASQGIHYFSSGRHRGGAPIRPI

SEQ ID NO: 144770 - protein, 108 aa, Glycine max
  Coding DNA Sequence Number=SeqID_53085
CDDLDVELPGCWGSLGGLMGDPVLRETRIWATWEYVSSVGGGQQGMVVVPGDMSWGSGDLGDVRRAPDSQQIKGTKTTKQGRLAWLENEASGNRLPVCVIDYTEEWVT

SEQ ID NO: 144771 - protein, 109 aa, Glycine max
  Coding DNA Sequence Number=SeqID_53086
  Gene Ontology: Biological process=transposition, DNA-mediated
  Homolog annotation: Hit_ID=Q1J7G7; Match level="QueryCoverage=31%, HitCoverage=48%, E-value=7e-12, Identity=97%"; Hit description =Transposase
MVKVGTSYVPINVSIRQKLAQGFPVLQWLLFLSAVPPVQLLTGWCVTAKAPPDISAGKCSGHAARNHHTRRAYCAATGRVPFAIQAAQLLGRAIGAGLFAITPAGERGM

SEQ ID NO: 144772 - protein, 84 aa, Glycine max
  Coding DNA Sequence Number=SeqID_53087
STEPAIKNLEVQVGQLAKQLADRPSSSFGANTEKNPKEECKAVMTRSKMVSMNEGEERIGAEKQQLVTEPTIDPVVEPLSETKE

SEQ ID NO: 144773 - protein, 218 aa, Glycine max
  Coding DNA Sequence Number=SeqID_53088
  Subcellular localization annotation: CTP_CleavageSite=61; ConfidenceScore=5.22e-01
LLIRPALDSFSWGGPFNATPKVEVCGRGAVNYSLGRRRHSCEFSFFYTLCGGRRGVLRNVLSSLRSGEQCLCGFFPGTTTLIWGHIDGSLSNVGKWIRARNGYGPEQQWCSKFGGVHTEPQKEGCPIKEGKKHGPAARTTSERGSLVSHRRKLCQRGLDVRGVGHHDTRRNPLRATELGAAVPSGVRVRELANSQTSQNFCGKRNEFVSPNPIVGPRL

SEQ ID NO: 144774 - protein, 221 aa, Glycine max
  Coding DNA Sequence Number=SeqID_53089
MRSWVRGQWIPFDANALSQFLGDPLVLEEGQECEFSQKRNRADGFDEEAIAQLLCTPGQDFARTAAGRRVRIMRTSMTTLTQTWMTLLLSNVLPSDHNSDLPLPKCQLVYAILTQMSVHVAQVIANVIYLFAGMPPTRHPLDPDKSNRALGFLALITGLCQSFGVLVTPSKAANHRGQVQIHECLYRLSLSQQGQGFAPFACPTPEQFGDEVAWPGDWPEA

SEQ ID NO: 144775 - protein, 87 aa, Glycine max
  Coding DNA Sequence Number=SeqID_53090
MATIALSSRHGSKLAYDTGIWGESYRLFAAKFISWLVGFVVDLGMAFVDKWAVGKEKGWEWQSLHGFLPHPHPLHLPQFSHSSKQDD

SEQ ID NO: 144776 - protein, 206 aa, Glycine max
  Coding DNA Sequence Number=SeqID_53091
  Homolog annotation: Hit_ID=A0ST23; Match level="QueryCoverage=12%, HitCoverage=51%, E-value=6e-07, Identity=100%"; Hit description =Putative reverse transcriptase
VPPVQLLTGWCVTAKAPPDISAGKCSGHAARRVPFAIQAAQLLGRAIGAGLFAITPAGERGMCCKAIKLGNARVFPVTTLANWSSTAVAAALELVDPPGCRNSMPDFQPRTNPTQFNIIIIKNQQGGARYQLLFPLVRVNFELGVIMVIAVSFGKPVVPAALMNRPTRGERRFAYWALAECILAYYVGTDEGVSEVLHVAGEKRLH

SEQ ID NO: 144777 - protein, 109 aa, Glycine max
  Coding DNA Sequence Number=SeqID_53092
MAAEWRRKRERRRHFKEKMSLEEAHHHRRPWIRAWRKKEMNEGRGREELVLNEGDWVWLHLRKDRFPTKRNPSLALEGMDLFRFWRGSITMPIGWTSQKSMESAPLLRG

SEQ ID NO: 144778 - protein, 189 aa, Glycine max
  Coding DNA Sequence Number=SeqID_53093
  Homolog annotation: Hit_ID=A8P6U5; Match level="QueryCoverage=13%, HitCoverage=40%, E-value=4e-07, Identity=96%"; Hit description =Putative uncharacterized protein
  Subcellular localization annotation: CTP_CleavageSite=55; ConfidenceScore=5.30e-01
MAGPGKFPPGLSQIKPQAPTPWGCPFRQFPFKLFVFHKSKNFTSDYEIRMPPTVPVNHYSDPEGQHNRIRILWCYPMLMYTERRLALSTLISSKSASPAEGTSRPVHTGGGPIDPTQAGITAAAGTRLALQWILVKGFRLYSFQLPDSMSPVLLFIVTTSPCQDWVICAPAAFLGCGSRFSGSLSGIEP

SEQ ID NO: 144779 - protein, 59 aa, Glycine max
  Coding DNA Sequence Number=SeqID_53094
MARAGDNGGVYHQLDGSHCLFLDAITTQMQRLLNRNKEELYRRIAKSSLFTLKPLSPRE

SEQ ID NO: 144780 - protein, 217 aa, Glycine max
  Coding DNA Sequence Number=SeqID_53095
  Gene Ontology: Mol. function=motor activity; Cellular component=cell projection
  Homolog annotation: Hit_ID=UPI00016621D1; Match level="QueryCoverage =97%, HitCoverage=40%, E-value=9e-23, Identity=37%"; Hit description =UPI00016621D1 related cluster
HVLTFRGLHILAFRGLDVLTFRGLHALAYKGLRVLTFNGLYVHAIRGLHALAFRGLRVLTFRGLYVLTIRGLHALTFIVLHALTFRGLHVLTFRGLHILTFRGLHALAIRGLHVLTIKGLHVLTFRGLHVLTFIGLHALTFRGLDVLAFRGLHVLTIRGLHALVFRGLHVLTFRGLHVLTFRGLHVLAIRGLHVLAIRGLHVLTIRGLHALDFVGLH

SEQ ID NO: 144781 - protein, 147 aa, Glycine max
  Coding DNA Sequence Number=SeqID_53096
MSDGFCGTHLQIMIRTRGLGRALGHVTGRGVGRGDRDDFDDAPQRQRPTASARRQRVAVTVAHDEPVVPAPYVQADVFLDDPMTPADVEDIVADILADTGAEAAEDEHEGFPGGPSDPSVLTQYADHVACSERPELKLSSHGRKVHS

SEQ ID NO: 144782 - protein, 69 aa, Glycine max
  Coding DNA Sequence Number=SeqID_53097
MRSQDIYSSQEEATSSPSSNGSKGEAKGDEHINEVYTYEEGNLLMHKVDIQVESHYHFPPKALQASMAQ

SEQ ID NO: 144783 - protein, 471 aa, Glycine max
  Coding DNA Sequence Number=SeqID_53098
  Gene Ontology: Mol. function=homoserine dehydrogenase activity; Cellular component=cytoplasm; Biological process=branched chain family amino acid biosynthetic process
  Homolog annotation: Hit_ID=Q8G041; Match level="QueryCoverage=53%, HitCoverage=57%, E-value=1e-132, Identity=96%"; Hit description =Homoserine dehydrogenase
  Pfam annotation: Domain name=Homoserine_dh; Domain location=359-471; Score=77.2; E_value=5.4e-20; Accession=PF00742.10; Description =Homoserine dehydrogenase
  Pfam annotation: Domain name=NAD_binding_3; Domain location=231-351; Score=68.6; E_value=2.1e-17; Accession=PF03447.7; Description =Homoserine dehydrogenase, NAD binding domain
  Pfam module annotation: Pfam domain module=Homoserine_dh::NAD_binding_ 3; Domain location=359-471::231-351
DVVAFARKHDIVILSDLAYSEIYFDDNPPPSVLEVPGAMDVTVEFTSMSKTFSMPGWRMGFAVGNERLIAALTRVKSYLDYGAFTPIQVAATAALNGDGSDIAYVRNVYKQRRDVLVESFGRAGWDVPPPAATMFAWVPIPERFRSLGSLEFSKLLVEQADVAVAPGIGFGEHGDDYVRIALVENEHRIRQAALFRNRHGRQLAARGIPPDSHSIQKVEIMSDALRIGVAGLGTVGASVLRILRDKSEMLTRQCGKPVTVTAVSARDRNRDRGIDLSGINWFDDPVELAKSADIDVFVELIGGEDGPARASVEAALRAGRHVVTANKALLARHGVALAKIAEDKGVLLNFEAAVAGGIPVIKAMRESLTGNTVSRVYGIMNGTCNYILTRMWEEGISFEACLKDAQRLGYAEADPTFDIEGNDTAHKLALLTSLAFGTQIAADDIYLEGISNISLADIRAADELGYRIKLL

SEQ ID NO: 144784 - protein, 168 aa, Glycine max
  Coding DNA Sequence Number=SeqID_53099
MQGVIKFVKGWLIFSLLWGIFMWFVSWQAQGKTPGMMIVMSLYAGGQDGKNVTDGMVFIAAITGGQCTITGGACGDSGAAWAPPGRAQQNDGTACRSGIEYRGRTGPDRRGLFTPQQETDNHADAGGNGQPGRRVVAYRSHHAVCCILHRITGLRRIASRGTACLMAA

SEQ ID NO: 144785 - protein, 115 aa, Glycine max
  Coding DNA Sequence Number=SeqID_53100
  Subcellular localization annotation: CTP_CleavageSite=60; ConfidenceScore=5.49e-01
MAEPSTQSSILPFPRSSVNCVFVHVSSTFEFGAVFHDCLSADPQGNPPFSPLFRSSMNCVYVHVSSTFEFGAVFHDCLSADPQGNPPFSPISELHELFSFMGPPLSSLELCFTIA

SEQ ID NO: 144786 - protein, 74 aa, Glycine max
  Coding DNA Sequence Number=SeqID_53101
MSVKNLVGRLGVHDKTNHILESQSRSQCFTRMLQLYGINIGLKEHSNRVTPKAYTPKSPSGSLPPDSGPTQKTF

SEQ ID NO: 144787 - protein, 111 aa, Glycine max
  Coding DNA Sequence Number=SeqID_53102
  Gene Ontology: Mol. function=oxidoreductase activity; Biological process=metabolic process
  Homolog annotation: Hit_ID=Q2UTE4; Match level="QueryCoverage=100%, HitCoverage=26%, E-value=2e-57, Identity=100%"; Hit description =RIB40 genomic DNA, SC005
  Pfam annotation: Domain name=Pyr_redox; Domain location=5-81; Score= -8.7; E_value=0.029; Accession=PF00070.18; Description=Pyridine nucleotide-disulphide oxidor
MTGLKVLICGAGITGNALAFWLSKMGHQVTVIERHSSLRATGLQVDLREPGITVLRRMGLEQQFRARSVREQGMEIVDHAGKRKAYFAANRSGLGMQSFTTDYEIMRGDLC

SEQ ID NO: 144788 - protein, 76 aa, Glycine max
  Coding DNA Sequence Number=SeqID_53103
MDEFIELMKEHNLETLGCLSAHLAVAMTNFARCFQIIIVTRALWNNMEARPEIDTLTPKFVSPQISRLGSHDKRPH

SEQ ID NO: 144789 - protein, 113 aa, Glycine max
  Coding DNA Sequence Number=SeqID_53104
MASGKRKAKALVPQAKYDRSKFSSQEAWDRFTENILGWKILLERNVKLYVTELVEFRRELERRNWHKELINFADGSIDVAIVKEFYANLYDPEDKSPKQRKGRACQPTPGLLS

SEQ ID NO: 144790 - protein, 19 aa, Glycine max
  Coding DNA Sequence Number=SeqID_53105
MATLSYYHEGSGYESTDDA

SEQ ID NO: 144791 - protein, 327 aa, Glycine max
  Coding DNA Sequence Number=SeqID_53106
RLCETETNMLAIIAKYEEELGLATAHEHRIADEYAQVYAEKEARGRVIDSLHQEATMWMDRFALTLNGSQELPRLLAKAKATADAYSTPEEIHGLLGYWIPIAPDPNLERWVIKEETQEQMKADMSALKEQMASMMEAMLGMRQLMEKNVAIAAAVSSAAEADPTFLATAHHLPSNIVGRGRDTLGHDGNPHLGYNRAAYPYGLPPNYSPPVLQDDAGHIASPVLEREPPQQPDEVHKDPQDYARRDVEFYPPIPEGPAPSMLPQPNITTQPIVLSTEGPPPATEERRKLDLLEERLRAVEGFGDYPFADMTDLCLVPDVVIPPKFK

SEQ ID NO: 144792 - protein, 160 aa, Glycine max
  Coding DNA Sequence Number=SeqID_53107
MRQFGYTQTIPAPPVDSWVSYDDIHNRWMHYLDHMVPGGEVCVVPGQCASDYIDWFFRISHPFMTPGQTSYPLPDGHAPQPQVIPQAPETDIPHVPEPRAPSTSARPAVEEPRHVVEVCYGIVERLECHLSLGVVTPGSSTHEVIEEFLWMARSVTQDQA

SEQ ID NO: 144793 - protein, 203 aa, Glycine max
  Coding DNA Sequence Number=SeqID_53108
MLESFQQQDQMSVLELYIEKDVAGGSMFNSANSLTACGNNLSNNEAQPPRNVSNLHGDEDDDDDNYLVSNSYVEESLDEDDSIDGISDTDDEVTNMIQPVRIVHPVEGVQGIQNPFWNDVLHYNNINWSHPDEEDICGLEMPSSFNVGQELYVDMDFDSKDVVKNAVKQYVMKVHQSFKVVESKSNKYVVCCLNKSAECPCPF

SEQ ID NO: 144794 - protein, 163 aa, Glycine max
  Coding DNA Sequence Number=SeqID_53109
MDFFSNESFECIQAFENSNLIPLMSLKLPVYTELVKAFYSNLEIQEGTLISEVYGIKMVIEQSLFYDLTQLSSEGVPFEGTLNDDWKFDFSMHDAHRLVCTNQADITGRLLADSLAFESHILHYLIVCIFLPRSSNLAQVSEEDLIVMWAFHTDRQIDWAHLV

SEQ ID NO: 144795 - protein, 72 aa, Glycine max
  Coding DNA Sequence Number=SeqID_53110
  Subcellular localization annotation: CTP_CleavageSite=63; ConfidenceScore=5.36e-01
MGVQIATKPTWAFQKIPPEGGCFWRKQPSSPGQAGKSKPRHFCNVYVTFSWVISRRFSTVLRRSSSFFGLQP

SEQ ID NO: 144796 - protein, 79 aa, Glycine max
  Coding DNA Sequence Number=SeqID_53111
  Homolog annotation: Hit_ID=Q7XGJ4; Match level="QueryCoverage=59%, HitCoverage=10%, E-value=6e-08, Identity=61%"; Hit description =Transposon protein, putative, CACTA, En/Spm sub-class
MSAYYESATRILFNIKSLVSVTELKLVGLKSHDCHVLMQQLLPVAIAGRCLKRMVHEALKGLYQESTSTRGVNSGKIRC

SEQ ID NO: 144797 - protein, 142 aa, Glycine max
  Coding DNA Sequence Number=SeqID_53112
MDNEEGVQEQMKADLSALKDQMASISEVMSKLQKTIEDKATATASSTVREAEPVLQPALNPGLDRNTAVFGRRYSPEAYPYGLPPNFTPRATPEDLSQAPTFEGQLPPYEDYPGQDDGEGDTHLGPLLHLKIHPRMNYPSRT

SEQ ID NO: 144798 - protein, 187 aa, Glycine max
  Coding DNA Sequence Number=SeqID_53113
MGDQEETQEQIKADMSALKEQMASMMEAMLGMRQLMEKNVATAAAVSSAAEADPTLLATAHHPPSNIVGRGRDTLGHDGGPHLGYNRAAYPYGLPPNYSPPVLQDDAGHLASPVLEREPPQHPDEVHKDPQDYARRDVEFYPPILEGPSPSTLPQPNITTQPIVLPTEGTVPRQLKKGGSSISLRKD

SEQ ID NO: 144799 - protein, 178 aa, Glycine max
  Coding DNA Sequence Number=SeqID_53114
  Homolog annotation: Hit_ID=Q6WAY6; Match level="QueryCoverage=88%, HitCoverage=28%, E-value=2e-13, Identity=31%"; Hit description =Putative uncharacterized protein
MVGASISRLPRWKEGGARVLCSCEGFPNVPLMGMKGCINYNPMLAIRQLGYPMRGAPSEEIIACFVARGFNEANAKILQRVRKAWNTVEMKDKELRGSSNGIIGGYHKWLNSRTQGITWLPKLKGLSGKEAEVPKESKEVQALKAELEKTRVIKEKLKTAVTRVRKDCDELRGQHDYG

SEQ ID NO: 144800 - protein, 123 aa, Glycine max
  Coding DNA Sequence Number=SeqID_53115
MGNPLRKDHELRGIRNDIIGGYHEWLKVHIRGLDWLAKLKVVSEDSFEAPEEDEEVQALKNELGKANLQGEVQVGTPLRIEEILGCPLGGRKPYLSSGCLPSLSRIATVVKEIQQKVSGLGCI

SEQ ID NO: 144801 - protein, 45 aa, Glycine max
  Coding DNA Sequence Number=SeqID_53116
ASHIDTLEIEQQEALEKFKSSKIFTRRSNSGTSHIEMLEIEQRKL

SEQ ID NO: 144802 - protein, 286 aa, Glycine max
  Coding DNA Sequence Number=SeqID_53117
  Gene Ontology: Biological process=transposition, DNA-mediated
  Homolog annotation: Hit_ID=Q6UUU1; Match level="QueryCoverage=20%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPVTTFDQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTGKTIRYQAFPPGGSLVRSPVPAF

SEQ ID NO: 144803 - protein, 214 aa, Glycine max
  Coding DNA Sequence Number=SeqID_53118
  Homolog annotation: Hit_ID=Q84VH5; Match level="QueryCoverage=100%, HitCoverage=32%, E-value=8e-82, Identity=73%"; Hit description =Envelope-like protein
MATSPKETSAPGSPSAPSNQERPEFNIQPIQVIPGQAPVPEKLVPKRQQGVKISENPSPATSPREVDPEMDKKIRSIVSNILKNAAVPDAGEDVPTSSTPNVSVPDVDKDVPTSSTPNAEALPSPSEEESTEEEDQASEETPAPRAPEPAPGDLIDLEEVESDEEPIANRLAPGIAERLQNRKGKTPLKRSGRIKTMAQKKSTPITPATSRRSK

SEQ ID NO: 144804 - protein, 231 aa, Glycine max
  Coding DNA Sequence Number=SeqID_53119
GLHVLAFRGLHTLAFRGLHALTFRGLHALAFKGLHALAFRGRHALDFRGLHALAFRGLCVLTFSRLHIRTLREFKILCPPPPDPGGGPTMRAQPEEEAIAQLLCISGQDFSHATAKRRVQIMRTNMTTLTQIWMTLLLSNILPSNHNADLPIRKDRAHKTPSGPGGVQQGPGVSSFCCGPQSILQGARPPQQGIAPARHPVDPKKSNRVLGFPALITGLCQFYGVPVAPNK

SEQ ID NO: 144805 - protein, 98 aa, Glycine max
  Coding DNA Sequence Number=SeqID_53120
MGLNEQGIGNDSLRSTSEREEERTSIARFLSRLNMKVRDKVELLPYRDLDELVQLCIRVEQQLKRKPSSKSYGFHSYPRKDQAQGIWVLHLSKPRKIR

SEQ ID NO: 144806 - protein, 53 aa, Glycine max
  Coding DNA Sequence Number=SeqID_53121
MHDAIKEQARGLSVTMHHQKRKTLDKTLLLSSESETQHDHRSTSIPYGSHRPE

SEQ ID NO: 144807 - protein, 110 aa, Glycine max
  Coding DNA Sequence Number=SeqID_53122
  Homolog annotation: Hit_ID=O82360; Match level="QueryCoverage=34%, HitCoverage=10%, E-value=2e-09, Identity=65%"; Hit description =Expressed protein
MTSVELPMSDWEDKWIDVYFDISSKLLDICNAFSSELSPQIDNICARAKGHEDEDNLWILCFVGNSTQSVDINKELSLGQVEFDQFKRQQSGSGNADGENFSQQLEWVQS

SEQ ID NO: 144808 - protein, 130 aa, Glycine max
  Coding DNA Sequence Number=SeqID_53123
MTYSNIKRDTYKNPTLAQWNNGGADGAASNYDRTYTLNDLSIEFLQPGGSTSSRAAATAVELQFALYWRNSEEARTDRPSQQLRSLNGEWDAPCSGALSAAGVVVTRSVTATLASADVRRCFCRYAPPRQ

SEQ ID NO: 144809 - protein, 142 aa, Glycine max
  Coding DNA Sequence Number=SeqID_53124
  Pfam annotation: Domain name=G-patch; Domain location=1-42; Score =32.2; E_value=1.9e-06; Accession=PF01585.14; Description=G-patch domain
MVARVMLRHGYEPGMGLGKDSHGNADVVDVRGNPHKYGLGYELKKPGRRNAPSRLRADRAWPGHVSQCFTSAGIMFEEEVAAIGEEAPQDPPSFVRPCHPNFQLGNWHVTSQSEVYTADSICKDRSFEDPNNEGLIIDFDRE

SEQ ID NO: 144810 - protein, 45 aa, Glycine max
  Coding DNA Sequence Number=SeqID_53125
MGLSGLKEHSNPVTPKAYTPKSPSGLLPPDSGLTPKIILAPRHCS

SEQ ID NO: 144811 - protein, 144 aa, Glycine max
  Coding DNA Sequence Number=SeqID_53126
MVKVGTSYVPINVSFSPKVGPGLPGINRDSRIYLFCEVIFRHSCPSCSATDGVVRNGKSTARTSALASVAVPLRVTTTPAALNAPLQGASHSPFRLRNCWEGRSVRASSLLRQLAKGGCAARRLSWVTPGFSQSRRCKTTASEF

SEQ ID NO: 144812 - protein, 40 aa, Glycine max
  Coding DNA Sequence Number=SeqID_53127
MTKARQKGVRKENGGDACHPARPGELGCFLQKQPPSVGIF

SEQ ID NO: 144813 - protein, 183 aa, Glycine max
  Coding DNA Sequence Number=SeqID_53128
ASLTGEKWWVSTNGHSWLGSDNAIPEGVGSWALDPFGPGERVTLGRGLVNQLVAPLVEASQFKYVIRRGIRPRGISIGTSPSDFARRRSRHSPRAMRKDESPARTTRASFPACGSSVITYSDLRELADRSLSGDAPSSMSEPFRNWLGMGVTIPALIQPEEEIAMHLAQLARRSLEWECSVGK

SEQ ID NO: 144814 - protein, 45 aa, Glycine max
  Coding DNA Sequence Number=SeqID_53129
MEILDPLYWLDLMMQSYPARALDRKLQVDWARDAREGPRVLMSLG

SEQ ID NO: 144815 - protein, 250 aa, Glycine max
  Coding DNA Sequence Number=SeqID_53130
  Homolog annotation: Hit_ID=UPI00006A2D9E; Match level="QueryCoverage =47%, HitCoverage=62%, E-value=5e-08, Identity=16%"; Hit description =UPI00006A2D9E related cluster
IPPLTFKGLHALIFKGLHALTFRGLHALTFKGLHALAFRGLHVLAFRGLHALTFRGLHALAFRGLDVLSLRGLYVLPLRGLHVFAFGGLHTLAFRGLHVPLFRRGHALAFRGRHVLAFEGLRSPSPFEGYASSLSKHSAQRLQCRSPPARVSVGLCHPNIGITPARHPVDPKKSNRVLGFPALIAGFCQFYGVPVIPSNVIRPPTNRAFIKKYCAPRKAEDETLQQPGDGQQQASNASPPPPEPLSSSTK

SEQ ID NO: 144816 - protein, 168 aa, Glycine max
  Coding DNA Sequence Number=SeqID_53131
  Homolog annotation: Hit_ID=Q6WAY4; Match level="QueryCoverage=71%, HitCoverage=21%, E-value=2e-11, Identity=32%"; Hit description =Putative uncharacterized protein
MGSSQKPSLKKRFYQVKIKSLEVTSLRELGQLMGQLQRQAFRKAYGKIWDLARVEVSMEPIASLSQYYDQPLRCFTFEDFQLVPTVKESEEILGCPLGGRKPYLFSGFYPSTTRVAKVVKISAQELDHLGYPMRGAPLDESITPFIARGFSDHNARVLQGVRKAWDAA

SEQ ID NO: 144817 - protein, 65 aa, Glycine max
  Coding DNA Sequence Number=SeqID_53132
MQSQGLALPTEPEVGLFTTRVRTKESCIDPSGNDLDTGVVGLGKPADRSDHYVDDPLYLMTLVIP

SEQ ID NO: 144818 - protein, 159 aa, Glycine max
  Coding DNA Sequence Number=SeqID_53133
  Homolog annotation: Hit_ID=A2Q274; Match level="QueryCoverage=55%, HitCoverage=45%, E-value=4e-10, Identity=41%"; Hit description =Ovarian tumour, otubain, putative
MDNSPTKKNSLKPGQISVWDAMNNMIMQQHTEIKASFDTSTHAAGHVFKITLYKRLLGMISRYALNQIATEYEHVHYANKNPSRCGCVMRTTRDLPCACELSKYVLGTILSYPNFVQGLLFDDIQPLIGRFEILGTLCCTICEVPRRAENQKEAGLCDP

SEQ ID NO: 144819 - protein, 59 aa, Glycine max
  Coding DNA Sequence Number=SeqID_53134
MSLHDRTSEWTEAVRLAAWPFAQQTCTAHPSSRFFLALSRGMLHSADGSLSQQIGLARG

SEQ ID NO: 144820 - protein, 80 aa, Glycine max
  Coding DNA Sequence Number=SeqID_53135
MGAKYLEVVKRGSHPNKRMVQNDHNLSLRALGHNRAWMARRRMTIICLCVPSYVIASGWRRGVGNDHNLSPPTSRLTVPE

SEQ ID NO: 144821 - protein, 98 aa, Glycine max
  Coding DNA Sequence Number=SeqID_53136
MVSHLALPLSHNNVLACPRSEFDVQQIPVWGKLKHGCQGGQCIGHLVLFPSFPFSSQLAYHQSRVSIHFEQLYIKINGRLNPKGARFIFDHIVGTIET

SEQ ID NO: 144822 - protein, 160 aa, Glycine max
  Coding DNA Sequence Number=SeqID_53137
  Gene Ontology: Biological process=transposition, DNA-mediated
  Homolog annotation: Hit_ID=Q1J7G7; Match level="QueryCoverage=20%, HitCoverage=47%, E-value=7e-12, Identity=100%"; Hit description =Transposase
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPVTTLANWSSTAVAAALELVDPPGCRNSMCLLSNTLAG

SEQ ID NO: 144823 - protein, 223 aa, Glycine max
  Coding DNA Sequence Number=SeqID_53138
  Subcellular localization annotation: CTP_CleavageSite=65; ConfidenceScore=5.05e-01
SEFLIGGYVGAKASLLSTTPLSVTMTQELANVVICALSGDVSIFRSKSLAFVGRPTISVILTLTSCDMRRQIMVIPHPFAIQTQSCPMARRDKLWSFCILLSARGGGPDDMRRQIMVIPHPFAIQTQSCPMARRDKLWSFCTLLSSRGGGPDDMRRQIMVIPHPFAIQTQSCPMARRDKLWSFRTLLSSRGGRPDDMQRKIMVIPHPFAIQTQSSPMARRDKL

SEQ ID NO: 144824 - protein, 168 aa, Glycine max
  Coding DNA Sequence Number=SeqID_53139
MASGKRKSTAYRPQAQYDSRRFQSLEAWNQYTDNILDWRILPERNVKIYHTEFDEFKAKLKRRNLHKRLANLQEGSIDVAVDKELYANLYSPENQSPKQVRVRGHLIRIGANSLNSFLETPVVLEKGETLPTYSRGPSLENSKERSHHSYIDMECPLLQQLDSHFPHL

SEQ ID NO: 144825 - protein, 99 aa, Glycine max
  Coding DNA Sequence Number=SeqID_53140
MKQKGKRKKDREGRHVIVKKYKSFEKSKRIFWKQGTDAKRCLSAHLAVAMTNFARCFQIIIVTRALWNNMEARPEIDTLTPKFVSPQISRLGSHDKRPH

SEQ ID NO: 144826 - protein, 244 aa, Glycine max
  Coding DNA Sequence Number=SeqID_53141
  Homolog annotation: Hit_ID=Q6WAY6; Match level="QueryCoverage=31%, HitCoverage=14%, E-value=3e-11, Identity=42%"; Hit description =Putative uncharacterized protein
KSLHVLNPYAFSGFSPRDFLSAVSLVTIFQRNERGFEALVLTLGQDHLELPSGVRTKHGQQKPIKVAILADLFDTFDRSAINWFPRWKEGKEGVLFSCGDYPNVPLIGTRGCINYNPALAIRQLGYPMRGAPTEEGLSPFLVRDLGAQGLKVKQRIHKAWRSPLKKHKELRGIRNDIIGGYHGWLRIHTRGLDWLSKLKVIDEENFEAPEEDEEVRALKLELGKARLTKEKFKSAAIHIWKECT

SEQ ID NO: 144827 - protein, 91 aa, Glycine max
  Coding DNA Sequence Number=SeqID_53142
IRPPITRAFIEKYCTLRQTHGDAPQDAGAPPPPHQADPTGSLGMEHYLQHLVRQQAANHRGQAPHTPVSPSSIKHECKLGSEAINRTRSVH

SEQ ID NO: 144828 - protein, 37 aa, Glycine max
  Coding DNA Sequence Number=SeqID_53143
MKMLLIPHDMNSSRMEKEEREETPLQGEDESRRSSPP

SEQ ID NO: 144829 - protein, 15 aa, Glycine max
  Coding DNA Sequence Number=SeqID_53144
SNGAYIMWYEEHLHV

SEQ ID NO: 144830 - protein, 223 aa, Glycine max
  Coding DNA Sequence Number=SeqID_53145
  Homolog annotation: Hit_ID=A0U722; Match level="QueryCoverage=95%, HitCoverage=27%, E-value=1e-30, Identity=43%"; Hit description =Putative uncharacterized protein precursor
PHERVFQTGLGGTRPARRILSGHRSPAPRRTHQRTVDRGGSGFAVPGRLPLLQPVHRQQGDAAGSDPGHPGGDQQRWPGLRADQQARAVRPSLCRHRRCRPAGRPGTGRADGLPARPVVAGGGRGAGRCGAGLHGPVPVQPPQRPFAGRPGKRRDGPGARHHRAVRRVPDHDHHPGGAGDGGGQGAGRKPVGHVHGDRDDAHRDPDGRVHALHPPRQDRLDLG

SEQ ID NO: 144831 - protein, 190 aa, Glycine max
  Coding DNA Sequence Number=SeqID_53146
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=27%, HitCoverage=50%, E-value=8e-24, Identity=100%"; Hit description=LacZ protein
  Subcellular localization annotation: CTP_CleavageSite=44; ConfidenceScore=5.46e-01
MTMITPSSKLTLTKGNKSWYRAPPRGSNSCSPGDPLVLERPPPRGSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYATTPSVAETGGTADKKQEPLGAPQKHHQYTKSVSWQHHPTHFAPK

SEQ ID NO: 144832 - protein, 206 aa, Glycine max
  Coding DNA Sequence Number=SeqID_53147
GYTPSPSEDYTCSPSEGYTPSPSEDFTSSPIEGCTRSHSEDYTFSPSEDYTSSPSRGLHAFAFRGIHVFAFRGLHALAFRGPTRPHLQRTARPRLQRTTRHHLQRVAHPRLQRTTSPHFQSQHVLALRGLHALAFRGLHVLAFRGLHALAFRGLHVLAFIGLHTLAFRRLHILSLEVLHALAFRGLQVLPSEDYTSSPSKGFTPSL

SEQ ID NO: 144833 - protein, 187 aa, Glycine max
  Coding DNA Sequence Number=SeqID_53148
  Subcellular localization annotation: CTP_CleavageSite=41; ConfidenceScore=5.37e-01
MAEPSKKRKGSSSTAAAAAYRRHGPSEASTAPIHPSLSSPRSSTLFSSDDQRLRYLSQFSSRIILDPKYLDVEFFNDETFDCYQVFQNFGLVDFMSLKLPQYPELVKVFYCNLKIQDDIISSEVHGIPMIIDQSLFFSLTHLPSQGAPFEGTIVDDWKFDYSSHDARRMVCNDQAEMTEFYFLGLQI

SEQ ID NO: 144834 - protein, 577 aa, Glycine max
  Coding DNA Sequence Number=SeqID_53149
  Gene Ontology: Mol. function=motor activity; Cellular component=cell projection; Biological process=keratinization
  Homolog annotation: Hit_ID=UPI00016621D1; Match level="QueryCoverage =95%, HitCoverage=44%, E-value=5e-22, Identity=35%"; Hit description =UPI00016621D1 related cluster
DRGLQALTFRGLHVLAFRGLHVLVFRGLHVVAFRGLHALAFRGLHVHTFRGLHAFALRGLHVLAFKGLHLLTFRGLHALTFRGVHVLAIRRLHVLTFRVLHVLTFRGILILAFKGLHVLAFRGLHVLTFNGVHVLAFRALHVLIFSGLHVLAIRGLHTLNFRGLHVLTFRGLHALTIRGMHILIIRGLHVLTFRGLHVLAFIGLHDYTSSTSKDYTSSPSKDNTSSPSEGYTPSPCEDCMSLPSEDYTSSSSEGNTPSHSEDCTSSPSEGFRSSPLEECTSSPSEGCTSSPLVDYTSSPSEGYMPSPLEGYMPSPSEGYMPSPLEECTSLPSEDWTSLPLEGYTPSPSEGFTSSPLEDYRVHTLTFRGVHVLNFRGLHVLTFRRLHVLAFRGLHALTFRGLHVLAFRGVHVLAFRGLHTLAFKGLHTLAFRVLHVLAFSGVHVVAFRGLHVLAFWGLHALTFRGLHAFTFRGLHALAFKGLHVLAFIGLHALAFRGLHVLTFDGVYVLTFKGLHVLIIRGLHVLTVRGLHVLTFRGLHVLNLDGYTRSPLEDFTSSPSEDCKSSPSEGYTPLPSEDC

SEQ ID NO: 144835 - protein, 271 aa, Glycine max
  Coding DNA Sequence Number=SeqID_53150
  Gene Ontology: Mol. function=2-dehydropantoate 2-reductase activity; Cellular component=cytoplasm; Biological process=pantothenate biosynthetic process
  Homolog annotation: Hit_ID=A4W796; Match level="QueryCoverage=100%, HitCoverage=89%, E-value=1e-142, Identity=90%"; Hit description=2 -dehydropantoate 2-reductase
  Pfam annotation: Domain name=ApbA; Domain location=3-144; Score =152.0; E_value=1.6e-42; Accession=PF02558.7; Description =Ketopantoate reductase PanEApbA
  Pfam annotation: Domain name=ApbA_C; Domain location=168-271; Score =130.6; E_value=4.5e-36; Accession=PF08546.2; Description =Ketopantoate reductase PanEApbA C ter
  Pfam annotation: Domain name=NAD_Gly3P_dh_N; Domain location=1-130; Score=-48.4; E_value=0.014; Accession=PF01210.14; Description=NAD -dependent glycerol-3-phosphate de
  Pfam module annotation: Pfam domain module=ApbA::ApbA_C::NAD_Gly3P_dh_ N; Domain location=3-144::168-271::1-130
MKITVLGCGALGQLWLTALCKHGHEVQGWLRVPQPYCSVNLIGEDGSIFNESLTANDPDFLAHSDLLLVTLKAWQVSDAVKALAAQLPPTSPVLLLHNGMGTIDELKSIVQPLLMATTTHAARRDGNIIVHVASGVTHIGPARDQDGDYSYLADTLQTVLPDVAWHNNIRPQLWRKLAVNCVINPLTALWDCPNGELKHHPQEVATLCAEVASVIEREGLHTSADDLRYYVEQVIDSTAENISSMLPDVRALRHTEIDYITGYLLKRARAH

SEQ ID NO: 144836 - protein, 81 aa, Glycine max
  Coding DNA Sequence Number=SeqID_53151
MKKKKIALYGSRFDEEMSEIGRFGGLGMEVRGKEEGAAQEILKTRRQPTGNRLHEYCNLLQAICSSVIDYSIHVIDYQNKK

SEQ ID NO: 144837 - protein, 148 aa, Glycine max
  Coding DNA Sequence Number=SeqID_53152
MVGYAPSSFADLVFADERIEVGLKRGKFNHPAWTNEKTGANEEGENEGVTHVATAVPTWKLPTNPTNIITQPISTLLLTHHPPIEFTLIPISYDDLLPYLLDSSMVAITSAKVPQPPFFRGYDSNAMCAYHGGAPRHSIEHCMTLKRK

SEQ ID NO: 144838 - protein, 122 aa, Glycine max
  Coding DNA Sequence Number=SeqID_53153
MHLRPRTPRLPIRLVQPDHFDTEQYLRHLVRQQATNHRAHVQTHDCLYQMSLSLQSQGFTSFPCPTPDQFRAEVAWLGDWPEARAGEAPAEAPAEAPDEADEAREDEEMTDLLDFLGGSGAT

SEQ ID NO: 144839 - protein, 40 aa, Glycine max
  Coding DNA Sequence Number=SeqID_53154
MENWRIAPDNQFAGLHTQALGNQFAGLQTQGGGHMNSARQ

SEQ ID NO: 144840 - protein, 60 aa, Glycine max
  Coding DNA Sequence Number=SeqID_53155
  Subcellular localization annotation: CTP_CleavageSite=27; ConfidenceScore=5.57e-01
MHALLGSFNSGNWSDSKVLGSAGLSCRAFTRNRSVTSQLNFRRAYGSMQIYSKFGGRKVN

SEQ ID NO: 144841 - protein, 96 aa, Glycine max
  Coding DNA Sequence Number=SeqID_53156
MSSSLSSNDSSLSSNESSSDDDDHITKNKVLMFAVANVTNYFMKYVVKNPCRDSSMTGHRWDIIKPIDPSFRDTPDEILKDARYRPYFRDCIGAID

SEQ ID NO: 144842 - protein, 149 aa, Glycine max
  Coding DNA Sequence Number=SeqID_53157
MKNNAGNIEEPTNSIKSSNLEHPFSSLLRRDLPRSEEDLNELNSKTLATFLKDGKEEEFGEDSLSGRTLSSTTSEVREAIKRIQEESLFEEDNSFFFVPEEKDPFANFDYSASSKAGPSHLGKGCNRKDLFAKVVKLPTILEESDTEIY

SEQ ID NO: 144843 - protein, 42 aa, Glycine max
  Coding DNA Sequence Number=SeqID_53158
IHQVLDCSPTNRERELGLDRRETVGGLGPPKARAVGDPREAD

SEQ ID NO: 144844 - protein, 17 aa, Glycine max
  Coding DNA Sequence Number=SeqID_53159
EFEVLVIPELLVEMFIL

SEQ ID NO: 144845 - protein, 99 aa, Glycine max
  Coding DNA Sequence Number=SeqID_53160
MTDPLDESVSCFLIRVNPWVLVPSPPEDYMSSPSEDYTSSPSKDHGYTPSPSEDYMSSSSEDYMSSPLEGYTPSAPRTIRPHLQRTACPQLHRATRPHL

SEQ ID NO: 144846 - protein, 193 aa, Glycine max
  Coding DNA Sequence Number=SeqID_53161
MDNEEGVQEHMKADLSALKDQMASITEAMLKLQKSIEDNATPVASNTAREAEPVLQPAINLGRDRNTMVFGRRYSPQAYPYGLPPDFTPRTAPDDLSQAPTFEGQLPPYADYPLQEDDEGDAHLSSLLPLKDPAPHELPQANIVRHVSSPPEPVKEFDPFAKDKGKIYLLEERLRAIEGLGNYPFSDLADLCL

SEQ ID NO: 144847 - protein, 151 aa, Glycine max
  Coding DNA Sequence Number=SeqID_53162
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=56%, HitCoverage=73%, E-value=2e-24, Identity=68%"; Hit description=LacZ protein
MRTVSAPYFSTITCGSMPLFFDFDILLSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 144848 - protein, 325 aa, Glycine max
  Coding DNA Sequence Number=SeqID_53163
MKREKHASYSSHNSCKSLSEELRNYYEGRHRSHLRPHSHRRENERKPQDVNIKLTYFHGKDNVEAYLDWEIRVEQKLKRKPTLKSYGYHSYPKKDQGLGILGASPSKPNDDKGKTIEKQPPKAKDTLLLSTKKTMIMRIQDIYSSQDEATTSPSSSESEEAKGEESSEEIYPQEEGKPLMVKEDCKEVSVSSKRLAKKERHFEIKTNIEEISPLKQPPHFLLCKKTLVSIATPLRLEFIPQVKELLDEGLVRKSLNPCAFLVPKIGITRHQIPKIRGMMNVLSGATLFCKITHAPNIFMICVHRDSLVGLFLFFVSCNLVLMWTP

SEQ ID NO: 144849 - protein, 143 aa, Glycine max
  Coding DNA Sequence Number=SeqID_53164
DGEEKLENQKKKKDSKALSSKAKGKEKEEKDSTKKIVKKENHFAIKCDIKRALLLKQYFYLLLSRETSLSTTIPLELKVIPQVKELLDEGLPMDPKRIKAIPEWPTPPLPLIELVRNYVLSWEDGVEERIPEFQEPMDLRLKF

SEQ ID NO: 144850 - protein, 185 aa, Glycine max
  Coding DNA Sequence Number=SeqID_53165
MDVLVDLAAIDAFLAYHHNKESSVIAILADDYDMFDRRCEKSNTRIVCCTPTLYVWLMVEGLDARDNLALEAKEFNNNELKLRRAKRDESRVESMILEDKLKACQRSKRSLTEQLSRAEENMWTIIDQEARERVIDSLHGEAMMWMDRFSFTLNRSQELPRLLAKAKAMADVYSTPEEVHGLFDY

SEQ ID NO: 144851 - protein, 89 aa, Glycine max
  Coding DNA Sequence Number=SeqID_53166
VIILRASPVESPTVATYPSAGGRRETRGMRVPRKEYARIATNVYLRKTSEKLGKDAIYELFSERLLGVVFTHGEGISTPHVTVPRDGSP

SEQ ID NO: 144852 - protein, 134 aa, Glycine max
  Coding DNA Sequence Number=SeqID_53167
MGEVEEVQKHMKADMEAMKEQMATMMEAMMSMKKIMEANAIAVAATSVVAKVNPMPLSALNQMNHPTLAMVDFEPCLGYATEGQAVGGIPLQNTLEGPQYHPQPHPSHSTAVKNPHAMAEMRKVGSSRGKAMGH

SEQ ID NO: 144853 - protein, 147 aa, Glycine max
  Coding DNA Sequence Number=SeqID_53168
MSKGQCGHLHPFWRCQHLPVETFSSLTSYLELRRSEFLIVGYVGRQKLVILHPLSSRGGGPDDTRRQNLVISHPFAIQTQSCPMARRDKNWSFYTLCHPEAAGPMTRGDKIWSFRTPLPFRHSRVRWLAETKIGHSAPFIIQRRRAR

SEQ ID NO: 144854 - protein, 173 aa, Glycine max
  Coding DNA Sequence Number=SeqID_53169
ATTSPSSSERDEEKWEESSEEIYPQEEGQPLVVKEKCKEVSVSSKSLAKKETHFTIKTNIKEIFPLRQPPHFLFCKKTLVSTATPFGLEVKSLCFVGAQNSDQGVPKDPKRIKIILDWPTPPSIREIWGCHDLTNFYKRCQGKEPEYEEPQDLRSNPFQGGRDDAILPPKGIG

SEQ ID NO: 144855 - protein, 110 aa, Glycine max
  Coding DNA Sequence Number=SeqID_53170
IQHSISSVSICYQLQSDIRLKGYCRLFWLGELNFQFRASRILRDSIRHPSKKLLSFELAERFNIQFRASRYVTGLNQTLSKKSWSFVLPQSFNIQFRASRYITGLNQTSE

SEQ ID NO: 144856 - protein, 79 aa, Glycine max
  Coding DNA Sequence Number=SeqID_53171
MSDIEEAQEQMKVDMEAMKEKMTIMVEAMMSMRSMMEVNTATVVAASTATKLDPTHPPGFNQLNNLVSDMVGQGGEALG

SEQ ID NO: 144857 - protein, 260 aa, Glycine max
  Coding DNA Sequence Number=SeqID_53172
DSSIDLALVKEFYANLYNPEGPCPKQVKIRGHLIKIDEDSLNTFLEIPVVLAEGESLPAYSSYCRMPTDIREIEAALCIPGRGFVLNAEGHPGKILKKDLTTLAQVWSVLSYSILAPTSHTSDLTLDRARLIFGLVSQLDMNVGALIFGQITSMAQSNSSRLGFPTLITEELLEPADLAVTIRGARRARARPAEAPSISTAPPPAHTLAASSTLSSTNFQCLEAMLRSIHQGHIILLQSLQLVAPPDSIPSIEQFNEWVA

SEQ ID NO: 144858 - protein, 150 aa, Glycine max
  Coding DNA Sequence Number=SeqID_53173
VGNMSWRSVRGSRKRKMDFELDLNRDPPLVREEEEEEEEGGPSRHQQHHHHQQEPQTPIVDVDAIDDDVVESSPRSFAQAKSNADERRRVRRRTTIVDLDSEDGTGGVPQNQTIINGDLYVNLANNSSSANAVIEDNMMEFCIRWSGYVM

SEQ ID NO: 144859 - protein, 107 aa, Glycine max
  Coding DNA Sequence Number=SeqID_53174
  Homolog annotation: Hit_ID=A7PNE1; Match level="QueryCoverage=62%, HitCoverage=19%, E-value=2e-15, Identity=61%"; Hit description =Chromosome chr1 scaffold_22, whole genome shotgun sequence
MDALLVIGNCVGSANHRSFIAFLISAVLSTIYVSIMSAYAGLRTWPPLKYSLGHINGVSSSELAWRIINEIVVAFLRSALLLSSRGLILAYLFIAKKDHFNVYILVD

SEQ ID NO: 144860 - protein, 72 aa, Glycine max
  Coding DNA Sequence Number=SeqID_53175
MVINYIMWPKKEKVQTADDSLSEADPLSEWHPLSEASNSLSGWKTLEEDKPEMCSPSAQPARLARTLSLLAL

SEQ ID NO: 144861 - protein, 122 aa, Glycine max
  Coding DNA Sequence Number=SeqID_53176
  Gene Ontology: Mol. function=nucleic acid binding; Cellular component= nucleolus; Biological process=ribosome biogenesis and assembly
  Homolog annotation: Hit_ID=Q40363; Match level="QueryCoverage=76%, HitCoverage=14%, E-value=7e-19, Identity=52%"; Hit description=NuM1 protein
  Pfam annotation: Domain name=RRM_1; Domain location=44-111; Score =37.8; E_value=3.9e-08; Accession=PF00076.13; Description=RNA recognition motif. (a.k.a. RRM, RB
MVPLPVKSSENSEKGIEEKDPKAPQENPKMLATPNERNAGSKTIVTRNLSYSVERADLENLFKECGEIVDVRLHTDAEGRFRGFGHVEFATAEAAQNNCQRLFMDSCTFASNSSIYLSRIKF

SEQ ID NO: 144862 - protein, 461 aa, Glycine max
  Coding DNA Sequence Number=SeqID_53177
  Gene Ontology: Biological process=cell wall catabolic process
  Homolog annotation: Hit_ID=A7P2V9; Match level="QueryCoverage=48%, HitCoverage=61%, E-value=2e-43, Identity=45%"; Hit description =Chromosome chr1 scaffold_5, whole genome shotgun sequence
  Pfam annotation: Domain name=DUF1723; Domain location=326-375; Score =43.6; E_value=6.9e-10; Accession=PF08330.1; Description=Protein of unknown function (DUF1723)
  Subcellular localization annotation: CTP_CleavageSite=13; ConfidenceScore=5.05e-01
MAFKSLMTMNVVPSDMVSPAMNSLQGYYGLKGTPSPSEDGPFPRNLPMSDRPLSHHRKSRSLVNVILEEIMEKSDDALAAETREVGSNKWNDKLGLRHQKSVADFIRIPELLLREDNSSSGVLPSRTGKGLALRQKAANRTTATTDSEPIGLNPAALGMGDASLIDGSSGVRKSSSTSCLQDQDNSGSSSIWPTKMWNLKPDLQALSTAAIGKPIFDGFPKPITGYGIISRYTSGPTTFTRRQREAAAVAEELFQHTEEVVDDAEGFPGGHCDTSVLTTYADHVAVLGGLSSHGKKVQKFERPATEIEGLVAATRLSSLIACSLDTGDRRLISTFVERWNKEASSFHLPVREVTITLDDVASLLHLPIIGAFHSFDTLHVDKAMLMLVKLLKVAEDEARAETSGSYAWGVVALMHMYDNLNDACKSGGKQLAGYITLLQVTTCMPLNIYKGLISIDVLKVA

SEQ ID NO: 144863 - protein, 1429 aa, Glycine max
  Coding DNA Sequence Number=SeqID_53178
  Gene Ontology: Mol. function=nucleotide binding; Cellular component =myosin complex; Biological process=protein amino acid phosphorylation
  Homolog annotation: Hit_ID=A5AK37; Match level="QueryCoverage=98%, HitCoverage=69%, E-value=0.0, Identity=52%"; Hit description =Putative uncharacterized protein
  Pfam annotation: Domain name=IQ; Domain location=635-655; Score=19.3; E_value=0.014; Accession=PF00612.18; Description=IQ calmodulin -binding motif
  Pfam annotation: Domain name=IQ; Domain location=658-678; Score=17.2; E_value=0.062; Accession=PF00612.18; Description=IQ calmodulin -binding motif
  Pfam annotation: Domain name=IQ; Domain location=683-703; Score=21.6; E_value=0.0028; Accession=PF00612.18; Description=IQ calmodulin -binding motif
  Pfam annotation: Domain name=IQ; Domain location=706-726; Score=14.7; E_value=0.36; Accession=PF00612.18; Description=IQ calmodulin-binding motif
  Pfam annotation: Domain name=IQ; Domain location=731-751; Score=18.9; E_value=0.019; Accession=PF00612.18; Description=IQ calmodulin -binding motif
  Pfam annotation: Domain name=IQ; Domain location=754-774; Score=19.9; E_value=0.0095; Accession=PF00612.18; Description=IQ calmodulin -binding motif
  Pfam annotation: Domain name=Myosin_head; Domain location=2-619; Score=802.4; E_value=2.7e-238; Accession=PF00063.12; Description =Myosin head (motor domain)
  Pfam module annotation: Pfam domain module=IQ::IQ::IQ::IQ::IQ::IQ::Myo sin_head; Domain location=635-655::658-678::683-703::706-726::731 -751::754-774::2-619
MSICSKMINEETSQSILVSGESGAGKTESTKMLMHYLAFLGGRAATEGRSVEQQVLESNPVLEAFGNAKTVRNNNSSRFGKFVEIQFDQKGRISGAAIRTYLLERSRVCQVSDPERNYHCFYMLCAAPQETFTAKGLMHFHLRWNPAAVIGGIGASLNKSKDRDVDKYKLGSPRTFHYLNQSNCIELDGLDDSKEYLATKRAMEVVGINSDEQDAIFRIVAAVLHLGNIEFVKGEEDETDSSKPKDEKSHFHLKIAAELLMCDEQSLEDSFCKRVMVTRGDTITKSLDPNAATLSRDALAKIVYSRLFDWIVDKTNNSIGQDPDSNNLIGVLDIYGFESFKTNSFEQFCINLTNEKLQQHFNQHVFKMEQEEYTKEEIDWSYIEFVDNQDVLDLIEKKPGGIIALLDEACMFPRSTHETFAEKLYQTFKDNKRFSKPKLSRTDFTINHYAGDVTYQTDFFLDKNKDYVVPEHAALLSASKCSFVSGLFPPLPEETTKSTKFSSIAAQFKLQLQSLLETLNATEPHYIRCVKPNNLLKPGIFENNNVLQQLRCGGVMEAIRISCAGYPTRKNFDEFVQRFTILEPKILKACPDEMTACKRLLDRANLKDYQIGKTKVFLRAGQMAELDACRAEVLGRSANIIQRKIRTFICRKHYILLQLSAIELQRVARGHLAQHQYECMRREAASLKIQKDFRMHMSRNAYKTIYASAVYIQTGMRGMAARNDLRFRKRTQASIVIQDHYRGYSARIYFQRLKKSAIAAQCSWRRTLARRELRKLKMLTLVLVREVRIERSRSVNLNSGSSSLDNSVHPNSAQSMNPNSQAQVNLTTQTTCEDNSANDYIGNRFSVVMVVGIFARTTIVVMVQAMVVVEVGLLMLEENYDPTLPPPASLAPTQSTSAPSAQTSQQVQHAQPIHSSSSPTQTQTQTWYPDSGASHHAAKESKALEAAKNNLEMQVKELTSCLETEKRMREAKTQENKKLQHALQEMQLQLQEIEEAKKQENEKLKHALQEKELQFQEIEEANKQENEKLQHALQEKELQFQEIEEANKQENEKLQHALQEMERQFQEIEEAKKQENEKLKHALQEKELQFQEIEEAKKQENEKLQLALQEMELQFQETKAALIQEREAAKKVDEQTPTTQENSVNVVDSELINKLTTENEQLKELVNSLEKKSIQEFPVNVTDNELINKLSSENEHLKELINSLEKKTIQEFPVNVTDNEVSSKLITENEHLKVFIISKITPEALQDQVNSLERKIDEAERKYEESNRVSDERMNQIIETESKMIEIKTNVQRLEEKLSDMETENQVLRQQALLSSSSRRMSGKLAPATTPPLENGHQASQGSVPAKTFGAEDKESVDALFKCVTKDLGFSEGKPVAAFTLYNCLLHWKSFEAEKTSIFDHLIQLIGSELEVTFCLLKPFFHLFVRGKS

SEQ ID NO: 144864 - protein, 167 aa, Glycine max
  Coding DNA Sequence Number=SeqID_53179
  Gene Ontology: Mol. function=nucleotide binding; Cellular component =myosin complex; Biological process=signal transduction
  Homolog annotation: Hit_ID=UPI0000162C52; Match level="QueryCoverage =85%, HitCoverage=8%, E-value=5e-52, Identity=69%"; Hit description =XIA (Myosin-like protein XIA); motor/ protein binding
  Pfam annotation: Domain name=Myosin_N; Domain location=31-72; Score =51.0; E_value=4e-12; Accession=PF02736.10; Description=Myosin N -terminal SH3-like domain
MSHRLVCMPTTDSYNANITSNEAGQLSFVVGSHVWVEDPDLAWIDGEIQESNNEEITVMYESGSKVVSKSANMYPKDPEFPPNGVEDMTRLAYLHEPGVLQNLHLRYAMNEIYTYTGNILIAVNPFQRLPHLSATSTMAKYKGAAFGEQSPHPFAIASSAYRYLVVA

SEQ ID NO: 144865 - protein, 268 aa, Glycine max
  Coding DNA Sequence Number=SeqID_53180
  Gene Ontology: Mol. function=hydrolase activity; Biological process =metabolic process
  Homolog annotation: Hit_ID=A7Q7L2; Match level="QueryCoverage=72%, HitCoverage=96%, E-value=4e-74, Identity=70%"; Hit description =Chromosome undetermined scaffold_60, whole genome shotgun sequence
  Pfam annotation: Domain name=Isochorismatase; Domain location=87-262; Score=90.9; E_value=4e-24; Accession=PF00857.11; Description =Isochorismatase family
MPRDSNSGWLVPPSARQKQVWVRLPAISYASVKIPYYAIHNYLFFVSTVEISNPQYLKYVSNSHTQMSSSLKRCTSYTKYEIRKRNPEPKSCALLVIDVQNHFSSMATPILHNLNTTISLCRRASIPVIFTRHCHKSPSDAGMLEEWWSGDLIVDGTAEAELLEALDRKSSDLVVEKSTYSAFRSTGLEEKLVEMGVKEVIVTGVMTNLCCETTSREAFVRGFRVFFSADATATSDVELHEAALKNLAYGFAYLVDCQRLQHALSGAK

SEQ ID NO: 144866 - protein, 558 aa, Glycine max
  Coding DNA Sequence Number=SeqID_53181
  Gene Ontology: Mol. function=nucleic acid binding; Cellular component= intracellular; Biological process=regulation of transcription
  Homolog annotation: Hit_ID=A7PC31; Match level="QueryCoverage=79%, HitCoverage=60%, E-value=1e-158, Identity=57%"; Hit description =Chromosome chr2 scaffold_11, whole genome shotgun sequence
  Pfam annotation: Domain name=JmjC; Domain location=213-336; Score =167.7; E_value=3e-47; Accession=PF02373.13; Description=JmjC domain
  Pfam annotation: Domain name=JmjN; Domain location=37-76; Score=35.2; E_value=2.4e-07; Accession=PF02375.8; Description=jmjN domain
  Pfam module annotation: Pfam domain module=JmjC::JmjN; Domain location=213-336::37-76
MTGKSPITQRTARHGSHKLCKFDLSDLEWTNMIPECPTYHPSEHEFEHPLVYLQKIAHEASKYGICKIVSPIAASNPAAFVLMKEKKNFKFETNVQPLRLSKWNEKDIITFSMRGRKYTYHDFEVLANKAFFSRFHSSRDLPSSYVEKEFWHEMAQGEKGTVEYGVNVEGSAFSCDPNDRLGTSKWNLKNFSQLPQSLIRLVDREIPGITDPMLYIGMLFSMFAWHVEDHYLYSINYHHSGANKTWYGVPGYAASQFEKTVLQHVYCNKIITKHGEDGAFKFLAQKTTMFPPNVMLQHDVAVYKAVQKPGEFIITFPRAYHAGFSHGFNCGEAVNFANGDWFPLGAAASRRYTHLKMMPLIPYEELLCKEAMLVFKSSRVRSSKNKPEDTTSYQAIMLPFMHLMQSYKTSLLRLNSSRKLHSSSNTTDIAPQTCLCGRDYTIFKRNDIFALEEAAKSFQQGKECVDKFSLSSIFSCNINDCIKVPENNPWQREKSVRGTSFLGVASKPKTKVADSTKHSDERNKSTTKHWRNNGLPSVRGAERPGIIYNLRKRKSKLI

SEQ ID NO: 144867 - protein, 43 aa, Glycine max
  Coding DNA Sequence Number=SeqID_53182
MKGEHEPTQLDLSRAIKMDQVDPLGLTHLINELVQPNSLFVET

SEQ ID NO: 144868 - protein, 275 aa, Glycine max
  Coding DNA Sequence Number=SeqID_53183
  Gene Ontology: Mol. function=molecular_function; Cellular component =membrane; Biological process=auxin mediated signaling pathway
  Homolog annotation: Hit_ID=A7QP79; Match level="QueryCoverage=86%, HitCoverage=66%, E-value=4e-81, Identity=60%"; Hit description =Chromosome chr1 scaffold_136, whole genome shotgun sequence
  Pfam annotation: Domain name=DUF6; Domain location=86-215; Score =41.7; E_value=2.5e-09; Accession=PF00892.11; Description=Integral membrane protein DUF6
MVPVFTFIMALPLGIEKVNMKKLSAKAKVLGTFVCIGGALMLILYKGVPLINQQPEHIADKGTIRSSASKLKKWIIGSLLLTAGCFLWSSWFLIQASISKKYPCQYSSTAILSFFASIQSAILTLVIDRSNAKWILKGKLEIMTVVYAGLVGSGLCYVAMSWCVKQRGPVFTSAFTPLLQMFVAVLDFSILHEEIYLGSVAGSVLVISGTYILLWGKSKEEEQCAVKGTQESQEDEECKNNLEASSNVPSKLRPNEEQGFSELQVKQLAITVTRS

SEQ ID NO: 144869 - protein, 47 aa, Glycine max
  Coding DNA Sequence Number=SeqID_53184
  Gene Ontology: Cellular component=nucleus
  Homolog annotation: Hit_ID=Q0WQE7; Match level="QueryCoverage=72%, HitCoverage=5%, E-value=1e-09, Identity=82%"; Hit description =Putative uncharacterized protein At5g48520
DGIYLAYSDFNQFLLGDSSCLKELNQWFAKQLDTLRRMNRFPFERKP

SEQ ID NO: 144870 - protein, 445 aa, Glycine max
  Coding DNA Sequence Number=SeqID_53185
  Gene Ontology: Mol. function=oxidoreductase activity, acting on the CH-OH group of donors, NAD or NADP as acceptor; Cellular component =nucleus; Biological process=metabolic process
  Homolog annotation: Hit_ID=A7PZI9; Match level="QueryCoverage=100%, HitCoverage=66%, E-value=1e-122, Identity=55%"; Hit description =Chromosome chr15 scaffold_40, whole genome shotgun sequence
  Pfam annotation: Domain name=2-Hacid_dh_C; Domain location=2-158; Score=-64.3; E_value=6.6e-05; Accession=PF02826.10; Description=D -isomer specific 2-hydroxyacid dehydr
  Pfam annotation: Domain name=DUF659; Domain location=46-194; Score= -55.5; E_value=0.0074; Accession=PF04937.6; Description=Protein of unknown function (DUF 659)
  Pfam module annotation: Pfam domain module=2-Hacid_dh_C::DUF659; Domain location=2-158::46-194
MDTLNDLLAASDLISLHCALTNETMQIINAECLQHVKPGAFIVNTGSSQLLDDCAVKQLLIDGTLAGCALDGAEGPQWMEAWVVGEYGRGLKPPTYHEIDGKGRPPINLLVNSASGTVFLNSIDTNDIIKDVKQMFELLDSLVEVKEMPNVLILPRSADYSEEVWMEIREKAISILQTFFIDGIIPKNAMSDVEEESEVDNESEQSDQQYNGNALQIIVREQTDDVHSTSARSEGRRSRSGKKAKKRHTRHKSQQKHEDPSALEKEGTSQRDDTAMSGTDQALSSSSEDSRNRKTPIESMQEPTGAQVIKSSLRLSGNCTELLKDGYIIALYARDCSALHVSRQRVKGGGWIMDSMSNVSKRDPAAQFLIIFRSKDTIGLRSLAAGGKLLQINRRMEFVFASHSFDVWENWTLEGSLQECRLAVLDVRVEILATVGEDGVTRWLE

SEQ ID NO: 144871 - protein, 322 aa, Glycine max
  Coding DNA Sequence Number=SeqID_53186
  Gene Ontology: Mol. function=protein serine/threonine kinase activity; Cellular component=cytoplasm; Biological process=protein amino acid phosphorylation
  Homolog annotation: Hit_ID=A5AD40; Match level="QueryCoverage=100%, HitCoverage=100%, E-value=1e-162, Identity=77%"; Hit description =Putative uncharacterized protein
  Pfam annotation: Domain name=Pkinase; Domain location=39-274; Score =184.4; E_value=2.8e-52; Accession=PF00069.16; Description=Protein kinase domain
  Pfam annotation: Domain name=Pkinase_Tyr; Domain location=39-274; Score=-55.5; E_value=5.2e-09; Accession=PF07714.8; Description =Protein tyrosine kinase
  Pfam module annotation: Pfam domain module=Pkinase::Pkinase_Tyr; Domain location=39-274::39-274
MALESAPASADIRGVHTHGGGYVQYNIYGNLFEVSRKYVPPIRPVGRGAYGIVCAAVNAETHEEVAIKKVGNAFDNRIDAKRTLREIKLLRHMEHENLLRGLKYVHSANVLHRDLKPSNLLLNANCDLKIADFGLARTTSETDFMTEYVVTRWYRAPELLLNCSEYTAAIDIWSVGCILGEIITRQPLFLGKDYVHQLRLITELIGSPDDTSLGFLRSDNARRYVRQLPQYPRQQFAARFPSMSPGAVDLLEKMLVFDPNRRITVEEALCHPYLAPLHDINEEPACVRPFSFDFEQPSFTEEDIKELIWRESVLFNPDPPIY

SEQ ID NO: 144872 - protein, 481 aa, Glycine max
  Coding DNA Sequence Number=SeqID_53187
  Gene Ontology: Mol. function=hydrolase activity, acting on glycosyl bonds; Cellular component=extracellular region; Biological process =cell wall organization and biogenesis
  Homolog annotation: Hit_ID=Q84LI7; Match level="QueryCoverage=91%, HitCoverage=93%, E-value=0.0, Identity=78%"; Hit description =Polygalacturonase-like protein
  Pfam annotation: Domain name=Glyco_hydro_28; Domain location=86-441; Score=-11.0; E_value=1.3e-08; Accession=PF00295.8; Description =Glycosyl hydrolases family 28
MEFLWKTLMRIHVIRTFFALLLVALLSSEGVESRKAKVVTTSLEYNAINCRAHSASLTDFGGVGDGKASNTKAFQSAISHLSQYASEGGSQLYVPAGKWLTGSFSLTSHFTLYLDKDAVLLASQDITEWPVLEPLPSYGRGRDAPAGRFTSLIFGTNLTDVIVTGENGTIDGQGEFWWQQFHRKKLKYTRPYLIELMFSDNIQISNLTLLNSPSWNVHPVYSSNIIVQGITIFAPVTSPNTDGINPGQYFIINFKFFKYRIMYSKQSGWDEYGIKFGWPTKQLMIRRLTCISPYSATIALGSEMSGGIQDVRAEDITAIQTESGVRIKTAVGRGGYVKDIYVKRMTLHTMKWAFKMTGDYNSHADSHYDPNALPEIKNINYRDVVAENVTIAARFQGISNDPFTGICIANVTLRMAAKAKKQPWTCTDIEGMTSGVTPPPCGLLPDQGPEKITACDFPADSLPIDMLELKKCTTTMTFVGV

SEQ ID NO: 144873 - protein, 178 aa, Glycine max
  Coding DNA Sequence Number=SeqID_53188
  Gene Ontology: Mol. function=calcium ion binding; Cellular component =integral to membrane; Biological process=negative regulation of myoblast differentiation
  Homolog annotation: Hit_ID=A9P0U8; Match level="QueryCoverage=68%, HitCoverage=50%, E-value=2e-49, Identity=65%"; Hit description =Putative uncharacterized protein
  Pfam annotation: Domain name=EGF; Domain location=116-147; Score=5.8; E_value=2.3; Accession=PF00008.18; Description=EGF-like domain
  Pfam annotation: Domain name=EGF; Domain location=73-109; Score=39.9; E_value=9.3e-09; Accession=PF00008.18; Description=EGF-like domain
  Pfam annotation: Domain name=EGF_2; Domain location=116-147; Score =2.8; E_value=1.4; Accession=PF07974.4; Description=EGF-like domain
  Pfam annotation: Domain name=EGF_2; Domain location=73-109; Score =10.7; E_value=0.16; Accession=PF07974.4; Description=EGF-like domain
  Pfam module annotation: Pfam domain module=EGF::EGF::EGF_2::EGF_2; Domain location=116-147::73-109::116-147::73-109
MSITTGICQVVAVSLLLGSLSVYSLECDDDRCKTWLCNSTGACTCNLPDPSTILNGDRTFLGGTFCDEEMTMCDGTNSFWCEHGATCEEIVQGEKYSCKCPPGFAGEHCEHSGASCGQTFCFHNAECLAEAGDVCQCPSEWKGSADCSLPTTPTGSTLPSSFHKLQPSLDAVEMKRVI

SEQ ID NO: 144874 - protein, 269 aa, Glycine max
  Coding DNA Sequence Number=SeqID_53189
  Gene Ontology: Mol. function=L-isoleucine transmembrane transporter activity; Cellular component=integral to membrane; Biological process=amino acid transport
  Homolog annotation: Hit_ID=Q2HUS3; Match level="QueryCoverage=99%, HitCoverage=63%, E-value=1e-104, Identity=71%"; Hit description =Amino acid/polyamine transporter II
  Pfam annotation: Domain name=Aa_trans; Domain location=3-269; Score= -64.8; E_value=0.0017; Accession=PF01490.9; Description=Transmembrane amino acid transporter protein
MDKDSNIRTYPDMGELAFGKTGRLIISGLIYTELFLVSVGFLILEGDNLSNLFPTVEIHTADLAIGGKKLFVILVALVLDNLRILSYVSASRVFASAIIILSISWTATFDGVGFHQKGTLVNWKGNPTAVSLYAFCYCAHPVFPSLYNSMRNKHQFSNVLLVSFLLSTAGYASMAIICCLMFGPKVESQVTLNLKINKVSPKIAICTTLVNPISKFALMVTPITNALKDLLPRTYRNRATRILISTVLVIRTTTVALVVPFFGYLMSLS

SEQ ID NO: 144875 - protein, 313 aa, Glycine max
  Coding DNA Sequence Number=SeqID_53190
  Gene Ontology: Mol. function=translation initiation factor activity; Cellular component=cellular_component; Biological process=regulation of translational initiation
  Homolog annotation: Hit_ID=A9P9K5; Match level="QueryCoverage=54%, HitCoverage=41%, E-value=1e-80, Identity=86%"; Hit description =Putative uncharacterized protein
MPVDNMGDNVTVSTTQHHIAIPIEKLNASLEAAKEENSVTDDAYVDNDVQKSQEKDEETEEKGECRYCQEEDLVSNMESPCNCNGSVKEWTIPGTNTQIRSPLVLADRATKGLIDSMNKDFSLRNPTGGVIFGMSLVIVVFTGGRTQPGTTKPDEGDRHPYSIIECEPKREVILPSVIYIQKILRRRPFLIKNLENVMRKFLQSLELFEENERKKLAIFTALAFSQKLSGLPPETVFQPLLKDNLVAKGLVLSFMTDFFKEYLIDNSLDDLISILKRGKVEENLLDIFPPTKRSNEAFSEHFTSSNSLDDLNL

SEQ ID NO: 144876 - protein, 395 aa, Glycine max
  Coding DNA Sequence Number=SeqID_53191
  Gene Ontology: Mol. function=pyridoxal phosphate binding; Cellular component=mitochondrion; Biological process=cysteine biosynthetic process from serine
  Homolog annotation: Hit_ID=A5YT86; Match level="QueryCoverage=100%, HitCoverage=100%, E-value=0.0, Identity=88%"; Hit description =Cysteine synthase
  Pfam annotation: Domain name=PALP; Domain location=80-368; Score =436.8; E_value=3e-128; Accession=PF00291.16; Description=Pyridoxal -phosphate dependent enzyme
  Subcellular localization annotation: CTP_CleavageSite=29; ConfidenceScore=5.17e-01
MASLMSTILKQRSCSSSSHAGRLLFSTTTAAIVDSPSLAQRIRDLPKDLPGTNIKKHVSQGLRIVKTPSSQHSEKIEFPLRKLIGRTPLVYLNKVTEGCGAYVAVKQEMMQPTASIKDRPAYAMITDAEEKNLITPGKTTLIEPTSGNMGISMAFMAAMKGYKMVLTMPSYTSLERRVTMRAFGAELILTDPAKGMGGTVKKAYELLENTPNAHMLQQFSNPANTQVHFETTGPEIWEDTNGQVDIFVMGIGSGGTVSGVGQYLKSKNPNVKIYGVEPSESNVLNGGKPGPHHITGNGVGFKPDILDLDVMEKVLEVSSEDAVNMARVLALKEGLMVGISSGANTVAALRLAQLPENKGKLIVTVHPSFGERYLSSVLFQELRQEAENMQPVAVD

SEQ ID NO: 144877 - protein, 624 aa, Glycine max
  Coding DNA Sequence Number=SeqID_53192
  Gene Ontology: Mol. function=identical protein binding; Cellular component=nucleus; Biological process=DNA replication initiation
  Homolog annotation: Hit_ID=A7PHB9; Match level="QueryCoverage=86%, HitCoverage=99%, E-value=0.0, Identity=61%"; Hit description =Chromosome chr17 scaffold_16, whole genome shotgun sequence
  Pfam annotation: Domain name=Arch_ATPase; Domain location=72-279; Score=-89.4; E_value=0.021; Accession=PF01637.9; Description =Archaeal ATPase
MDEDKTQQLPRRMTRSSASSSPSTSNNIVAAKVTSLEPLTINDLLVGGDPISLDDIISSFPGRSSQILEVVRHLGPLNSPMLPLFVYGSSSTGKTSIILQLFRHLNRPIVFSSCRTCYNQNILFESILNQLLLHRKNAANGYLNAKRCERPSDFVNFLREALTNVISNLKEKSEKLISNEMTQGKIGNMIYLVFDNFQLVREWDKSSTILPLLFNLYDLLNTPEVGLIFISSTSPDTFYSNMGYVEPIPIYFPDYTEEDIRQILLRNQVNQKLYSSFLDVSLKSFCGITKQIDDLSAALKPLYEKYCEPLSDKGKGVAPNQEMKRRLLAHINPHIASSLNEIFKVSSLSSTEVETRKEEKWKGNLRRLEQSKELVSLDFHISTSAKYLLISAFLASRNPATLDASLFDSKGGSDNRKRKRKPSEKAQERKETLEQELLMKGPGTFPLERLLAIFQCLVSVAEEPSDEEEQNNDGLGVEGGNGGLMSDILLQLSSLCNSNFIFKGRSCPIEGSTRYRSTISEDLALKVTSLSHLTPSKFFVIVYVRRLKYTSTKNDAFNFVKQVARSLEFPLSKVYTTSTMPYCYQHEMAGIPYECLKQNQRYRMDNCEHGGSWDGWTEHFTMDN

SEQ ID NO: 144878 - protein, 125 aa, Glycine max
  Coding DNA Sequence Number=SeqID_53193
MTTMSGPHRSTARPWPELDESDDGSGVALHHLLLDLRGIELGDIGGRERGFGFLAPFSPRVVLLVVEHVVQLVGDVNLALSGEGKMGICGREEEKEKESGDWLEGHGGREDQMRNDALSLSTGIP

SEQ ID NO: 144879 - protein, 55 aa, Glycine max
  Coding DNA Sequence Number=SeqID_53194
MAPIDSRTLIQPLNCHCMQGMTWCKGHAYLLSRTGMDWTINHRRSLGVEKEMWAQ

SEQ ID NO: 144880 - protein, 970 aa, Glycine max
  Coding DNA Sequence Number=SeqID_53195
  Gene Ontology: Mol. function=beta-amylase activity; Cellular component=extracellular region; Biological process=polysaccharide catabolic process
  Homolog annotation: Hit_ID=A7PZF6; Match level="QueryCoverage=59%, HitCoverage=88%, E-value=0.0, Identity=72%"; Hit description =Chromosome chr15 scaffold_40, whole genome shotgun sequence
  Pfam annotation: Domain name=DUF822; Domain location=284-447; Score =195.0; E_value=1.9e-55; Accession=PF05687.4; Description=Plant protein of unknown function (DUF822)
  Pfam annotation: Domain name=Glyco_hydro_14; Domain location=474-883; Score=333.0; E_value=5.5e-97; Accession=PF01373.8; Description =Glycosyl hydrolase family 14
  Pfam module annotation: Pfam domain module=DUF822::Glyco_hydro_14; Domain location=284-447::474-883
MGLNVYCPHIDPKQHFLGTGAYYEWVYSGGIPSPGETPFLCYFTWQGASHSTDLCVPDKDTGCQFADWEIKLNGLCRYFGAGPGAYLARTPRSCQVPKHARLRTHDTSENQPRETHLACFTRSHARTPDTFRSALPFPDLDPAGFLPFAIDHAGSPRRSPGIAVPDGALKIPSRRRGICRRIRHLQRVFDLEACEIPEDMVLGIMATDMQRLVGTSEDDEEMGMDVKDEDDEDDDYEENGGEQGNASVSGMVEIDDGNGIGTATGDNRFQQHQQFQEQVGTPGGGTRRSRPLEEKERTKLRERRRRAITARILAGLRRHGNYNLRVRADINDVIAALAREAGWVVLPDGSTFPSRSQGQKPAGGNSTIVTSSSSLAASQQTPSASLRGVASGYRSPLEYNACQTKGVFMPTPSPYDLSSSSRSQTSMVGDGEAQRDNRPLIAGSMDNADDKQIADLPPRLPERDLAGTPYVPVYVMLSLGVINIKCELVDPDGLLKQLRVLKSVHVDGVMVDCWWGIVEAHAPQEYNWNGYKRLFQMVRELKLKLQVVISFHECGGNFGDDVCIPLPHWVAEIGRSNPDIFFTDKEGRHNPECLSWGIDKERVLRGRTAVEVYFDFMRSFRVEFDEYFEDGFISMIEIGLGPCGELRYPSCPVKHGWRYPGVGEFQCYDQYMLKSLRKAAEVRGHSIWARGPDNAGTYNSQPHETGFFCDGGDYDGFYGRFFLSWYSQVLVDHGNRVLSLAKLAFEGSCIAAKTASHAAELTAGYYNPCNRDGYAAIMTMLKTIGVSLNIPCVDLHTFNQQHEGFPETFADPEGIVWQLLNAGWDVDLPVTGQNGFPCLNRVGYNKVLDNAKPMNDPDGRLFSSFTYLRLSPLLMEQQNFVEFERFVKRMHVFVFLGNVPLLRRLPGSSVQKISELVILKHYAVGVELGPISYFDTQVPHRLTICCSRIKPKLRLLALLVPMKKIIRSST

SEQ ID NO: 144881 - protein, 136 aa, Glycine max
  Coding DNA Sequence Number=SeqID_53196
  Gene Ontology: Mol. function=3'-5'-exoribonuclease activity; Biological process=RNA processing
  Homolog annotation: Hit_ID=Q2HRD9; Match level="QueryCoverage=88%, HitCoverage=50%, E-value=3e-49, Identity=78%"; Hit description =Peptidase S8 and S53, subtilisin, kexin, sedolisin; 3 exoribonuclease
MYNNFTDDPYTIGYMSCTALVDAGIPLKHLAVAICCSVTDSGCIILDPTKEEEEKMKAYINLVFPNTIVSVLPERSSQVGSEPMAHGIMTSVTQGAMSVDDYLHCLDRGRAASARLSEFVRKNIGPKSTCEASKAG

SEQ ID NO: 144882 - protein, 323 aa, Glycine max
  Coding DNA Sequence Number=SeqID_53197
  Gene Ontology: Mol. function=DNA binding; Cellular component=nucleus
  Homolog annotation: Hit_ID=A7PZC7; Match level="QueryCoverage=99%, HitCoverage=96%, E-value=1e-77, Identity=53%"; Hit description =Chromosome chr15 scaffold_40, whole genome shotgun sequence
  Pfam annotation: Domain name=AT_hook; Domain location=116-128; Score =9.8; E_value=0.49; Accession=PF02178.10; Description=AT hook motif
  Pfam annotation: Domain name=AT_hook; Domain location=79-91; Score =19.7; E_value=0.0095; Accession=PF02178.10; Description=AT hook motif
  Pfam annotation: Domain name=DUF296; Domain location=146-254; Score =168.2; E_value=2.2e-47; Accession=PF03479.6; Description=Domain of unknown function (DUF296)
  Pfam module annotation: Pfam domain module=AT_hook::AT_hook::DUF296; Domain location=116-128::79-91::146-254
  Subcellular localization annotation: CTP_CleavageSite=55; ConfidenceScore=5.07e-01
MALSGSYYMQQRGIPGSGGQPELHISPNMRPLSNPNLPFQSSIGGGTIGSTLPLESSAISAHGVNVGAPTGAPLGEPVKRKRGRPRKYGTDGSVSLALTPTPTSSSHPGALSQSQKRGRGRPPGTGKKQQLASLGELMSGSAGMGFTPHIINIASGEGPRVVCILSANGAVSTVTLRQPSTSGGTVTYEGRFEIVCLSGSYLVTENGGSRNRTGGLSVSLASPDGRVIGGGVGGVLIASSPVQVVVGSFLWGGSKTKNKKKESSEGAEVAVESDHQGVHNPVSLNSISQNQNLPPTPPSLSPWSTSRPLDMRNSHVDIDLMRG

SEQ ID NO: 144883 - protein, 434 aa, Glycine max
  Coding DNA Sequence Number=SeqID_53198
  Gene Ontology: Mol. function=ATP-dependent helicase activity; Cellular component=cytoplasm; Biological process=regulation of translation
  Homolog annotation: Hit_ID=A7QIS9; Match level="QueryCoverage=93%, HitCoverage=84%, E-value=0.0, Identity=92%"; Hit description =Chromosome chr2 scaffold_105, whole genome shotgun sequence
  Pfam annotation: Domain name=DEAD; Domain location=56-222; Score =229.4; E_value=8e-66; Accession=PF00270.20; Description=DEADDEAH box helicase
  Pfam annotation: Domain name=Helicase_C; Domain location=288-364; Score=113.9; E_value=4.9e-31; Accession=PF00271.22; Description =Helicase conserved C-terminal domain
  Pfam module annotation: Pfam domain module=DEAD::Helicase_C; Domain location=56-222::288-364
MDFGGQYWKARLNIPPPDTCHKTEDVTATKGNEFEDYFLKRELLMGIYEKGFERPSPIQEECIPIALTGSDILARAKNGTGKTAAFCIPALEKIDQDNDVIQVAILVPTRELALQTSQVCKDLGKHLKIQVMVTTGGTSLKDDIMRLYQPVHLLVGTPGRILDLAKKGVCILNDCSMLVMDEADKLLSQEFQPSIEQLIQFLPGNRQILMFSATFPVTVKDFKDRYLRKPYIVNLMDELTLKGITQYYAFLEERQKVHCLNTLFSKLQINQSIIFCNSVNRVELLAKKITELGYSCFYIHAKMLQDHRNRVFHDFCNGACRNLVCTDLFTRGIDIQAVNVVINFDFPKNSETYLHRVGRSGRFGHLGLAVNLITYEDRFNLYRIEQELGTEIKQIPPHIDQAIYCRAPNVYYYCTLLIEEKVDANVVLALVNAL

SEQ ID NO: 144884 - protein, 1863 aa, Glycine max
  Coding DNA Sequence Number=SeqID_53199
  Gene Ontology: Mol. function=cation transmembrane transporter activity; Cellular component=integral to membrane; Biological process=potassium ion transport
  Homolog annotation: Hit_ID=A7R1T0; Match level="QueryCoverage=30%, HitCoverage=88%, E-value=0.0, Identity=64%"; Hit description =Chromosome undetermined scaffold_376, whole genome shotgun sequence
  Pfam annotation: Domain name=DUF827; Domain location=639-921; Score= -111.9; E_value=0.044; Accession=PF05701.2; Description=Plant protein of unknown function (DUF827)
  Pfam annotation: Domain name=Na_H_Exchanger; Domain location=1200 -1536; Score=144.3; E_value=3.4e-40; Accession=PF00999.12; Description=Sodiumhydrogen exchanger family
  Pfam annotation: Domain name=PPR; Domain location=144-178; Score =34.8; E_value=3.2e-07; Accession=PF01535.11; Description=PPR repeat
  Pfam annotation: Domain name=PPR; Domain location=179-213; Score=4.2; E_value=2.4; Accession=PF01535.11; Description=PPR repeat
  Pfam annotation: Domain name=PPR; Domain location=214-248; Score =12.7; E_value=0.24; Accession=PF01535.11; Description=PPR repeat
  Pfam annotation: Domain name=PPR; Domain location=276-310; Score =49.9; E_value=8.6e-12; Accession=PF01535.11; Description=PPR repeat
  Pfam annotation: Domain name=PPR; Domain location=311-345; Score=6.9; E_value=1.2; Accession=PF01535.11; Description=PPR repeat
  Pfam annotation: Domain name=PPR; Domain location=377-411; Score =35.1; E_value=2.5e-07; Accession=PF01535.11; Description=PPR repeat
  Pfam annotation: Domain name=PPR; Domain location=412-446; Score=4.2; E_value=2.4; Accession=PF01535.11; Description=PPR repeat
  Pfam annotation: Domain name=PPR; Domain location=43-77; Score=20.1; E_value=0.0083; Accession=PF01535.11; Description=PPR repeat
  Pfam annotation: Domain name=PPR; Domain location=448-482; Score=7.7; E_value=0.94; Accession=PF01535.11; Description=PPR repeat
  Pfam annotation: Domain name=TrkA_N; Domain location=1567-1682; Score= 115.1; E_value=2.1e-31; Accession=PF02254.9; Description=TrkA-N domain
  Pfam module annotation: Pfam domain module=DUF827::Na_H _Exchanger::PPR::PPR::PPR::PPR::PPR::PPR::PPR::PPR::PPR::TrkA_N; Domain location=639-921::1200-1536::144-178::179-213::214-248::276 -310::311-345::377-411::412-446::...
  Pfam module annotation: Domain location=43-77::448-482::1567-1682
MVNPNLRTDPSTIYNLIKSYALSPSTILKAHNLFQQIHRPTLPFWNIMIRGWSVSDQPNEAIRMYNLMYRQGLLGNNLTYLFLFKACARVPDVSCGSTIHARVLKLGFESHLYVSNALINMYGSCGHLGLAQKVFDEMPERDLVSWNSLVCGYGQCKRFREVLGVFEAMRVAGVKGDAVTMVKVVLACTSLGEWGVADAMVDYIEENNVEIDVYLGNTLIDMYGRRGLVHLARGVFDQMQWRNLVSWNAMIMGYGKAGNLVAARELFDAMSQRDVISWTNMITSYSQAGQFTEALRLFKEMMESKVKPDEITVASVLSACAHTGSLDVGEAAHDYIQKYDVKADIYVGNALIDMYCKCGVVEKALEVFKEMRKKDSVSWTSIISGLAVNGFADSALDYFSRMLREVVQPSHGAFVGILLACAHAGLVDKGLEYFESMEKVYGLKPEMKHYGCVVDLLSRSGNLQRAFEFIKEMPVTPDVVIWRILLSASQVHGNIPLAEIATKKLLELDPSNSGNYVLSSNTYAGSNRWEDAVKMRELMEKSNVQKPSGSSCIETQSVVELWNLEDNADSFNVFVIILSILTLFFPVRNETTMDRLRNMSMDMACSLPQSRVLHGGLGTSYRHRSVGQLGCFDFRGRGFGCASFGDSRSVSRLQRSRMNVSACWNNSRVATGREFKVLNTKRSLSCKKNNNLFMVSRVIWSKCQGNDSLAYVNGNGRNVDYVEGSGEDVGLGPVSSAELDATLEEEEGQAERKEGGSEIGLEELSVDELKELLQKALKELEVAQINSTMFEEKVKKISETAISLHDEAVNSWNNVNSTLGTIQEIANEEHTAKEVVQNATMALSLAEARLQVAIESLEAAKEVPDSAQGSNENSGDKDTVDEEQALLVAKEDIKECQANLANCEAELRHLQDRKEELQKEVSKLQEIAEKAQLNAVKAEEDVTNIMLLAEQAVAFELEATKLVNDAEIALQRADKSNSNSNADTIESTQAQDVVVAVPEEEKVVQGFSGDVERDRDLAIDDESVLANLSPETLSDKTSQVLEDKTQSDYLSDNENAVQTKKQEIQKDLTRDSSLAPKALLKKSSRFFSASFFSSAEDGTEFTPASVFQSFVLSVQKQLPKLIFGLLLMGAGVAFYSNRVERNAQLLTQADVIMTSVEEVSSSAKPLFRQLQKLPKKIKKIIASLPHQEVNEEEASLFDILWLLLASVIFVPIFQKIPGGSPVLGYLAAGILIGPYGLSIIRHVHGTKAVAEFGVVFLLFNIGLELSVERLSSMKKYVFGLGSAQVLATAVAVGLMAHYICGQAGPAAIVIGNGLALSSTAVVLQERGESTSRHGRATFSVLLFQDLAVVVLLILIPLISPNSSKGGVGFQAIAEALGLAAVKAAVAITAIIAGGRLAGLSMALGAFLAGLLLAETEFSLQVESDIAPYRGLLLGLFFMTVGMSIDPKLLVSNFPVITGTLGLLICGKTILVCLIGRMFGISLISAIRVGLLLAPGGEFAFVAFGEAVNQGIMSSQLSSLLFLVVGISMAITPWLAAGGQLIASRFEQNDVRSLLPVESETDDLQDHIIICGFGRVGQIIAQLLSERLIPFVALDVRSDRVAVGRALDLPVYFGDAGSREVLHKVGAERACAAAITLDTPGANYRTVWALSKYFPNVKTFVRAHDVDHGLNLEKAGATAVVPETLEPSLQLAAAVLSQAKLPTSEIAATINEFRSRHLAELTEWGESNLRPLTPSLLPLSLDQPYNSYITIIWWIAATRSIWKLRNDVIFHNQPFHISKLVDNTNFLTWSWLRGVMGVSCRASVLCSFGLMFLETLSPYLVVPLLCEASGSSLGYGFNRIMNKPKSPSPDSLDETPVSEGTLAI

SEQ ID NO: 144885 - protein, 74 aa, Glycine max
  Coding DNA Sequence Number=SeqID_53200
  Gene Ontology: Mol. function=phosphomannomutase activity; Cellular component=cytoplasm; Biological process=mannose biosynthetic process
  Homolog annotation: Hit_ID=Q1W377; Match level="QueryCoverage=62%, HitCoverage=18%, E-value=5e-17, Identity=91%"; Hit description =Phosphomannomutase
  Pfam annotation: Domain name=PMM; Domain location=1-74; Score=-125.5; E_value=0.032; Accession=PF03332.4; Description=Eukaryotic phosphomannomutase
VVTVGVVGGSDLIKISEQLGSTVTNEYDYVFSENGLVAHKEGKLIGTQQSRQQQQQQQRLIPLGGVGYMDQLPP

SEQ ID NO: 144886 - protein, 464 aa, Glycine max
  Coding DNA Sequence Number=SeqID_53201
  Gene Ontology: Mol. function=oxidoreductase activity; Cellular component=cytosol; Biological process=metabolic process
  Homolog annotation: Hit_ID=Q2HVK5; Match level="QueryCoverage=98%, HitCoverage=99%, E-value=1e-122, Identity=60%"; Hit description =Short-chain dehydrogenase/reductase SDR
  Pfam annotation: Domain name=adh_short; Domain location=7-187; Score =32.3; E_value=9.3e-08; Accession=PF00106.16; Description=short chain dehydrogenase
MAEAKLRYAVVTGANKGIGFETVKELASNGVKVVLTARDEKKGHEAFERLKECGFSDLVIFHQLDVTESASISSLVEFVKTNFGKLDILVNNAGISGANLDEVEGSTFKWEELTQTNEMTEKCLTTNYYGAKKTTEAFLTLLQLSNSPRIVNVSSQAGLLKNISNEWAKGVLDDADNLTEERIDEVLKEFIKDFKEGSLATKGWPTFLSAYIVSKAAMNSYTRILAKKHQNMCINSVCPGFVKTDINKNTGILTVDQGAASVVKLALLPDGSPSGLFYIRQELANKGIGLETVKVLDSNVIKVVLTARYEDKGHEAIERLKECGLSNLVIYHQLDVTDSASIASLVDFVKSQFGKLDILESVISDVNLDEVNIANEWAKGVLDDVENLTEERIALNSYTRFLAKKHPNMCINSVCPGFVKTDINRNTGIYSIDQGAANVVKFALLPDGSPSGLFYIGKNCQTSE

SEQ ID NO: 144887 - protein, 241 aa, Glycine max
  Coding DNA Sequence Number=SeqID_53202
  Homolog annotation: Hit_ID=A2Z383; Match level="QueryCoverage=28%, HitCoverage=9%, E-value=2e-09, Identity=56%"; Hit description =Putative uncharacterized protein
  Subcellular localization annotation: CTP_CleavageSite=70; ConfidenceScore=5.18e-01
MLQPYGISIGLKEHSNPMTPKAYTPKSPSGPLPPDSAIATSLAVPGNSFNYSSDCSDRIPKRQRDGEEIETSTYAVFMRFLFLPPRIISRKSQRWKHSSGFLRERKRLQCEGCFSQFRHDIKIPNGENARNCVANMTLKFHNDPTVNGFKIIVFLRLVAIMDEMQMRSAGSKVVFRSLLSLKYPEIVIVPSAITRARVPASVDSNPPLKVPRESLDDIIFDRSERFTPGLIEQILVRVTDK

SEQ ID NO: 144888 - protein, 154 aa, Glycine max
  Coding DNA Sequence Number=SeqID_53203
  Gene Ontology: Mol. function=sequence-specific DNA binding; Cellular component=nucleus; Biological process=regulation of transcription, DNA-dependent
  Homolog annotation: Hit_ID=A5BA82; Match level="QueryCoverage=82%, HitCoverage=14%, E-value=4e-18, Identity=50%"; Hit description =Putative uncharacterized protein
MEQDNLNNNNNCDEETFVCDSRETKRSIAERRGFNSNAARINTALFRTATSTTNPSPSLAARSPRLTIPPGISPTDLLDSPIMLPNSQAISPTTGSFFMLPPLSHEGSMLTTEQGNVDVSTASDVDASFKFKPRGHFDPNHLPPYSASLNQLLI

SEQ ID NO: 144889 - protein, 595 aa, Glycine max
  Coding DNA Sequence Number=SeqID_53204
  Gene Ontology: Mol. function=ribonuclease inhibitor activity; Cellular component=cytoplasm; Biological process=regulation of RNA metabolic process
  Homolog annotation: Hit_ID=A5C7K4; Match level="QueryCoverage=27%, HitCoverage=99%, E-value=2e-84, Identity=93%"; Hit description =Putative uncharacterized protein
  Pfam annotation: Domain name=Methyltransf_6; Domain location=2-159; Score=170.0; E_value=6.3e-48; Accession=PF03737.6; Description =Demethylmenaquinone methyltransferase
  Pfam annotation: Domain name=Seipin; Domain location=281-488; Score =301.0; E_value=2.4e-87; Accession=PF06775.5; Description=Putative adipose-regulatory protein (
  Pfam module annotation: Pfam domain module=Methyltransf_6::Seipin; Domain location=2-159::281-488
MAFVTTAEVCDANPQLILSGELRALQPVFQIYGRRQVFSGPIVTLKVFEDNVLVREFLEEKGNGRVLVVDGGASLRCAILGGNPVVQAQNNGWAGIVVNGCIRDVDEINGCDIGVRALASHPMKANKKGMGEKHVPVNIAGTRISDGDWLYADTDGILISRTELSGGFGDVVLNMRQCAASSYYLDMDKSSHRVAKLPSIGNATTLSYSHADDTCGATLCNNTAPTCVYSSLPKSYHRAEETKDSVESAVQRAPSQSTHGSALLLKKLGLCFLSVAYVCMVMILALILAAVVGVALVRLWVEEPVSVKENLHFDYTEAHPTAVFLFNGVRSFKGHLKKKQISVPVGHSFFASLVLVMPESDFNRELGVFQLTAELISVNGNVIAKSSQPCMLRFRSSPIRLARTFMMGVPLVLGISGETQNINVEILRHKEDYRRSNAIRVTLHPRAGTSSLPQLYEADIVIKSHLPWTKELVRNWKWTFYVWVSLYVYIVLLVSLLCCYRPLVFLVTPEYFNDHRVSELTREEPGQLGDESEVSELLRKWRRSRSKRKTVLAHGGVPETIVGSSASSISMTAREDVTSVVMEDEVEDSESVCIG

SEQ ID NO: 144890 - protein, 144 aa, Glycine max
  Coding DNA Sequence Number=SeqID_53205
MVIQVECLKSSTFEAQTIHEGGEGKRVNPKTPFDDFPHDGEGEAHLAQVGEGVDEDAESDEGGFREKLVEGNDGGWRVEVEHAVEGGNGVVEAEGFGEGFARGVGVEAGEEEEKRKGGEKGGGVQHYGGEGDMGLIEFVSVAWK

SEQ ID NO: 144891 - protein, 46 aa, Glycine max
  Coding DNA Sequence Number=SeqID_53206
MKMLSGPSKLSLASMMIIALSTRFALSAPLSFFVDLLRAKLGMTAK

SEQ ID NO: 144892 - protein, 418 aa, Glycine max
  Coding DNA Sequence Number=SeqID_53207
  Gene Ontology: Mol. function=single-stranded DNA binding; Cellular component=nucleus; Biological process=response to DNA damage stimulus
  Homolog annotation: Hit_ID=A2Q3P8; Match level="QueryCoverage=100%, HitCoverage=69%, E-value=1e-171, Identity=70%"; Hit description =Helix-hairpin-helix motif, class 2
MSDIEAGLGLKRKHLIAISLLVGDDHDINGVRGIGLDTALHFVKAFSEDDILNRLHEIGKGNTSQIPICIKVEDNVDGNSPNRKLSHCSFCGHPGSKKDHMKFPCEYCVTKDDEGCQRKPEDFKCDCFSCDMNRKHKEKKRLENQHTIFFHKIAEEPNFPKDEIIDMYLCNDNGYFSASDSPHIVWGNPNIEMLINFLNFHQHWEPAYVRRMMFPMISTIFLRDMTTTTVETTLFGQYEFDSVERVKMRYGYQFFVVKWKRAGVNISCKVPLKESSVQQDDAIELDEMVDLLDDFDAPEIHGDDGCSFLLTDENMDLVGAAFPAEVKRFWQEQELKRIKNSTSRSQENEKSPSPNSRSIQLNITEFYPSTKVKHRQSKQGEESSKNADSQGNGGSKMKRKMSSPDKIPKSVRRRLLFD

SEQ ID NO: 144893 - protein, 142 aa, Glycine max
  Coding DNA Sequence Number=SeqID_53208
  Homolog annotation: Hit_ID=A2Q3Q0; Match level="QueryCoverage=46%, HitCoverage=37%, E-value=7e-17, Identity=68%"; Hit description =Putative uncharacterized protein
  Subcellular localization annotation: CTP_CleavageSite=42; ConfidenceScore=5.19e-01
MEESKTSFSLFKKPLSWQNTCYLLRPPTTTLTPPISTKSTPSSATDGDPMQVEIVADDEETTSKCTIDKVEEKMRHCFIKNKRPKRPLLPSAAAVAEEKRVVSDDGFVGRVSDSDYDPYAMRMVGFVDGHGLWLFWHGRFGM

SEQ ID NO: 144894 - protein, 622 aa, Glycine max
  Coding DNA Sequence Number=SeqID_53209
  Gene Ontology: Mol. function=kinase activity; Cellular component =Golgi apparatus
  Homolog annotation: Hit_ID=A2Q5C6; Match level="QueryCoverage=97%, HitCoverage=97%, E-value=0.0, Identity=80%"; Hit description=Generic methyltransferase
  Pfam annotation: Domain name=DUF248; Domain location=92-604; Score =1189.7; E_value=0; Accession=PF03141.7; Description=Putative methyltransferase
  Pfam annotation: Domain name=Methyltransf_11; Domain location=209 -304; Score=28.1; E_value=3.3e-05; Accession=PF08241.3; Description =Methyltransferase domain
  Pfam module annotation: Pfam domain module=DUF248::Methyltransf_11; Domain location=92-604::209-304
MAIQNCFSKKPNHQLTRLYLLSFTTFLCTITYLLGLWHHAPPSLPSLVSTTAHSNCPNSIPTLNFSATHFSPDPQAPARDFYAPPCDPSLSEYTPCEDVQRSLKFPRENLIYRERHCPPAEELLRCRVPAPFGYRVPLRWPESRDAAWFANVPHKELTVEKKNQNWVRFEGDQFRFPGGGTMFPRGAGAYIDDIGKLINLEDGSIRTALDTGCGVASWGAYLLSRDIIAVSFAPRDTHEAQVQFALERGVPGLIGVLASIRLPYPSRSFDMAHCSRCLIPWGQNEGIYLNEVDRVLRPGGYWILSGPPINWENHWKGWERTRENLKEEQDGIEKVAKSLCWKKLVQKGDLAIWQKPTNHIHCKITRKVYKNRPFCEAKDPDTAWYTKMDTCLTPLPEVNDIREVSGGELSNWPERLTSVPPRISSGSLKGITAEMFKENNELWKKRVAYYKTLDYQLAERGRYRNLLDMNAYLGGFAAALIDDPVWVMNTVPVEAEVNTLGAIYERGLIGTYMNWCEAMSTYPRTYDFMHGDSVFSLYQNRCKMEDILLEMDRILRPQGSVILRDDVDVLLKVKSFTDAMQWDSRIADHEKGPHQREKILVAVKQYWTAPSPDQKLTQKALN

SEQ ID NO: 144895 - protein, 500 aa, Glycine max
  Coding DNA Sequence Number=SeqID_53210
  Gene Ontology: Mol. function=protein serine/threonine kinase activity; Cellular component=beta-catenin destruction complex; Biological process=protein amino acid phosphorylation
  Homolog annotation: Hit_ID=Q53VM1; Match level="QueryCoverage=94%, HitCoverage=100%, E-value=0.0, Identity=78%"; Hit description =Ser/Thr protein kinase
  Pfam annotation: Domain name=Pkinase; Domain location=171-455; Score =327.2; E_value=2.9e-95; Accession=PF00069.16; Description=Protein kinase domain
  Pfam annotation: Domain name=Pkinase_Tyr; Domain location=171-420; Score=-2.1; E_value=2.9e-12; Accession=PF07714.8; Description =Protein tyrosine kinase
  Pfam module annotation: Pfam domain module=Pkinase::Pkinase_Tyr; Domain location=171-455::171-420
  Subcellular localization annotation: CTP_CleavageSite=51; ConfidenceScore=5.03e-01
MGFIRSVLSGSILLVGFVFAGSCESIAMNVMRRLKSIASGRTSISSDPVMRAQALCEIDMIGGDCTTKRAKFDQDTEGKVNEETYPNERCGKDQEHHVDSNVPSVPRTEKSGYDQLPKELNEMKIGDDKGKNNNEKDMEATIVSGNGTETGEIITTAIGGRDGQPKRTISYIAERVVGTGSFGVVYQAKCLETGEAVAIKKVLQDKRYKNRELQVMRMLDHTNVLRLKHCFYSTAEKDDLYLNLVLEYVPETVYRVSKHYVRMHQHMPIINVQLYTYQICRGLNYLHHVIGVCHRDIKPQNLLVNPQTHQLKVCDFGSAKMLVPGEPNISYICSRYYRAPELIFGATEYTTAIDIWSAGCVLAELLLGHPMFPGESGVDQLVEIIKILGTPTREEIKCMNPNYTEFKFPQIKAHPWHKVFHKKMPSEAVDLVSRMLQYSPNLRCTALEACAHPFFDDLREPNACLPNGRPLPPLFNFTAQELADAPDELRRRLIPEHARS

SEQ ID NO: 144896 - protein, 98 aa, Glycine max
  Coding DNA Sequence Number=SeqID_53211
MEKVQGEMQQKGYGHQDRKKCKPHEKSKQPSLPRPRHRDVKSGPSVFSRLGEDITRGDVDVQFRLFQEAFLQDVFKCFHSSLAVLKFLIWPSAFPHES

SEQ ID NO: 144897 - protein, 53 aa, Glycine max
  Coding DNA Sequence Number=SeqID_53212
MAEEDALSLDNNEGGVCAEYTDVGVYGRRKSGSSKEAYEMRERRLHLSWTHSE

SEQ ID NO: 144898 - protein, 159 aa, Glycine max
  Coding DNA Sequence Number=SeqID_53213
  Gene Ontology: Mol. function=protein binding; Cellular component =membrane; Biological process=ribosome biogenesis and assembly
  Homolog annotation: Hit_ID=A7PV91; Match level="QueryCoverage=69%, HitCoverage=39%, E-value=6e-38, Identity=75%"; Hit description =Chromosome chr4 scaffold_32, whole genome shotgun sequence
  Pfam annotation: Domain name=UPF0016; Domain location=75-150; Score =116.8; E_value=6.4e-32; Accession=PF01169.10; Description =Uncharacterized protein family UPF0016
MGKAAHLNMLQISSWHGFYTLIDSIFYIKKISWSNLVHAKNLLILLTRLKKNWMVDKGKLQLGASFQDFVHQYFWRQSFILTFLAEWGDRSQIATIALATHKNAIGVAVGATIGHTICTSLAVVGGSMLASKISQRSVATVGGLLFLGFSVSSYFYPPL

SEQ ID NO: 144899 - protein, 160 aa, Glycine max
  Coding DNA Sequence Number=SeqID_53214
  Gene Ontology: Mol. function=sequence-specific DNA binding; Cellular component=nucleus; Biological process=regulation of transcription, DNA-dependent
  Homolog annotation: Hit_ID=A1XG54; Match level="QueryCoverage=98%, HitCoverage=57%, E-value=3e-38, Identity=63%"; Hit description=SOC1
  Pfam annotation: Domain name=K-box; Domain location=18-122; Score =74.9; E_value=2.6e-19; Accession=PF01486.8; Description=K-box region
MHLKQETANLMKKIELLEASKRFNISFFSIHLRKLVMFTVRFHSQQKEYIALYYSSLRKLLGEGLGSCSLEELQQIEQQLERSVSSVRARKNQVYKEQIDQLKEKERALYAENARLCEQYGGIQPQPATKDPKEIQPYAESSPSSEVETELFIGLLRSSY

SEQ ID NO: 144900 - protein, 158 aa, Glycine max
  Coding DNA Sequence Number=SeqID_53215
  Gene Ontology: Mol. function=phosphopantothenoylcysteine decarboxylase activity; Biological process=response to stress
  Homolog annotation: Hit_ID=P94063; Match level="QueryCoverage=52%, HitCoverage=58%, E-value=1e-15, Identity=43%"; Hit description =Probable phosphopantothenoylcysteine decarboxylase
  Pfam annotation: Domain name=Flavoprotein; Domain location=53-139; Score=-29.3; E_value=0.0036; Accession=PF02441.10; Description =Flavoprotein
MADPSTISSTVRLFYEQKMRERNNRGQAKPKSRVEARRAELRAKAKAILEKPRILLVAAFGSVCAAIVKVVLTKSALCFIDEQILPQNVTVYRHEKVWNIWKKLGDPLLQIAGELCDDLLTSIVLAWDYKKPLFDLIIVSLSSVFMSPPRVLLVHLYT

SEQ ID NO: 144901 - protein, 153 aa, Glycine max
  Coding DNA Sequence Number=SeqID_53216
MGYLRKHFDAQIRIIECLWSGGLTPTTNNFQVQEMSRKLHPLRAWHNKPDIMPITIDHRRYCYIPWGFTPHRQLEWFKDIRFYLDMEVSHDAQEFIVTLVRFDARGNVLSWRFELVRPVHVTKDQGDHTDMTPEEGEEYYELPQDLEPSFEED

SEQ ID NO: 144902 - protein, 306 aa, Glycine max
  Coding DNA Sequence Number=SeqID_53217
  Homolog annotation: Hit_ID=A7PY22; Match level="QueryCoverage=87%, HitCoverage=9%, E-value=3e-57, Identity=48%"; Hit description =Chromosome chr15 scaffold_37, whole genome shotgun sequence
MFKPHTCGSHALDCILYGTIRPSSCETPSWLNISSNSRLVVQPNTSRAHTFAEEFLACGGIETLLVLLQREAKAGDSGVLESLSMNPESQKTEIAGGNEMIKESQKDEGLKEKSEAIIQDNDQGSISVDSGSSPDPSSDVNSDRIFEITSAKNLGGISLSISADSARKNVYNADKSDGIVVGIIGLLGALVASGHLTFGSRAGPDTTSNLLGVGLHDKGGTMFEDKVSLLLYALQKAFQAAPNRLMTNNVYTALLAASINASSSEDGLNFYDSGHRFEHSQLLLVLLHSLPFAPRSLQSRALQVLA

SEQ ID NO: 144903 - protein, 127 aa, Glycine max
  Coding DNA Sequence Number=SeqID_53218
MDSVPLIAITGQVPLKMIGIGPVLMDIHEIEWKHEEIEQKQKRVPMTLPNLTHLKGHFWLVPQLSNMAKIIKIVPRDNDSDIGVFERLMDIYGATARVGKDIGNPTTMALESLNEHVSTIFGLAGVN

SEQ ID NO: 144904 - protein, 603 aa, Glycine max
  Coding DNA Sequence Number=SeqID_53219
  Gene Ontology: Mol. function=calcium-dependent phospholipid binding; Cellular component=integral to membrane; Biological process=signal transduction
  Homolog annotation: Hit_ID=A7PY44; Match level="QueryCoverage=77%, HitCoverage=83%, E-value=0.0, Identity=70%"; Hit description =Chromosome chr15 scaffold_37, whole genome shotgun sequence
  Pfam annotation: Domain name=C2; Domain location=333-414; Score =104.2; E_value=3.9e-28; Accession=PF00168.21; Description=C2 domain
MKMLKKPIKCIKKKKTEGCFVWNLGKMGLFSGIFLGMVLGIALMAAWQRMMTYRSAKRIAKEYLLVTSDTVITVMSYKFISRMSVSYACGLWTSAWSPDPRFYRLNYSPGEVLICYCDYLAFYRNDLTHPPIIPVNLVKWLNKQLSKLWPFVADAATLVIRESVEPLLEEYRPTGISSLKFSKLSLGNVAPKIEGIRVQSLNKGQIIMDIDFRWGGDPNIVLAVEALVASIPIQLKDLQVFTIIRVIFQLADEIPCISAVVVALLAEPKPRIDYTLKAVGGSLTALPGISDMIDDMVNSIVTDTLQWPHRIVVPLGGIPVDTSELELKPQGTLRVTVIKANDLKNMEMIGKSDPYAVLYIRPLFKVKTKVIDNNLNPVWNEVFDLIAEDKETQSLIVEVFDKDIGQDKRLGIVKLPLNDMEPETEKEFELRMLSSLDTLKVKDKKDRGTITMKIFYHQFNKEEQLVALEAEKNILEERKKLKEEGVIGTTMDALDGAASAVGSGVGMVGTGVATGAGLVGTGIGAGAGFVGTGIGTGAGFVGSGIGAGVGFVGSGLGAVGSGLSRAGKFMGRTITGQGSSRRSGSNTPVNVEETGGGAKPLQQ

SEQ ID NO: 144905 - protein, 811 aa, Glycine max
  Coding DNA Sequence Number=SeqID_53220
  Pfam annotation: Domain name=DUF1777; Domain location=1-198; Score= -70.4; E_value=0.013; Accession=PF08648.3; Description=Protein of unknown function (DUF1777)
  Pfam annotation: Domain name=RRM_1; Domain location=154-219; Score =25.3; E_value=0.00023; Accession=PF00076.13; Description=RNA recognition motif. (a.k.a. RRM, RB
  Pfam module annotation: Pfam domain module=DUF1777::RRM_1; Domain location=1-198::154-219
MREREREQPREREKHRVSERPSERGRLREKQKGRGPGGERERGRDRKRSLPIAKESHRGRRAEKRRERSRTTVTKRGRWRNVIRKEELHGGHGARNNDLVENEKWTTVVSRRSLKASQHLSSTGGQPELGGRDTRYERNWRNQADITSYYFTHFPDEANEELLWWHFKKWGDVREVYIAKRLNKEGRRYGFVRYKDVRDARGLELRLDNIVINGCKLFANLPRFERSRRKTELQEYKYAGGKKTTEGSKVGVTNTDHPRKSYVDAVVKGGCLGPTKEDEVRKPIIQIKPPESGGVWCEGTWTGKLKKMTEIETLEDRIAWELGYNVGTKFLGDDMVLLHGLTDDQARSIIKSEMERGDSLFYEMKKWSPSSRPTNRVVWLQLWGFPIQVWGMQSFRTAMAEIGDVIEPDDDTEDRRRLDRARVLVRTPLPPPIRSDIIVCVGKLEYKVCIVEEVGPEGGMTKRSSSPSEGWSDMITSEDDGDGGDVVDDTDTNFSFSPELSNRNAFPAGNLWTHRQTDGRSIDGGLTGNIQPNVNLQQKSKTSAEAMVDPTTGKDSLGEGPTVTQKEEVYTKRDTANNNQQNDYRHRHHPQGKYSNGEGKDPEEQASIGEEEITAIQYPYPLPLEQNGPNYSKGPLEVKDGCNKEYSVSADHLGMNEGQHHKGGGLSNNTGPLLTEEGCHKEKPRHEAQPLKVCSDKFCKVYSRQKTSSLSRDRIPHMEAQEPSPPHRSFSSAEPNDTQTRNQKQNPVPSEGRLKSEIQCSDEMMLEAQQLCTLGKELGMETDLDVLHKYASMERRDREEARKMGNRIWPQ

SEQ ID NO: 144906 - protein, 385 aa, Glycine max
  Coding DNA Sequence Number=SeqID_53221
  Gene Ontology: Mol. function=nutrient reservoir activity; Cellular component=anchored to membrane
  Homolog annotation: Hit_ID=A7PY10; Match level="QueryCoverage=80%, HitCoverage=76%, E-value=1e-115, Identity=67%"; Hit description =Chromosome chr15 scaffold_37, whole genome shotgun sequence
  Pfam annotation: Domain name=Fasciclin; Domain location=191-321; Score=91.2; E_value=3.4e-24; Accession=PF02469.13; Description =Fasciclin domain
MAHLLPFLVLTLLAATASAHNITDILAANPDYSDFNDFLSQTGLAGDINTRQTITVLVLNNAAFSAVAAKHPLSVVKNLLSLHILLDYFDNTKLHQITNGTTLSTTLYQTTGNANGNVGSVNITDLKGGKVGFGSAAPGSKLDSSYIKSVKSIPYNISVIEISAPIMAPGILAAPPPSADVNITALIEKAGCKTFASLISSNGLIKTFQATADKGLTIFAPNDEAFKAKGVPDLSKLTNAEVVSLLQYHAAAKYLPVGSLKTTKDSINTLASNGAGKFDLTVSVAGDSLTLHTGVDSSRIADTILDSSPLSIYSVDSVLLPQELFAKSPSPAPAPESVSSPTPAPSPVAEAPSPFPASPPAPAGESPAGAPAEAPSSEAERSSSA

SEQ ID NO: 144907 - protein, 378 aa, Glycine max
  Coding DNA Sequence Number=SeqID_53222
  Pfam annotation: Domain name=Retrotrans_gag; Domain location=224-317; Score=6.3; E_value=0.013; Accession=PF03732.8; Description =Retrotransposon gag protein
MAAAWHHVGAVFYKVSVYDGGIAERTHDREGSKFSCVVAYDAPATARLLAQTATSTPAVLLHRQPFPVPATAISIGCTRVDGMAVFGDHNGYCSLVKKAKRYIKDAWRESGTRNKCRRYGRMHHHTPKQWGTQMLFDVQREGVSSKLWQRLPTKEKIAGKGDSEQKKERSPLECGNRTPEVGRQAEWFTGDNSCQCSWGQTQLVGLLGLKNSEVQEIPSFHKLQYAFMSMEGAATHWFYIWSQNNPDSDWESFFTALIKRFGDRHGNHIFERLSILKQEKPTKTKTHIKKWETSTKFLKGRTDISKRKHMLRKILNEKVDSHASQQDKNSMEGSGSEFSEAKASSWARKEELPNFDRNIEGGTDLSFECDNDPLQFLK

SEQ ID NO: 144908 - protein, 491 aa, Glycine max
  Coding DNA Sequence Number=SeqID_53223
  Gene Ontology: Mol. function=nucleotide binding; Cellular component =striated muscle thick filament; Biological process=striated muscle contraction
  Homolog annotation: Hit_ID=A7PYA8; Match level="QueryCoverage=94%, HitCoverage=52%, E-value=1e-180, Identity=70%"; Hit description =Chromosome chr15 scaffold_37, whole genome shotgun sequence
  Pfam annotation: Domain name=DUF827; Domain location=248-485; Score= -103.7; E_value=0.011; Accession=PF05701.2; Description=Plant protein of unknown function (DUF827)
  Pfam annotation: Domain name=FHA; Domain location=73-149; Score=53.5; E_value=7.1e-13; Accession=PF00498.17; Description=FHA domain
  Pfam module annotation: Pfam domain module=DUF827::FHA; Domain location=248-485::73-149
MEEAKVETPMTTWRDNCSQSLSPRARIVSVASNIASQPLHNPDPQVWGVLTAVSYNARKRHQGINILLTANEHCIGRLVEDVRFQIDSNSVSANHCRIYRMKVTNENMENATSIFLKDASTNGTYLNWERLKKNGAAVKVCHGDIISFAAPPQHDLAFAFVFREALVPSLMPDNAVAKRKAEDFVSDNKRLKGLGIGAPEGPISLDDFRSLQRSNMELRKQLENQVVTVDTLRSDNCAAVECHESELKSVKESVAKCYLDQLKALQQMVDLKHKELGDLNRASAAQKHAMEDLNERLSASTQSCAEANSIISSQKVNIAELKEQLDEEWTQRKEEREKAAGDLKAAVHRAQSEAQEELKRLSDASLRRERELQETINKLQESEREMSLLVETLRSKLEDTRQKLVVSDNKVRQLEAQVHEEKLANENEMKKVELEQQETRRLRKELESEKAAREEAWAKVSVLELEINAAMRDLDFERRRLKGARERLMLR

SEQ ID NO: 144909 - protein, 1367 aa, Glycine max
  Coding DNA Sequence Number=SeqID_53224
  Gene Ontology: Mol. function=ARF guanyl-nucleotide exchange factor activity; Cellular component=intracellular; Biological process =regulation of ARF protein signal transduction
  Homolog annotation: Hit_ID=A7PYA2; Match level="QueryCoverage=99%, HitCoverage=76%, E-value=0.0, Identity=78%"; Hit description =Chromosome chr15 scaffold_37, whole genome shotgun sequence
  Pfam annotation: Domain name=DUF1981; Domain location=749-834; Score =167.7; E_value=3.1e-47; Accession=PF09324.1; Description=Domain of unknown function (DUF1981)
  Pfam annotation: Domain name=Sec7; Domain location=196-381; Score =333.6; E_value=3.4e-97; Accession=PF01369.11; Description=Sec7 domain
  Pfam module annotation: Pfam domain module=DUF1981::Sec7; Domain location=749-834::196-381
MVALTVVKQLSCSIFISLVSRFRAGLKAEIGVFFPMIVLRVLENVAQPNFHQKMIVLRFLQKLCDDSQILVDIFINYDCDVNSTNIFERTINGLLKTAQGVPPGATTTVLPPQEETLKYEAMKCLVAVLKSMGDWMNKQLRIPDPHSGKKVEAVDNGYEAGGLPLANGNEEEPVEGSDTHSGISNEVSDVSTIEQRRAYKLKLQEGISLFNRKPKKGIEFLINANKVGNSPEEIAAFLKDASGLNKTLIGDYLGEREESSLKVMHAYVDSFDFQGMEFDEAIRAFLQGFRLPGEAQKIDRIMEKFAERYCKCNPKVFSSADTAYVLAYSVILLNTDAHNPMVKNKMSAEDFIKNNRGIDDGKDVPEEYLRSLYERISRNEIKMKEVDLEAQQKQAVNSNRLLGLDSILNIVVRKRGEDSNMETSDDLIRHMQEQFKEKARKTESVYYAATDVVILRFMIEVCWAPMLAAFSVPLDQSDDEIVIALCLEGFRYAIHVTSVMSMKTHRDAFVTSLAKFTSLHSPADIKQKNIDAIKVIVTIADEDGNYLQEAWEHILTCVSRFEHLHLLGEGAPPDATFFAFPRNDSENTKQAKSTILPVLKKKGPGRMQYAAATVMRGSYDSTGISSNTTGAVTSEQVNNLVSNLNMLEQVGSSEMNRIYTRSQKLNSEAIIDFVKALCKVSMEELRSPSDPRVFSLTKIVEIAHYNMNRIRLVWSSIWHVLSDFFVTIGCSGNLSIAIFAMDSLRQLSMKFLEREELANYNFQNEFMKPFVIVMRKSSAVEIRELIIRCVSQMVLSRVNNVKSGWKSMFMVFTTAAYDDHKNIVLLAFEIMEKIIRDYFPCITETETTTFTDCVNCLIAFTNSRFNKEISLNAIAFLRFCATKLAEGDLGSSSRNNDKESYGKISAPSPRTGKEGKQDNGEVTDKDDHLYFWFPLLAGLSELSFDPRSEIRQRALKVLFETLRNHGHLFSLPLWERVFESVLFPIFDYVRHAIDPSGSTSEVNEVETDGQLDQDAWLYETCTLALQLVVDLFVNFYNTVNPLLRKVLMLLVSFIKRPHQSLAGIGIAAFVRLMSNAGELFSDEKWLEVVLSLKEAANATLPNFSFLDSGNFVTVNHEYASMAEDDRDPAESGSHDNLESPRTQNLYAYFSDAKCRAAVQLLLIQAVLEIYNMYRTQLSAKTILVLFEALRDVALHAHKINSNIILRSKLQEFGSMTQMQDPPLLRLENESYQICLTFLQNLVVDRPTSYEEVEVETRLIRLCQEVLEFYIEVAGSGTVSESSHGKQLHWLIPLGSGKRRELAARAPLVVTTLQAICNLGEISFEKNLAHFFPLLSSLISCEHGSAEVQVALSDMLSLSVGPLLLRSC

SEQ ID NO: 144910 - protein, 416 aa, Glycine max
  Coding DNA Sequence Number=SeqID_53225
  Gene Ontology: Mol. function=catalytic activity; Cellular component =cytoplasm; Biological process=cellular metabolic process
  Homolog annotation: Hit_ID=O48602; Match level="QueryCoverage=78%, HitCoverage=99%, E-value=1e-145, Identity=78%"; Hit description=2' -hydroxydihydrodaidzein reductase
  Pfam annotation: Domain name=3Beta_HSD; Domain location=9-285; Score=- 70.4; E_value=1.1e-05; Accession=PF01073.10; Description=3-beta hydroxysteroid dehydrogenaseisomerase family
  Pfam annotation: Domain name=Epimerase; Domain location=8-255; Score =69.9; E_value=8.3e-18; Accession=PF01370.12; Description=NAD dependent epimerasedehydratase family
  Pfam annotation: Domain name=KR; Domain location=6-152; Score=-93.0; E_value=0.06; Accession=PF08659.1; Description=KR domain
  Pfam annotation: Domain name=NAD_binding_4; Domain location=10-239; Score=-10.7; E_value=4.1e-08; Accession=PF07993.3; Description=Male sterility protein
  Pfam annotation: Domain name=NmrA; Domain location=8-279; Score= -100.9; E_value=0.019; Accession=PF05368.4; Description=NmrA-like family
  Pfam annotation: Domain name=RmlD_sub_bind; Domain location=6-319; Score=-186.3; E_value=0.068; Accession=PF04321.8; Description=RmlD substrate binding domain
  Pfam annotation: Domain name=adh_short; Domain location=6-138; Score=- 51.6; E_value=0.031; Accession=PF00106.16; Description=short chain dehydrogenase
  Pfam module annotation: Pfam domain module=3Beta_HSD::Epimerase::KR::N AD_binding_4::NmrA::RmlD_sub_bind::adh_short; Domain location=9 -285::8-255::6-152::10-239::8-279::6-319::6-138
MAEGKGRVCVTGGTGFLGSWIIKRLLEDGYAVNTTIRSDPGRKRDVSFLTNLPGASEKLKIFNADLSDPESFDPAVEGCVGIFHTATPIDFAVNEPEEVVTKRAIDGALGIMKAGLKAKTVKRVVYTSSGSTVSFSSLEEKDVVDESVWSDVDMLRSVKPFGWSYAVSKVLTEKAVLEFGEHNGLEVATVIAPFIVGPFVCPKLPDSIEKALLMVLGKKEEIGVIRYHMVHVDDVARAHIFLLEHPNPKGRYNCSPFIVPIEEMGELLSAKYPEFQLPTVDELKGIKGAKQPHLTSKKLVDAGFEFKYSLEDMFQDAIECCKEKGYNNIEDMGCFCSRAPSVGSCHHHHHGDGGGGGGCGGGSGGGGGFKLSTAISGRVFPRSGTLMILLVPPLAAVVVFRFWDHRPVPKGTIFWR

SEQ ID NO: 144911 - protein, 435 aa, Glycine max
  Coding DNA Sequence Number=SeqID_53226
  Gene Ontology: Mol. function=molecular_function; Cellular component =cellular_component; Biological process=biological_process
  Homolog annotation: Hit_ID=A7PY90; Match level="QueryCoverage=100%, HitCoverage=100%, E-value=1e-179, Identity=70%"; Hit description =Chromosome chr15 scaffold_37, whole genome shotgun sequence
  Pfam annotation: Domain name=WD40; Domain location=234-272; Score =6.2; E_value=5.4; Accession=PF00400.23; Description=WD domain, G -beta repeat
  Pfam annotation: Domain name=WD40; Domain location=284-322; Score =38.3; E_value=2.8e-08; Accession=PF00400.23; Description=WD domain, G-beta repeat
  Pfam annotation: Domain name=WD40; Domain location=382-428; Score =31.9; E_value=2.4e-06; Accession=PF00400.23; Description=WD domain, G-beta repeat
  Pfam annotation: Domain name=WD40; Domain location=77-115; Score =37.7; E_value=4.1e-08; Accession=PF00400.23; Description=WD domain, G-beta repeat
  Pfam module annotation: Pfam domain module=WD40::WD40::WD40::WD40; Domain location=234-272::284-322::382-428::77-115
MDPALPIVALSLLLGAIIAFLIFNTYFCKRQSEIRSIADPNPNSNSNPKLVSSKPPPKKPLSKPHSSDKDQNKRHHPLDLNTLKGHGDAVTGVCFSRDGRNLATACADGVVRVFKLDDASSKSFKFLRINLPAGGHPTAVAFSDDASSIVVASYTLSGCSLYMYGEEKPKTSEDKPQAKLPLPEIKWEHHKVHDKKSIITMFGASATYGTADGSTIIASCSEGTDIILWHGKTGKSVGHVDTNQLKNNMATISPNGRFIAAAAFTADVKIWEIVYAKDGSVKEVLNVMQLKGHKSAVTWLCFTPNSEQIITASKDGSMRIWNINVRYHLDEDPKTLKVFPIPLHDSSGTTLHYDRMSVSPDGNFLAATHGSTLQWLCVETGKVLDTAEKAHDSDISCISWAPKTIPMGNEQVLVLATASADKKVKLWASPSIPAS

SEQ ID NO: 144912 - protein, 130 aa, Glycine max
  Coding DNA Sequence Number=SeqID_53227
MATRRREAMEMKAWFGEGEKEERPWSWRLSGALEFYATLEQKDKRRKKEMFDREAKGKSWFGGPVPPEKKNRGRILEHQSWLNLSPPRRPARYPDPAHFLYLVLEKAKENKQRGRKHFRTRGRRQSNKNH

SEQ ID NO: 144913 - protein, 267 aa, Glycine max
  Coding DNA Sequence Number=SeqID_53228
  Gene Ontology: Mol. function=nucleic acid binding; Cellular component= nucleus; Biological process=RNA metabolic process
  Homolog annotation: Hit_ID=Q9SWF9; Match level="QueryCoverage=98%, HitCoverage=68%, E-value=1e-133, Identity=75%"; Hit description=Zinc finger CCCH domain-containing protein ZFN-like
  Pfam annotation: Domain name=zf-CCCH; Domain location=219-245; Score =46.0; E_value=1.3e-10; Accession=PF00642.15; Description=Zinc finger C-x8-C-x5-C-x3-H type (and similar)
  Pfam annotation: Domain name=zf-CCCH; Domain location=22-42; Score =25.6; E_value=0.00018; Accession=PF00642.15; Description=Zinc finger C-x8-C-x5-C-x3-H type (and similar)
  Pfam annotation: Domain name=zf-CCCH; Domain location=62-88; Score =44.8; E_value=3e-10; Accession=PF00642.15; Description=Zinc finger C- x8-C-x5-C-x3-H type (and similar)
  Pfam module annotation: Pfam domain module=zf-CCCH::zf-CCCH::zf-CCCH; Domain location=219-245::22-42::62-88
MTITWRVRDLIPDKGNIRPSHDYYLKTGTCKFGATCRFHHPRDKAGIAGRVAMNILGYPLRPNEPECAYYLRTGQCKFGNTCKFHHPQPNNMVLSMRSSPVYPTVHSPTTPGQQSYATGITNWSSSSYIPSPRWQGPSSYAPLILPQGMVSVPGWSAYSGQMGSDSPQQTMGNGQSYGTSRQSEPANSGSQGAYSQFRSGSVPVGFYALQRENIFPERPDQPECQFYMKTGDCKFGAVCRFHHPRERMIPAPDCVLSPIGLPLRPVS

SEQ ID NO: 144914 - protein, 204 aa, Glycine max
  Coding DNA Sequence Number=SeqID_53229
  Homolog annotation: Hit_ID=A7Q9U4; Match level="QueryCoverage=93%, HitCoverage=46%, E-value=6e-69, Identity=61%"; Hit description =Chromosome chr8 scaffold_68, whole genome shotgun sequence
MLLIFNRISGHIPLKITSIENGTVLKTFKHLLHQNKQVDFIELFHEKLLVKQENENQLFLTFINGTVSVWSFCGELVTQFEDHQLWHPDCYTNNTYITKDQDLIISYCKADSDDQWMEGNAGSINVSDILTGKCVAKLNATSSSIKADECNNSACNCNKQSHSCLLRSSVAEALEEVTALFYDEDRNEIYAAPDFSKIQAASAL

SEQ ID NO: 144915 - protein, 28 aa, Glycine max
  Coding DNA Sequence Number=SeqID_53230
MVKCSSGLRLWGKSEKSMMFANAVLAGP

SEQ ID NO: 144916 - protein, 64 aa, Glycine max
  Coding DNA Sequence Number=SeqID_53231
  Gene Ontology: Mol. function=N-acetyltransferase activity; Cellular component=chloroplast; Biological process=metabolic process
  Homolog annotation: Hit_ID=A7Q9W9; Match level="QueryCoverage=87%, HitCoverage=25%, E-value=1e-22, Identity=92%"; Hit description =Chromosome chr8 scaffold_68, whole genome shotgun sequence
  Pfam annotation: Domain name=Acetyltransf_1; Domain location=1-58; Score=12.3; E_value=0.095; Accession=PF00583.15; Description =Acetyltransferase (GNAT) family
MARATSDHAFNATIWDVLVDPGYQGQGLGKALIEKLIRTLLQRDIGNITLFADSQVDTKQCHKF

SEQ ID NO: 144917 - protein, 95 aa, Glycine max
  Coding DNA Sequence Number=SeqID_53232
DDNGVIPMMMGLGMLMGATMVTMIVIVVMMIAIMIKVFVIEMTIVIMITTMIKVGDNCDSVSDNDNDNDNNIHDNNKNDDYGHNGGGNGSGGDRG

SEQ ID NO: 144918 - protein, 783 aa, Glycine max
  Coding DNA Sequence Number=SeqID_53233
  Gene Ontology: Mol. function=protein transporter activity; Cellular component=Golgi membrane; Biological process=vesicle fusion with Golgi apparatus
  Homolog annotation: Hit_ID=Q682E1; Match level="QueryCoverage=72%, HitCoverage=87%, E-value=1e-55, Identity=30%"; Hit description =Putative uncharacterized protein At2g38580
  Pfam annotation: Domain name=DUF1103; Domain location=247-276; Score =7.3; E_value=6.8; Accession=PF06513.2; Description=Repeat of unknown function (DUF1103)
  Pfam annotation: Domain name=DUF1103; Domain location=294-323; Score =4.9; E_value=18; Accession=PF06513.2; Description=Repeat of unknown function (DUF1103)
  Pfam annotation: Domain name=DUF1103; Domain location=341-370; Score =5.4; E_value=15; Accession=PF06513.2; Description=Repeat of unknown function (DUF1103)
  Pfam module annotation: Pfam domain module=DUF1103::DUF1103::DUF1103; Domain location=247-276::294-323::341-370
MEDDKRKRKNKKKKNKQNKNVENGVGETANRDQNLVSNGKDEHTNLSETANEQSSNVDSNGVGETSSRDQNLVNNGKDEPALLSGVTHEQSMNADRNGVVETPNSDQNLVKSGKDKNIPPLEFADGQSTNMDSNGHLPNGKECAKGGILIRLDMATGQGGAGMGIASPVPDPDSPTYTRTSPRAFVYKNHQEKNLKLCKNYKKINKVVHHITPQAISEETIRKLKEENDIHIQKETLSKETIRKLKAENDMHIQKEAIMEETIRKLTEQNDLHMQKEAIFPQIASEETIRKLKEKHDVHVQKEAISEDTIRNLKEKNDMHMQKEHILKQTLSQETIRKLKEENEGHIQKEAISKETIKKFEEENDKLVQKETSLEMRIAQLQSENNSLLQKEAGLVERSNQLLNEKVVLSMKAYIIDGILDLGPNPDHWAEQNKDQLLDPSPKEMESLEGLYQKAALWRVMFSYIGRRLHVGLETRFAQLHSENNSLLQKEATLVERTNQLLNEKEVLSLKGESLEQKIYLLESDLSSLVEKENSTKDTISKLNGNIAVLQVQVEELEESRNNLFLENQQLREKVSSLESTVQNHENSNASSCSRDAPEKDLASENKDLKSEIEAAFTLVEKLMAENAELVEKVTELCVELDHQSAVTEPNEMTEFAKPTGVAIPPPESAEYASVSAPKLNSLEETSVKDNGNSFNDAKHVVGVMSNSSLLSDDAGEIVQIPLDDNEIQDIELQDAKNVENDADAVPITDAPLIGAPFRLISFVANFVSGADLVDPSSSNTAR

SEQ ID NO: 144919 - protein, 354 aa, Glycine max
  Coding DNA Sequence Number=SeqID_53234
  Gene Ontology: Mol. function=transporter activity; Cellular component= integral to membrane; Biological process=auxin mediated signaling pathway
  Homolog annotation: Hit_ID=Q673E6; Match level="QueryCoverage=100%, HitCoverage=93%, E-value=1e-120, Identity=63%"; Hit description =Putative auxin efflux carrier protein 9
  Pfam annotation: Domain name=Mem_trans; Domain location=9-354; Score =227.7; E_value=2.7e-65; Accession=PF03547.9; Description=Membrane transport protein
MIGWEEVYKVVVAVVPLYFALLLGYGSLKWWNIFTREQCEAINKLVCYFTLPLFIFEFTAHIDPFKMNYSFIAADTISKFIIMVVLALWAKCTPKGTFSWSITSFSLCNLTNALVVGVPMVKPMYGALGVDLVVQASVIQATIWFPLLLFVLEFWRTGSEGTTITTTTTLKPRPKTMIIDNESGGGKDVEATTVAIDVKEEMMLEESVTSSRLPFCKVMKLVWRKLATNPNSFGCVIGISWAFISNRWNLEMPSMLEGSIQIMSKAGTGTAMFSMGTFMALQEKVIACGPSMTIIGLVLKFIAGPAATAIGAIVVGLRGDVLRVVIIQAAVPQSITSFIFAKEYGLHPEVLSTA

SEQ ID NO: 144920 - protein, 93 aa, Glycine max
  Coding DNA Sequence Number=SeqID_53235
VSTYALLVEDVLEVVFDAVVVHEAAALRIQRLSKGFLGNQNVRISVDDFEDLDSEQSDTYGPISMRRKSTGGKKPNQRDWDDEDNWELPMDYP

SEQ ID NO: 144921 - protein, 42 aa, Glycine max
  Coding DNA Sequence Number=SeqID_53236
MEQCISGFCCSLKQKGTKLHYDDAISSIVKKNNQYYNGKGLT

SEQ ID NO: 144922 - protein, 312 aa, Glycine max
  Coding DNA Sequence Number=SeqID_53237
  Gene Ontology: Mol. function=sugar:hydrogen symporter activity; Cellular component=integral to membrane; Biological process =carbohydrate transport
  Homolog annotation: Hit_ID=Q5K3W0; Match level="QueryCoverage=38%, HitCoverage=24%, E-value=2e-21, Identity=47%"; Hit description =Monosaccharide transporter
  Pfam annotation: Domain name=Chromo; Domain location=257-310; Score =13.7; E_value=0.012; Accession=PF00385.15; Description='chromo' (CHRromatin Organisation MOdi
  Pfam annotation: Domain name=Retrotrans_gag; Domain location=4-85; Score=11.9; E_value=0.0037; Accession=PF03732.8; Description =Retrotransposon gag protein
  Pfam annotation: Domain name=Sugar_tr; Domain location=42-305; Score=- 120.4; E_value=0.00028; Accession=PF00083.15; Description=Sugar (and other) transporter
  Pfam module annotation: Pfam domain module=Chromo::Retrotrans _gag::Sugar_tr; Domain location=257-310::4-85::42-305
MDGKAFAWQRHYMLNNNRGNSWQQIIHNAGSRFDTSAFDDPIAEIARLKQDGPLIDYLENFDTLLARVSITEDVALSFFLSGLTIELEKSVRVHRPNAMIFGGCIFFSGGAINGAAENIATLILGRILLGLGVGFTNQATPISKAVKGEGFGMMFEEQYQPKLVMVFAIPMSQQLTGINIVAFYAPDLFQSMGVDNDLALLLAVILGLVNLGSILVSTAIVDHFGRRFLYIIGSIQMLICMIVVVVVLAVVNGVHGTEHISKLNARMKKKGSRAVTEVLIQWQHTNPEDAIWKELHSMQHQFPDFDWRANRP

SEQ ID NO: 144923 - protein, 329 aa, Glycine max
  Coding DNA Sequence Number=SeqID_53238
  Gene Ontology: Mol. function=translation elongation factor activity; Cellular component=cytoplasm; Biological process=translational elongation
  Homolog annotation: Hit_ID=A7QFN9; Match level="QueryCoverage=76%, HitCoverage=96%, E-value=7e-78, Identity=59%"; Hit description =Chromosome chr8 scaffold_88, whole genome shotgun sequence
  Pfam annotation: Domain name=EFP; Domain location=163-217; Score =87.1; E_value=5.8e-23; Accession=PF01132.11; Description=Elongation factor P (EF-P)
  Pfam annotation: Domain name=EFP_N; Domain location=81-156; Score =81.2; E_value=3.4e-21; Accession=PF08207.3; Description=Elongation factor P (EF-P) KOW-like do
  Pfam annotation: Domain name=Elong-fact-P_C; Domain location=273-328; Score=111.4; E_value=2.7e-30; Accession=PF09285.2; Description =Elongation factor P, C-terminal
  Pfam module annotation: Pfam domain module=EFP::EFP_N::Elong-fact-P _C; Domain location=163-217::81-156::273-328
  Subcellular localization annotation: CTP_CleavageSite=70; ConfidenceScore=5.97e-01
MVAGTATLKLNLSDFSSPMSSFSASSSSSSFPFLLSMRTPSSSSKPRFLSQSLPSLISSLSPTAFLSSLTCAFLSGIYALTSNDIKVGTNLEVDGAPWRVLVLNCEASFNLACVALHGSEFLHVKPGKGAAFVRTKMKNYITGNTVEKTFRAGSSIEQADVFKETKQFTYKDGVQFVFMDLNTYEEFRLGEKEIGDRTKWLKEGMDCNLLLWNGKVIISSHNILCLSLLLQVSHRVVNEHDKPLLDHFGDKLTLEEHFLIGSMVIDVELPITIKLTVVDVDPGLKGDTAQGGTKPATLDTSAVVNVPLFVNVGDEILVDSRTGQYMSRA

SEQ ID NO: 144924 - protein, 133 aa, Glycine max
  Coding DNA Sequence Number=SeqID_53239
  Gene Ontology: Mol. function=metal ion binding; Cellular component =integral to membrane; Biological process=ubiquitin cycle
  Homolog annotation: Hit_ID=A7NY09; Match level="QueryCoverage=74%, HitCoverage=71%, E-value=3e-20, Identity=43%"; Hit description =Chromosome chr6 scaffold_3, whole genome shotgun sequence
MLQRRLLETELSMPPSYGGSGGNNTRDTFISDANFDTNMTAEQAAARLAGTGLKRRELSRIPVAVYGAAGGENTIPATECPICLGEFEKGDKVRMLPKCNHGFHRGGCCGGAGELNGINSERWKEGQVLVNGG

SEQ ID NO: 144925 - protein, 473 aa, Glycine max
  Coding DNA Sequence Number=SeqID_53240
  Gene Ontology: Mol. function=drug transporter activity; Cellular component=membrane; Biological process=multidrug transport
  Homolog annotation: Hit_ID=A7Q3W9; Match level="QueryCoverage=98%, HitCoverage=99%, E-value=1e-154, Identity=58%"; Hit description =Chromosome chr13 scaffold_48, whole genome shotgun sequence
  Pfam annotation: Domain name=MatE; Domain location=20-180; Score =127.1; E_value=5.2e-35; Accession=PF01554.9; Description=MatE
  Pfam annotation: Domain name=MatE; Domain location=242-405; Score =128.2; E_value=2.3e-35; Accession=PF01554.9; Description=MatE
  Pfam module annotation: Pfam domain module=MatE::MatE; Domain location=20-180::242-405
MTNSTQVKEELKSLANIACPMMMTNVLLYSRSAISMLYLGRQGKVELAGGSLAIGFANITANSFLKGLTMGMDPICCQAYGAKRWSVLSQTFCKTLCLLLLVAIPISLLWLNMAPLLHWLGQDPEVTKVAQVYMVFSIPELLAQVHLNPLRSFLRTQGLTTPLTIAASFAAILHLPINYFLATYLELGVKGIALATGLNSINMILGLVLYLVVSEKPLKPWEGVTILSSFHDWRPLLTLALPSCISVCLEWWCYEIMLFLCGLLSNPQTTIATMGVLIQTTGFLYVFPFSLSAALTTQIGHSLGAGQPSRAQNTAKIGLFIAFALGVSAFVFLLFVRNVWGKLFTNETQIVDMVTAILPILGLCEIGNWPQTAACGILSGTARPYVGARINLCAFYLIGLPVAIFAAFMHRYQLRGLWFGMLAAQISCFCMMVYTLVQTDWGHQSRRAEQLAQTTDEENVNNDEKSGLLDSDL

SEQ ID NO: 144926 - protein, 358 aa, Glycine max
  Coding DNA Sequence Number=SeqID_53241
  Gene Ontology: Mol. function=transferase activity, transferring hexosyl groups; Cellular component=membrane; Biological process =carbohydrate metabolic process
  Homolog annotation: Hit_ID=A2Q1P6; Match level="QueryCoverage=94%, HitCoverage=64%, E-value=1e-159, Identity=79%"; Hit description =Glycosyl transferase, family 28
MTTSLENYLWDYLQLLWHTHVAEYLNVPLHIFFTMPWTPTSEFPHPLSHVKQPIGYRLSYQIVDALIWLGMRDLINEFRKKKLKLKPITYLSGSYTHPFDVPHGYIWSPHLVPKPKDWGPKIDVVGFCFLDLASNYVPPKSLVDWLEEGEKPIYVGFGSLPLQEPEKITRIIIQALEETGQRGIINKGWGGLGSLAEQNKSVYLLDNCPHDWPFPRCTAVVHHGGAGTTATGLRAECPTTIVPFFGDQPFWGDRVHARGVGPAPIPVDEFTFDRLVDAIRLMLKPEVKKRAVELANAMKNEDGVLGAVKAFYKHYPPEKSKFDDAKSKQLASTAEPKPVHKYFSIRGCFGCSKSSGYK

SEQ ID NO: 144927 - protein, 80 aa, Glycine max
  Coding DNA Sequence Number=SeqID_53242
  Homolog annotation: Hit_ID=Q8GY13; Match level="QueryCoverage=86%, HitCoverage=19%, E-value=1e-12, Identity=50%"; Hit description =Putative uncharacterized protein At2g38500
MEHCIFYVQTERGPLSFDAGPENIVVTVGKQLEGWSHGVFKCVPGEMIFMPSFQSSPASFSIELDMIAPFPFIWVPVAWS

SEQ ID NO: 144928 - protein, 78 aa, Glycine max
  Coding DNA Sequence Number=SeqID_53243
MAHQGHEVRNTLGEYTYSTMSRYASKIIRLLVAANNFETNLYFLVLCNKTSLEGGKEEEEDQNLHIAKFGEICDTIIK

SEQ ID NO: 144929 - protein, 579 aa, Glycine max
  Coding DNA Sequence Number=SeqID_53244
  Gene Ontology: Mol. function=transporter activity; Cellular component= membrane; Biological process=transport
  Homolog annotation: Hit_ID=A5B8A6; Match level="QueryCoverage=90%, HitCoverage=91%, E-value=0.0, Identity=71%"; Hit description =Putative uncharacterized protein
  Pfam annotation: Domain name=Exosortase_EpsH; Domain location=184 -346; Score=-141.8; E_value=0.071; Accession=PF09721.1; Description =Transmembrane exosortase (Exosortase_
  Pfam annotation: Domain name=Sulfate_transp; Domain location=199-538; Score=-152.1; E_value=0.011; Accession=PF00916.11; Description =Sulfate transporter family
  Pfam annotation: Domain name=Xan_ur_permease; Domain location=86-525; Score=-15.4; E_value=1.6e-07; Accession=PF00860.11; Description =Permease family
  Pfam module annotation: Pfam domain module=Exosortase_EpsH::Sulfate _transp::Xan_ur_permease; Domain location=184-346::199-538::86-525
  Subcellular localization annotation: CTP_CleavageSite=21; ConfidenceScore=5.18e-01
MEQLRPPPLSGRQLSLAARLNSMVAQSRIGKYFRVAERNTTFTTELRAGTATFLTMAYILAVNATIIADSGGTCSVSDCIPLCSDPKTPLSECPTHLLTRPGLSCKYPPVNPGYAACVERTRRDLIVATVASSLIGSGIMGLFANLPLALAPGMGANAYFAYSVVGFHGSGPVPYRTALTAIFLEGLIFLIISAVGFRAKLAKLVPKPVRVSSAAGIGLFLAFIGLQSNEGIGLIGFSPSTLITLGGCPRNKLTALAPVITINGTVSLIPGATVSDKILCSGNRMESPTLWLGLVGFLIIAYCLMKNIKGAMIYGIVFVTVISWFRNTPVTVFPNTQLGDAGYDYFKKVVDVHVIKTTAGALSFDSMWKGAFWEALFTFLYVDILDTTGTLYSMARFAGFVDDNGDFEGQNFAFMADASSTVVGSLLGTSPVTAFIDSSTGIREGGRTGLTAVTVAGYFLMAFFFTPLLASIPAWAVGPPLIMVGVMMVRCVVEIDWEDMREAIPAFVTIVLMPLTYSIAYGLIGGIGTYLVLHAWEWGEEVVRNFFTNNNFKDNNNISNVNANSRVVDDHEQGDDNKV

SEQ ID NO: 144930 - protein, 268 aa, Glycine max
  Coding DNA Sequence Number=SeqID_53245
  Gene Ontology: Mol. function=transferase activity, transferring glycosyl groups; Biological process=carbohydrate metabolic process
  Homolog annotation: Hit_ID=A2Q1P6; Match level="QueryCoverage=63%, HitCoverage=34%, E-value=1e-40, Identity=53%"; Hit description =Glycosyl transferase, family 28
  Pfam annotation: Domain name=Glyco_transf_28; Domain location=155 -254; Score=-16.3; E_value=0.074; Accession=PF03033.11; Description =Glycosyltransferase family 28 N-terminal domain
  Subcellular localization annotation: CTP_CleavageSite=81; ConfidenceScore=5.16e-01
MAEANTRHHRATSSSSDISVYLDADHSSVPAASFGPIDRNPSSSTPPSSSRNAAAAPANQVNDKNAAAAVAKVVGRSKGSSAMALAKFLDEKVPFREKMQWIKQASILKDDGTVGIKVPGAGSNIEHDVKCNESYDEIYNAIHSQDIQPIEPLQIVMLIVGTRGDVQPFVAMGKRLQACSFTLWVEIPKFSLVCFFSVHAFKLFKYMISSDMVKNKGFLPSGPSEIHIQRYQIKDIINSLLNACDSRYPESNAPFQAEAIIANPPAYG

SEQ ID NO: 144931 - protein, 921 aa, Glycine max
  Coding DNA Sequence Number=SeqID_53246
  Gene Ontology: Mol. function=DNA binding; Cellular component =chromatin; Biological process=regulation of transcription
  Homolog annotation: Hit_ID=Q2HV80; Match level="QueryCoverage=94%, HitCoverage=93%, E-value=0.0, Identity=54%"; Hit description =Homeodomain-like
MVGFVSELMLLLAKVLSDFVAVLGERSPRESWTLVVYEYCALFRGVLNFSDTTSDGKRPCFKQPICSSLLPLQNICDPKTGELVNYDATQIRATTHESSSATNPSEDNIKRDVSELPLVENASQNDCDTQRNSYADESSGNGCDNCSNNINSLPVELDAGDDLNLVKSETLIIREFSSACVNKSPVSNNSVDEPTDSHSNVNFKNPSGDMVLQTNLTSPIITFNRCYKRKKGLEQSNLSHKKESISALTKWSMLANGNPGLSNESSSEESPVDNVPDLNQSVGLSERGQALSETQDETSCRSCSMVFQTDLNQSAELSERGELCQTEEKVRLPGNLDLKIYSVSQRDFEFVTCFDADHHRLQTSYMREQPCHGEDSVKNASHTDKTGEPSHNCLIHNEDQHILKDCQGVSIIVDSRGPYPVATTTDQELEKSLLLPCEAIENVSCNDIMKKIGEHQPQFDLPVNSAEENTVDLNLGAEKYPLHLRMRTLGAKLESTSSSSAIAEDQVSELDFLNSRNTQLISEGKAIDGVCSSSTQPQLMMSEERMNVQHTKTDQPKLMPVISLSLGLSLPMEHKTGCSDSVNSLSVLSLSNSTTEARDIVQDGFCWSSSVNRRSLLPRHQVVLDNIVHRTRALNERGNFQEYLKPHPIMWSEEELDFLWIGVRRHGRGNWDAMLRDPRLWFSPLRVPGDLAERWEDEQLKLLNDISVPQFMYPAAASLQGNFCYLDPKSSFWESNPLKKSLPRYNFQSNTTAHSHRPTIHSRKASYNNIDKYELGFFNSPGSLGISRENSYSNDYSFNCSAVTNSLPHWLREAVNTPPIQPNMSAAISLSSHPEIPGTSDRCFSAGKSCFVPQNWFNGLTPNEIYMSNGSHYSTYSRRKYGVVKMNKSLEQRVHKPDNLIIIDSDTSSEETISDDHRSSL

SEQ ID NO: 144932 - protein, 75 aa, Glycine max
  Coding DNA Sequence Number=SeqID_53247
MSIPGRRVELEKKRRTGKGRVWTCADCGRKRGRRECGRKRGRREAEDRKKIEGKNKDKKLLVIQHNPDKAVNVAC

SEQ ID NO: 144933 - protein, 253 aa, Glycine max
  Coding DNA Sequence Number=SeqID_53248
  Gene Ontology: Mol. function=nucleic acid binding; Cellular component= lysosome; Biological process=sphingolipid metabolic process
  Homolog annotation: Hit_ID=Q9SCT5; Match level="QueryCoverage=60%, HitCoverage=72%, E-value=1e-30, Identity=41%"; Hit description =Putative uncharacterized protein T18N14.110
  Pfam annotation: Domain name=SapB_1; Domain location=153-191; Score =12.4; E_value=0.039; Accession=PF05184.6; Description=Saposin-like type B, region 1
  Pfam annotation: Domain name=SapB_1; Domain location=67-105; Score =41.4; E_value=3.2e-09; Accession=PF05184.6; Description=Saposin-like type B, region 1
  Pfam annotation: Domain name=SapB_2; Domain location=108-141; Score =32.7; E_value=1.3e-06; Accession=PF03489.8; Description=Saposin-like type B, region 2
  Pfam module annotation: Pfam domain module=SapB_1::SapB_1::SapB_2; Domain location=153-191::67-105::108-141
MEGRMGLLFLVEVNRVEEACIVHDIFSPPFLVCLVNVKNLRSGSLKCKCGVNILLTYLQISELSRKPDACALCEEYSTKVLDYLNENKTQQEIIDILHNICHQTSSFKQKCITLVDYYAPLFFLEIVTIQPGEFCHKVNLCQLITYISLLVQEDTSGFCKDTVSTLSAKLKDSDTKLEIIETSLKVCNSVEKYANKVRKIWQIRPFSSVHIQSYEASIFKFYPSDQIGNYHAWNHGNFLAMIISWTWVTWQPP

SEQ ID NO: 144934 - protein, 529 aa, Glycine max
  Coding DNA Sequence Number=SeqID_53249
  Homolog annotation: Hit_ID=Q9SCU3; Match level="QueryCoverage=100%, HitCoverage=60%, E-value=1e-83, Identity=38%"; Hit description =Putative uncharacterized protein T18N14.30
MEAEKERSKSSYPSKEKDSKKEAERKRQEKRKEKDKGSSKSNSDVEELDRRASKESERKCDFDKKSETDRREHQKSGFESGKGHNTDNTHSKNVAANSYNRGSTGTRYLDRMRGTILSSSKALGFGKGANAPGSVVKENKFNGSVDHIHSTATRKDIYPPDCSTAKSNLNGDDKNINHSVPPEPQPWSPWTAPKKSWQQLFTRSSTVAQSSNSNVICRPNSKIQAEAKSPQLSGQSPITQPFNNPIQFGLPSPFNISSYPIGSTGSSQGFSPAIEPLYSTVENISQDFRHEEQELFEDPCYIPDPVSLLGPVSESLDNFQLDLGSGFVTDTKMAMPHSLKSTSAGSDISKPSPIESPLSREKNSCSNRFPSISQAQDMHPFPLDNAAANEKGTWQMWNTLPLGQEGLGLVSDPANWFLSPQRDVPNKDDFVLPSSKTMDSLFNKDDNIISSNHSSQHFFLPNGQSGGTFSPVTGSNGYDPWSQGALFPSLSGGLKAQESATQNEMIYASQSGSASNHVHECSKANSWTK

SEQ ID NO: 144935 - protein, 161 aa, Glycine max
  Coding DNA Sequence Number=SeqID_53250
  Gene Ontology: Mol. function=transcription regulator activity; Cellular component=nucleus; Biological process=regulation of transcription
  Homolog annotation: Hit_ID=A7QFK2; Match level="QueryCoverage=97%, HitCoverage=94%, E-value=2e-41, Identity=61%"; Hit description =Chromosome chr8 scaffold_88, whole genome shotgun sequence
MAASREKRRASLEETLQQLRDVTNSTAVIDMKLVLLLNKASIIVDASKYIEELKQKVEGLNSELEIAESSTTTQIDELPMVIVKTLKKGFLINVLLEKNCPGMLVSILEAFEELGLDVLDARVSCEDSFQLEAVGRESHKNDSVDAQVVKQAVLQAIKNAD

SEQ ID NO: 144936 - protein, 1044 aa, Glycine max
  Coding DNA Sequence Number=SeqID_53251
  Gene Ontology: Mol. function=protein binding; Cellular component =TORC1 complex; Biological process=embryonic development ending in seed dormancy
  Homolog annotation: Hit_ID=Q93YQ1; Match level="QueryCoverage=100%, HitCoverage=89%, E-value=0.0, Identity=64%"; Hit description =Putative uncharacterized protein T16O11.22
  Pfam annotation: Domain name=HEAT; Domain location=315-351; Score =20.2; E_value=0.008; Accession=PF02985.13; Description=HEAT repeat
  Pfam annotation: Domain name=WD40; Domain location=767-807; Score =12.8; E_value=0.83; Accession=PF00400.23; Description=WD domain, G -beta repeat
  Pfam annotation: Domain name=WD40; Domain location=818-860; Score =5.7; E_value=6.3; Accession=PF00400.23; Description=WD domain, G -beta repeat
  Pfam annotation: Domain name=WD40; Domain location=865-904; Score =6.0; E_value=5.8; Accession=PF00400.23; Description=WD domain, G -beta repeat
  Pfam annotation: Domain name=WD40; Domain location=951-989; Score =19.0; E_value=0.017; Accession=PF00400.23; Description=WD domain, G -beta repeat
  Pfam annotation: Domain name=WD40; Domain location=999-1037; Score =7.8; E_value=3.4; Accession=PF00400.23; Description=WD domain, G -beta repeat
  Pfam module annotation: Pfam domain module=HEAT::WD40::WD40::WD40::WD4 0::WD40; Domain location=315-351::767-807::818-860::865-904::951 -989::999-1037
MAPQKALESIGKTLSSQYERWQPKARYKCQLDPTVDEVKKLCTTCRKYAKSERVLFHYNGHGVPKPTANDKIPGRPNDRKTLLGELNWIFTAVTDTIAWNVLPHDLFQRLFRQDLLVATSTLLAMWLAISSCGKGISDLFTHPTVHGLYYNASLKVLLSQCHRFRALVLLGRFLDMGPWAVDLALSVGIFPYVLKLLQTTTPELRQILVFIWTKILALDKVDLVKDGGHIYFIKFLDSMEAYPEQRAMAAFVLAVIVDGHRRGQEACIEAGLIHVCLKHLQSSCPNDSQTEPLFLQWLCLCLGKLWEDFSEAQTIGLQEDATTIFAPLLSEPQPEVRASAVFALGTLLDVGFDSCRSVGGDEECDDDDKFRAEVSIVKSMLDVASDGSPLVRAEGEMDLRHLSDSLLFQLSALARFAFGHNKHLKSIAAAYWKPQANSLINSLPSLTNIKGSVGGYAKQNQHMPHGSIVSPQIGPIRVGNDNSPVVRDGRVSSSSPLAGSGIMHGSPLSDDSSHHSDSGILNDGFSNGVANHTGPKPFDNALYSQCVLAMCTLAKDPSPRIANLGRRVLSIIGIEQVVAKPLKSSGVRTAESTASPLARSSSWFDMNGGHLPLTFRTPPVSPPRPSYITRMRRVCSLEFRPHLMDSPDSGLADPLLGSGGASGTSDRSFLPQSTIYSWSCGHFSKPLLTAADDSEEVSARREEREKFALEHIAKCQHSAVSRLTNPIAKWDIKGTQTALLQPFSPIVIAADENERIRIWNHEEATLLNSFDNHDFPDKGISKLCLVNELDESLLLAASSDGNIRIWKDYTLRGKQKLVTAFSSIHGHKPGVRNLNAVVDWQQQCGYLYASGEISSIMLWDVDKEQLVNSKSSSSDCSVSALAASQVHGGQFTAGFIDGSVRLYDVRTPDMPHTQRVEKVVGIGFQPGLDQGKIVSASQAGDIQFLDIRNHSSAYLTIEAHRGSLTALAVHRHAPIIASGSAKQLIKVFSLEGDQLGTIRYYPTLMAQKIGSVSCLNFHPYQVLLAAGAADACVCIYADDNTQAR

SEQ ID NO: 144937 - protein, 854 aa, Glycine max
  Coding DNA Sequence Number=SeqID_53252
  Gene Ontology: Mol. function=D-alanine-D-alanine ligase activity; Cellular component=cell wall; Biological process=peptidoglycan biosynthetic process
  Homolog annotation: Hit_ID=A7QFI6; Match level="QueryCoverage=92%, HitCoverage=82%, E-value=0.0, Identity=71%"; Hit description =Chromosome chr8 scaffold_88, whole genome shotgun sequence
  Pfam annotation: Domain name=Dala_Dala_lig_C; Domain location=200 -449; Score=-39.7; E_value=3.6e-07; Accession=PF07478.4; Description =D-ala D-ala ligase C-terminus
  Pfam annotation: Domain name=Dala_Dala_lig_N; Domain location=488 -671; Score=11.6; E_value=1.9e-08; Accession=PF01820.12; Description =D-ala D-ala ligase N-terminus
  Pfam annotation: Domain name=Dala_Dala_lig_N; Domain location=73-199; Score=57.7; E_value=4e-14; Accession=PF01820.12; Description=D-ala D -ala ligase N-terminus
  Pfam module annotation: Pfam domain module=Dala_Dala_lig_C::Dala_Dala_ lig_N::Dala_Dala_lig_N; Domain location=200-449::488-671::73-199
  Subcellular localization annotation: CTP_CleavageSite=54; ConfidenceScore=5.34e-01
MATSSLSGNFSLLRHSETQSRSLLLLGGSSVKLFRSKHEASTCHGARVAAAVPRASAPEVAVVEKGREKVRVLKLGLICGGPSAERGISLNSARSVLDHLQGDDLHVSCYYIDCNLNAFAISSAQVYSNTPADFDFKLESLAQSFQTLSDLAKHLATAVDIVFPVIHGQFGEDGGIQELLEKYNVPFVGTGSKECCQAFDKHKASLELRKHGFITVPSFLVQGYETDKSELSEWFKKHQLDPDLGKVVVKPTRGGSSIGVGVAYGVNDSLVKANEIMSEGIDKKVLIEIFLEGGNEFTAIVLDVGSDLDSFPVVLLPTEVELQFRGANDVKENDAIFNYRRKYLPTQQVAYHTPPRFPLDVIENIRKGASLLFQRLCLQDFARIDGWFLPNSSSKLSPFSQSEFGRTESGAIIFTDINMISGMEQTSFLFQQASKVGFSHTNILRSIIHHACLRFPNLASVSGISGQLPSRSKSLQRNKSFSRREGTRKVFVIFGGNTSERQVSLMSGTNVWLNLLAFHDLEVTPCLLSPTSECASSIDMGKKADDVMNRTVWSLPYSLVLRHTTEEVLDACMEAIEPEHAAITSELRKKVMNDLMEGLKDHNWFTGFDIADDLPVKFSLRQWIKLAKEVQATVFIAVHGGIGEDGTLQSLLDAEGVPYTGPGAMASKICMDKVATSVALKHLANSGVLTINKDVRQKDDLSNKPINDTWHDLTRKLQCQTLCVKPAKDGCSTGVARLCCPEDLAIYVKALEDCLLRIPPNCLSKAHGMIEMPNPPPEHLIFEPFIETDEIIVTSKFEDATGHGLTWKGHSRWVEITVGVIGKRGSMHSLSPSVTVKESGDILSLEEKFQGWSP

SEQ ID NO: 144938 - protein, 423 aa, Glycine max
  Coding DNA Sequence Number=SeqID_53253
  Homolog annotation: Hit_ID=A7NY60; Match level="QueryCoverage=94%, HitCoverage=87%, E-value=1e-154, Identity=62%"; Hit description =Chromosome chr6 scaffold_3, whole genome shotgun sequence
MALTICVLLIARSGPLALQSATAAAGLVQPGLYTSKYWINGIRFYSSAFQDFIAGGYLSPESKALCVETPTGRDVFALREIGEAARESAKPAEFAAEIGRTLRPGGFAVFHFAIPKDTYSFNSFLDLFNCFKVVKLHGLEGFDSSMPYIREIVLKKECGDGAGKFDFDDSNGKCYVPGYKHDLVKIAEPLIEEEPLKPWITLKRNVRNIKYLPSMADISFKNRYVYVDVGARSYGSSIGSWFRKQYPKQNKTYHVYAIEADKTFHQGYGLKKGITLVPYAAWVKNETLMFEIHRNPREHVEVKGRGMGRIQPLQSSLGKGEFDGKVEKIQGFDFANWLKKMVSKNDFVVMKMDVEGTEFDLIPRLIKTGAICLIDEIFLECHYNRWQRCCPGQRSSKYEKTYDQCLQLFNSLRQSGVLVHQWF

SEQ ID NO: 144939 - protein, 109 aa, Glycine max
  Coding DNA Sequence Number=SeqID_53254
  Homolog annotation: Hit_ID=A7QFH8; Match level="QueryCoverage=87%, HitCoverage=86%, E-value=9e-30, Identity=66%"; Hit description =Chromosome chr8 scaffold_88, whole genome shotgun sequence
MESSSGIESTGGRAPLSGVVADCVKRWFKDTLKEAKAGDVNMQVLVGQMYYHGYGVPRDAQKADVIGWGMKGRIWLTKASRVRSSVWRVGGKRPGYNASDSESDEEEDS

SEQ ID NO: 144940 - protein, 470 aa, Glycine max
  Coding DNA Sequence Number=SeqID_53255
  Gene Ontology: Mol. function=transferase activity, transferring glycosyl groups; Cellular component=integral to membrane; Biological process=metabolic process
  Homolog annotation: Hit_ID=A6XNC7; Match level="QueryCoverage=99%, HitCoverage=93%, E-value=1e-138, Identity=53%"; Hit description =(Iso)flavonoid glycosyltransferase
  Pfam annotation: Domain name=UDPGT; Domain location=2-461; Score= -97.0; E_value=1e-05; Accession=PF00201.9; Description=UDP -glucoronosyl and UDP-glucosyl transferase
MVDTARLFARHGASVTIITTPANALTFQKAIDSDFNCGYHIRTQVVPFPSAQLGLPDGAENLKDGTSLEILGKIMYGISMLQGQIEPLFQDLQPDCLVTDVLYPWTVESAAKLGIPRLYFYSASYFASCATYFIRKHKPHERLVSDTQKFSIPGLPHNIEMTTLQLEEWERTKNEFSDLMNAVYESESRSYGTLCNSFHEFEGEYELLYQSTKGVKSWSVGPVCASANTSGEEKVYRGQKEEHAQESEWLKWLNSKQNESVLYVNFGSLTRLSLAQIVEIAHGLENSGHSFIWVVRIKDENENGDNFLQEFEQKIKESKKGYIIWNWAPQLLILDHPAIGGIVTHCGWNSILESVSAGLPMITWPMFAEQFYNEKLLVDVLKIGVPVGSKENKFWTTLGEVPVVGREEIAKAVVQLMGKEESTEMRRRARKLGDASKKTIEEGGSSYNNLMQLLDELKSLKASKAIEKET

SEQ ID NO: 144941 - protein, 258 aa, Glycine max
  Coding DNA Sequence Number=SeqID_53256
  Gene Ontology: Mol. function=protein disulfide oxidoreductase activity; Biological process=intracellular signaling cascade
  Homolog annotation: Hit_ID=A7PNI1; Match level="QueryCoverage=68%, HitCoverage=26%, E-value=5e-40, Identity=50%"; Hit description =Chromosome chr1 scaffold_22, whole genome shotgun sequence
  Pfam annotation: Domain name=Glutaredoxin; Domain location=146-205; Score=55.8; E_value=1.5e-13; Accession=PF00462.15; Description =Glutaredoxin
MGSEEVVEEPTPKTPNQTTTPETTSSSSPRKIKTNTPTENGHVSVTPTTLSIVQPHSLLPKPVPPRTTYTQNDVVVSSTTFGKFLRKRSNDLSSAISKGISTLKHSINDQNDNNGVTEFNLSGLKVFVTVKNKNDASSNSLARMKISFFSRSNCRECCAVRRFFRERALRFVEINVDVFAEREKELRERTGSATVPKIFFGERLIGGLVELNALRKDGGEELERRLKEAGGQGPAAPAYGFDEAEEEEMPEEEIGKVG

SEQ ID NO: 144942 - protein, 97 aa, Glycine max
  Coding DNA Sequence Number=SeqID_53257
MDAYRKRRKPEEPMVKMVNNRKDKLVKSSSKQYCQSTPTPSMTTYSLISNHMNKSQGIPWQDGKYIISSHHRECNTSLFDFEVPIQFGQGRTKSINY

SEQ ID NO: 144943 - protein, 113 aa, Glycine max
  Coding DNA Sequence Number=SeqID_53258
  Gene Ontology: Mol. function=binding; Cellular component=integral to membrane; Biological process=transport
  Homolog annotation: Hit_ID=A9PF19; Match level="QueryCoverage=90%, HitCoverage=27%, E-value=6e-35, Identity=70%"; Hit description =Putative uncharacterized protein
  Pfam annotation: Domain name=Mito_carr; Domain location=6-87; Score= -0.9; E_value=0.0037; Accession=PF00153.18; Description=Mitochondrial carrier protein
MEEKKEALRKAASESTIADSTLQDKLAELNSIKPRPYGTIHAANEVYNEAGIVGFWKGVIPALIMVCNPSIQFMIYESSLKHLREKRAAKKQGNTSISALELCISVNKHPPVL

SEQ ID NO: 144944 - protein, 1071 aa, Glycine max
  Coding DNA Sequence Number=SeqID_53259
  Gene Ontology: Mol. function=transferase activity, transferring hexosyl groups; Cellular component=Golgi apparatus; Biological process=carbohydrate biosynthetic process
  Homolog annotation: Hit_ID=Q9M3Y6; Match level="QueryCoverage=54%, HitCoverage=96%, E-value=0.0, Identity=78%"; Hit description=68 kDa protein
  Pfam annotation: Domain name=Glyco_transf_8; Domain location=719 -1045; Score=392.3; E_value=7.5e-115; Accession=PF01501.11; Description=Glycosyl transferase family 8
  Pfam annotation: Domain name=SAP18; Domain location=29-165; Score =163.0; E_value=8e-46; Accession=PF06487.3; Description=Sin3 associated polypeptide p18 (SAP18
  Pfam module annotation: Pfam domain module=Glyco_transf_8::SAP18; Domain location=719-1045::29-165
  Subcellular localization annotation: CTP_CleavageSite=54; ConfidenceScore=5.40e-01
MSDGGKRQGGRALPPPPRGPPPPPPSRPRLEPVDREKVLTLPSSSSSSSSSGERCEEEKVFTKIGSHHSMEDFAVRGKEPKDEVQIYTWKDATLRELTDLVKEVAPAARRRNAKLSFAFVFPDKNGRFKVQEVGKTLSYGNGRLDDGKALAELGFEVKDFFSSFLEFMLDLFTNSVADPVRKCADRVRTNFTTQSVACADALRREPSLAHSPIRSKFVCVDSPIRNDAEEEQRQGFVFSSSRFRPPLRSRAVFFLPLPEALRRPGTHLVWVGTMKHYFKVKGMDEDKKLEAMLRVVERKALSWLQWWESYIENLTWGELKYLGGIFFSVLRVEIMGRREVGCLKKGIGAPWKEMWDPIEMATSRTRPSNKIPVSNNSHYSLEEIQKKRMKGLCFAYDEKLSPMCLKTRTSKILMLEEVEPVKPWEMVVGEDVVLGMEWLENLGNAKENFKELSLKTKKGVILPRITYMCNKLDITNDLGPFSLDNFRKNLSASWRVGLGNSNAEHELNQQTTHVRQEKPEVKEDNPSQWTDSSAQQTRRHLIEKRREKRAAELVKKDNEVAVRVENTAIERSKSVESAIIGKYNIWRKEFENENGDSTVRLMRDQIIMARVYISIAKLKNKVELHEELISRLKESQRALGDAVSDADLHHRSEAITHGKIKAMGQVLSKAREQLYDCKLVTGKLRAMLQTADDQVRSLKKQSTFLSQLAAKTIPNGIHCLSMRLTIDYYLLPPEKRKFPGSENLENPSLYHYALFSDNVLAASVVVNSTIMNAKVTWAVFLTIPDPSKNVFHLVTDKLNFGAMSMWFLLNPPGKATIHVENVDDYKWLNSSYCPVLRQLESATLKEFYFKAGHPNSLSSGASNLKYRNPKYLSMLNHLRFYLPQVYPKLDKILFLDDDIVVQKDLTGLWAVDLNGKVNGAVETCGQSFHRFDKYLNFSNPHIARNFDPNACGWAYGMNMFDLKVWKKKDITGIYHKWQNMNEDRVLWKLGTLPPGLITFYGLTHPLDKSWHVLGLGYNPSLDRSEIENAAVVHYNGNMKPWLEIAMTKYRSYWTNVFARMMIIVLKLRRDR

SEQ ID NO: 144945 - protein, 132 aa, Glycine max
  Coding DNA Sequence Number=SeqID_53260
  Gene Ontology: Mol. function=sequence-specific DNA binding; Cellular component=nucleus; Biological process=regulation of transcription, DNA-dependent
  Homolog annotation: Hit_ID=A1XG54; Match level="QueryCoverage=81%, HitCoverage=57%, E-value=4e-23, Identity=53%"; Hit description=SOC1
  Pfam annotation: Domain name=K-box; Domain location=1-100; Score =69.1; E_value=1.5e-17; Accession=PF01486.8; Description=K-box region
MQFSSLSIPVNMHILKHLKQEAANMMKKIGLLEAAKRKFLGEGLGACSIEELQWIEQQLERSLSNVRTRKIQVFKEQIEQLKGKHGINLQTETKNQNVNQPQYNAGSPSSDVETELIIGLPDTRTRRIVHQV

SEQ ID NO: 144946 - protein, 152 aa, Glycine max
  Coding DNA Sequence Number=SeqID_53261
MERVASPTVHMRCSAMELASFKVQRSMLATRASNAMPASTLSSGDQMKAQLADGKSERGLHPQKWKLALIFLEEPDDAATSHHDHFPDPNPFNEDVEDDEDDFRDFVGFDHSSEEAFKELEVDYKDVIILKVHNFTIVIENNRFVMVKIYTP

SEQ ID NO: 144947 - protein, 132 aa, Glycine max
  Coding DNA Sequence Number=SeqID_53262
MKSCLGSERAMMPIDILNWDLEKKQEKVARRTKTRHNFKEPSNQSLNTDIDTMRVKTHANTLPYKVTTMGNTSHSHKSLTGYTFRYQIQTCVQPIPFTARLVKQLIARSARFSESRQKAISVVASTHFTNST

SEQ ID NO: 144948 - protein, 144 aa, Glycine max
  Coding DNA Sequence Number=SeqID_53263
  Gene Ontology: Mol. function=acyltransferase activity; Biological process=metabolic process
  Homolog annotation: Hit_ID=A7PY61; Match level="QueryCoverage=95%, HitCoverage=27%, E-value=2e-29, Identity=48%"; Hit description =Chromosome chr15 scaffold_37, whole genome shotgun sequence
  Pfam annotation: Domain name=efhand; Domain location=99-127; Score =33.5; E_value=7.4e-07; Accession=PF00036.23; Description=EF hand
MEAVDFLDKFLAMNPDSSLYLAYSGRVQYHDFLRVLRLKACPLSAKFLYGSAHVMSQPGFHQACEEAFAGCGGAVKAYVVEQELRDFIQPVILNWSEDEVHELFMVFDNDNDGRIDKNDFLSCLRKTPLLIAFFTLQLQQKEFE

SEQ ID NO: 144949 - protein, 176 aa, Glycine max
  Coding DNA Sequence Number=SeqID_53264
MDVKITIMTQEIGGNGTTSSTYAYWQTRGCNRYLFMFLHTDWMNAAGGVLRDWKGEFILGFSDALIECSSALEAELCAIKIGMQTAVAREAIQIINADKGAFLRSSIQHMTRMVDRICWNHVYWETNWVANSVADGLVKHGLSLSKDQSIRVFESPPDLIESRLYGDRIGKIYYCI

SEQ ID NO: 144950 - protein, 162 aa, Glycine max
  Coding DNA Sequence Number=SeqID_53265
  Gene Ontology: Mol. function=small conjugating protein ligase activity; Cellular component=mitochondrial matrix; Biological process=regulation of protein metabolic process
  Homolog annotation: Hit_ID=A7P8D5; Match level="QueryCoverage=34%, HitCoverage=5%, E-value=3e-13, Identity=68%"; Hit description =Chromosome chr3 scaffold_8, whole genome shotgun sequence
MGENQITPPQNPKFNFLILPVAAGVEIGSRRDEEPAINSTNIFAVLGSLKKKKDQQGPSKPNDKKDVFWAPAPLTSKSWADVDDEDDDDYYATIAPPESVWVAPIVTLNDVAAAEVGPQAIYVVGRDDDESIAAGSEISDAASWETVNDDEMEVFEDSREEA

SEQ ID NO: 144951 - protein, 101 aa, Glycine max
  Coding DNA Sequence Number=SeqID_53266
  Homolog annotation: Hit_ID=A7QFU6; Match level="QueryCoverage=61%, HitCoverage=17%, E-value=1e-11, Identity=45%"; Hit description =Chromosome undetermined scaffold_89, whole genome shotgun sequence
MSLNQVPEKRKKAEWCDKNIEIMLKVCIEEVNAENKPHNHFTKLGWANIAKKFNKATNLRYEYKQFRNRGGVRAFIEFNNMLTKVVSGLNHGIIELSIMEN

SEQ ID NO: 144952 - protein, 263 aa, Glycine max
  Coding DNA Sequence Number=SeqID_53267
  Gene Ontology: Mol. function=hydrolase activity, hydrolyzing O -glycosyl compounds; Cellular component=extracellular region; Biological process=carbohydrate metabolic process
  Homolog annotation: Hit_ID=Q10SM5; Match level="QueryCoverage=36%, HitCoverage=30%, E-value=5e-32, Identity=64%"; Hit description =Glycosyl hydrolases family 16 protein, expressed
  Pfam annotation: Domain name=Glyco_hydro_16; Domain location=38-216; Score=42.5; E_value=1.7e-10; Accession=PF00722.12; Description =Glycosyl hydrolases family 16
  Subcellular localization annotation: CTP_CleavageSite=74; ConfidenceScore=5.41e-01
MDPDIIDIPPPTKNNVSNSMKQNEASSSSLFLCRRGMQFVEFELLGRKRKRSNTLPKPVPTAPPPTPSPSPTTTAAACGGAPPTCFNSGTLSALIRCPSGDTSGLNFNLYLSSLEGNKSQDEIDFEFLGRDRNIVQTNYFSEGVGNMEKVHVLGFDASDGFHEYGIVWGSDAIEWRVDGNLVRRLCFCTLRCGMQVGLMKGSGVGSTNALETKHVRHATFTIRHSLDESNTAERNTDSDQRLVELDSSNDSQQPTLGEPEARQ

SEQ ID NO: 144953 - protein, 283 aa, Glycine max
  Coding DNA Sequence Number=SeqID_53268
MPMTKPKPMPEEQKMEYFMQVTEAPLSVAVQKLEKHGGNLNKALEDFYQKDSLRNPSQNEQHRSQKGLTVAEFLEAYPKKTLAELLDESTEGSFSWKKWAAPKIPPSHSQKTEAELLDEGTEGSSSRQKWAVPKIPPSHSPKTLAEFLAEGTEGSSSWKKWAVPKILPSHSQKKQKAKSGQLPMSSSSKGPVKQKAIDPLTRPKFPYARIPADKRWEYLERLWRDYADTRDNIHIAVHIPGGGCVQRIFLKTDKLKFKGMDLSSFFVPKQRKNNKKTGTNTTG

SEQ ID NO: 144954 - protein, 43 aa, Glycine max
  Coding DNA Sequence Number=SeqID_53269
MIIVCYTDNAPMVSESYWFPHANAISFALNDGNASPNSFCTLI

SEQ ID NO: 144955 - protein, 124 aa, Glycine max
  Coding DNA Sequence Number=SeqID_53270
MGILKEDAEVKDFRRDPNDQYLPLAFVVVENEINDSWKWFLELLVQDIGEIDGLVQTLRSMGAGDEHHQTQSTKLQLMPSMMNTNTMNSIRPSQTTTSHHQLGFVLINNLASIILLVLVSDQQP

SEQ ID NO: 144956 - protein, 76 aa, Glycine max
  Coding DNA Sequence Number=SeqID_53271
MTGLNVTVVRVRDILHKLITAQRLTMTPPSQVYLCHGYNVIFHRINSCTHPPHNTAPPPPFFACYHLWVWVSGVEQ

SEQ ID NO: 144957 - protein, 140 aa, Glycine max
  Coding DNA Sequence Number=SeqID_53272
MDTNQEEERFQEARKKKGFRSKEEEGFWKKLRGFFVWSSGAIHGVTPLKREKQYNKNQGFPSARKYLRSTRLRQERGLRIIGRFELVYTRVEVKAARFLDLVQFLTKLHKISSTSSNVGNRSKEQLCACKVYVAGHLALG

SEQ ID NO: 144958 - protein, 519 aa, Glycine max
  Coding DNA Sequence Number=SeqID_53273
  Gene Ontology: Mol. function=nucleoside-triphosphatase activity; Cellular component=signal recognition particle; Biological process =SRP-dependent cotranslational protein targeting to membrane
  Homolog annotation: Hit_ID=A7PXY2; Match level="QueryCoverage=96%, HitCoverage=96%, E-value=1e-120, Identity=79%"; Hit description =Chromosome chr15 scaffold_37, whole genome shotgun sequence
  Pfam annotation: Domain name=CbiA; Domain location=301-504; Score= -22.3; E_value=0.0035; Accession=PF01656.14; Description=Cobyrinic acid a,c-diamide synthase
  Pfam annotation: Domain name=SRP54; Domain location=297-519; Score =364.5; E_value=1.8e-106; Accession=PF00448.13; Description=SRP54 -type protein, GTPase domain
  Pfam module annotation: Pfam domain module=CbiA::SRP54; Domain location=301-504::297-519
  Subcellular localization annotation: CTP_CleavageSite=63; ConfidenceScore=5.77e-01
MATTSASFARFSVISRPSSSNPQFILFNAAPRTGTPHSRTGSARFRCLAGQTGFFTKLGRLIKEKAKSDVEKLFSGFSKTRSNLAVIDELLLYWNLADTDRVLDELEEERSVNKPSLAWNSYLLDAFQWFCLGAYERLIWQVKLGFEVRMRGFTLPDSFLLMHVELVALSSTLEVKVQPSSWRIYSSTNRAISIILDAKYKVSLVRQQEEEEARPLTGSLELPLHPPLKEESHHSAALLVSDFGPRITIKIVENLREDIFSGKLKSGNEIKEALKRNVLELLTSKGSKTELQLGYRKPAVIMIVGVNGGGKTTSLGKLAYRLKNEGAKVRLHYLSVAMVHDFDLHLKILMAAGDTFRAAASDQLEIWAERTGCEIVVAESEKAKASSVLSQAVKKGKELGFDIVLCDTSGRLHTNYSLMEELISCKKSVAKVVPGAPNEILLVLDGTTGLNMLPQAREFNDVVGVTGLVLTKLDGSARGGCVVSVVDELGIPVKFVGVGEGVEDLQPFDAEAFVNAIFM

SEQ ID NO: 144959 - protein, 260 aa, Glycine max
  Coding DNA Sequence Number=SeqID_53274
  Gene Ontology: Mol. function=catalytic activity; Biological process =cellular metabolic process
  Homolog annotation: Hit_ID=A7PZ68; Match level="QueryCoverage=99%, HitCoverage=81%, E-value=1e-86, Identity=64%"; Hit description =Chromosome chr15 scaffold_40, whole genome shotgun sequence
  Pfam annotation: Domain name=Epimerase; Domain location=6-243; Score =0.1; E_value=3.6e-07; Accession=PF01370.12; Description=NAD dependent epimerasedehydratase family
  Pfam annotation: Domain name=NAD_binding_4; Domain location=8-257; Score=-105.1; E_value=0.059; Accession=PF07993.3; Description=Male sterility protein
  Pfam annotation: Domain name=RmlD_sub_bind; Domain location=4-260; Score=-104.6; E_value=1.6e-06; Accession=PF04321.8; Description=RmlD substrate binding domain
  Pfam module annotation: Pfam domain module=Epimerase::NAD_binding _4::RmlD_sub_bind; Domain location=6-243::8-257::4-260
MSKVKILVVGGTCYLGQHLLQVYAHANANANANISGTPFVFDLAFTHHSSPPPHPLLDAIPSSLPFQVDLKTGLGFEAISNTFGQVPRACEIDPATAHAINLPSSLVKWLQSFEKRTTLLIHLSTDQVYEGEKSFYKEEDIAVPVNVYGKTKVAAEQFISENCPNFAILRCSIIYGPQTVSPVPKSLPNQWIDGALAKVEKVEFFQDEFRCPIYVKDLVNIILALTTQWISEGKQMQLLLNVGGADRVSRVQMAEAVAQF

SEQ ID NO: 144960 - protein, 214 aa, Glycine max
  Coding DNA Sequence Number=SeqID_53275
  Gene Ontology: Mol. function=hydrolase activity, hydrolyzing O -glycosyl compounds; Biological process=carbohydrate metabolic process
  Homolog annotation: Hit_ID=Q2HTU0; Match level="QueryCoverage=90%, HitCoverage=36%, E-value=3e-51, Identity=48%"; Hit description =Glycoside hydrolase, family 5; Ricin B-related lectin
MSLRNELHGPRQNLRDWYRYMSQAALAIHKANPNVLVVISGLNYDTELQFLKSKPLKIDLAKKMVFETHLYSWSGIGTLKLKEIWTKQPLNRICANSIKGINHRTGFLTTDKNATPLIFTEFGFDETGSSEEDNRFLTCLQTYLVGRDMDWGLWAFQGSYYVRNDKVQLGVMDDTWHHLRKPNFTDKFQLLQRKNHGKHFELLNGVIALATSVG

SEQ ID NO: 144961 - protein, 157 aa, Glycine max
  Coding DNA Sequence Number=SeqID_53276
  Gene Ontology: Mol. function=RNA-directed DNA polymerase activity; Biological process=RNA-dependent DNA replication
  Homolog annotation: Hit_ID=A2Q3D2; Match level="QueryCoverage=52%, HitCoverage=15%, E-value=8e-10, Identity=38%"; Hit description =Putative non-LTR retroelement reverse transcriptase, related
MKIPSKVAHFVWRLVKDRLPSRANLRRRNMQLDDYHCLFCSSHEEEASHIFFGCQRIMPLWWESLAWTEVVTVFPTSPKEHFVQHSYGNSSGIVQNRWWICNHCLDSSQTKSFSNGLETNLETEIGISQKDNIDDDDNERSKVKSLAFNQAFNMNHL

SEQ ID NO: 144962 - protein, 305 aa, Glycine max
  Coding DNA Sequence Number=SeqID_53277
  Homolog annotation: Hit_ID=A7PZA5; Match level="QueryCoverage=99%, HitCoverage=100%, E-value=1e-116, Identity=52%"; Hit description =Chromosome chr15 scaffold_40, whole genome shotgun sequence
  Pfam annotation: Domain name=DUF821; Domain location=1-298; Score =499.5; E_value=4e-147; Accession=PF05686.3; Description=Arabidopsis thaliana protein of unknown function (DUF821)
MLEGARRTAHFRVVIVDAWQVERFQGSNAPTPPLLRYCSDQWNLDIVFPDWSFWGWAEINIKAWKHVLKEIKEGNEKTKWKDRVPYAYWKGNPFVTPTRKDLMKCNVTEKDDWNTHLYIQDWDQESSQGYKKSNLGDQCTHRSGFHDFFVRGMVPLEHYWPIRDNSKCRSLKFAVEWGNNNTDKAQAIGEAGSKFIHEDMDMDYIYDYMFHLLNEYAKLQRFKPTIPPNAVEYCPETMTCGVDGTQKRFMEDSLVKSPSDSNPCTLPPPYEPINLQDFLEKKANSTRQVETWEDQYWENKKRGQL

SEQ ID NO: 144963 - protein, 426 aa, Glycine max
  Coding DNA Sequence Number=SeqID_53278
  Gene Ontology: Mol. function=cation transmembrane transporter activity; Cellular component=integral to membrane; Biological process=potassium ion transport
  Homolog annotation: Hit_ID=UPI0000196AE3; Match level="QueryCoverage =96%, HitCoverage=65%, E-value=1e-168, Identity=76%"; Hit description= KEA2 (K+ efflux antiporter); potassium:hydrogen antiporter
  Pfam annotation: Domain name=Na_H_Exchanger; Domain location=4-200; Score=-110.6; E_value=0.1; Accession=PF00999.12; Description =Sodiumhydrogen exchanger family
  Pfam annotation: Domain name=TrkA_N; Domain location=231-346; Score =117.3; E_value=4.6e-32; Accession=PF02254.9; Description=TrkA-N domain
  Pfam module annotation: Pfam domain module=Na_H_Exchanger::TrkA_N; Domain location=4-200::231-346
MEQAFKSFFILQRISSIFMGTLGRHLLRPIYKQIAENQNAEIFSANTLFVILGTSLLTARAGLSMALGAFLAGLLLAETEFSLQVESDIAPYRGLLLGLFFMTVGMSIDPKLLVSNFPVITGALGLLIFGKTLLVSLIGRAFGISLISAIRVGLLLAPGGEFAFVAFGEAVNQGIMSSQLSSLLFLVVGISMALTPWLAEGGQLLASRFELHDVRSLLPVESETDDLQNHIIICGFGRVGQIIAQLLSEQLIPFVALDVRSDRVTIGRSLDLPVYFGDAGSREVLHKVGAERASAAAVTLDSPGANYRTVWALSKHFPNVKTFVRAHDVDHGLNLEKAGATAVVPETLEPSLQLAAAVLAQAKLPTSEIAATINEFRSRHLSELTELSETNGTSFGYGYNRTTSKAKSQSPDSSDDTQVSEGKLAT

SEQ ID NO: 144964 - protein, 207 aa, Glycine max
  Coding DNA Sequence Number=SeqID_53279
  Gene Ontology: Mol. function=oxidoreductase activity, acting on the CH-OH group of donors, NAD or NADP as acceptor; Cellular component =cytoplasm; Biological process=metabolic process
  Homolog annotation: Hit_ID=A7PY52; Match level="QueryCoverage=78%, HitCoverage=66%, E-value=8e-39, Identity=44%"; Hit description =Chromosome chr15 scaffold_37, whole genome shotgun sequence
  Pfam annotation: Domain name=2-Hacid_dh_C; Domain location=51-172; Score=23.1; E_value=1e-11; Accession=PF02826.10; Description=D -isomer specific 2-hydroxyacid dehydr
TLVSVVEEGSPSSDLGVEEVTTTTMAPIMTTTTISTHVCDDYSHVAANMVVALLIDVMRKILAADRYLRTQQSRDNTPWDFFTFGSKSFGCIILYNSKHKKASVSYPFYSSIVDLATTSDARRGGLIDEKELVKCLMEGEIGGAGLDVFENEPRVPEELLEMNNVVLSPHAAALTVESMMNLCELMGGNLEAFFSNKPRITPVMLAE

SEQ ID NO: 144965 - protein, 63 aa, Glycine max
  Coding DNA Sequence Number=SeqID_53280
MVYSLLPWKEESLHFDVVVVVSLSLAHVAVERWFIDVVRWVDAAWWVIVAVLRRCGGSSTRGC

SEQ ID NO: 144966 - protein, 54 aa, Glycine max
  Coding DNA Sequence Number=SeqID_53281
MSFQEIDSLGLRDRGFHVVKKSDTKEGLSLCGSELVKGFCNIVELSSGLLRDWT

SEQ ID NO: 144967 - protein, 82 aa, Glycine max
  Coding DNA Sequence Number=SeqID_53282
MLLSNVIYICVRVVKLVRMIHTRLFAVAQVKSCLGMHSSCVIASLSGCIRTGCTLQYQGVAQELIKENYWPLNREYKSRLSI

SEQ ID NO: 144968 - protein, 80 aa, Glycine max
  Coding DNA Sequence Number=SeqID_53283
AIRQGDSEVAESWFNQAAEYWKQAIALTPAAATAGGAPIRPIVSRIKIHWPSFYNVVTGKNPGRLPNLIALQHIPPFAQL

SEQ ID NO: 144969 - protein, 123 aa, Glycine max
  Coding DNA Sequence Number=SeqID_53284
MLRNFTDCATILFLTSGMLRSFTDCATMLVLTSRMLRDFTDYTTMGVKNFEVVKRRSHANKQWSPDEIRSLSEELRDYYEGRHRAYPRPHSHCREKERKPQEANINLLYFHGKDNVEANLDWK

SEQ ID NO: 144970 - protein, 18 aa, Glycine max
  Coding DNA Sequence Number=SeqID_53285
MGHLRVLRKKPEFPGTSD

SEQ ID NO: 144971 - protein, 652 aa, Glycine max
  Coding DNA Sequence Number=SeqID_53286
  Gene Ontology: Mol. function=oxidoreductase activity, acting on the CH-CH group of donors; Cellular component=integral to membrane; Biological process=fatty acid metabolic process
  Homolog annotation: Hit_ID=A8GAB5; Match level="QueryCoverage=100%, HitCoverage=79%, E-value=0.0, Identity=87%"; Hit description =Putative uncharacterized protein
  Pfam annotation: Domain name=Acyl-CoA_dh_1; Domain location=194-341; Score=38.6; E_value=2.3e-08; Accession=PF00441.15; Description=Acyl -CoA dehydrogenase, C-terminal dom
  Pfam annotation: Domain name=Acyl-CoA_dh_M; Domain location=71-131; Score=4.3; E_value=0.019; Accession=PF02770.10; Description=Acyl-CoA dehydrogenase, middle domain
  Pfam annotation: Domain name=DUF1974; Domain location=348-626; Score =626.9; E_value=1.8e-185; Accession=PF09317.2; Description=Domain of unknown function (DUF1974)
  Pfam module annotation: Pfam domain module=Acyl-CoA_dh_1::Acyl-CoA_dh_ M::DUF1974; Domain location=194-341::71-131::348-626
MIIKKEYGGLEFSPYAQAMVLQKLAGVSGILAITVGVPNSLGPGELLQHYGTEEQKNHYLPGLARGDEIPCFALTSPEAGSDAGAIPDVGTVCMGEWQGKQVLGMRLTWNKRYITLAPVATVLGLAFKLHDPNRLLSDNESPGITCALIPTSTPGVEIGNRHFPLNVPFQNGPTRGTDVFVPIDYIIGGPKMAGQGWRMLVECLSVGRGITLPSNSTGSLKSIALATGAYAHIRRQFKISIGKMEGIEEPLARIAGNTYVMDAAASLITYALVQGEKPAVLSAIVKYHCTHRGQQSIVDAMDIAGGKGIMLGESNFLARAYQGAPIAITVEGANILTRTMMIFGQGAIRCHPYVLDEMAAAQSNDLNAFDKSLFGHLGHVGSNKVRSFWLGLTNGRTSATPTKDATRRYYQQLNRLSANLALLSDVSMGVMGGSLKRRERISARLGDIISQMYLASAVLKRFDDEGRQKEDLPLVHWGVQDSLHKAEQAMDDLLRNFPNRFIAGALRFVVFPFGRVHTAPSDRLDHQLAKILQVPSATRSRLGRGQYLTPSEHNPIGLLEAALADVMAAEPIHERLCKAAGKNLPFTRLDRLAERALEEGKISADEARILVKAEESRLRSINVDDFAPDALAAAKPEKPAAQSKRQQQTEAA

SEQ ID NO: 144972 - protein, 96 aa, Glycine max
  Coding DNA Sequence Number=SeqID_53287
MMTHQNPPYLAFCTPGQNETKNKIQGYQRETNKNIHIFLNEHQACSELQNKERETRLKRAIKGINSKDAFNQEIKAKGYLVQSNSMGAKTTPKMDY

SEQ ID NO: 144973 - protein, 192 aa, Glycine max
  Coding DNA Sequence Number=SeqID_53288
  Subcellular localization annotation: CTP_CleavageSite=27; ConfidenceScore=5.05e-01
MVKVGTSYVPINVSFSPKVGPGSSAVPFMSRGEVQEAASLLFTKCELHHSLIRQYRAPRGGMPGPLIDSSVVRVNFEAPVAYHGFYQLFPPVQLLTGLPHSPFRLRNCSGKGLIGARAFAINESPTLAKGGCAARKGSHRCVAQNSGSPGLTGNSALTLILTQLPRIVPAASGKVTNGAEISWKMPGRYLTG

SEQ ID NO: 144974 - protein, 63 aa, Glycine max
  Coding DNA Sequence Number=SeqID_53289
MMFLINFVKKLALSTNSPYLTPHNNNGVKRDESLIKRQNPEFSLDTATPPKLTEFSNLKMGKF

SEQ ID NO: 144975 - protein, 181 aa, Glycine max
  Coding DNA Sequence Number=SeqID_53290
  Homolog annotation: Hit_ID=Q5CDC4; Match level="QueryCoverage=23%, HitCoverage=32%, E-value=1e-15, Identity=100%"; Hit description =LacOPZ-alpha peptide from pUC9
MVKVGTSYVPINVSFSPKVGPGLPGINRDTRIYLFCEVIFRHSCPSCSATDGVGELELHRGGGRSRTSGSPGLQEFDRSRSFFHRMGQQDRGPDHVALPGRLFGGQRLGGARVGAERLDEVERPDQAYRYRRPRGGARYQLLFPLVRVNFELGVIMVIAVSCVKLLSAHNSTQHTSRKHKV

SEQ ID NO: 144976 - protein, 55 aa, Glycine max
  Coding DNA Sequence Number=SeqID_53291
MASYGGELLLDSSSPWSDVSNHLSSFFIPLPFIFKKQKTSLMKKIQGLHNVGRVP

SEQ ID NO: 144977 - protein, 177 aa, Glycine max
  Coding DNA Sequence Number=SeqID_53292
MQSQGLALPPEPEIGPSGARVSTKESCVAPSGNDLGMGDSDKCRLYIEENLSRLVALGRLYEGSTIVHNIPLLHGQVKVGVEEVKDAEALVPVPTDEAAVSPAKPSESPDDEVDDPLYLMTLTIPQLFLKPLQVMWDATIFGVFNQNFPLYIKHEDLSAIAHGGQCLSISVIQLWIL

SEQ ID NO: 144978 - protein, 100 aa, Glycine max
  Coding DNA Sequence Number=SeqID_53293
MHNLKENNTYKKIVMFSLILLLKVQVKVQLKDLLDGEFILVGVDHWGYPMGWEEKTPLNAIGSLVRRHQCAPINFLSWKDMPKDYITDMVELIQVWYKTL

SEQ ID NO: 144979 - protein, 94 aa, Glycine max
  Coding DNA Sequence Number=SeqID_53294
GGACHPARPGEPGFFLQKQSPSGGTSLKAQVGLNFTYCATKGAKYLEAAAQCPMCAVKKVIWTFQLPMTKDETNIQRMRDDMMQMRKNATGGWT

SEQ ID NO: 144980 - protein, 315 aa, Glycine max
  Coding DNA Sequence Number=SeqID_53295
  Gene Ontology: Biological process=transposition, DNA-mediated
  Homolog annotation: Hit_ID=Q6UUU1; Match level="QueryCoverage=19%, HitCoverage=40%, E-value=5e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPVTTLANWSSTAVAAALELVDPPGCRNSISVGEKSPTEGSDHLVHYNVADKYQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTGK

SEQ ID NO: 144981 - protein, 130 aa, Glycine max
  Coding DNA Sequence Number=SeqID_53296
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=66%, HitCoverage=73%, E-value=5e-25, Identity=67%"; Hit description=LacZ protein
MICSVTLTHLSLKLILTSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVR

SEQ ID NO: 144982 - protein, 100 aa, Glycine max
  Coding DNA Sequence Number=SeqID_53297
MVILFKALQSEHILQEPSFFGTKITRTAHGLMLSLTYPLPMSSSTCLCDENHETGQIQAKGPSGEGRRPKWRRTKPRVEKDEDPEVETLSRLLIVAEDPN

SEQ ID NO: 144983 - protein, 85 aa, Glycine max
  Coding DNA Sequence Number=SeqID_53298
  Gene Ontology: Biological process=transposition, DNA-mediated
  Homolog annotation: Hit_ID=Q1J7G7; Match level="QueryCoverage=35%, HitCoverage=42%, E-value=2e-10, Identity=100%"; Hit description =Transposase
WNSYVPDQRLIFAKKLAQGFPGINRDTRIYFILRSDLPSQWLLFLSAVPPVQLLTGWCVTAKAPPDISAGKCSGHAARNHHTRRA

SEQ ID NO: 144984 - protein, 118 aa, Glycine max
  Coding DNA Sequence Number=SeqID_53299
MEKNVATAAAVSLAAKANPTLLATAHHPPPNTIGREKSTQGHNSNPHLGYNRVAFKYKVQHLIDAGWLTFQEDRPNVKTNPVANHGRGAINAIESDRPRRSKPLKDVATPRRFIFEAL

SEQ ID NO: 144985 - protein, 147 aa, Glycine max
  Coding DNA Sequence Number=SeqID_53300
MSTDGIISSEVHGNSKIIDQSLFFSLTKLPSQGAPFEGTIVDDWKFDYSSHDARRMIDRAHLVRYQMHKALRANAPLPYPQLVTLFLRHFQIPLDDEPFVQVKRSFAIGAGAVTSFGYHKDRNGQWLKKDALPPQDEHTPSPPPQQR

SEQ ID NO: 144986 - protein, 22 aa, Glycine max
  Coding DNA Sequence Number=SeqID_53301
MDSRNQSRYLGTDASGDGVTTN

SEQ ID NO: 144987 - protein, 96 aa, Glycine max
  Coding DNA Sequence Number=SeqID_53302
MARTRGLGRAIDRLIGRDRQDDHDAVDVPERRRLTASAHRQRVHQMTVDAPDMAADVPDMTEDVPDMAEDAPEMTVDIQGDDGAEGSHADDAEGFL

SEQ ID NO: 144988 - protein, 99 aa, Glycine max
  Coding DNA Sequence Number=SeqID_53303
MASKKWKAHSTPSQARYDRSRFTSSKAWERYTDIVVPRKLLPERNIVVYYTEFDEFKEELERRHWDEELTDFNDNSIDITIVKEFYANLYDPEDKSRKQ

SEQ ID NO: 144989 - protein, 341 aa, Glycine max
  Coding DNA Sequence Number=SeqID_53304
  Gene Ontology: Mol. function=receptor activity; Cellular component =outer membrane-bounded periplasmic space
  Homolog annotation: Hit_ID=Q46VW7; Match level="QueryCoverage=58%, HitCoverage=61%, E-value=4e-80, Identity=72%"; Hit description =Uncharacterized protein UPF0065
  Pfam annotation: Domain name=Bug; Domain location=95-341; Score =173.6; E_value=5.2e-49; Accession=PF03401.5; Description=Bordetella uptake gene (bug) product
MARLTAPWVTHRVSAARVKLPSRAAVMKACSSDMDGECRRMARRSPGPGDRPLSMSVGNEGVQYSRLKGDRKVRTLAASQQDLHLFPESLHVPPLFRLFRAHRARRRLRRAVLCRPGASRRLSLPPHQTGGAVRRGRFDRHCGAPGGRVARSTPDGYTIGMATMSTHGSNPAVYRKMNYDPLKDFEPVANVLAVPSIFAINPQVPAKNMAEFVALAKGQADKYSFASPGVGSLGHVNIENFMMLAGIKLLHVPYRGAGPALNDVMGGQVDAITDNLSSTLPQVLGGKLRPLAVLGAERSPLLPDVPTYIELGYPDMGTGGWFGLVAPAGTPPAVIERLNQA

SEQ ID NO: 144990 - protein, 181 aa, Glycine max
  Coding DNA Sequence Number=SeqID_53305
MIRGDTLRLFAPFCHPEAAGPMTSRDQVWSFCTLVSSRGGGPDDTRRYLTVIRTLLSSRGGGPDDKQRPKAAGPMIRGDTLRLFAPFCHPEAAGPMTSRDQIWSFCTLVSSRGGRPDDTRRYLTVIRTLLSSRGGGPDDKQRPSFGHSAPLYHPEAAGPMIRGDTFTVISHPFVIQRRRAR

SEQ ID NO: 144991 - protein, 467 aa, Glycine max
  Coding DNA Sequence Number=SeqID_53306
  Gene Ontology: Mol. function=phosphoribosylaminoimidazole carboxylase activity; Cellular component=phosphoribosylaminoimidazole carboxylase complex; Biological process=purine nucleotide biosynthetic process
  Homolog annotation: Hit_ID=P09029; Match level="QueryCoverage=64%, HitCoverage=93%, E-value=1e-137, Identity=74%"; Hit description =Phosphoribosylaminoimidazole carboxylase ATPase subunit
  Pfam annotation: Domain name=AIRC; Domain location=20-144; Score =151.9; E_value=1.7e-42; Accession=PF00731.11; Description=AIR carboxylase
  Pfam annotation: Domain name=ATP-grasp; Domain location=200-342; Score=179.4; E_value=9.1e-51; Accession=PF02222.13; Description=ATP -grasp domain
  Pfam module annotation: Pfam domain module=AIRC::ATP-grasp; Domain location=20-144::200-342
MPVFRPRNRVDRMSSNAAPARIAIVMGSKSDWATMQFAEEILNSLDVPFHVEVVSAHRTPDKLFSFAERAADNGFQVIIAGAGASTPSCRCRAVIPVGTLAIGKAGAANAALLAAQILAIHDRELAARLAAWRQSQTDEAGEPLGIAVYPVGLDAEPSALPIAQSVITAEIERWPETALTRELANHPAFVNRDIFPRLADRLTQKQLLDQLNLATAPWQLLADKSEWPAVFSTLGELAIVKRRTGGYDGRGQWRLRADETATLPDECYGECIVEQGINFSGEVSLADAAKQHQGEAMLSAIMHELKYVGVMAMECFVTPQGLLINELAPRVHNSSHWTHNGASISQFELHLRAVLGLPLPQPVVFAPSVMVNLIGTDLNTDWLQLPLVHLHWYDKEVRAGHKVGHLNLTDSDPARLTAALNALVPLLPDAYASGIAWAVANLYFCGVPLTLALSHKGEGIIGCDFSV

SEQ ID NO: 144992 - protein, 149 aa, Glycine max
  Coding DNA Sequence Number=SeqID_53307
  Subcellular localization annotation: CTP_CleavageSite=49; ConfidenceScore=5.09e-01
MGGYVGAKASLLSTAPLSVTMTQELVARRDTLRGQYGHLRPFRRCRHLLVETFSSLTSYPELRRSEFLIGGYVGARALLLRRPIFVILTSRGHVTCTLVSSRGGGPDDTRRYLTVIRTLLSSRGGGPDDKQRPSLVILHPCIIQRRRAR

SEQ ID NO: 144993 - protein, 107 aa, Glycine max
  Coding DNA Sequence Number=SeqID_53308
  Gene Ontology: Mol. function=chloramphenicol O-acetyltransferase activity; Biological process=response to antibiotic
  Homolog annotation: Hit_ID=UPI0000ECBC59; Match level="QueryCoverage =73%, HitCoverage=16%, E-value=1e-18, Identity=57%"; Hit description =UPI0000ECBC59 related cluster
MSKYYTQGDKVLMPQAIQVHHAVYDGFQVGRMLNEVQQYCDEWQGGAHQNLSFQFSLNRRMTSRLTPLNQLPVAAASGALAFQLGANCLPGTECQAWNETNAAITAE

SEQ ID NO: 144994 - protein, 243 aa, Glycine max
  Coding DNA Sequence Number=SeqID_53309
  Gene Ontology: Mol. function=DNA topoisomerase type I activity; Cellular component=chromosome; Biological process=DNA unwinding during replication
  Homolog annotation: Hit_ID=A9CJ93; Match level="QueryCoverage=100%, HitCoverage=27%, E-value=1e-131, Identity=98%"; Hit description=DNA topoisomerase
  Pfam annotation: Domain name=Toprim; Domain location=1-113; Score =99.0; E_value=1.5e-26; Accession=PF01751.13; Description=Toprim domain
MNVVVVESPAKAKTINKYLGSGYKVLASFGHVRDLPAKDGSVLPDQDFEMSWEVDSASAKRMKDIADAVKSSDGLFLATDPDREGEAISWHVLDLLKKKRVLGDKPVKRVVFNAITKKAVLDAMANPRDIDVPLVDAYLARRALDYLVGFNLSPVLWRKLPGARSAGRVQSVALRLVCDRESEIERFVSEEYWNISALLKTPRGDEFEARLVSADGKRLQNRAIKTGDDANRLKALLEGATYV

SEQ ID NO: 144995 - protein, 59 aa, Glycine max
  Coding DNA Sequence Number=SeqID_53310
MTKCPSTMNFSFWWSVEGMTPTEWIYGRPKRQLYGGLSVQGGRSLASPLSGFRRRHGPP

SEQ ID NO: 144996 - protein, 146 aa, Glycine max
  Coding DNA Sequence Number=SeqID_53311
MELASLYRAAIVSSSSEEDELKVCLRSKRNLSQQLSETEGNMWAIIDKCKERLNLAATHEQRLEDEYAKISAEREARERVIDSLHQEATMWTDRFALTLNRSQELPPLLAKAKAMADTYSAPKKIHGLLSYCQHMIDLMDHMIRNR

SEQ ID NO: 144997 - protein, 105 aa, Glycine max
  Coding DNA Sequence Number=SeqID_53312
MTRGNPSDLQPFDPEIDRTFHRLVRHHFIPFDHSEHSITGESVHSVIGDFEHPDLEHYNFEHSDSEHSDFAHSENMTQPPPRERTLREMAAPDFTYESLCIQYPD

SEQ ID NO: 144998 - protein, 96 aa, Glycine max
  Coding DNA Sequence Number=SeqID_53313
  Homolog annotation: Hit_ID=A5AV98; Match level="QueryCoverage=93%, HitCoverage=9%, E-value=4e-09, Identity=39%"; Hit description =Putative uncharacterized protein
  Pfam annotation: Domain name=zf-CCHC; Domain location=60-77; Score =22.9; E_value=0.00052; Accession=PF00098.14; Description=Zinc knuckle
MLVQEETRLKNQGSHPIHYVSHQRNQGAEKKFMKKHDKGKGSLKINDDSLQIHKKVSKGNNCQFCGKSGHFQKDCLKRKPWFGKKGIPYNPNHKLK

SEQ ID NO: 144999 - protein, 215 aa, Glycine max
  Coding DNA Sequence Number=SeqID_53314
  Subcellular localization annotation: CTP_CleavageSite=41; ConfidenceScore=5.24e-01
MAESSKKRKGSSSSAAAAGHRRHGPSEAPRTPIHPSLSSLRSSTLFSYDDQRLRQGTPFEGTIVDDWKFDYFSHDASHMVCNDQAEMTASEEDLILMWAFLTNRQIDWAHLRSFAIGAGAVTSFGYRKDRNGQWPKKDALPPQDERTPSPPPQQDDSALMTKVLSELRGLRTYVGEHFDSLDTCFAGMDIRLTQLEEDVGYIRQSFNLPPPPPPS

SEQ ID NO: 145000 - protein, 87 aa, Glycine max
  Coding DNA Sequence Number=SeqID_53315
MEVDEPWLGLWLPLNYQVDMGSSLAYDNGIWGFVVDLGMAFVDNWVVGKEEVCYWLSNDIVGMIKFASFQIHFDPFTGEDQIRKAFR

SEQ ID NO: 145001 - protein, 48 aa, Glycine max
  Coding DNA Sequence Number=SeqID_53316
  Homolog annotation: Hit_ID=Q2HW89; Match level="QueryCoverage=97%, HitCoverage=7%, E-value=5e-08, Identity=45%"; Hit description =Integrase, catalytic region; Ribonuclease H
MKNAFDKKVRLRKFHEGAFFGGALVLTNMDGEELPSPVNSDVVKRYYA

SEQ ID NO: 145002 - protein, 93 aa, Glycine max
  Coding DNA Sequence Number=SeqID_53317
  Subcellular localization annotation: CTP_CleavageSite=77; ConfidenceScore=5.42e-01
MLVRMIHTRLFAAARVKSCPGMHSRCVIASLSGCARTVGRPPISGSSPGTVERKPWPPTLKMRTRSPLKARACSPLQARMCSPLMPRTYGPLK

SEQ ID NO: 145003 - protein, 109 aa, Glycine max
  Coding DNA Sequence Number=SeqID_53318
MSEIGRFGGLGMEERRKEEGAAQGILKMRRQPTGNRLHEYCNRLQAICSSVIDYSIHVYDQEGYHSQIIVASSIKSVHNNCRQKYILLQQWIKQHCFVSYYAMRQERIQ

SEQ ID NO: 145004 - protein, 145 aa, Glycine max
  Coding DNA Sequence Number=SeqID_53319
  Gene Ontology: Mol. function=tetracycline:hydrogen antiporter activity; Cellular component=integral to membrane; Biological process=response to antibiotic
  Homolog annotation: Hit_ID=Q8GEG0; Match level="QueryCoverage=70%, HitCoverage=83%, E-value=1e-24, Identity=61%"; Hit description =Putative uncharacterized protein
MNGITECLARMPRLLFKKSHSSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 145005 - protein, 91 aa, Glycine max
  Coding DNA Sequence Number=SeqID_53320
  Gene Ontology: Biological process=transposition, DNA-mediated
  Homolog annotation: Hit_ID=Q1J7G7; Match level="QueryCoverage=36%, HitCoverage=47%, E-value=1e-11, Identity=96%"; Hit description =Transposase
MVKVGTSLRADQRFIFAKSWPRASRYQQGHQDLFILRSDFPSQVLQWLLFLSAVPPVQLLTGWCVTAKAPPDISAGKCSGHAARNHHPRRA

SEQ ID NO: 145006 - protein, 40 aa, Glycine max
  Coding DNA Sequence Number=SeqID_53321
APKKVENGELANSTAQKLRRAADSKGSRLEGGGHMNSARQ

SEQ ID NO: 145007 - protein, 73 aa, Glycine max
  Coding DNA Sequence Number=SeqID_53322
MVLDLEVLAQFLHHLVIQIGGIVCDNLFGQSIPADYFLFNEPNYHASCDAGVQGSFNPFGEVVDRNQDKAMLV

SEQ ID NO: 145008 - protein, 154 aa, Glycine max
  Coding DNA Sequence Number=SeqID_53323
MVKVGTSYVPINVSFSPKVGPGLPGDQTGTLTPPLDLRLHELTNKLDQAYRIPSTSRGGPLLKLLSAHNSHTSIPSRKHQRASVKPGVPNDAAANLTPALNCVALQGCPLLQFRETCRANCINESATPGDRGGSSLLPSWRKGRMCATGDYYVG

SEQ ID NO: 145009 - protein, 90 aa, Glycine max
  Coding DNA Sequence Number=SeqID_53324
MERYFQHLVRQQVQIHECLYQLSLSQQSQGFAPFACPTLDQFRAELAWPGDWPEDQTEEAPAGAPDGAEDTRMDEEMTDLLGFMRGSGAT

SEQ ID NO: 145010 - protein, 66 aa, Glycine max
  Coding DNA Sequence Number=SeqID_53325
MNQIVPYVPPQPSDPLMEKISRLERAVNKLSRDKYDVADLENLSLYPKMMMSTPGSMRLTKGNSLD

SEQ ID NO: 145011 - protein, 222 aa, Glycine max
  Coding DNA Sequence Number=SeqID_53326
  Homolog annotation: Hit_ID=Q8FRD9; Match level="QueryCoverage=44%, HitCoverage=67%, E-value=5e-08, Identity=36%"; Hit description =Putative uncharacterized protein
  Pfam annotation: Domain name=DUF955; Domain location=86-192; Score =39.0; E_value=1.7e-08; Accession=PF06114.4; Description=Domain of unknown function (DUF955)
RRFALSGYSDQDLTREIVRRLDHGTATADLTDPVDSALVDEVLAEDVPYIGRVTEKPERLAADTRPKKIDEPHAEEVCMRELLAHASRLGVSVHVAHLPAPYRGWYDIDAAQVVYDWDLTPDEQREVLAHELGHVHHGHACEGNPDHERLADTYAARLLIHPEEYAAAERVAENPTYIAEELSVSTHLVGIYQRHCLTRLRGVSYASSRMGVGQWRFRRAHA

SEQ ID NO: 145012 - protein, 71 aa, Glycine max
  Coding DNA Sequence Number=SeqID_53327
MPLRSGGGCDSDYGGGGGMVTMMMVVIVVVEGWNNGGSGSNDSGGNNNDGNVVAVAVVVVVVVTATTWWWR

SEQ ID NO: 145013 - protein, 117 aa, Glycine max
  Coding DNA Sequence Number=SeqID_53328
MRNDHNLSPHVIGLRRLWMTKGCRMTIICLCVPSDTLSVMAKGVRNDHNLSPHVIGPRRLWMTKGCRMTIICLCVPSDTIIFGWRKGCGMTIICLRMSSGSPASRMTKGCRMTIICL

SEQ ID NO: 145014 - protein, 151 aa, Glycine max
  Coding DNA Sequence Number=SeqID_53329
MRDLATWRRVFDAASGGALGDMTPVEARNLIKKMASNSQQFSARNDAIVLRGVHEITIQIFVLLCSNLESMSNLKLMLQTFIIDPLGCKTNNSRIIMIFQATDTMYVLHNNNSLSLLSRMLLVQASHMFLLQYSSSHNKDNKQLRLLLNIP

SEQ ID NO: 145015 - protein, 37 aa, Glycine max
  Coding DNA Sequence Number=SeqID_53330
MGVKHFEVVKRRSHANKQWSPDEIRMRTLSPLKACND

SEQ ID NO: 145016 - protein, 87 aa, Glycine max
  Coding DNA Sequence Number=SeqID_53331
  Subcellular localization annotation: CTP_CleavageSite=34; ConfidenceScore=5.25e-01
MWVQAIGQFAQATCAPEFGLPRPFNQRLLLLHVGVGAVKQRESSTTRDSRSLSPFSEVRRREEEISLERDRLYNEDQSKFLIEYASG

SEQ ID NO: 145017 - protein, 299 aa, Glycine max
  Coding DNA Sequence Number=SeqID_53332
  Gene Ontology: Biological process=transposition, DNA-mediated
  Homolog annotation: Hit_ID=Q6UUU1; Match level="QueryCoverage=20%, HitCoverage=40%, E-value=4e-18, Identity=78%"; Hit description =Putative uncharacterized protein
WNSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPVTTLANWSSTAVAAALELVDPPGCRNSMPKKKRFKQLMTHLARQIRSASDICLARHSARLTDEIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 145018 - protein, 32 aa, Glycine max
  Coding DNA Sequence Number=SeqID_53333
MGKWLRRNSPRRGLEETPQEKGPMPPPSLIVI

SEQ ID NO: 145019 - protein, 240 aa, Glycine max
  Coding DNA Sequence Number=SeqID_53334
  Homolog annotation: Hit_ID=A5BU47; Match level="QueryCoverage=57%, HitCoverage=7%, E-value=9e-12, Identity=31%"; Hit description =Putative uncharacterized protein
  Subcellular localization annotation: CTP_CleavageSite=40; ConfidenceScore=5.27e-01
MTTPPPSPIQAEIPFDGTSRKTRQATRLRRLTARTLDQPRATVSVNPAPVVAQDKIPIVHSTWNDVPETLKNMIWDDILAKFDIPEGDNAKKKVMSTVTTRWRKFKSSLTTKYVYGNSDGQPKDDPLVKYVIDAKDWVKFAKMRQTPTWQGIQKKGQEIQKYNDSSHLLSRGGYELLEKKLMAEKRKIQEEQAAFTEDPSLYLPSSPISRHEKWKSACTKQYGQMTSQATKEIADKIVSN

SEQ ID NO: 145020 - protein, 70 aa, Glycine max
  Coding DNA Sequence Number=SeqID_53335
MVICALSGDVGIFWWRLFQVSQVIQNYVCHVTCTLVSSRGGEPDDTRRYLTVIRTLLSSRGGGPDDKQRP

SEQ ID NO: 145021 - protein, 108 aa, Glycine max
  Coding DNA Sequence Number=SeqID_53336
MVSKTLTRYDFVATYPSAGGRRVTRGMRVPRKEYARSRHQRLFEENVGKTGKDAIYELLSERFGSCIYARGRRETLRRWTINDVSGWSTKVGLLLLRILNCDEEIRST

SEQ ID NO: 145022 - protein, 79 aa, Glycine max
  Coding DNA Sequence Number=SeqID_53337
MYLENSTTSRKDQESKLTTNLGSHEWTIIMRLGKHDSEGEGAQHFECKPNYSNKTSPRFSTRWLGVMSMEKMKDKMHKV

SEQ ID NO: 145023 - protein, 264 aa, Glycine max
  Coding DNA Sequence Number=SeqID_53338
  Gene Ontology: Biological process=transposition, DNA-mediated
  Homolog annotation: Hit_ID=Q6UUU1; Match level="QueryCoverage=22%, HitCoverage=40%, E-value=3e-18, Identity=78%"; Hit description =Putative uncharacterized protein
DLPSQWLLFLSAVPPVQLLTGWCVTAKAPPDISAGKCSGRVPFAIQAAQLLGRAIGAGLFAITPAGERGMCCKAIKLGNARVFPVTTLANWSSTAVAAALELVDPPGCRNSIRPPLHFMKGTTDQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 145024 - protein, 114 aa, Glycine max
  Coding DNA Sequence Number=SeqID_53339
MDNEEGVQEQMKADLSTLKDQMASITKAMLKLQKTIEDNATKVASNTAREAEPVLQPTINLGRDKNTTSSSRRYSPQAYPYGLPLDFTPHTVPDDLSQAPTFEGQLPPHADYPL

SEQ ID NO: 145025 - protein, 172 aa, Glycine max
  Coding DNA Sequence Number=SeqID_53340
MATMMEAMMSMKKIMEANAVTVAATSAVAKVNPMPSSGLNQMNHPTLDMVGKDLGSTGGPHHAQIENKHAFPPYGLPPNYTPPNVAYTPNEDTHEMPHHNLADFEPCLGYATEGQAVGGIPMPNTLEGPQFRPQPQPLHFTVGRAPPAMVEKGELDHIEERLKDIEGGKDYA

SEQ ID NO: 145026 - protein, 175 aa, Glycine max
  Coding DNA Sequence Number=SeqID_53341
MAPTRHPLDPDKSNRALGFPALITGLCQSFGVPITPSKVIWPPITRAFIEKYCTQRQVPGDAPQAADVPPPHQAGPAGLFDTEQYLRHLVRQQAANHRAHVQTHDCLYQMSLSLQSQGFTSFPCPTPDQFRAEVAWPGDWPEAQAGEAPAEAPDEADEAREDEEMTDLLDFLGGS

SEQ ID NO: 145027 - protein, 60 aa, Glycine max
  Coding DNA Sequence Number=SeqID_53342
LKTEENEERTMDVEERLKTFALNSFLFTPFPIYSKIREELATQLAQASKVASSRSNRLLE

SEQ ID NO: 145028 - protein, 135 aa, Glycine max
  Coding DNA Sequence Number=SeqID_53343
MELPDSIPTVEQFNEMVAWPGTQPSLHKEDEGPTAQVPQHMEDESSEATIPEPFDIGEEAEETQVRQVAATTPERSLEATSKPYAPVVNLPSPQSAADPSTPLLQMPKDPTTLVLAVDTSPPTTPVLQLTDEEDG

SEQ ID NO: 145029 - protein, 83 aa, Glycine max
  Coding DNA Sequence Number=SeqID_53344
MANLRADLAETWMLVWQFMKFQDMPKNQKDVDAQSQRGVYLVKMGVQIAPRPIWALQKIPPEGGCFWRKQPCSLGRAELAWAS

SEQ ID NO: 145030 - protein, 516 aa, Glycine max
  Coding DNA Sequence Number=SeqID_53345
  Gene Ontology: Mol. function=motor activity; Cellular component=cell projection
  Homolog annotation: Hit_ID=UPI000038446F; Match level="QueryCoverage =99%, HitCoverage=95%, E-value=5e-21, Identity=22%"; Hit description =COG3210: Large exoproteins involved in heme utilization or adhesion
PSEGCTALTFRALHVLTIIGFQALTFRGLHVLAIRGLHTLAFRGLHVLTIRGLHALTFKGQYVLTIRGLHALSLRIQHVLAIRGLHALTFRGLHVLAIRGLHALAFRGLQVLTIGGLQAVTFRGLHVLACRGLHVLAIRGQHPLTFRGQHVLAIRVLHDLTFRGLHVLAIRGLHALTFRGLHVLAIRGLHTLAFRGLQVLTIGGQQALTFRGLHVLAIRGLHTLAIRGLHVLAIRGQHALTFRGLHVLAIRGLHALTFRGLHVLAIRGLSALSFRGLHVLAIRGLHALSFRGLHVLAIEGLHALTFRGLHVLAIRGLHILACRGLHVLDCRGVDVLAIRRLHALTFRGLHVLVIRGLHVLACRGLHVLAIRELGLHALSFRGIHNLAIVGLRSLTFRGLHFLAIRGLPFLAVRGLHALTFRALHVLAIRGLQALTFKGLHVLAIRGLHTLAFRGLHVLAIRGLHTLTFKGQYVLTIRGLHALSFRGLDVLAITGLHALTFRGLHVLAIRGLHFLAV

SEQ ID NO: 145031 - protein, 248 aa, Glycine max
  Coding DNA Sequence Number=SeqID_53346
  Homolog annotation: Hit_ID=Q6UUU1; Match level="QueryCoverage=24%, HitCoverage=40%, E-value=3e-18, Identity=78%"; Hit description =Putative uncharacterized protein
  Subcellular localization annotation: CTP_CleavageSite=44; ConfidenceScore=5.27e-01
KVGTSYVPINVSFSPKVGPGLPAVPPVQLLTGWCVTAKAPPDISAGKCSGRVPFAIQAAQLLGRAIGAGLFAITPAGERGMCCKAIKLGNARVFPVTTLANWSSTAVAAALELVDPPGCRNSIIILGHHTQIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 145032 - protein, 138 aa, Glycine max
  Coding DNA Sequence Number=SeqID_53347
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=61%, HitCoverage=72%, E-value=3e-24, Identity=69%"; Hit description=LacZ protein
MFVIFEFVIIENDLSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 145033 - protein, 223 aa, Glycine max
  Coding DNA Sequence Number=SeqID_53348
  Subcellular localization annotation: CTP_CleavageSite=49; ConfidenceScore=5.15e-01
MVEPSKKRKGSSSRSQRHSETQNIPIPSSISSSSLFSSEEQRIRFECIQAFQNSNLIPFMSLKLPVYSELVKTFYSNLEIQESTLIPEVYGIKMVIDQSFFCDLTQLSSAGVPFEGTLDDDWKFDFSVHDARRLVCTNQADMTGRLLTGSLALESRILYYLIIRILLLRSSNLTQVSEKDLIVMWAFHTDRQIDWAHLVRYRMHKALRLNAPLPYPHLVTLFL

SEQ ID NO: 145034 - protein, 162 aa, Glycine max
  Coding DNA Sequence Number=SeqID_53349
AAGPMIRGDTLRLSAPFCHPEAAGPMTSRDQVWSFCTLVSSRGGGPDDTRRYLTVIRTLLSSRGGGPDDKQRPKTKFGHSAPLYHPEAAGPMIRGDTLRLFAPFCHPEAAGPMIRGDTLRLFAPFCHPEAASPMTSRDKVWSFCTLVSSRGGGPDDTRKYPS

SEQ ID NO: 145035 - protein, 155 aa, Glycine max
  Coding DNA Sequence Number=SeqID_53350
MTRGNPSDLQPFDLEIDRTFHRLVRHHFIPFDHSEHSITGESVHSVIGDFEHPDLEHYNFEHSDSEHFDFAYSENMAQPPPRERTLREMAAPDFTNESLCIQYPDEDVPYVLKTGLIHLLPKFHGLAGEDPHIFLKAFPHSLEGVAKDWLYYLAP

SEQ ID NO: 145036 - protein, 64 aa, Glycine max
  Coding DNA Sequence Number=SeqID_53351
MVSVASAANVSAQVNNISMLNGTNFKVEKEAIEIVLSYMNLDLTLRTKQPTSTLKASNEVKIEK

SEQ ID NO: 145037 - protein, 166 aa, Glycine max
  Coding DNA Sequence Number=SeqID_53352
MIMRGQDIYSSQDEATTSPSSSESEKAKGEESSEEIYPQEEGQPLVVKEKCKEGHLRFEISYCGKKNKREKKKERLKEISQDEKEKIREEERRKILKKLRKEKHAFYSSHNSCKSLSEELRDYYEGRHRSHLRPHSHRREKERNPQEANINLPYFHGKDNVEANLD

SEQ ID NO: 145038 - protein, 185 aa, Glycine max
  Coding DNA Sequence Number=SeqID_53353
  Gene Ontology: Mol. function=ATPase activity, coupled to transmembrane movement of substances; Cellular component=integral to membrane; Biological process=transport
  Homolog annotation: Hit_ID=Q5CDC4; Match level="QueryCoverage=22%, HitCoverage=32%, E-value=1e-15, Identity=100%"; Hit description =LacOPZ-alpha peptide from pUC9
MVKVGTSYVPINVSFSPKVGPGLPGINRDTRIYLFCEVIFRHSCPSCSATDGVGFPSHDVVKRRPVNCNTTHYRANWSSTAVAAALELVDPPGCRNSMAGTVTTTGRVRYLAQNAHVFATSISENVRIDQAYRYRRPRGGARYQLLFPLVRVNFELGVIMVIAVSCVKLLSAHNSTQHTSRKHKV

SEQ ID NO: 145039 - protein, 51 aa, Glycine max
  Coding DNA Sequence Number=SeqID_53354
MVKKRLSFELQKVAIGLSSTVGLSAYPPLSMASKRLVQRRIWQSINIKAAR

SEQ ID NO: 145040 - protein, 267 aa, Glycine max
  Coding DNA Sequence Number=SeqID_53355
  Homolog annotation: Hit_ID=Q6UUU1; Match level="QueryCoverage=22%, HitCoverage=40%, E-value=3e-18, Identity=78%"; Hit description =Putative uncharacterized protein
  Subcellular localization annotation: CTP_CleavageSite=42; ConfidenceScore=5.16e-01
WNSYVPINVSFSPKVGPGLPAVPPVQLLTGWCVTAKAPPDISAGKCSGRVPFAIQAAQLLGRAIGAGLFAITPAGERGMCCKAIKLGNARVFPEFDIPTRSCEESIFLSMGIKPGYNYSPMELRQLHQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 145041 - protein, 179 aa, Glycine max
  Coding DNA Sequence Number=SeqID_53356
MTIRGLGLNGPDDIYSPHGERPRGGHDIQRMRWGIDIIRECLTFVALPHMDTTITFHGKPVITCSSSIFRWYSIPGSSGSKRALRVASSIMDCVLASTAWEHLFLYAQVSAHEETGCRKLVLSCRNASRVFFAGISAQCSGRNLTMRLELITSRSDFHSGNNPEFCHDTEDPQCTGLVP

SEQ ID NO: 145042 - protein, 39 aa, Glycine max
  Coding DNA Sequence Number=SeqID_53357
MERSMIDAASGGALIDMIPAEAKNLIEKMTSNSQQFSAI

SEQ ID NO: 145043 - protein, 145 aa, Glycine max
  Coding DNA Sequence Number=SeqID_53358
  Homolog annotation: Hit_ID=Q2HW90; Match level="QueryCoverage=52%, HitCoverage=15%, E-value=3e-09, Identity=42%"; Hit description =Putative uncharacterized protein
MGPLQRQAFRKVYGKILDLTAAEVFTEAVVSLAQYYDQPLRCFTFGDFQMVPTIEEFEEILGCPLGGRKPYLFSGFLPSLSKIVAVIGDSAKELDRTKQTQNDVVGQLGYPMRGCINYNPALAIRQLGNPMRGAPTEESLSRLSL

SEQ ID NO: 145044 - protein, 110 aa, Glycine max
  Coding DNA Sequence Number=SeqID_53359
MAEEECKEVNVSSKRLAKKESHFAIKRNIKETSLLRQPPHFLLCKKTLVSTATPLGLEVIPLVKELLDEGLVHKSLNPCALLVPKIGIIRHQIPKIGDMMNVLSGATLFL

SEQ ID NO: 145045 - protein, 82 aa, Glycine max
  Coding DNA Sequence Number=SeqID_53360
MGEVEEVQEQMKANMEAMKEKTATMMEAMMSMKKIMEANAVTIAATSTVAERNPMPPSGLNQMNHPTFSYGRQRFGKYGQPP

SEQ ID NO: 145046 - protein, 254 aa, Glycine max
  Coding DNA Sequence Number=SeqID_53361
  Gene Ontology: Mol. function=protein serine/threonine kinase activity; Cellular component=cell surface; Biological process =protein amino acid phosphorylation
  Homolog annotation: Hit_ID=A7QXX4; Match level="QueryCoverage=58%, HitCoverage=21%, E-value=5e-45, Identity=59%"; Hit description =Chromosome undetermined scaffold_234, whole genome shotgun sequence
MGYMAPECATSGRASKESDVYSFGVVALEIACGRKPINHRAQENEINIVEWVWGLYGEGRILEAADQRLEGEFEEEQIKCLMIVGLWCAHPDHNNRPSMRQAIQVLNFEAPLPNLPSSLPVPTYLEGPLHSFIAPFSITSSEEGQSQITGSSSNTNSTGFTTKSDDASPSVSLLYSRDSWVVELLPYFESLDNGVFYVCILQLIFLKDSIFRINFLHLFDFVKSLKEENKDNVINKLEPPQSTHYVNLSWSQQQ

SEQ ID NO: 145047 - protein, 63 aa, Glycine max
  Coding DNA Sequence Number=SeqID_53362
MGGLLAKVDIRNALSFHKNDSVVDPPLRLASLILSSLQKVAQGDPAPVYTTTPNIHAYAYAYA

SEQ ID NO: 145048 - protein, 211 aa, Glycine max
  Coding DNA Sequence Number=SeqID_53363
  Homolog annotation: Hit_ID=Q6WAY6; Match level="QueryCoverage=87%, HitCoverage=31%, E-value=9e-25, Identity=38%"; Hit description =Putative uncharacterized protein
ELDHRKQVKNGVVGIPRKCLKEKARNLAGKGEWVPFIDILALLIFGGVLFPNVDGLVDLAAINTFLAYHDHKESPIVAMLADLYDTFDRRCEKSSTRIVCCTPALYVRHACPLESHRSCTEKGGASWDQLLANKEGASVKWFPRWKKGRTGVLILCGGFPNVPLMGTRGCISYNPILAIRQLGCPMRGALLEEELAPIISRGFNKTNKETL

SEQ ID NO: 145049 - protein, 271 aa, Glycine max
  Coding DNA Sequence Number=SeqID_53364
  Gene Ontology: Mol. function=hydrogen ion transporting ATP synthase activity, rotational mechanism; Cellular component=proton -transporting ATP synthase complex, catalytic core F(1); Biological process=plasma membrane ...
  Gene Ontology: Biological process=ATP synthesis coupled proton transport
  Homolog annotation: Hit_ID=Q7HDI4; Match level="QueryCoverage=100%, HitCoverage=64%, E-value=1e-138, Identity=82%"; Hit description=ATP synthase subunit beta
  Pfam annotation: Domain name=ATP-synt_ab; Domain location=63-271; Score=280.7; E_value=3e-81; Accession=PF00006.16; Description=ATP synthase alphabeta family, nucleotide-binding domain
  Pfam annotation: Domain name=ATP-synt_ab_N; Domain location=1-56; Score=44.4; E_value=4.1e-10; Accession=PF02874.14; Description=ATP synthase alphabeta family, beta-barrel domain
  Pfam module annotation: Pfam domain module=ATP-synt_ab::ATP-synt_ab _N; Domain location=63-271::1-56
MPNIYNALIVKGRDTVGQQINVTCEVQQLLGNNRIRAVAMSATEGLMRGMEVIDTGAALSVPVGIKVVDLLAPYRRGGKIGLFGGAGVGKTVLIMELINNIAKAHGGVSVFGGVGERTREGNDLYMEMKESGVINEQNIAESKVALVYGQMNEPPGARMRVGLTALTMAEYFRDVNEQDVLLFIDNIFRFVQAGSEVSALLGRMPSAVGYQPTLSTEMGSLQERITSTKEGSITSIQAVYVPADDLTDPAPATTFAHLDATTVLSRGLAAK

SEQ ID NO: 145050 - protein, 259 aa, Glycine max
  Coding DNA Sequence Number=SeqID_53365
  Gene Ontology: Mol. function=DNA-directed DNA polymerase activity; Cellular component=mitochondrion; Biological process=nucleobase, nucleoside, nucleotide and nucleic acid metabolic process
  Homolog annotation: Hit_ID=Q39432; Match level="QueryCoverage=93%, HitCoverage=34%, E-value=2e-60, Identity=44%"; Hit description=DNA polymerase
ELLEEALSECIKPSSGEIDISNLPVKSLSSTSRKYPKNITVPRKSGNISLRPFLVADTETIINKNSQHVPYAVGVMVVNPGIPVSRRERIDTYFSEDYSSRIFPTFEERSCQMLKSFIFRVAAITRQNRSAKTIYFHNLGRFDGIFLLKHLALYHPNYTVTPLMRDNRLYEVAVYSKKRLLFTFRDSLHLLPGKLDDLAKNLCPELGSKGSISYEDVRLESLSIMKESLLEYMEQDILLLGGIMQSFQDIYYKAYQADI

SEQ ID NO: 145051 - protein, 118 aa, Glycine max
  Coding DNA Sequence Number=SeqID_53366
  Subcellular localization annotation: CTP_CleavageSite=28; ConfidenceScore=5.00e-01
MPISPCGRITPTKTPSGPREVQQGLGVSSSSYGPLLVLQGARSPQQGIAPARHPVDPKKSNRVLELPALITGLCQFYGVPVAPSKAQGETPQQSGDGRQRATDALPPPLEFTSAHPEK

SEQ ID NO: 145052 - protein, 200 aa, Glycine max
  Coding DNA Sequence Number=SeqID_53367
  Gene Ontology: Mol. function=transmembrane receptor activity; Cellular component=intrinsic to membrane; Biological process=innate immune response
  Homolog annotation: Hit_ID=Q5JBT4; Match level="QueryCoverage=88%, HitCoverage=17%, E-value=9e-37, Identity=45%"; Hit description =Candidate disease-resistance protein SR1
EIRGVPPFLTYFTARECISLSSSSSRMLSNQELHEAGQTKFWFPGATIPEWFNNQSRGHSSSFWFRNEFPVNVLCLLLARVERIDVDDIFMPAVFINGKLHKNPSRGTKVRKVKLDYTYLFDLKSALELNDISEVALEKERNQVEITYAGLIETSLVKATGTHVFRQDDIRYDDPYYGKRKLEHDLNSCESRVGNKTFYV

SEQ ID NO: 145053 - protein, 60 aa, Glycine max
  Coding DNA Sequence Number=SeqID_53368
VMATIALSSRYGSKLAYDTGIWGFVVDLGMAFVDNWVVGKEKVCYWLSNDIVGLVGNLAV

SEQ ID NO: 145054 - protein, 126 aa, Glycine max
  Coding DNA Sequence Number=SeqID_53369
LSEELRDYYKGRHRSHLRPHSHRREKERKPQEANINLTYFHGKDNVEANLDWEIKVTPFKPKDDKGKTIEKQDPKASMQEKTSSIKTLASIATPLGLEFIPQVKKLLDEGLVRTSLNPCALLVPKI

SEQ ID NO: 145055 - protein, 194 aa, Glycine max
  Coding DNA Sequence Number=SeqID_53370
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=26%, HitCoverage=50%, E-value=8e-24, Identity=100%"; Hit description=LacZ protein
MKHFTDTLISANIGTKAGTGPPLEVDGIDKLDGRGRGPGPRRAGRRAPRPGPGRGAAGASRAARAASGTGSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 145056 - protein, 223 aa, Glycine max
  Coding DNA Sequence Number=SeqID_53371
  Homolog annotation: Hit_ID=Q6WAY6; Match level="QueryCoverage=84%, HitCoverage=31%, E-value=8e-19, Identity=33%"; Hit description =Putative uncharacterized protein
KESPVIAVLADAYDTFDQRCEKSGARIVCCTPALYVWLVSHLFHHESRPVCPLQGHCMCTKKREANWEQLLVGMHGASINWFPRWKEGGARVLSSCEGFSNVPLMGTRGCINYKPVLAIRQLGYPMRGASSEESVTPFITRGFSDPNARTFQKVRKAWGAVQRKDKELRGSNNGIIGGYHKWLKARTQEISWLPKLKISSEEEAETPEESEEVQALKAELERA

SEQ ID NO: 145057 - protein, 161 aa, Glycine max
  Coding DNA Sequence Number=SeqID_53372
  Homolog annotation: Hit_ID=A0PAV3; Match level="QueryCoverage=23%, HitCoverage=17%, E-value=6e-07, Identity=76%"; Hit description =Restriction endonuclease
MVKVGTSYVPINVSFSPKVGPGLPGINRDTRIYLFCEVIFRHSCPSCSATDGVGFPSHDVVKRRPVNCNTTHYRANWSSTAVAAALELVDPPGCRNSMQGQILPGVSSMKQYPSSGPGGRNQVPNRAAMGEHAEGACSSSLSIPSTSRGGPVPAFVPFSEG

SEQ ID NO: 145058 - protein, 146 aa, Glycine max
  Coding DNA Sequence Number=SeqID_53373
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=35%, HitCoverage=50%, E-value=4e-24, Identity=100%"; Hit description=LacZ protein
MRRHLMVIYIFIIQRRQVRSHASNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 145059 - protein, 164 aa, Glycine max
  Coding DNA Sequence Number=SeqID_53374
  Homolog annotation: Hit_ID=Q6UUU1; Match level="QueryCoverage=43%, HitCoverage=46%, E-value=3e-18, Identity=70%"; Hit description =Putative uncharacterized protein
MKSLRGKEIALVKVQWGNYEGDSTWELEDRMRELYPRGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERNGLRTGRRFPGRCQEDT

SEQ ID NO: 145060 - protein, 169 aa, Glycine max
  Coding DNA Sequence Number=SeqID_53375
MALPHLYSPIHLWPIRGRVMMLDLEIPAHLLHHFVVQIGAIVSNDLPRESVSTNQFPLYESDHHTSRDIGIRGRFDPFGEVIYCHQNEAVTIRSFGFDGPNDIYPPHGKRPRGGHNIPRMWRNIDIVRVCLTFMTFPYMGASIAFHSEPVITCSKDLPGHSMPIGMCPK

SEQ ID NO: 145061 - protein, 162 aa, Glycine max
  Coding DNA Sequence Number=SeqID_53376
  Homolog annotation: Hit_ID=Q6UUU1; Match level="QueryCoverage=37%, HitCoverage=40%, E-value=1e-18, Identity=78%"; Hit description =Putative uncharacterized protein
  Subcellular localization annotation: CTP_CleavageSite=54; ConfidenceScore=5.43e-01
AVHVSSTFKEFGAMLHDCLSVDPQVQSSILHFFRRSSLSIPSTSRGGPVPAFVPFSEVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTGK

SEQ ID NO: 145062 - protein, 100 aa, Glycine max
  Coding DNA Sequence Number=SeqID_53377
MREPFGPALLNFLLLSLRLNDASSIGACRPRIFFINGFLCFLEDEWQRNGERERERRRHFKEKMSLEEAHHHRRPWIRAWRKNEMNEGRGREEHEILCSK

SEQ ID NO: 145063 - protein, 115 aa, Glycine max
  Coding DNA Sequence Number=SeqID_53378
MWLKGVKTLWFCLEIAMNALSAPAAFSMFITTVKILDFQMNALSGPCRAKRMASKKRKAPSTPTQARYDRSRFTSQEAWERYTDIVVPRKLLPERNVVVYYTEFDEFKEELERRH

SEQ ID NO: 145064 - protein, 110 aa, Glycine max
  Coding DNA Sequence Number=SeqID_53379
MATIALLSRYGSKLANDTIIGAGFVVDLGVAFVDDLVFLADRVMGVSRFGNNPCLHPVPKQPPILEISNNLVKSFTSKDPQGIITTQVDVRSTCTTEDVPSNVLRQRILR

SEQ ID NO: 145065 - protein, 159 aa, Glycine max
  Coding DNA Sequence Number=SeqID_53380
MEAMKEQMTTLMEAMMSIRRMMEVNAATVVATSITIEVDPTHPPSFNQNKHSFPPYGLPPNVAQTPDENVDNSAPIPIESQQPQYDHAHISLPLGDTHEAPRDHNLANFEPRLEYAAEGQTFCDVPMPNTLGGPQYRPQHNPSILWWKSSLADMAELCL

SEQ ID NO: 145066 - protein, 136 aa, Glycine max
  Coding DNA Sequence Number=SeqID_53381
MGEVEEAQEQMKADMEAMKEQMATMMEAMMSMKKIMEAKAVTVAATSAVAKVNPMPSSGLNQMNHPTSDMVGKDLGSIGGPHYAQIQIKHAFTPYGLPPNYTPPNVAASSCRYTPAKHIGGPAVSPTITPLAFHNG

SEQ ID NO: 145067 - protein, 156 aa, Glycine max
  Coding DNA Sequence Number=SeqID_53382
  Homolog annotation: Hit_ID=UPI00016621D1; Match level="QueryCoverage =81%, HitCoverage=41%, E-value=6e-10, Identity=33%"; Hit description =UPI00016621D1 related cluster
MTKDNPKPYTRAMKGIVHEPQGGPLGTSTLVFRGLLALAFRGLHALAFVGLHALTFRGLHVLAFRGSCTFTFRGLHVLTSRGLHVLTFRGLHVLAIRGLHVLAFRGLHILTFRGLRALTFRGLHVLAIKGLYILTFKGLHILAVRGLQVLTIRGLH

SEQ ID NO: 145068 - protein, 273 aa, Glycine max
  Coding DNA Sequence Number=SeqID_53383
  Gene Ontology: Biological process=transposition, DNA-mediated
  Homolog annotation: Hit_ID=Q6UUU1; Match level="QueryCoverage=21%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPEFDPVNNHRYVGDCIDYMIGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 145069 - protein, 109 aa, Glycine max
  Coding DNA Sequence Number=SeqID_53384
  Gene Ontology: Mol. function=tetracycline:hydrogen antiporter activity; Cellular component=integral to membrane; Biological process=response to antibiotic
  Homolog annotation: Hit_ID=O21999; Match level="QueryCoverage=61%, HitCoverage=44%, E-value=4e-23, Identity=76%"; Hit description=LacZ -alpha
MTFMGLQKRGRMEDCLEVDVVLQRRDWENPGVTQLNRLASHPPFASWRNSEEARTDRPSQQLRSLNGEWDAPCSGALSAAGVVVTRSVTATLASADVRRCFCRYAPPRQ

SEQ ID NO: 145070 - protein, 289 aa, Glycine max
  Coding DNA Sequence Number=SeqID_53385
  Gene Ontology: Mol. function=catalytic activity; Biological process =cellular metabolic process
  Homolog annotation: Hit_ID=Q20ZC6; Match level="QueryCoverage=98%, HitCoverage=98%, E-value=1e-100, Identity=63%"; Hit description=NAD -dependent epimerase/dehydratase
  Pfam annotation: Domain name=3Beta_HSD; Domain location=4-240; Score=- 126.6; E_value=0.02; Accession=PF01073.10; Description=3-beta hydroxysteroid dehydrogenaseisomerase family
  Pfam annotation: Domain name=ADH_zinc_N; Domain location=1-141; Score= -21.6; E_value=0.049; Accession=PF00107.17; Description=Zinc-binding dehydrogenase
  Pfam annotation: Domain name=DapB_N; Domain location=1-102; Score= -29.8; E_value=0.013; Accession=PF01113.11; Description =Dihydrodipicolinate reductase, N-terminus
  Pfam annotation: Domain name=Epimerase; Domain location=3-215; Score =21.0; E_value=1e-08; Accession=PF01370.12; Description=NAD dependent epimerasedehydratase family
  Pfam annotation: Domain name=NAD_binding_2; Domain location=1-182; Score=-89.4; E_value=0.085; Accession=PF03446.6; Description=NAD binding domain of 6-phosphogluconate dehydrogenase
  Pfam annotation: Domain name=NAD_binding_4; Domain location=5-196; Score=-78.9; E_value=0.0011; Accession=PF07993.3; Description=Male sterility protein
  Pfam annotation: Domain name=NmrA; Domain location=3-237; Score= -79.9; E_value=0.0011; Accession=PF05368.4; Description=NmrA-like family
  Pfam annotation: Domain name=RmlD_sub_bind; Domain location=1-285; Score=-165.1; E_value=0.0042; Accession=PF04321.8; Description=RmlD substrate binding domain
  Pfam annotation: Domain name=TrkA_N; Domain location=3-107; Score= -0.6; E_value=0.0089; Accession=PF02254.9; Description=TrkA-N domain
  Pfam annotation: Domain name=adh_short; Domain location=3-121; Score=- 58.9; E_value=0.093; Accession=PF00106.16; Description=short chain dehydrogenase
  Pfam module annotation: Pfam domain module=3Beta_HSD::ADH_zinc _N::DapB_N::Epimerase::NAD_binding_2::NAD_binding_4::NmrA::RmlD_sub _bind::TrkA_N::adh_short; Domain location=4-240::1-141::1-102::3 -215::1-182::5-196::3-237::1-285::3-107::3-121
MQIFVTGATGWVGSAVVEELIAAGHQVTGLARSAEKAVALAVTGAQVIRGSLEDADVLRDAAQSADAIIHTAFNHDFSRFVQNCEQDRQVIELLGEAIAGSDRMLLVTSGLSGMARGATELDQPQPVSPRQSEAAAQALSQRGVHVATVRLAPSVHGLGDHGFVPILVRLARESGISAWCGSGENCWSGVHRRDAARVYRLALEQGVTERVYHAVADEAVPFRAIAETIGRQLGLPSGERDRAHFGWFANMAAGNMAVSSQRTRTLLDWSATRPDLLSELDTPAYYTHL

SEQ ID NO: 145071 - protein, 78 aa, Glycine max
  Coding DNA Sequence Number=SeqID_53386
MRDGKRSSYVIGIRVNSGIGLGGKFLIALEPMPKWALPTERVVVGAGAWGASLWMGAGALGCTGAELEEFPARAKKLG

SEQ ID NO: 145072 - protein, 267 aa, Glycine max
  Coding DNA Sequence Number=SeqID_53387
  Gene Ontology: Biological process=transposition, DNA-mediated
  Homolog annotation: Hit_ID=Q6UUU1; Match level="QueryCoverage=22%, HitCoverage=40%, E-value=3e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPVTTFPSLSATDSEIRVKVINWMRDEIQIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 145073 - protein, 95 aa, Glycine max
  Coding DNA Sequence Number=SeqID_53388
RYLRHLVRQQAANHRAHVQIHDCLYQLSLSLQSQGFAPFPCPTPDQFRAEVAWPGDWPEAQAREAPTEAPSDANEALMDEEMTDLLNFLGGTGAT

SEQ ID NO: 145074 - protein, 239 aa, Glycine max
  Coding DNA Sequence Number=SeqID_53389
  Gene Ontology: Biological process=transposition, DNA-mediated
  Homolog annotation: Hit_ID=Q6UUU1; Match level="QueryCoverage=25%, HitCoverage=40%, E-value=3e-18, Identity=78%"; Hit description =Putative uncharacterized protein
WNSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 145075 - protein, 122 aa, Glycine max
  Coding DNA Sequence Number=SeqID_53390
MADALATLASMFQLAPYGDLPYMCELGISWVGQRVGSHDEEESMGNKDCQAINMWNKKFTDMGKGKCLHIEPLSGIREQCNVPPHPLNDMPPLGPVSMWGMRSGAIETQRRRMVTASFLMAI

SEQ ID NO: 145076 - protein, 58 aa, Glycine max
  Coding DNA Sequence Number=SeqID_53391
MSQHISVTVVDSSSKCDVPHFRIPFRNNGRYFRSLADHGGSQRDKGIADLVDKFYRSS

SEQ ID NO: 145077 - protein, 203 aa, Glycine max
  Coding DNA Sequence Number=SeqID_53392
  Homolog annotation: Hit_ID=UPI00006A2939; Match level="QueryCoverage =69%, HitCoverage=81%, E-value=1e-08, Identity=29%"; Hit description =UPI00006A2939 related cluster
MSKSFGFGMTDPLDESISCFLIRVNPWRTTHPRLQRTARPHLERTKRPRLERTTCPHHQRAAHPHLQRTTLTLTFRGLHVLTFVGLHALTFRGPHVLTFRGLHALAIRGLHVLTFVGLHALTFRGLHGLANRGLHAFTFRGLHVLANRGLHALTLRGLHALTSRGLYILALRGLHALTFRGLRVLIFSVLHIRTLREFKVLYP

SEQ ID NO: 145078 - protein, 259 aa, Glycine max
  Coding DNA Sequence Number=SeqID_53393
  Pfam annotation: Domain name=Transposase_23; Domain location=51-121; Score=-9.0; E_value=0.011; Accession=PF03017.5; Description =TNP1ENSPM transposase
  Subcellular localization annotation: CTP_CleavageSite=34; ConfidenceScore=5.47e-01
MASFSQMQSQFQSQMQSQGLALPLKPQVGPSGPRVSTKESCVDPSRNDPKTGDSDRCGLYIEANPAHLVALRRVYEGSTVVHNTPLLPSQVNVGVEEVKDPNAPVLVPTDEVSLVGQAIHTFLAWPTHLVKPLSQQAIVSPAKPPQTLDPEVDDPLYLMTLTILELFLRPYQVTWDAAVFEVFNPDFLIYTKYEDLSEIAYSGQCLIISVLQLWILHLTKTSMRAGNSDLYGFLEPQSIQRYGKSQFEVERYIKNWMQN

SEQ ID NO: 145079 - protein, 82 aa, Glycine max
  Coding DNA Sequence Number=SeqID_53394
MRIVETGNAKLIENDEISGSTVPREVEIKEVRVQVPLACACSSKQSYHDNSPRCFDDAKAQRVVSRLKNEVFKIPLKDSRIK

SEQ ID NO: 145080 - protein, 80 aa, Glycine max
  Coding DNA Sequence Number=SeqID_53395
MVKVGTSYVPINVSMLNHAKSPRRGSADALNRALQQDLFILEAPASQLFPPVQLLRGGAAHNSHTSIPSRNISAGKCSGC

SEQ ID NO: 145081 - protein, 275 aa, Glycine max
  Coding DNA Sequence Number=SeqID_53396
VAEYRQTIDRLLAGLNRDNLAQAATIAALAETIRGFGHVKAANVEKYRTELARLSTNPKLKARCARAMYPGGATHARAGNHSPGARRRRAQCIYLPRGGRTTSCGRQRADGAGADARIRRAAMALATPLFKPSFKAMRLRCLLSTGPPIFARKTDPACRARRAMGQLQHHAAQARCGFDPFKIAIAALVDPFGSTGQGRAPGGRAQQCCSWLNNDDPGRQRAGAQPPRWRHLPYRRHPGPGRTGPDALGPARRRPRLRALPREAHPGTRRRRGRL

SEQ ID NO: 145082 - protein, 140 aa, Glycine max
  Coding DNA Sequence Number=SeqID_53397
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=37%, HitCoverage=50%, E-value=4e-24, Identity=100%"; Hit description=LacZ protein
MSVSCLHSIDLCYCGRSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 145083 - protein, 41 aa, Glycine max
  Coding DNA Sequence Number=SeqID_53398
MMHGSKLFGGGCMNENAIHGAPEKKARMEDYTKQSLRMAPN

SEQ ID NO: 145084 - protein, 62 aa, Glycine max
  Coding DNA Sequence Number=SeqID_53399
MIMMGQDIYSSQDEDTTSPSSSESEEAKGEESSEEIYPLEEGQPLVVKEKCKEVLFGTKSLK

SEQ ID NO: 145085 - protein, 60 aa, Glycine max
  Coding DNA Sequence Number=SeqID_53400
  Subcellular localization annotation: CTP_CleavageSite=35; ConfidenceScore=5.25e-01
MVRARSPLKVRTCSPLKVRACNPLKARTCSPLKVRACNPLNGRNSKAFSDNSQGGHISLD

SEQ ID NO: 145086 - protein, 132 aa, Glycine max
  Coding DNA Sequence Number=SeqID_53401
MTEEPLALAPSPSPTAAEEETTPDQTPQPSPSSASAPEETQPSALDLNEDQSQEEHDAKLDLELILKQCLFVEATFEADWLSEPHSLCEAANSLSGCKTLEEDRLESSTLSTQPARPTRMLSLLALSVLRLA

SEQ ID NO: 145087 - protein, 256 aa, Glycine max
  Coding DNA Sequence Number=SeqID_53402
MPRNCTDYLTMGVKYLEEIKKRWLLGNIKVLVQDPQCSMTQGDNDLGRNILPERKVERYHTELDDFKTELERRNFHKCLTNFVDGSIDLALVKEFYANLYSSEGSSPKQSRVRGHLVKIDADSLNTFLETPVVLAEGETLPAYSRYCRLPIDYREIEAALCIPRRGFILNSEGHPGKILRKDLTTLAQVWSVLSYYNLAPTSHTSDLIVDRARLIFGLVFRMDMNIGVLISGQMTSIALSNTSRLGFPTLITALCR

SEQ ID NO: 145088 - protein, 245 aa, Glycine max
  Coding DNA Sequence Number=SeqID_53403
GIRKGIIAGYHEWLKVRTRGLDWLSKLKIINEENFEAPEEDEEVRALKTELGKARLAKEKFKLVATDVQKECAELREENAATARALEQETKRARKEEHGRDKFRGAFWGINNELKLRREERDQSRAHSMVLKEELAACSRSKRSLSQRLCETETNMLAIVSKYQEELNLAMAHEHKVVDEYARVYAEKEARGRVIDSLHQEATMWMDRFAITLIGSQELPRLLAKAKAMADTYSALEDIHGLLSY

SEQ ID NO: 145089 - protein, 210 aa, Glycine max
  Coding DNA Sequence Number=SeqID_53404
  Homolog annotation: Hit_ID=Q6WAY4; Match level="QueryCoverage=88%, HitCoverage=33%, E-value=5e-22, Identity=35%"; Hit description =Putative uncharacterized protein
MGTNQTGKRFYQVKIQGLDVTSLKELGRLMGPLQMQAFRKVYGKILDLTIAEIFTEVVVSLTQYYDQPLRCFTFGDFQLVPTVEEFKEILGSPLGGRKPYLFSGFLPSLSKIAVMVRGSARELDRVKQTRNDVVGLPRKYLEGKARDMVNQEEWVPFVDVLALLIFGVVLLPNVDGLVDLAAIDAFLAYHHSKESPVVAILADLFDTFDR

SEQ ID NO: 145090 - protein, 269 aa, Glycine max
  Coding DNA Sequence Number=SeqID_53405
  Gene Ontology: Biological process=transposition, DNA-mediated
  Homolog annotation: Hit_ID=Q6UUU1; Match level="QueryCoverage=22%, HitCoverage=40%, E-value=3e-18, Identity=78%"; Hit description =Putative uncharacterized protein
YDGVFEVLQWLLFLSAVPPVQLLTGWCVTAKAPPDISAGKCSGRVPFAIQAAQLLGRAIGAGLFAITPAGERGMCCKAIKLGNARVFPGELELHRGGGRSRTSGSPGLQEFDGNVMERNAMEWNHQEWNGMEWNGMEWNGMEWNQPECNGMEIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 145091 - protein, 37 aa, Glycine max
  Coding DNA Sequence Number=SeqID_53406
MTRGGGGPDDTRRYLAVIRTLLSSRGGGPDDTRRYLT

SEQ ID NO: 145092 - protein, 46 aa, Glycine max
  Coding DNA Sequence Number=SeqID_53407
MEKNKQQCKRSGRQRRRGERRRHPLGNKPWKKELHHQDEPWIEAWR

SEQ ID NO: 145093 - protein, 168 aa, Glycine max
  Coding DNA Sequence Number=SeqID_53408
  Homolog annotation: Hit_ID=Q6WAY6; Match level="QueryCoverage=51%, HitCoverage=15%, E-value=1e-07, Identity=37%"; Hit description =Putative uncharacterized protein
MGMRGCISYNPVLAIRQLGYPMRGAPLGEELAPVISRGFNKTNMETLQKVHKAWEVVQKKDKELRGSNNGPIGGYRKWLKAHVQGLDWLSSLRTAKTEEVEAPEEDEEVQALRAELEQAQIVKERFKSAALKIRKENTELRDVNVATTKALERETKRACREEHGWNKF

SEQ ID NO: 145094 - protein, 175 aa, Glycine max
  Coding DNA Sequence Number=SeqID_53409
KVKSLGTTSLKGLGQLMGQLQQQAFHKAYGKIWDLAMAEVSTVAIASLTQYYDQPVEMLHLWGLPAITHARISKIVQISAQELDCGKQVENGAVGILRKCLEVKARILAGRGHWASFIDILTLLIFGGVLFPNVDGLVDLAAINAFLAYHNHKESPVVTMLADLYDTFDRRCEKS

SEQ ID NO: 145095 - protein, 155 aa, Glycine max
  Coding DNA Sequence Number=SeqID_53410
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=33%, HitCoverage=50%, E-value=4e-24, Identity=100%"; Hit description=LacZ protein
MKHFTDTLISANISCKILPQELPRQALGVKKSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 145096 - protein, 180 aa, Glycine max
  Coding DNA Sequence Number=SeqID_53411
MTSRDQVWSFSPLYYPEHGGPDAYAEIPYGYSAPSCHPEAAGPMTSRDFFKSNKLSRTTGGGPDDTRRYLTVIRTLLSSRGGGPDDKQRPKAAGPMIRGDTLRLSAPFCHPEAAGPMTSRDQVWSFCTLVSSRGGGPDDTRRYLTVIRTLLSSRGGGPDDKQRPSLVILHPCIIQRRRAR

SEQ ID NO: 145097 - protein, 178 aa, Glycine max
  Coding DNA Sequence Number=SeqID_53412
MTRGNPSDLQPFDPEIDRTFHRLVRHHFIPFDHPEHSITGESVHSVIGDFEHPDFEHYNFEHSDSEHSDFEHSENMAQPPPHERTLREMAAPDFTYESLCIQYPDEDVPYVLKTGLIHLLPKFHGLAKFEGISYCLLHHETLRCPRGSYIFEGFSSFFRGSGKGLLVLPCSTVHHELG

SEQ ID NO: 145098 - protein, 36 aa, Glycine max
  Coding DNA Sequence Number=SeqID_53413
MMTMIVNTLPVFYYEKMVGYTPSSFADLVFAGHNPC

SEQ ID NO: 145099 - protein, 155 aa, Glycine max
  Coding DNA Sequence Number=SeqID_53414
  Homolog annotation: Hit_ID=Q5BBQ3; Match level="QueryCoverage=36%, HitCoverage=6%, E-value=2e-07, Identity=42%"; Hit description =Putative uncharacterized protein
MNVLGGATLFCKITRAPNIFKICAHRDSLGRNNQHENTEKGVPMNPKRIKVIPEWPAPPSVRKIWGFQDLTNFYKRFAPYFSILVAPLIELVSVATYPSAGGRRVTRGRRVPRKEYARSRHQRLFEENVGKTGKDAIYELLSERLGSCIYARGRY

SEQ ID NO: 145100 - protein, 71 aa, Glycine max
  Coding DNA Sequence Number=SeqID_53415
VPTCPLRASEGEARALSKGGKMRGVATNEGISTSYVDKSGAFAPTYPPLERKSNLRSSFLCVNQVIDFLLE

SEQ ID NO: 145101 - protein, 272 aa, Glycine max
  Coding DNA Sequence Number=SeqID_53416
TTFREDPTVNAGWEVFLPRQLHVAFSRSFIKRIPPEASSKDKELRGIRNGIIGGYHEWLKVRTRGLDWLSQLKIINEENFEAPEEDEEVRALKIELGKARLAKEKFKARKEEHGRDKFRGALWGTNSELKLRREERDQSRAHSMVLKEELAACSRSKRNLSQRLCEIETNMLAIVSKYQEEVNLATAYEHKVADEYAQVYSKKEARERVIDSLHQEATTWMDRFALTLNGSQELPRLLAKAEAMADTYSAPEEIHRLLNYFQHLIDLNGPYN

SEQ ID NO: 145102 - protein, 80 aa, Glycine max
  Coding DNA Sequence Number=SeqID_53417
MASAMYIRAQHLRCKQDSSNPSFALVDPYRSTKSKARPWYASAQLHRLDKTQGKHVTSPRLDKSKVHPFFLLSLVSIGTK

SEQ ID NO: 145103 - protein, 252 aa, Glycine max
  Coding DNA Sequence Number=SeqID_53418
  Gene Ontology: Biological process=transposition, DNA-mediated
  Homolog annotation: Hit_ID=Q6UUU1; Match level="QueryCoverage=23%, HitCoverage=40%, E-value=3e-18, Identity=78%"; Hit description =Putative uncharacterized protein
DLPSQVLQWLLFLSAVPPVQLLTGWCVTAKAPPDISAGKCSGRVPFAIQAAQLLGRAIGAGLFAITPAGERGMCCKAIKLGNARVFPVTTLIWLCHTGCSAVVQSHLTATLDQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 145104 - protein, 137 aa, Glycine max
  Coding DNA Sequence Number=SeqID_53419
MHSWVRGQWIPFDADALNQFQGDPLVLEESQECEFSQRRNRANEFDEEAIGQLLCTPGQDFARTAAGRRVRIMRTSMTTLTQTWMTLLLNNVLPSDHNSDLPLPKCMPPTRHPLDPDKSNRALGFSALIMGLCQSFR

SEQ ID NO: 145105 - protein, 81 aa, Glycine max
  Coding DNA Sequence Number=SeqID_53420
MKEKKFNKVMNRMDRHGRSHDVQNIPFDIRKAQQNTKRGQESHHSKGFSYWWQGYGHIKPFCIILMPPHHGTQSSNSRKKI

SEQ ID NO: 145106 - protein, 164 aa, Glycine max
  Coding DNA Sequence Number=SeqID_53421
MCAIRLFVLQTAKKNVYTDNHSGISARQRGSNVSMTDLVSAEDDINLRVSTGLSAAIDEGRKRRLKKNVYTDNHSGISSCQHDSNVSMTDLVSAEDDVNLRVSTGAEDDTAKKNVYTDNHSGISAGQRDSNVSMTDLVSAKDDVNLRVSTGLSAAIDEGRRRRR

SEQ ID NO: 145107 - protein, 70 aa, Glycine max
  Coding DNA Sequence Number=SeqID_53422
MVSVKLRSRFREKTKSYEDSTSGGFNPFSVSLTLGTPSEQSEEKLEESQGTARDIVVVVGRHVSPLRGKR

SEQ ID NO: 145108 - protein, 67 aa, Glycine max
  Coding DNA Sequence Number=SeqID_53423
MQKNAHANACTSVITVDSLEDINCESPQASDSNSFSDDENCESNTNEAAIDTEGNNYSSDITLTDIN

SEQ ID NO: 145109 - protein, 167 aa, Glycine max
  Coding DNA Sequence Number=SeqID_53424
  Subcellular localization annotation: CTP_CleavageSite=76; ConfidenceScore=5.64e-01
MEPDTTDTAPNSPMARALVSTTPYSSAQRMFGSVTRRNICQPDAPSSTAASSSWLPWLSITGTSSRTTNGQVTKIVASTIPGQANITWMLCASSQPPAGPFTPQNSRYIRPATTGDTANGISNSVSSSWRPGKVKRVTSQASSVPNTRLTGTVISATSTVSQDSMQH

SEQ ID NO: 145110 - protein, 165 aa, Glycine max
  Coding DNA Sequence Number=SeqID_53425
MSHHSSSVNGKGTSHKDPLSRILDELSSLKLSKEKLERKEKEKEKERVKINQDEREQIREEERRKILKELRKEKHASYSSHNSCKSLSEELRDYYEGRHRSHLRPHSHMREKERKPQEANINLPYFHGKDNLEANLDWEIRVEQQLKRKSTSKFYGSHSYPKKDQ

SEQ ID NO: 145111 - protein, 201 aa, Glycine max
  Coding DNA Sequence Number=SeqID_53426
MEEGFSHGSVPIILGMPFMKTSRTKIDVYAGTLSMEFGDIVVHFNILDAMKHPSEDYSIFRAVIIDQIVDDYMFDFDFILHGRKHPFLSDLHACHSLCIESESEFESDPVSNFYAENESKFESGSDFLGVVPLDVDFLESECTNHVAGSTYTSDLLYEVQAKEPSFSPTLVPPTAQPPPTLKLKPLPATLKYAYWRTRKIP

SEQ ID NO: 145112 - protein, 130 aa, Glycine max
  Coding DNA Sequence Number=SeqID_53427
MAQKKSTPITPTTSRRSKVAIPSKKRKEISSSDSDDDVEPDVPDIKRAKTSGKKTSPTGTLRRILQIIPRLLDFLAENSHQGEEKACQLLDSLSTFPHPPKHHNKPERPEFRVSSHTKCLSKVVQILPCL

SEQ ID NO: 145113 - protein, 67 aa, Glycine max
  Coding DNA Sequence Number=SeqID_53428
MPKDRGTCLDFRDCPHQKGGDCRQRIKLNVLMMPKFHMRLKALFKTKKLKIFKMDDQDKSLVLERVY

SEQ ID NO: 145114 - protein, 131 aa, Glycine max
  Coding DNA Sequence Number=SeqID_53429
MGAKYLEVVKQKLHATKQWSPDEIRISLHATDSLSLDDKGAEFVYARLPPNLLLLNDKGKNAGPTGSRMSSGPPPLDDKSMTEIFCAEDDVNLYVSTGLLAAIDKGMTEIVDAEDDVNLRVSTGLLAAIDK

SEQ ID NO: 145115 - protein, 145 aa, Glycine max
  Coding DNA Sequence Number=SeqID_53430
MVVYKPSSFADLVFVGERIEMGLRRGKFEYPALMNGKPRENGENKKEGGTHPRRPPLNHPQNPSAAHPISNTTLNTNQNINYGRNFPEKKPVEFTPILLSYANLLPYLLNNAMVAIIPTKIPPFSRGYNSNATCAYHGGVSGHSI

SEQ ID NO: 145116 - protein, 229 aa, Glycine max
  Coding DNA Sequence Number=SeqID_53431
TTRPRLERTTRPHHQRAARPHLQRTISPRLERTTRPHHQRAARPHHQRTTRPRLERATRPHLGGLHALTIRGLHVLALRGLHALTLGLHVLTIRGLHALTSGGLHVLALRGLHALTLGLHVLTIRGLHALTSRGLHVLAQRAARPHLQRTISPRLERTTRPHHQRAARPHHQRTTRPRLERATRPHLGTTRPHHQRAARPHLQRTTCPRLERATRPHIGTSSLTVRGLH

SEQ ID NO: 145117 - protein, 150 aa, Glycine max
  Coding DNA Sequence Number=SeqID_53432
  Homolog annotation: Hit_ID=Q124B1; Match level="QueryCoverage=87%, HitCoverage=87%, E-value=1e-25, Identity=42%"; Hit description =Putative uncharacterized protein
MKSWTAMVNISRETFEQTERRLRQVITKARLRIYPGTYAFVEFPLDRFPSAVRADALALVRDDDVWSQLVPSDGTHDEQFGLFRFHFPPGADNSGFVGWLATHFKNRFGTGVFVTCGQNQSDGGIFDYWGVPKTLAAEVFNEVQRLVEGR

SEQ ID NO: 145118 - protein, 225 aa, Glycine max
  Coding DNA Sequence Number=SeqID_53433
  Gene Ontology: Mol. function=RNA-directed DNA polymerase activity; Biological process=regulation of transcription, DNA-dependent
  Homolog annotation: Hit_ID=Q8H6Q8; Match level="QueryCoverage=75%, HitCoverage=45%, E-value=2e-41, Identity=52%"; Hit description=CTV.20
MEYNIMNTLQHMTMVATAYQTSHECSEETIIDILVAGFSEQLKAQHFIGDPSMWKDRSAELLSNLKCRTLADFRWYRDTFLTRVYTREDRQQPFWKEKFLASLPRSLGDKVRDKIRSQSANGDIPYESLSYGQLISYVQKVALKICQDDKIQSQLAKEKAQTKKDLGYFCEQFGLPACPKQKKKQSSRKEIHENKPVNKKRFSRRRYSYKPSTSKEMENPKQKIK

SEQ ID NO: 145119 - protein, 107 aa, Glycine max
  Coding DNA Sequence Number=SeqID_53434
MATMMEAMMSLKKIMEANAVAVTATHAVAWVNPMPPSSLNQMNHPTSTRVGKDLGSTGGPIYAQIQNKHAFPPYGLPPNYTPPNVAYTPNENVNNCTPILVESRQTQ

SEQ ID NO: 145120 - protein, 74 aa, Glycine max
  Coding DNA Sequence Number=SeqID_53435
MGIAPTKTPSGPEEVQQGPGVSSSGIVPARHLVDPKKANSVLELPALNTGPYQFKGVPVAPSRVIRPPTNRVFV

SEQ ID NO: 145121 - protein, 271 aa, Glycine max
  Coding DNA Sequence Number=SeqID_53436
  Gene Ontology: Biological process=transposition, DNA-mediated
  Homolog annotation: Hit_ID=Q6UUU1; Match level="QueryCoverage=22%, HitCoverage=40%, E-value=4e-18, Identity=78%"; Hit description =Putative uncharacterized protein
MVKVGTSYVPINVSFRQKLAQGFPVLQWLLFLSAVPPVQLLTGWCVTAKAPPDISAGKCSGHAARRVPFAIQAAQLLGRAIGAGLFAITPAGERGMCCKAIKLGNARVFPVTTLANWSSTAVAAALELVDPPGCRNSILRPDKLDGLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 145122 - protein, 104 aa, Glycine max
  Coding DNA Sequence Number=SeqID_53437
MLEVVSNPWRFTVGNWLCDSDLVSPTGIERVLTEKDLLADSYSDLEASILDEKEFLLLKVISTFPELSCLICSMVGAGRGIDDCLSLFGDLELSLALLKNFLVS

SEQ ID NO: 145123 - protein, 113 aa, Glycine max
  Coding DNA Sequence Number=SeqID_53438
LETRMDSYEKIVSDLQESMQNSFEMMQKSIEGLMVSLATQHKGPKITTEDGNHSGTHEPIVSVVDRAQIPFPSFDELARLKQEDSLIEYLERFDTLLARIAIPEELALSFFLS

SEQ ID NO: 145124 - protein, 288 aa, Glycine max
  Coding DNA Sequence Number=SeqID_53439
  Gene Ontology: Biological process=transposition, DNA-mediated
  Homolog annotation: Hit_ID=Q6UUU1; Match level="QueryCoverage=20%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPVTTLANWSSTAVAAALELVDPPGCRNSMILHTINVTVTGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 145125 - protein, 151 aa, Glycine max
  Coding DNA Sequence Number=SeqID_53440
  Gene Ontology: Mol. function=tetracycline:hydrogen antiporter activity; Cellular component=integral to membrane; Biological process=response to antibiotic
  Homolog annotation: Hit_ID=Q8GEG0; Match level="QueryCoverage=73%, HitCoverage=96%, E-value=2e-24, Identity=56%"; Hit description =Putative uncharacterized protein
  Subcellular localization annotation: CTP_CleavageSite=25; ConfidenceScore=5.28e-01
MTMITPSSKLTLTKGNKSWYRAPPRESSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 145126 - protein, 210 aa, Glycine max
  Coding DNA Sequence Number=SeqID_53441
MAPKKLSTKRSRRDATGEGSSADPEFDSHHFRSAEHQQRFEAIRGWLFHRERRVQLREDEYTDFQEEIAHRRWTSLVTPMAKFDPEIVLEFYANAWPTEEGVRDMRSWVRGQWIPFDADALSQFLDDPLVLEEGMAPTRHPLDPEKSNRALGFPVLITGLCQFFGVPITPSKVIRPPITRAFIEKYCTARQAQGDAHNAADAPPPPRQAD

SEQ ID NO: 145127 - protein, 36 aa, Glycine max
  Coding DNA Sequence Number=SeqID_53442
MLAVSGNGVADSLDDGESASISKSRGTKLPVGDLCK

SEQ ID NO: 145128 - protein, 37 aa, Glycine max
  Coding DNA Sequence Number=SeqID_53443
MWKFFIVLHVVLHPFFVPSSFFNGFLFFPFDVLKPFI

SEQ ID NO: 145129 - protein, 68 aa, Glycine max
  Coding DNA Sequence Number=SeqID_53444
MEEKMITKDDDKGDDKKLKGQSKNEFKIFKRSRFQESRFKRSRFKTQDSRIKKKLNQDKYEKVFSKTE

SEQ ID NO: 145130 - protein, 138 aa, Glycine max
  Coding DNA Sequence Number=SeqID_53445
MEVDMEAMKEQMVAMMEAMMSVKKIMEANAVAIAATSAVAKVNPTFPSGINQMNHPTSDMVGKDLGSTGGPHDVQIQNEHAFPPYGLPLNYTHPMWCTLPIRMSISPLLYPLRANNPKLIMHMSLKPWGRHMKFPIII

SEQ ID NO: 145131 - protein, 136 aa, Glycine max
  Coding DNA Sequence Number=SeqID_53446
MNFFAYDDNTILYLHFTPPLNQQTCGRQILHSRLHAWTTKITQYILGAPQPLEIPSHARKYLKQCENHLTILRKNAPPLQWDVVTLDRGIKDKSIVRPWYKFLRENDFHHGDEVSFYYRPHERIWEIVIRREKKWQ

SEQ ID NO: 145132 - protein, 71 aa, Glycine max
  Coding DNA Sequence Number=SeqID_53447
AFSGGALVLTNMDGEELPSPDHLELPSGVGTKRGQQKPIKERMQVGMGSRPTDYCPFSALDKQRTSLQGSP

SEQ ID NO: 145133 - protein, 84 aa, Glycine max
  Coding DNA Sequence Number=SeqID_53448
MSGNHVRLRNCLESANARAIECGPLALLRQLALKGGCVHTGDYYVGTDNEGVPSHEVRSCGREKGCTGASVRICEYDIFRFLAH

SEQ ID NO: 145134 - protein, 396 aa, Glycine max
  Coding DNA Sequence Number=SeqID_53449
  Gene Ontology: Mol. function=motor activity; Cellular component=cell projection
  Homolog annotation: Hit_ID=UPI00016621D1; Match level="QueryCoverage =91%, HitCoverage=41%, E-value=2e-21, Identity=31%"; Hit description =UPI00016621D1 related cluster
MSSPSGTTSPHLRGLPDLVFRGLHVLTFGGLHVLAFRGLHTFAFRRLHVLTIRGLHVLTFKVLHAMTIRGLHALTFRGLHVLAIRGLHVFPIRGLHTLAIRGLHVLAILGLHTLTFRGLQIIAISGLHVLSIRGLHAFTFRGQHVLAFRGLHVLPFRELHVLAFRELHVLTFRGLHVLTFRGLNVLTLRELHSLIFLELDAIIFRELHTLAFRGLHVLNFRGLHGLTFRGLHIPTFRGLHVPTFRGLHVLLFRGLHVLAFRGLHALTFRGLHVLAFKGLHILPFRRLHVVAFRKPQALAFRGLHVLGLRGLHALAFRGLHVLPFRGLHVLPFRGLDVLSFRGLHVLTFRGLHLVPFRGLQVLSFRGLHVLTFRGLHPLTSEGYMPSPSEVCTSSFS

SEQ ID NO: 145135 - protein, 192 aa, Glycine max
  Coding DNA Sequence Number=SeqID_53450
MSEIEEVQEQMKADMEAMKDQMTSMMEAMLSMRQMMEDNAAAVAATSVATKANPTHPSGINQTNHPPIDMVGQGGEVLRSMGGPCMVQSKNSFPLYGLPPNYTPPNAMHVPSKNASHFVPILLEGQQPQLGHAPFAQPMGEAREKPRDHALGKFESYPTYAAKGPAFGGMPQPNAMGAPQHCSLQPLHFSVG

SEQ ID NO: 145136 - protein, 122 aa, Glycine max
  Coding DNA Sequence Number=SeqID_53451
MVVCSGSQPSLHREHEGPTAQVPQHLEDESSEATVPEPFIVGEEAGETQVRQVAAVTPERSLVATSEPLAPVVDLSSTQHVADLSTPILEIHEDLTTPVLTMDTSPPATPVLHLKDADGVQT

SEQ ID NO: 145137 - protein, 105 aa, Glycine max
  Coding DNA Sequence Number=SeqID_53452
  Homolog annotation: Hit_ID=A5AG41; Match level="QueryCoverage=77%, HitCoverage=6%, E-value=6e-07, Identity=42%"; Hit description =Putative uncharacterized protein
  Pfam annotation: Domain name=zf-CCHC; Domain location=28-45; Score =10.9; E_value=0.034; Accession=PF00098.14; Description=Zinc knuckle
  Subcellular localization annotation: CTP_CleavageSite=20; ConfidenceScore=5.25e-01
MSSSKGPRTKLGYDTTPKTSSQARTSNIKCFKYLGRSHIASQCPTKKTMIMRGQDIYSSQEETTSSPSFSGSEDQVRGEKSSEEVYPHEEGDLLMVRKLHGRSIL

SEQ ID NO: 145138 - protein, 158 aa, Glycine max
  Coding DNA Sequence Number=SeqID_53453
NPQETQRKDAHAKVEYLKTLYDQVKVQIAKKNESYAKQANKKRKEVGMMRIMKLAKYRLKTQVEKDEGPSGEGQSPRVEKDEGPNLSSFTGSGVYPDLSSFTGSGVYPDLSSFTRSGVYPDLSSSTGSLSSFTRSGVYPDLSSFTGSGVYPDLSSFTG

SEQ ID NO: 145139 - protein, 250 aa, Glycine max
  Coding DNA Sequence Number=SeqID_53454
  Gene Ontology: Mol. function=motor activity; Cellular component=cell projection
  Homolog annotation: Hit_ID=UPI00006A2D9E; Match level="QueryCoverage =93%, HitCoverage=96%, E-value=7e-18, Identity=17%"; Hit description =UPI00006A2D9E related cluster
DYTSSPSRTTRPRLRGLHVLAIRGLHALAFRGLHALACKGLHVLAIRGLHSLAIRGLHILTFSGLHVLTFQGLHVLAFRGLPALTFRGLPALAFRGLHVLAFRGLHALAFRGLHVLAFGGLHVHTFRGVHVLAFRWLHTLAFKGQHVLTFTLLHVLAFRGQYALLFRGLHALPIKGLHVLDFRGLHAFTFRGLHALAFRGLHILVFRGLHSITFKGLHVIAFRWLHALSFRELHALSFRELHALSYRGLH

SEQ ID NO: 145140 - protein, 174 aa, Glycine max
  Coding DNA Sequence Number=SeqID_53455
MASNSQHFSARNDAMVIRGVHEVATNSAASSETKKLEGKLDALVNLVTQQALNQKSVPVARVCGLCSSADHHTDLCPSMQQPGAIEQPEAYVANIYNRPPQPQQQNQPQQNNYNLSSNRYNPGWRNHPNLRWSSPQQQQQQPAPSFQNVAGPSRPYIPPTNPTTTTTAPETANS

SEQ ID NO: 145141 - protein, 20 aa, Glycine max
  Coding DNA Sequence Number=SeqID_53456
MSNSGDHCGLVKLNCDENCS

SEQ ID NO: 145142 - protein, 124 aa, Glycine max
  Coding DNA Sequence Number=SeqID_53457
MKDMSILYEDAPVPVPTDEVFLVGQTLHTFLAWPTHLVKSLSQQVAVSPAKPPPKPDPEVDDLLYLMTLTIPELFLRPYQVRWDATVFGVFNPDFPLYIKHEDLSEIAHGGQCLSISVLQLWIL

SEQ ID NO: 145143 - protein, 88 aa, Glycine max
  Coding DNA Sequence Number=SeqID_53458
MQEQQQQQQRQQATEAPSLPSLEESSKQIEVPQPVAALAPEPVKLHSTPEKEDEIQPPIPLPFPPRAIPNKKIEEVDKEILETFRKVE

SEQ ID NO: 145144 - protein, 36 aa, Glycine max
  Coding DNA Sequence Number=SeqID_53459
MPVTAETQFGNVRSASSGDASSFKPRPLILSWPTSA

SEQ ID NO: 145145 - protein, 157 aa, Glycine max
  Coding DNA Sequence Number=SeqID_53460
MIMRGQDIYSSQDEATTSPSSSESEEAKGGESSEEIYPQEEGQPLMVKEECKEVSVSSKRLAKKERHFEIKTNIKEISLLRQPPHFLLCKKTLVSIATSLRLEFIPQVKELLDEGLVHKRLNPCALLVPKIGVPMNPKRIKVIPEWPAPPSVLREKA

SEQ ID NO: 145146 - protein, 28 aa, Glycine max
  Coding DNA Sequence Number=SeqID_53461
ILGRFPTTSDKPNVHNTTCSNTNSNDGA

SEQ ID NO: 145147 - protein, 176 aa, Glycine max
  Coding DNA Sequence Number=SeqID_53462
MSALKEQMASMMEAMLGMRQFMEKNVATAAAVSSVAEADPTLLATAHHPPPNTLGRERNTLGHSNNPHLGYNRVVYPYGLPPNYTPPVMHDDAGHVSSPILEGEPPRQPDEVHEDHQEYAQEDVDSYPLIPVEGPAPNTLPQHNLTAQPIFLSTEGPPPTAEERRKLDLIKERLRA

SEQ ID NO: 145148 - protein, 72 aa, Glycine max
  Coding DNA Sequence Number=SeqID_53463
  Homolog annotation: Hit_ID=A7Q3C8; Match level="QueryCoverage=65%, HitCoverage=8%, E-value=2e-11, Identity=65%"; Hit description =Chromosome chr13 scaffold_48, whole genome shotgun sequence
MHKSLHLGRPSYLTKTLKPLLGNGIIRSNGLQWAFPRNLLAPEFFHSKIKASAVIFQVRLCWNSNMSFASAR

SEQ ID NO: 145149 - protein, 164 aa, Glycine max
  Coding DNA Sequence Number=SeqID_53464
MKEAYDEIQTPLVPQMPTTFSKVSIIQELDATAYEEAPAIAFNMSFECHKAKTLVPESSSQPTQTGEAVVGIKEHQSTLTGIEEKRLKFDSRVTTTNTFSNYFILGDLDEVGVGGQAGIHEGEGGGGFVVAVKAGLDLGGAGLGLGGVTMVHWQRGGWQRQEGG

SEQ ID NO: 145150 - protein, 239 aa, Glycine max
  Coding DNA Sequence Number=SeqID_53465
  Gene Ontology: Mol. function=protein binding
  Homolog annotation: Hit_ID=A7Q5S1; Match level="QueryCoverage=86%, HitCoverage=17%, E-value=7e-78, Identity=69%"; Hit description =Chromosome chr14 scaffold_54, whole genome shotgun sequence
MGCLQREGRLLQGEHNLLGEAFLVMSSSAGIQQQQDVLRWLLEPLSVQWTQLEWQDKYLSGPHGLVQLCSDVPVMWSIFHTVTFFERALKRSGLKKANWNSENSSTPNSIPLNPMASRISWMVTPLLKLLRCIHSLWSPSVSQALPGEVRAAMVMGDVERFSLLGEGNSKLPKGVTDGSKIDMNKEGYTEPNESDIRNWFKGIRDSGLLQDGRAMVPDAHGILSGSDLKVEVMEETIPG

SEQ ID NO: 145151 - protein, 443 aa, Glycine max
  Coding DNA Sequence Number=SeqID_53466
  Homolog annotation: Hit_ID=A5C9E2; Match level="QueryCoverage=76%, HitCoverage=60%, E-value=7e-51, Identity=34%"; Hit description =Putative uncharacterized protein
MTTISYKTIFETGVDVESPNQHPSCALFYLFHQVRSTRVWNPNMCPHCVVQDLTRLHSSDSVVLVARPQYGSWQNARLLANDGRFFKNGNRGSIRAVDNNIVLVNIPQKHSSKAKQLHRGTNDIVRYKETKWAAECAKALVKAELSNAKQTVKDLFSMIGESMYNAKAKMRDMAPLKKYVKSRNDDNQYSQEKLQAENEVKASRSSMFFFSRVAQKLTNERKPAIEAIDETKELEMILATTLSDIDMLKNEFKFVNKTGKRLLQRGEPTKEEIEAAKKDLASITKQGFKFMASMDVTRNQLKHLLREKSKSEAMSVAEEKAKSIVSNLTQTLGKLKSKTEAAKKEKDLIINGEVIETKEDIKKALLEIKVSEERFQGAMQELQAVKSSEALALEKLKILRENAMKDKISKVTKPSLLIIIYKFQYDYLRNHAGKANEIAEKVK

SEQ ID NO: 145152 - protein, 76 aa, Glycine max
  Coding DNA Sequence Number=SeqID_53467
MGAKYLEVVKQRLHAIKQWSPDEIRAIVSWGSGLDGGGCMNDNQFMGLRIRFDGGGCTNNARQSIRGAPDSMVEDA

SEQ ID NO: 145153 - protein, 74 aa, Glycine max
  Coding DNA Sequence Number=SeqID_53468
  Homolog annotation: Hit_ID=A2Q410; Match level="QueryCoverage=51%, HitCoverage=5%, E-value=5e-10, Identity=71%"; Hit description=Cation transporting ATPase, C-terminal
MEQEEYTKEKMNWSYIEFVDNQDVLDLIDKGANDVEADCNIHIHWKCATDIVLACCTGYVDVNDQLVGMDEEKV

SEQ ID NO: 145154 - protein, 60 aa, Glycine max
  Coding DNA Sequence Number=SeqID_53469
  Subcellular localization annotation: CTP_CleavageSite=13; ConfidenceScore=5.14e-01
MAESSKKRKGSSSTSTATDHRRPGTSGDPPAPVPPSFSSPRVILDPKYLDPEFFYEEAFG

SEQ ID NO: 145155 - protein, 53 aa, Glycine max
  Coding DNA Sequence Number=SeqID_53470
MTHTKKTGQMTSEAAKEIADTIMSRPILFLLLTTRFLGGAGLIGKLYRPWTSG

SEQ ID NO: 145156 - protein, 97 aa, Glycine max
  Coding DNA Sequence Number=SeqID_53471
MLDPTSDSLYPDDIDHSTAFSEVIAAHGGQCLSISIIQLWILALKGFNDSQGSKSKAATRWIVVKYFTDQIPLEPKRMKAICIQWARYYLKVKNQTL

SEQ ID NO: 145157 - protein, 147 aa, Glycine max
  Coding DNA Sequence Number=SeqID_53472
MNEEKKFVVKEVYAILPGEGQLGEGMFYKHLWKLPIPSKVKGLISRGTHNHLQTMGNLKKGKIIDDTTSFECISCNSRARCYEWYGDERVLPADYFNHFWQHRGNINGKKTILAWGAGLLWMLSSIEHGHGAKLTFMASIHLCMYGP

SEQ ID NO: 145158 - protein, 75 aa, Glycine max
  Coding DNA Sequence Number=SeqID_53473
MWFVQPLSINQLSLDFTTQEACGHKQLVLFFLISNLSSLIMLNEAAVAKGCLGRIPGGEMVGIIKKFINLDAGTD

SEQ ID NO: 145159 - protein, 330 aa, Glycine max
  Coding DNA Sequence Number=SeqID_53474
  Subcellular localization annotation: CTP_CleavageSite=56; ConfidenceScore=5.23e-01
MSSFPSSVERTVASSLLLLNTTPLSPSLSTPKFHSDYSGDALLERRSGSKRFREISVSYGSYKSSSSSLTEDDDDDDDDGDSSEKDIKSGSVSSSAVTRYDQMKLKVDSTFLCAFSSILILCLFRFVMCLCLEAQRKQTNMRDLKIHLTDSSNENHSVFFILIDSSLEFVSLRYVFVFIARKIRTKVAWTTSCSGDRKPNVGEAEKVLSPASVSGEASSCLSSSSSGISSERSLRYAKRCRGAIVSVAGINRETAAAAKRRGAGSPHLHRRGEAILKLLSCCGGSSEVKIRQMLGDSPDTSKALRMYNLCLSLFLTHTQIVACNINFYEI

SEQ ID NO: 145160 - protein, 111 aa, Glycine max
  Coding DNA Sequence Number=SeqID_53475
  Gene Ontology: Mol. function=transferase activity, transferring glycosyl groups; Biological process=metabolic process
  Homolog annotation: Hit_ID=Q8S3B9; Match level="QueryCoverage=97%, HitCoverage=29%, E-value=2e-34, Identity=59%"; Hit description =Putative glucosyltransferase
MGLVEGLGIPTGNSEPLFNRGFMSQCEWNSCLESITMGEPIAALPMHSDQPRNTVLTTQMLKNTVRRLMETNEGDEMRERAVRLKNAIHRSMDEDGVSRMEMDSFIAHITK

SEQ ID NO: 145161 - protein, 36 aa, Glycine max
  Coding DNA Sequence Number=SeqID_53476
MNQKEKFSKEEGVDNINEGYCGSLIGCLMYLTSTSF

SEQ ID NO: 145162 - protein, 200 aa, Glycine max
  Coding DNA Sequence Number=SeqID_53477
  Subcellular localization annotation: CTP_CleavageSite=36; ConfidenceScore=5.17e-01
MAFMGETSSQTVVNFTLGFIFPNGSIGHNDSGVSFQASTQVPIRVPNSCDFQTLKTRIHNTLKLTDKQILDEIYYRQPFTYADGILNLLQATMTPTHDALLYYNGRWNMSRQNEFVGYLFTGKNPKKFDIPTGCTMDELKDSIKQVAPSGIPPYVRERCEMSGLKTEEGGAKDEKNTEDSGGGFSHSPSCGHSVSVEVSV

SEQ ID NO: 145163 - protein, 23 aa, Glycine max
  Coding DNA Sequence Number=SeqID_53478
MRNVEGAGAGASKKPCLNYAVAS

SEQ ID NO: 145164 - protein, 76 aa, Glycine max
  Coding DNA Sequence Number=SeqID_53479
MTTPRLISALVSVRTLEKRESIKQGLWKQPTALCIKCKTDGATRGFPGTSGWKLTLTLLLLAFSHPKSVHWSINTS

SEQ ID NO: 145165 - protein, 248 aa, Glycine max
  Coding DNA Sequence Number=SeqID_53480
MDGDISILLSIPHGVRLLIDLPLKNSHLSIVVKADLAWPFEPVQPEPGGIIEPVSLMDHSYWVVHVKGNYGSNLQLLAIDERVEEDALLHLLHSTILPQQRLVQNNWSPLDHVGFEVHLLSLQRRQRLHVAPMDNVKAIGKRPFVPIQPGPGGIIESFRYWIVHTGLCTLNGNYGQNLQLLTINEHVEVDASLHLLHRTVLHRQRLEQNNQLPLDLIGFEVHLLSLQRRKRLRVASMDNVEAIGKRSL

SEQ ID NO: 145166 - protein, 628 aa, Glycine max
  Coding DNA Sequence Number=SeqID_53481
  Gene Ontology: Mol. function=calcium ion binding; Cellular component =cytoskeleton; Biological process=cytoskeleton organization and biogenesis
  Homolog annotation: Hit_ID=A7PWH1; Match level="QueryCoverage=86%, HitCoverage=60%, E-value=0.0, Identity=80%"; Hit description =Chromosome chr8 scaffold_34, whole genome shotgun sequence
  Pfam annotation: Domain name=Gelsolin; Domain location=136-216; Score= 49.3; E_value=1.4e-11; Accession=PF00626.13; Description=Gelsolin repeat
  Pfam annotation: Domain name=Gelsolin; Domain location=250-326; Score= 56.1; E_value=1.2e-13; Accession=PF00626.13; Description=Gelsolin repeat
  Pfam annotation: Domain name=Gelsolin; Domain location=389-472; Score= 45.9; E_value=1.4e-10; Accession=PF00626.13; Description=Gelsolin repeat
  Pfam annotation: Domain name=Gelsolin; Domain location=39-99; Score =8.9; E_value=0.056; Accession=PF00626.13; Description=Gelsolin repeat
  Pfam annotation: Domain name=Gelsolin; Domain location=519-609; Score= 18.5; E_value=0.0063; Accession=PF00626.13; Description=Gelsolin repeat
  Pfam module annotation: Pfam domain module=Gelsolin::Gelsolin::Gelsoli n::Gelsolin::Gelsolin; Domain location=136-216::250-326::389-472::39 -99::519-609
MGNKDQTLDHTVIEAPITCHELVLNLTCCRGTEIWRIENFQPVPLPKSEYGKFYMGDSYIILQDEAGTAAIKTVELDAAIGGRAVQHREIQGHESDKFLSYFKPCIIPLEGGVASGFKKPEEEKFETCLYVCRGKRVVRLRQVPFARSSLNHEDVFILDTQNKIYQFNGANSNIQERAKALEVIQFLKEKYHEGKCDVAIVDDGKLDTESDSGEFWVLFGGFAPIGKKVISEDDIIPETIPAQLYSIVDGEVKPVEGELSKSLLENNKCYLLDCGAEMFVWVGRVTQVEERKAACQAVEEFVASQNRPKSTRITRIIQGYETHSFKSNFDSWPSGSASTNAEEGRGKVAALLKQQGMGVKGMTKSTPVNEEIPPLLEGDGKIEVWRINGNAKTALPKEEIGKFYSGDCYIVLYTYHSGERKEDYFVCCWFGKDSVEEDQTTATRLANTMSTSLKGRPVQGRIFEGKEPPQFVAIFQPMVVLKGGLSSGYKKLMADKGASDETYTAESIALIRISGTSIHNNKSVQVDAVPSSLNSTECFVLQSGSTIFTWHGNQCSFEQQQLAAKVADFLRTSNECIRGFFMLAVEAVGDADPITIVEHLGTGRLAIPMLIVLIEWWGDTQCSPRDEL

SEQ ID NO: 145167 - protein, 139 aa, Glycine max
  Coding DNA Sequence Number=SeqID_53482
MDGWRNLDSISLSRKYMMKKKLWEELWLVCRGGLNVSYKKNQESNDSRRDDNTKFFHSINNWKRRSNGLKGVMKYGRLVEDPNIVKEEVKCFFEKKFKESDDLNLNLDGVAFNSIGREDNEIRVARFSKFEIKQAIHSV

SEQ ID NO: 145168 - protein, 125 aa, Glycine max
  Coding DNA Sequence Number=SeqID_53483
MVLSANAHQLGWILEGMVNEVESWPYIFPASEDFLSSNQRGKVEVKYFLRWFRERRQERTKIQRRVVSMILLALALEIKHNVLKKTTPKALWKKLENICVKVVNQSSLFEDGVVSTQYGDGRRSP

SEQ ID NO: 145169 - protein, 43 aa, Glycine max
  Coding DNA Sequence Number=SeqID_53484
  Gene Ontology: Mol. function=carbohydrate binding
  Homolog annotation: Hit_ID=A7NUJ3; Match level="QueryCoverage=88%, HitCoverage=5%, E-value=3e-08, Identity=73%"; Hit description =Chromosome chr18 scaffold_1, whole genome shotgun sequence
MMILISGAYVGLAAIGEVGSWQRECKGYQFWTITDDKGYFQDT

SEQ ID NO: 145170 - protein, 54 aa, Glycine max
  Coding DNA Sequence Number=SeqID_53485
MMTTKDDEQKAQENQEQVKSSRIKKNSRFKKKAYKQESRFKTQDSRMKKRLNQD

SEQ ID NO: 145171 - protein, 200 aa, Glycine max
  Coding DNA Sequence Number=SeqID_53486
MAGPKTYWCHECDMSMSLTLPPSPLLYPPCHTHFLKLMDSLTLSQNDIESSLFDVVFQDALLLLNPLPQNPAPSPPSTSPPPSSPPSTPAVSSFTASSAKTKLPPLPKPNNYPANTYTTPMARTPCLVTEEDFYGLRITLNHITSRHALIEENENRSPQIGKTPGESRVQRERFASMKASMDFRISSLLDKIYNSKILVN

SEQ ID NO: 145172 - protein, 455 aa, Glycine max
  Coding DNA Sequence Number=SeqID_53487
  Homolog annotation: Hit_ID=A7PWH0; Match level="QueryCoverage=92%, HitCoverage=91%, E-value=6e-95, Identity=46%"; Hit description =Chromosome chr8 scaffold_34, whole genome shotgun sequence
  Subcellular localization annotation: CTP_CleavageSite=42; ConfidenceScore=5.53e-01
MGSFPKAKPNNTHTDTNTNTHNRVMGFLLVFFPEENNNTTPTIATKSTKPNLVSSSPSPHSLKRISSSSNNALLSKAQSTISICFLLLFTTLLLFTLSTFEPTHHKPRSIPPKSKLRKNTSSSDVAFPSTALQRMGTLYRRGTRAMNDIVVCHVPEDTTHDEFRIFLRLLHRSGLTSKSDVVFIFVSASSSTTFAHIVHEENTSFLSLINLHAQLNSTQWAKPSESNFDATRFLKAPKKGEPLWGKKIRTNYSGSEGELSRASYGSVLSFDANELDPENSLAGFLDRVPLSLRRWACYPMLLGRVRRNFKHVTLVDVKNVVIFNDPLGRVRNQSPESVFVYPNAKHGRNSERTQSHHPVNSVILMGGARGIRRVSHAMLVAIVRAAMQPHKRKNSVSDSAILSQLVRNKFALRNVHLIVSGESIPEASSLAGSTSFSDCAIIQRASGKSRTIMRK

SEQ ID NO: 145173 - protein, 77 aa, Glycine max
  Coding DNA Sequence Number=SeqID_53488
  Subcellular localization annotation: CTP_CleavageSite=40; ConfidenceScore=5.14e-01
MSVLELYIEKDVASGSAFHSANSVRSCGNNLSNNESEPSRNMMKSPTWFNQLQLFNQEKRCTSLYINNQVQQIPMNM

SEQ ID NO: 145174 - protein, 273 aa, Glycine max
  Coding DNA Sequence Number=SeqID_53489
MKEPEEDARENMQQGRRSEKVEPGHYKVVIVDHILRHFSLGRPLDIDEVFKETNIRKKDNTWVDKRYEQTYKKLQEGSSGGTQTINTESRVKLWVDVVGGKSQGLLYRAGDMSSHYRLGAYLIVVEFMSLLTCRIVGDQCEMLKEETIEFCSEYIEKVKLVGLPKSQHEERVGEQAKQVFVFKILVMKGGKWFYTEKSLVLILKMMIQPLILVVATYPSAGGRRGARGCIFQGRKMRGVATNVYSRKTSEKPERCGLRTLSVKGSGVVFTHGE

SEQ ID NO: 145175 - protein, 98 aa, Glycine max
  Coding DNA Sequence Number=SeqID_53490
MDPPTGKVDGSHKKKLRIRIYLRVITQDKEDDDNNVYEKYDINKEKLNQFFQIRRYTSWEDVRKKVQSIQKQNTALYMLSYRGYDFLEQKSMEEKQQN

SEQ ID NO: 145176 - protein, 45 aa, Glycine max
  Coding DNA Sequence Number=SeqID_53491
AFDHDLVEPLDVFDLFPRFLSETKAGATSKLRYLMGGMDESLMES

SEQ ID NO: 145177 - protein, 61 aa, Glycine max
  Coding DNA Sequence Number=SeqID_53492
MDLVHARFVSISGGFFVGLVTCGGEGGGSDLGRARLMSGHFTVDLVVCGGDGWWLNLDLGG

SEQ ID NO: 145178 - protein, 177 aa, Glycine max
  Coding DNA Sequence Number=SeqID_53493
  Homolog annotation: Hit_ID=A2Q5X7; Match level="QueryCoverage=79%, HitCoverage=16%, E-value=8e-09, Identity=26%"; Hit description =Ovarian tumour, otubain, putative
RDALPGVIVTDRDQALMNAEKDVFPECTNLLCSFHINKNVKAKSMSRNLRSTKRNPSYWEYVDAFESMQNSNLPVRRTASSSKQPNRRTMMPMLDQFQPFMHDFIDKIVDVKADDSWSVVRNHLLKELAKFSEDYIKLFGGTERFEELRMSLLVDGLTKVTMDKWMDITDMGHVIAS

SEQ ID NO: 145179 - protein, 135 aa, Glycine max
  Coding DNA Sequence Number=SeqID_53494
MSLYVCGEGEGEGALLWPAAANEVRRRWLHCRESTDHLRIKLIQACGANEPHVDCSDAFNTSQVFKCREDVLRWARSVAHENRFVAVILRSDTNTGVTSIGVGKKNLSEETLGLGNVGVPSIFVASQWLEEKAGW

SEQ ID NO: 145180 - protein, 72 aa, Glycine max
  Coding DNA Sequence Number=SeqID_53495
MVLEPDDDPGHLRANAFQEGGNGNPCGVYPDLSSFIGSGVYLDLSSFIGSGVIQIFVAYIKRSAPSQVHISS

SEQ ID NO: 145181 - protein, 159 aa, Glycine max
  Coding DNA Sequence Number=SeqID_53496
  Subcellular localization annotation: CTP_CleavageSite=58; ConfidenceScore=5.07e-01
MAHLPPPPLQATAATVLSVTLRHHQTHLFPHHTLSICFPPMTNVRELVQVFYNNLEIRDGVIFSEHFNVPLANEPFVKVKCLFSIGATTVASFGYRKDIDGQWVRKQDLSANAPDERTPSPLPRDPSSTLLNDVLTELWDLRAFVEERFDSMDSHITRL

SEQ ID NO: 145182 - protein, 208 aa, Glycine max
  Coding DNA Sequence Number=SeqID_53497
MASNYKDVKEALMEGNLMTPKKLTSKRARKTTAGEGSSIAPPVEIEFDGHRFRGEEHQCSFEVIKDWSFLKERIVQLPEGEHIEFQAEIARRHWTQLAEPMRKYDPEIVMEFYANAWPTEEGVMDKCSIVRGQWIPYDTYAINQFLRNLLILEEGQQCEYIARRSQTIGFDEKAIGQLLCFPGRDFVRIMVGRQLRIMCTNMTTLTQI

SEQ ID NO: 145183 - protein, 75 aa, Glycine max
  Coding DNA Sequence Number=SeqID_53498
  Subcellular localization annotation: CTP_CleavageSite=28; ConfidenceScore=5.07e-01
MNIVNEARLTGASSKGGKCVESPPTLICGKRRKNRRKPVIKNIPSSGVVFTFEEGRQKRGSCSCVPSIEEEIRPK

SEQ ID NO: 145184 - protein, 94 aa, Glycine max
  Coding DNA Sequence Number=SeqID_53499
MAVVWSIWKMRNRILFSNDSFNGSKLVDDAVFLVWSWLSNLDKDFKLYKPQTFKASSLRESNQQKTRQASSISKPKEKEKGDWEPCSKQYKGQR

SEQ ID NO: 145185 - protein, 255 aa, Glycine max
  Coding DNA Sequence Number=SeqID_53500
MASASQSFVSQSFPNFIAEKLDDANYLRWVWKKIHEYFSLHKKSRACQLRTAMRAVSLEGYVNELTGVGVPVHHEYVDMILEGLSFDYTLMISVIESKKHTLSIAEIETLLYGHETHIVCYNKETQALSSPFLNYTQGYSHPNSYKSGDSGGSRGAYGRGSGGRGGFLDRGAGRSGGAFAEVEPYESLTFFDPTTLPPIPYSSNSAKTSNTWVSPNSKPAVPASNQPMLCLPIPPLMEMVILVPPGYQTLVLASM

SEQ ID NO: 145186 - protein, 446 aa, Glycine max
  Coding DNA Sequence Number=SeqID_53501
  Gene Ontology: Mol. function=amine oxidase activity; Biological process=amine metabolic process
  Homolog annotation: Hit_ID=A7QKQ3; Match level="QueryCoverage=95%, HitCoverage=94%, E-value=1e-170, Identity=66%"; Hit description =Chromosome chr2 scaffold_113, whole genome shotgun sequence
  Pfam annotation: Domain name=Transferase; Domain location=1-417; Score=170.1; E_value=5.9e-48; Accession=PF02458.6; Description =Transferase family
LNPSLEPFSITLSNLDLLSGRFPVTYLYFYRKLESDNFKAFVDALKNTLAQVLDHYYPFAGQIVQNPKTSEPEIICDNNGALVIEAHTNIPLKSLDFYNLNETLQEKVVSVEPDFPLQIQATEYTCGGISIAFTFDHALGDATSFGKFIASWCEIAQKKPLSSIPDHTRHLRARSSPKYQPSLDQTFMKCTMKEIQNMPMNHVLLKRLYHIEASSIDMLQKLASLNGVKRTKIEAFSAYVWKIMIGTIDERHKTCKMGWLVDGRERMGRGKNLMSNYIGNVLSLAFGEASIQELKEASISEIAKTVHEAISKVNNEDHFLDLIDWIECHRPGLMLAKAVLGQEGPTLVVSSGQRFPVKEVDFGFGSPLLGTVYTSIQKVGVSYMNQRLSAKGDGSWTVSAILWPELEAALQDDPIFHPIPTRGIKLKECAKFLIIVVAQQERQSCL

SEQ ID NO: 145187 - protein, 199 aa, Glycine max
  Coding DNA Sequence Number=SeqID_53502
MGKSRDKPMSIVALYAARKGIATETHSKTSHDMPHSPLKRKKVVNIDYNMDLIGSSLVPIRKFNGPPSWMSLGEEIDHVILSEYWDMIQKSNHAELDSTISMLIRRAEDQADVLIEELNNYKKENFKKAVEDSFNNALKQVHPTHLGASGIVNEYFVGHETPDEEMAYGFIDTLDANFDDKISRTSNANADLRDLKGPI

SEQ ID NO: 145188 - protein, 92 aa, Glycine max
  Coding DNA Sequence Number=SeqID_53503
MAIKGYMVFMEIRGLEGGGNMLTWRNDRMGVRLDRCLINLDWRLKFQEGVVVHLGWLKSDQRPILPRLENQTRRKQHKRPVLKLFGPYMMTS

SEQ ID NO: 145189 - protein, 145 aa, Glycine max
  Coding DNA Sequence Number=SeqID_53504
MAPKKLSTKRSRRDAAAEGSNAAPEFDSHRFRSAEHQQHFEAIKGWSLHRERPRRRWMSLVTPMAKFDLEIVLEFYANAWPTEEGVRDMRSWVRGQQCEFSQRRNRVDGFDEEAIAQLEAGADHAHQHDHFDLDVDDIAAQQCLA

SEQ ID NO: 145190 - protein, 61 aa, Glycine max
  Coding DNA Sequence Number=SeqID_53505
MECMERLEPGQANSAQPAIKQQGWKNPNCLTPKWHEKGGRYHEGWYASVVPLVQGPMARGR

SEQ ID NO: 145191 - protein, 75 aa, Glycine max
  Coding DNA Sequence Number=SeqID_53506
MGKKKLEMSLENQQISLDLFNEGRELLDQDVCLQVKELDKKKKNLENFSVVHSLSATLTLSAKSSRAKRALALSA

SEQ ID NO: 145192 - protein, 56 aa, Glycine max
  Coding DNA Sequence Number=SeqID_53507
MTKTMTSPTRWWTPITSRISSFQYDWFFHVMIMLLFYLKNFDLVLQTNVVHQTIVK

SEQ ID NO: 145193 - protein, 18 aa, Glycine max
  Coding DNA Sequence Number=SeqID_53508
MVEMKVMMSYKACEKKIK

SEQ ID NO: 145194 - protein, 132 aa, Glycine max
  Coding DNA Sequence Number=SeqID_53509
MSFLFTVIILITYTLLMSRCSHLCSLSLSVSPLPITLLSIRHRCCFYMGVVLPASAPGRQDKNTKHRFLHVATYPSAGGRRVTRGMRVPRKEYARSRHQRLFEENVGKTEKEAIYELLSERFGSCIYARGRY

SEQ ID NO: 145195 - protein, 158 aa, Glycine max
  Coding DNA Sequence Number=SeqID_53510
  Subcellular localization annotation: CTP_CleavageSite=22; ConfidenceScore=5.21e-01
MAQLLCTPGQDFAQTATGRRVRIMRTSMTTLTRTWRTLLVSNVLPSDHNSDLPLPKCMPPTKHPLDLDKSNRALGFPTLITGLCQSFGVLVTPSKRQRFAPFACPTPDQFRAEVAWPGDWPVAQAGEAPAGAPGDAEEARMEEEMTDLLGFLGGTGAT

SEQ ID NO: 145196 - protein, 55 aa, Glycine max
  Coding DNA Sequence Number=SeqID_53511
MEKDLKKTLKFLDATNATNLAYIAWDDNDSSDGSEKEINLLTKDYESDENISQED

SEQ ID NO: 145197 - protein, 259 aa, Glycine max
  Coding DNA Sequence Number=SeqID_53512
MRPAGGVMCTESFNEGVEAVYGSRKTSRCWSGSFVQSYRLRLSGFHPKGMSASITRSTKGCRRTVHLAGRCMWERLKSSVVLPMCQGCDSPWVRSVKPLASHGQPLAWSTHPHGVTPSPQCDFGVDVKPHGMFYCGPMVGAKSSYQNLEPRHVRVDAADVGLQNKGLKRSSKNMSEEKVKRPHSCNKTNMEGEHVSLNVMVGTDVIIPYSYPIFGYRGKPEPKLISDQLEYYLSKSGWIWTSTHEYGFLAMSNRFDIEY

SEQ ID NO: 145198 - protein, 240 aa, Glycine max
  Coding DNA Sequence Number=SeqID_53513
  Subcellular localization annotation: CTP_CleavageSite=84; ConfidenceScore=5.06e-01
MAVHLSGLTSIPQCVIMKLRNLLPPSSKVHFSGVGACRICGVPCILLPGLPHVGASRKLSTWNPDIPSTSQSMLSRGYSSTWVLVSYGEALGELALIEGGHQVHVASGLYSLACKVEEWTDVRWTVSGETLSLWKDLGHHEICNDDGDGHRVDGVDAFEVPTSKGEPKEKENYSRRRGLKSVSFRERRAEQGAKFSSFREISEFLSDCEIPRGGGVIPTPLDFSIGKCTVSLELDRAGTE

SEQ ID NO: 145199 - protein, 101 aa, Glycine max
  Coding DNA Sequence Number=SeqID_53514
MARGLLEDWARDVGEGSRVLMSLKGSIVYRREPLKFKFLLPSSSYPWLPMVVSLFLTYLLLELHLQSSFLLLHFAAIDLQEAKDSIDEEDPMPTSSTWSHI

SEQ ID NO: 145200 - protein, 52 aa, Glycine max
  Coding DNA Sequence Number=SeqID_53515
MEEIHGEDDEEQGIKDQWQRNGEGGTVIGEDEWRERERGERNFERGKRENGV

SEQ ID NO: 145201 - protein, 105 aa, Glycine max
  Coding DNA Sequence Number=SeqID_53516
MTRGNPSDLQPFDPEIDRTFHRLVRHHFIPFDHPEHSITGESVHSVIGDFKHPDFEHYNFEHSDSEHSDFEHSENMAQPPPRERTLREMAAPDFTYESLCIQYPQ

SEQ ID NO: 145202 - protein, 153 aa, Glycine max
  Coding DNA Sequence Number=SeqID_53517
MTPSTEDVKKAMQGLFAVLQLSMWGWFHTFFSKKVGPSIRYKEGRIRILSSCEGCPMRGVPSDESITPFIARGFSDHNARDRELRGSSNGIIGGYHKWLRVRTQGLDWLPNLKTVRDNEVKASEESDEVQALKAKLERARVVKEKFKSIAIKV

SEQ ID NO: 145203 - protein, 138 aa, Glycine max
  Coding DNA Sequence Number=SeqID_53518
  Pfam annotation: Domain name=zf-CCHC; Domain location=51-68; Score =20.2; E_value=0.0013; Accession=PF00098.14; Description=Zinc knuckle
MSKSYGSHSYPKKDQGQGIFGVTPSKPKYNKGKTIEKQPLKASMQEKTSSMNCFKCLGRGHITSQCPTKKTMIMKGQDIYSSQDEATTSPSSSESEEAKGEESSEEIYPQEEGQPLMVKEECKEVWREEARSFMNLGI

SEQ ID NO: 145204 - protein, 150 aa, Glycine max
  Coding DNA Sequence Number=SeqID_53519
MTLAQVWSVLSYSNLAPTSHTSDLTVDRARLIFGLDSQMDINVGALISGQITSIAQSNSSRLGFPTLITACVRPEGKNCWNPNDLTVSIKGARRARMRLAEPPSTSTTPIPARPSAAPSAPASADFSILKPCVATYPSAGGRRVTRGSVF

SEQ ID NO: 145205 - protein, 134 aa, Glycine max
  Coding DNA Sequence Number=SeqID_53520
MEAIKEQMATMMKPMMSMKKIMEANAVIVAAISAVAKVNPMLPSSLKQMNHPTSNMLGKDLGSTDDPMMCKFKTSTPSHHMACLPTIHHPMWHTLSMKISITPLRYSLRTNNPKLIMHMSLKPWGGPMKFPITI

SEQ ID NO: 145206 - protein, 49 aa, Glycine max
  Coding DNA Sequence Number=SeqID_53521
MGDRLEDMIRDLGQESFQQAHAPVYGWSDKSFTSVLEVVTLCLQRTTRS

SEQ ID NO: 145207 - protein, 48 aa, Glycine max
  Coding DNA Sequence Number=SeqID_53522
MVVFEYKEASISSGLLTLRIMDWWLKDKGFQNLVKLEWGNYHPQGWGV

SEQ ID NO: 145208 - protein, 299 aa, Glycine max
  Coding DNA Sequence Number=SeqID_53523
MASRKRKVPSTPTQARFDRSIFNSQEAGERYTDVIVPRKLLPERNVVIYYTEFDEFKEELERCHWDEELTDFIDGNIDVAIVKEFYANLYDPEDKSPKFSLLRPDPQELAAKLCILGRGFELNADGQPLNILRKKMTTLAQTWSVLSFSNLIPTSHTSGVTLDRAKLIYGIIMKMDMNVGYLISHQISLTAQHDTSRLGFPTLITTLCKARGVQSDSRSLESLSPSINLPYIKKNCWNLDDPTVTFRGPRKARGKRSEAPSTSAPETGGPSSSTLPPSSSTEIPVIPPAPSQIPLTTPL

SEQ ID NO: 145209 - protein, 239 aa, Glycine max
  Coding DNA Sequence Number=SeqID_53524
  Homolog annotation: Hit_ID=UPI00006A2D9E; Match level="QueryCoverage =43%, HitCoverage=61%, E-value=6e-07, Identity=19%"; Hit description =UPI00006A2D9E related cluster
  Subcellular localization annotation: CTP_CleavageSite=27; ConfidenceScore=5.03e-01
MSSLSEDCTSSPSEGFTSSPSEGCTFSSSEDVTSSPSEGYTPSSSEDYTSSPSEGYTSSPSEGYTPSPSEGYTRSPSEDYMSSPSEGYTPSPSEDYMSSSSEDYMSSPSEGYTPSAPRTTCPHLQRTTCPHLRRLHVLIIRGLHVLTFVGLHALTFRGLHELTFRGLHVLAFRGQHVLALTFRGLHVLTFRGLHVLAFRGLHVLTFSGLHALAFKGLHALTIRGLRVLTLSGLHIHTLR

SEQ ID NO: 145210 - protein, 124 aa, Glycine max
  Coding DNA Sequence Number=SeqID_53525
MAENMQIEEPSSHQPTSQSSDHPTPLSSHQPTPVESSTGTVEGPNNEPMQQPPSIEVDDHGVSSTKTGGGEAQKYCVEPFCCWIQMKEGWQLHQICGLQATKRKGIWLSQLITLIAHGLCKVAF

SEQ ID NO: 145211 - protein, 99 aa, Glycine max
  Coding DNA Sequence Number=SeqID_53526
MFQMQGEQTRCSCKKCKCKVLKFVDDVMRDLYEERFMPNYYWWTTHGEELPQFPPIVLQGSYYKSGRQRKELNPYEQMIMDHAGPSIGQYIEQQGVIET

SEQ ID NO: 145212 - protein, 356 aa, Glycine max
  Coding DNA Sequence Number=SeqID_53527
MINLGTLGAQRGQAETALQIFRKQRLLHIIFAIDATTQITNHPQADLFQQLRIDVLFSVVFQPLLHFVQAFDRHAGHRGTRALDFATVSHFVVALHAAQQNRQQNHADKQREQNHAGGDKHQFVARRKRFAVAEEQRDRQHTGQRDSTTHAGKRGDQQFTQRVAGELQRLLLQQAQAGALHDPQPAEAHDHQRRIDQPDVSEQHPQLDVRIGVRLSNRGGENVRQLQAQHQEHHAVEHKLQHLPYAVGAQAHCQRCLTDDAGTGDGHTGRYRRQNAGDAEVFSNQVRGERQQQQQYGLRCRVVTAPAAEQAQRTTVQPANGDTGHQAANRHFKEFDAGAAPGEHHSAHRHRDGKLE

SEQ ID NO: 145213 - protein, 101 aa, Glycine max
  Coding DNA Sequence Number=SeqID_53528
MADSISRLSFPEAAGPMIRGDTLRLSAPFCHPEAAGPMTSRDQVWSFCTLVSSRGGGPDDTRRYLTVIRTLLSSRGGGPDDKQRPNLVILHPCIIQRRRAR

SEQ ID NO: 145214 - protein, 115 aa, Glycine max
  Coding DNA Sequence Number=SeqID_53529
MSNEELKLQDPRCRIQCPGHPARKYWSCCTMHKARQKLQDPRCRIQCPGHLARKYWTHKSVISLTDYCAIFQENDRSHPAQVVAAQIRTLLYKHEGCTSSVPSPGLKSYFVSFGT

SEQ ID NO: 145215 - protein, 242 aa, Glycine max
  Coding DNA Sequence Number=SeqID_53530
  Gene Ontology: Mol. function=DNA-directed DNA polymerase activity; Cellular component=mitochondrion; Biological process=nucleobase, nucleoside, nucleotide and nucleic acid metabolic process
  Homolog annotation: Hit_ID=Q39432; Match level="QueryCoverage=96%, HitCoverage=32%, E-value=4e-76, Identity=55%"; Hit description=DNA polymerase
  Pfam annotation: Domain name=DNA_pol_B_2; Domain location=2-238; Score=-88.4; E_value=0.0012; Accession=PF03175.4; Description=DNA polymerase type B, organellar and viral
MRDNRLYEVAVYSKKRLLFTFRDSLHLLPGKLDDLAKNLCPELGSKGSISYEDVRLESLSIMKESLLEYMEQDILLLGGIMQSFQDIYYKAYQADIVNKLTIASLALSLFREKYYDYNKHRIHIPNQNEDTFIRRGYYGGHTDAYLPYGTNLYYYDVNSLYPFVMKEFSMPGGTPVWHSDLEYMTLDNMFGFIEAYVECPKSTFVGVYYSEELKYARDIRLHYNTNLWIPLRGDGKSIQGLH

SEQ ID NO: 145216 - protein, 130 aa, Glycine max
  Coding DNA Sequence Number=SeqID_53531
MQSQFQSQMQSQGLALPPQPEVGPSAARVSTKETCVDPSGNDLDTGDSDRCRLYIEENPPHLVALGRLYEGSITVHNIPLLHDQVKVGVEEVRDANASIPVPIEEVKLVRQTLNTFLAWPTHLVKRLSEQ

SEQ ID NO: 145217 - protein, 83 aa, Glycine max
  Coding DNA Sequence Number=SeqID_53532
MALARDFRRETTHGAIWFRIGSKIPLAIYTLDVGAKYLDVEEYLVRVNVRKEEMAPRKLVLKRSRKDKAAEGTSSLLSMTVTL

SEQ ID NO: 145218 - protein, 76 aa, Glycine max
  Coding DNA Sequence Number=SeqID_53533
  Subcellular localization annotation: CTP_CleavageSite=51; ConfidenceScore=5.23e-01
MLFPLDSQVLSPKAYKSILSPSPLMQAPLELVGLGSSSSMDSFASWKMNGSGMEKGREREETPLQGEDESRRSSPP

SEQ ID NO: 145219 - protein, 74 aa, Glycine max
  Coding DNA Sequence Number=SeqID_53534
MTCLSKDNPIRRHSYGCFVGSPMCPESIIKPDAIGFDVLMMIMNDVLQLMQMGFSRLKFKTILQDYKSQHQDDH

SEQ ID NO: 145220 - protein, 221 aa, Glycine max
  Coding DNA Sequence Number=SeqID_53535
MASRKRRIIGIRPTSQYDTRRFSSLDAWTRYTDNVLGRNILPERKVELYHTELDDFKAELERGHLVKIDADSLNAFLETPVILAEAETLPVYSRYCRLPTDFREIEAALCIPGRGFILNFKGHPGNILRKDLTTLAPVWSVLSYSNLAPTSHTSDLTVDRARLIFGLVSHLDKNIGVLISVQMTSIAQYNTSRLWFPALITVLCRVRGVVSDSLTFKRLSP

SEQ ID NO: 145221 - protein, 95 aa, Glycine max
  Coding DNA Sequence Number=SeqID_53536
  Homolog annotation: Hit_ID=A5BK23; Match level="QueryCoverage=62%, HitCoverage=9%, E-value=2e-11, Identity=50%"; Hit description =Putative uncharacterized protein
MTGDASKFTHISPKNGGHVTYGDNNKCTDTFLPKEWRTSRYHPLDNIIGDISKGVTTKHFLKDACNNMAFFSLIEPKNLNEAIIDEHGLLLCKKS

SEQ ID NO: 145222 - protein, 15 aa, Glycine max
  Coding DNA Sequence Number=SeqID_53537
MQVPYTRYPICPQFK

SEQ ID NO: 145223 - protein, 53 aa, Glycine max
  Coding DNA Sequence Number=SeqID_53538
MSVKNLVGRLGVHDKTNHTLASQVTLTRLKRALKSGVFNPKAYTPKSSSGSPS

SEQ ID NO: 145224 - protein, 60 aa, Glycine max
  Coding DNA Sequence Number=SeqID_53539
MVWVYPNYRMTLSGRHAVNPRHSPDQQWTPQLRESARISSTTKQCDVTAKLLVAADRSIV

SEQ ID NO: 145225 - protein, 51 aa, Glycine max
  Coding DNA Sequence Number=SeqID_53540
MALYGSEFAYLNPLRILGCLLAALSVCPELGKGRRSIGHDPSLYLRLSLST

SEQ ID NO: 145226 - protein, 29 aa, Glycine max
  Coding DNA Sequence Number=SeqID_53541
MEDDVILTRSGSLDTGYGDLNDATSSEGR

SEQ ID NO: 145227 - protein, 134 aa, Glycine max
  Coding DNA Sequence Number=SeqID_53542
IAMAAQLIRDCVVMECLEGVWETLEGNERCQFRGTVRLTATLLVHPEQPARTLQQPVEWILPTPTPYRLVEPVQLIEVSSSEEDPEGDPEESSPEPAMDAADLPEDDEDPLPDVDSPDTVLERRFFEPNDDRNG

SEQ ID NO: 145228 - protein, 162 aa, Glycine max
  Coding DNA Sequence Number=SeqID_53543
  Homolog annotation: Hit_ID=Q6WAY3; Match level="QueryCoverage=46%, HitCoverage=3%, E-value=7e-08, Identity=43%"; Hit description =Gag/pol polyprotein
MTNTTFSTNLNTNQEMNFAAKKPVEFTPIPVSYADLLPYLLDNSMVAITPAKVHKPAFLRKYDSNATCACHGEAPGRSFKHCGALKHKVQGLIDAGWLKFEENRMIFNFHRKWVQAIGLFAQATCAPEFGLPRPFNQRLLVLRVGGVAVKQQIKFKTNKFPK

SEQ ID NO: 145229 - protein, 85 aa, Glycine max
  Coding DNA Sequence Number=SeqID_53544
  Homolog annotation: Hit_ID=A5BVM8; Match level="QueryCoverage=95%, HitCoverage=5%, E-value=1e-11, Identity=42%"; Hit description =Putative uncharacterized protein
MVRSMGYKFYDPTLRSIFETGNARFLEEVEFGKEENIRKVLFEEKPIIDSSQVLIPIVVQETTPVIENSVQTIVDDIVQEQDNDE

SEQ ID NO: 145230 - protein, 257 aa, Glycine max
  Coding DNA Sequence Number=SeqID_53545
  Gene Ontology: Mol. function=motor activity; Cellular component=cell projection
  Homolog annotation: Hit_ID=UPI00016621D1; Match level="QueryCoverage =85%, HitCoverage=40%, E-value=1e-23, Identity=36%"; Hit description =UPI00016621D1 related cluster
MSQSLPRATRPHHQRATRPHLQRTIRPHLRGLHVLTYRGLYVLTFRGLHVLTFRGLYILTIRGLHVLTFRGLHVLTFRGLYVLTFRGLHILTFRGLQVLAFRGLHTLDFRGLHVLTIRGLHVLAFRGLHVLTFRGLHALTIRGLHALTFKGLHVLAIRGLHVLAFRGLHVLSFRGLHALTFKGLHALAFVGLHALTFRGLHVLTVGGLHALTFSGLQALAFRGLHVLAIRGLHVLAFRGLHVLAFRGLHTFGFIGLH

SEQ ID NO: 145231 - protein, 59 aa, Glycine max
  Coding DNA Sequence Number=SeqID_53546
MVIFRAYIHKDTGLGSSSSMDSFASWNMNDSGMEKEEREEMPLQGDPPPQKKLTTIGGK

SEQ ID NO: 145232 - protein, 228 aa, Glycine max
  Coding DNA Sequence Number=SeqID_53547
MQKCFRVQKAGNAVERKDKELRGSKNGVIGGYHKWLKARKQGITWLSKLKISSGEEVEVPEESEEVQALKLERTRVVKGMFKMTATRVRKECDELRDKQRSQALKGRKGRVKGGKYDIRGQVEGLSKYREKLNLAASHEQRLEDEHAKVLAPHMERKARERVIELLHREAMKWMDRFTLTLNGSQELPRLLARAKSMANVYSAPEEVHGLFDYCHHMIELMSHKIRNH

SEQ ID NO: 145233 - protein, 56 aa, Glycine max
  Coding DNA Sequence Number=SeqID_53548
MESHNFPEKVLRCGKHHPPCGRIESTPLWVLGSPRTKSILMSTQGADGMGKGVYSP

SEQ ID NO: 145234 - protein, 52 aa, Glycine max
  Coding DNA Sequence Number=SeqID_53549
LSSSFSRRLLKEVSLVFRWILKEVFSKKLLKEVFSRKLLKEVFSRKLLKEAT

SEQ ID NO: 145235 - protein, 118 aa, Glycine max
  Coding DNA Sequence Number=SeqID_53550
MVVQLIHDRVEMECLEGVWETLEGNARCQFCGTIRLTATSLVHPEEPACTLQHTVEWILPTPTPYRLVEPFQVIEVSSSEEDPEEDPKELPPEPTVDAIDFPEGDEDPLPDVDSPEDV

SEQ ID NO: 145236 - protein, 96 aa, Glycine max
  Coding DNA Sequence Number=SeqID_53551
LGFPTFISALCRARRVTSDSLTYESLSPAINLAYIKKNCWNVDDLTVNFRRARKARARPANVPSSSTPPAPSTSATPTPSPPGPSAQDSQRFESML

SEQ ID NO: 145237 - protein, 70 aa, Glycine max
  Coding DNA Sequence Number=SeqID_53552
MARNVFAPCPYLMDLYGRELKGLLVIIPEVVVSLLMVSRGIIPFEEHIVAVGTTSNNVSSKRKTLDEGSL

SEQ ID NO: 145238 - protein, 87 aa, Glycine max
  Coding DNA Sequence Number=SeqID_53553
MNVMSSAVHVSSTFEFGAMFHDFLSADPQGNPPFSPFFEPHECYCLVLLHVPSTFEFGAMFHDCLSADPQGNPPYSTFFRSPMNVIG

SEQ ID NO: 145239 - protein, 85 aa, Glycine max
  Coding DNA Sequence Number=SeqID_53554
MQLPQEPLNKRPRGLARKSMAGTNFAELYGARGRVIDSLHQEATMWMDRFALTLNGSQELPRLLAKAKAMADTYSAPKEIHGLLG

SEQ ID NO: 145240 - protein, 111 aa, Glycine max
  Coding DNA Sequence Number=SeqID_53555
MWLKGVKTLVVLSGNHDECAKCACALSLFIAVVKFLDFQMNALSGPSLSLTCTAKRLFASMASKKRKAPSTPTQARFDRSRFTSQEACERYTDIVVPQKLLPERNMVVYYT

SEQ ID NO: 145241 - protein, 98 aa, Glycine max
  Coding DNA Sequence Number=SeqID_53556
MDQIGLPLGMGSFVRGEKKGSLAHGILGKDYGESGFWLKVCRMARHDTCRGLVWLKDKRDASHYFHDTKCKNDDLETLCKTGHACTYADTQVSNFMVM

SEQ ID NO: 145242 - protein, 82 aa, Glycine max
  Coding DNA Sequence Number=SeqID_53557
PLIELGRNHVPSWEDAQEMGVEGRSPEYEEHRDLRSNPFQGGGNLMEACLWGFYGGWIFELQWGPLMVIFHHGDAAEDKGKE

SEQ ID NO: 145243 - protein, 19 aa, Glycine max
  Coding DNA Sequence Number=SeqID_53558
MCPPPIGDQPGSPKVFPTR

SEQ ID NO: 145244 - protein, 51 aa, Glycine max
  Coding DNA Sequence Number=SeqID_53559
GVANCRNLPFGRRVTRDSQVRVPRKEYARHRHQRLFEENVGKTGKDVTYEF

SEQ ID NO: 145245 - protein, 25 aa, Glycine max
  Coding DNA Sequence Number=SeqID_53560
MVKDNLGKFDAKSDEGRLFERPTNA

SEQ ID NO: 145246 - protein, 143 aa, Glycine max
  Coding DNA Sequence Number=SeqID_53561
MPKNKSKKTICIILLTCFIGLMLLKAPELTSPTWRSTSMIVPTLMHANAEESLAKVATPADEGDAKAQVYKSSPDLYAVILLVRDASPSSESHFHTRVFPWWPLEFTCSGYLHRRSTYGTYFLACMHGLTRQEDFRYKGSSCP

SEQ ID NO: 145247 - protein, 177 aa, Glycine max
  Coding DNA Sequence Number=SeqID_53562
DAGSRQARQGASAGVGGCRGWLNYAASEQIVLRVHHMRCEIPHRCVRRKYRIRRHSPFRLRNCWEGRSVRASSLLRQLAKGGCAARRLSWVTPGFSQSRRCKTTASAKLACLQVDSRGSRLKCGMLRVRATLWGLRRGFEPREGWWLHGVDAGEVNDGKDYQVGTWGSEEKKVLSSH

SEQ ID NO: 145248 - protein, 104 aa, Glycine max
  Coding DNA Sequence Number=SeqID_53563
MPCHEVIRLAICIICEVQWDDMASDVSSIRACRPSIFFINGFLCFLEDEWQHNEERKRERRRHFKEKMSLEEAHHHRRPWIRAWRKKEMNEGRGREEHEILCSK

SEQ ID NO: 145249 - protein, 37 aa, Glycine max
  Coding DNA Sequence Number=SeqID_53564
MTKLGLCVPTDTTVSEWQRGADNHKVSPRIMGADNRK

SEQ ID NO: 145250 - protein, 55 aa, Glycine max
  Coding DNA Sequence Number=SeqID_53565
MAITEATGLQMRELWPRGNSWAEVDFLELWFERTRVMMIGRKESLFPARATHNRL

SEQ ID NO: 145251 - protein, 118 aa, Glycine max
  Coding DNA Sequence Number=SeqID_53566
MWGIPFILEPNQALTCIMSSHSTSFEPKSRLTINLDPGEKKKKKKKKKKRKEGKFPNQRVGESKRKERKFPIKEWEKVKKEEEEGKKAPDRGSKEKQKKCAERSLDRTISEQYRIVTK

SEQ ID NO: 145252 - protein, 61 aa, Glycine max
  Coding DNA Sequence Number=SeqID_53567
VVIIKKGEIVESMPSKVILMMPKNSRIKRKIQEKFQISKNQESRIIKYKIKDSRFKNQEKT

SEQ ID NO: 145253 - protein, 191 aa, Glycine max
  Coding DNA Sequence Number=SeqID_53568
  Gene Ontology: Mol. function=microtubule motor activity; Cellular component=microtubule associated complex; Biological process =microtubule-based movement
  Homolog annotation: Hit_ID=A2Q2F9; Match level="QueryCoverage=32%, HitCoverage=8%, E-value=1e-12, Identity=59%"; Hit description =Prefoldin
MRLRFREAGIKRLQTDASEKISAETHLLKEKEEHLKEIEVLRAQVDRNNEATTFAMENLQLKEEIRRHVLLIQLKYFFVAFFFIHVHAKVTHFDFMIKVKVGKWHSYSMTKNQSSSTNNIYIAYYIHKYEKMLKSFCMEGERERMSEQIMVLENKLLEALDWKFMHETDLKKNSDLMIEDVHNDGNLISKQ

SEQ ID NO: 145254 - protein, 88 aa, Glycine max
  Coding DNA Sequence Number=SeqID_53569
  Subcellular localization annotation: CTP_CleavageSite=39; ConfidenceScore=5.09e-01
TCKRNLQDSGTLKRVAWGLDVGTRLSLAHQWTKRASTVKCSLSTHSATEESGRASISRSHAKREISELSARVVFSQAQHTTSAKLKST

SEQ ID NO: 145255 - protein, 95 aa, Glycine max
  Coding DNA Sequence Number=SeqID_53570
MDKVDIFVPHPLTNACLLIQLSSECGCKPLVCLLKRPMLLSVDFQDCSIRDTRLARWWGCRKQRESSTTRDPRSLNPFSEIRRREEEVSRKRGRL

SEQ ID NO: 145256 - protein, 135 aa, Glycine max
  Coding DNA Sequence Number=SeqID_53571
  Gene Ontology: Mol. function=chitin binding; Cellular component =extracellular region; Biological process=chitin metabolic process
  Homolog annotation: Hit_ID=UPI00006A17C9; Match level="QueryCoverage =54%, HitCoverage=97%, E-value=2e-08, Identity=35%"; Hit description =UPI00006A17C9 related cluster
  Subcellular localization annotation: CTP_CleavageSite=29; ConfidenceScore=5.18e-01
KGITVATKPSAGGRCGAHGCVFQGRKACRVATNVYSRKTLEKPECSPLKARTCSPLNARACGPLKAMACSPLKTRTCSPLKVRACSPLKVRTCSPLKGRTCSPLKARACLSPLTGLETHGFYSSTPVKRMKTYVF

SEQ ID NO: 145257 - protein, 124 aa, Glycine max
  Coding DNA Sequence Number=SeqID_53572
MAPTRHPLDPDKSNRALGFPELITGLCQSFGVPVAPTKARQRAPHQAGQAGAFDMEQYLRHLVRQQAANHRAHTSFRAEVAWPGDWPEAQAGEAPPEVPGDGEEAHEDEEMGDLLDFLGGSGDT

SEQ ID NO: 145258 - protein, 87 aa, Glycine max
  Coding DNA Sequence Number=SeqID_53573
MVQKRDKKLRGSSNGPIGGYHRWLKAYAQGLDWLPNLRTTKGLEFETPEEDDEVQALKTELEKAQIVKEKFKSKAVRIRKENAKLRD

SEQ ID NO: 145259 - protein, 125 aa, Glycine max
  Coding DNA Sequence Number=SeqID_53574
QAFGVPVTPSKVIRPPITQAFIEKYCTPRQGQGDAPQAANAPPPPHQAGPAGSFGMERLSQQSQGFAPFACPTPNQFRAEVAWPGDWPEAQAGEAPTEAPGDTKEARMDEEMTYLLGFLGGSGAT

SEQ ID NO: 145260 - protein, 108 aa, Glycine max
  Coding DNA Sequence Number=SeqID_53575
MDVQLMTDQFMIMHSTNQLHHPAFSSNRWLATKLEGTPTFLSPNYDKGDDKKLKGQSKNEFKIFKIESRTLQDSRGKLISRIKNQDSRDQDFKNQDSRDQDSRLKIQE

SEQ ID NO: 145261 - protein, 102 aa, Glycine max
  Coding DNA Sequence Number=SeqID_53576
MTETVCTESRLGISVRHLTSRVRMTESAEDDEMLTSSKRVQMTTLASACQSDLGSPNDEVRITERCLRMLPDSWVMRAKGGVVDKREPFAPTYPPFVMKNSD

SEQ ID NO: 145262 - protein, 96 aa, Glycine max
  Coding DNA Sequence Number=SeqID_53577
MAPKKLSVKRSRRDVAAKGSSAAPEFDSHRFWSAEHQQRFNAIKGWSFHRERRVQLREDEYTDFQEEEAHRHWTLLVTPMAKFDPERRECETCVHG

SEQ ID NO: 145263 - protein, 142 aa, Glycine max
  Coding DNA Sequence Number=SeqID_53578
MEGLVDLAAIDAFLAFHHGKESPVVAILAMYDTFDRGCEKSSAKNCLLCTGSLCVAGFTPFFSKKEGRIRILSSCEGCPNVPLMEQGECHQTKASRLSSHGVSVTTTRGYSKEFARHGMQREERTESLGEAVMGASAAIISG

SEQ ID NO: 145264 - protein, 165 aa, Glycine max
  Coding DNA Sequence Number=SeqID_53579
  Homolog annotation: Hit_ID=A5B4G8; Match level="QueryCoverage=63%, HitCoverage=12%, E-value=2e-08, Identity=33%"; Hit description =Putative uncharacterized protein
MTRGNPSDLQPFDPEIDMTFHRVVRHHFVPFEHPEHFIIGETEHFVVGNFEHPDFEHYSFEHSDFEHSENMAQPPPRERTLREMAAPDFTYESLCIQYPDEDVPYVPKTGLIHLLPKFHGLAGEDPHKHLKEFHIFYSTMKPLDVQEDHIFLKAFPHSLEGVAKD

SEQ ID NO: 145265 - protein, 71 aa, Glycine max
  Coding DNA Sequence Number=SeqID_53580
GQDHLELLSGVGTKLEQQKPIKERMQVGMKSRSTDRCPFSALNKQRTSLQDSPVSFVFAVFFYYLFVLKRK

SEQ ID NO: 145266 - protein, 188 aa, Glycine max
  Coding DNA Sequence Number=SeqID_53581
MVCNDQVDMIDRLLVGSFTFDCHIKHYIIVRILLPWSSNLAQASEEDLILLWALQTGRQIDWAHLVRYWMHKALQTHALLLYPHLVTFFLHHFNVPLDDEPMLMVNGFANKTCHCLFLMNVPLSPPPQRDASSSLLTEVLTELCDIRAFVGARFDAMDTHFDGMDTRITRLEDDMSFIKRCFDPPADS

SEQ ID NO: 145267 - protein, 341 aa, Glycine max
  Coding DNA Sequence Number=SeqID_53582
  Gene Ontology: Mol. function=motor activity; Cellular component=cell projection
  Homolog annotation: Hit_ID=UPI00016621D1; Match level="QueryCoverage =63%, HitCoverage=40%, E-value=5e-26, Identity=39%"; Hit description =UPI00016621D1 related cluster
GLQARTFKGQHVLAFRGLHALAFRGLHVLTFKGLHALAFRGLHVLTFRGLYALTFRGLHVLAFRRLHALTFRGMHVLTFRGLCTLTFRGLHVHAFTGLHALAFRGLQVLAFRGLHVLAFRGLHVLAFRGLHVLTFRGLHVLTFRRLHAFTFRGVHVLAFKGLHTLTFRGLHVLSFSGLHTLTFRGLHVLAFTGLHALAFRGLHVLPFRGLHVLAFRGLHAFTRASSFPLSVPWSPPDLGGGPTVDHAHKTPNGPGGAQQGPGVSSSGYGPLSVLQGARPPQQGIVPARHLVDPKKSNRVLGFPALITGLYQFYGVPVAPTKVIRPPNNRAFIKKYYAPRQA

SEQ ID NO: 145268 - protein, 178 aa, Glycine max
  Coding DNA Sequence Number=SeqID_53583
MTEGCGEGFCLANLPGDAFSLWGNFFEAKKQMMADAKFAGLLGLGKPLVKFCPPGQLRGFCPLLALARVGGAGILPTLACAPLAKSVPRWWIIMQNEREPTNGSLFWPNIVEEERDTGLIGEGRIKATRAESQWIVAARPLCHLQYPVAYLSRLQRILPAARWELRFKASRRANPPHE

SEQ ID NO: 145269 - protein, 72 aa, Glycine max
  Coding DNA Sequence Number=SeqID_53584
MIPTPNENIPVVATYPSAGGRRVTRGMRVPRKEYARSRHQRLFEENVGKTGKDAIYELFSEKVRELYLRTGK

SEQ ID NO: 145270 - protein, 105 aa, Glycine max
  Coding DNA Sequence Number=SeqID_53585
MPYESSCAYAASTREASYPVHDSVGWVDGMHVGAAQRFRKKRTGCLLLEQKVHSLRDELLYAGNNVLRFNMGIPSSKAVYVEPYYLVGIQDGPSQVKPALTGQIA

SEQ ID NO: 145271 - protein, 19 aa, Glycine max
  Coding DNA Sequence Number=SeqID_53586
MVKDQRMRGEELRRHLFKF

SEQ ID NO: 145272 - protein, 93 aa, Glycine max
  Coding DNA Sequence Number=SeqID_53587
MPAGRLLEDPTGYVGARASLLSIAPLFVTMTQELVARGDTLRLSAPRHSVTPSVIDEQRPMWSSAPFPEMSASSGGEIMVILHPFVIQRRRAR

SEQ ID NO: 145273 - protein, 76 aa, Glycine max
  Coding DNA Sequence Number=SeqID_53588
MLHSMLQSLHRGCTHGSEGGDFYRPDPKAIPAPIPDDAIPSAPASKLGQPISQDSPIAQVLDLNEHAQEQPQEQDI

SEQ ID NO: 145274 - protein, 116 aa, Glycine max
  Coding DNA Sequence Number=SeqID_53589
HIASPVLEREPRQQPEEGHKDPQDYARRDVEFYPPIPEGPAPKGPSPATEERRKLDLLEERLRAMEGFGDYPFTDMTESLLSTRCCYPPEVHRQVYRDDLSQKPSQDVLPQDGRTL

SEQ ID NO: 145275 - protein, 112 aa, Glycine max
  Coding DNA Sequence Number=SeqID_53590
  Homolog annotation: Hit_ID=Q84VH5; Match level="QueryCoverage=54%, HitCoverage=9%, E-value=3e-13, Identity=69%"; Hit description =Envelope-like protein
STPRGSHPDIVSTSGKAAASGAVSKDALIAELKDTCKVLEATIKANTEKKMELERLIKRLSESGIDDGEAAEEEDEAAEEEVEAAEEEEEAAEEEEDAAEDTESDDDSEATP

SEQ ID NO: 145276 - protein, 85 aa, Glycine max
  Coding DNA Sequence Number=SeqID_53591
MRAPNCYDYAGFTRTSTSRQLERKGEEIGEGKFISFFIDSFSLFTGLTTSSKNFLQGRFSKILGMTQHSLFVTILKRSRLGMHVS

SEQ ID NO: 145277 - protein, 131 aa, Glycine max
  Coding DNA Sequence Number=SeqID_53592
MGQPTHSSVLQVTGSTIYGEAHETGQCIPIEQWRTHRSPYNQQGQWRTHLSNQFNKDQSGPSNRPIQQGPNILQRTTKLEETLTQFMQIVDKSSNSFVANTEQNPKEECKAVMTRSKKSVEAEDEDSVVHK

SEQ ID NO: 145278 - protein, 42 aa, Glycine max
  Coding DNA Sequence Number=SeqID_53593
MGKLDHLEERLRAIEGGCRNLPFGGRATRDSRDACSTKGIRA

SEQ ID NO: 145279 - protein, 58 aa, Glycine max
  Coding DNA Sequence Number=SeqID_53594
SRENNLHLPIWSLCLTENVMQSYPPRELDRRLQEDWAKDAREGPRILMSLRVDFGPMG

SEQ ID NO: 145280 - protein, 103 aa, Glycine max
  Coding DNA Sequence Number=SeqID_53595
TSGKSVSGYEKKIQQPQEPLNKKPIGLARKRMAETNSVELCGAATRLCETETSMLAIVSKYQEELNLAIAHEHKVADEYAQVYAEKEARGRVSQPTLRREGDA

SEQ ID NO: 145281 - protein, 21 aa, Glycine max
  Coding DNA Sequence Number=SeqID_53596
MRPPPSSAEPPRKKKERWESS

SEQ ID NO: 145282 - protein, 65 aa, Glycine max
  Coding DNA Sequence Number=SeqID_53597
MAEMGKLDHLRKGSGPLKENICKKGDGSFKEHAQKVEGSGGPSGTPNDGKGDDNRDGRHIIDTLL

SEQ ID NO: 145283 - protein, 132 aa, Glycine max
  Coding DNA Sequence Number=SeqID_53598
MASTRHPLDPDKSNRALGFPALITGLCQSFGVPVAPSKGDAPQAADAPPPHQAGLAGSFDSEQYLRHVVRQQAANHRAHVAWPGDWPEAQAGEAPAEAPGEADEAREDEEMINLLDFLGGGAEPHDLEIPRS

SEQ ID NO: 145284 - protein, 117 aa, Glycine max
  Coding DNA Sequence Number=SeqID_53599
  Subcellular localization annotation: CTP_CleavageSite=23; ConfidenceScore=5.01e-01
MREKLATQLAQASKVASSRSNTLLEEGSRRPKWARLLFAPPFLLSAPPFYFFAFEEVTETHGLRKNTSFRLPPHYGISRIAQACFLLISETSRDFIHCATKDAKYLKAANQRLHVIK

SEQ ID NO: 145285 - protein, 42 aa, Glycine max
  Coding DNA Sequence Number=SeqID_53600
MVLHEKAIGVNVEDDDSAVDTCVSPFSTQMPPNINGGEEVNN

SEQ ID NO: 145286 - protein, 209 aa, Glycine max
  Coding DNA Sequence Number=SeqID_53601
  Homolog annotation: Hit_ID=Q8TGM5; Match level="QueryCoverage=19%, HitCoverage=61%, E-value=1e-07, Identity=70%"; Hit description =Uncharacterized protein ART3
DLGRSATEDASPDYNSDAEGDRFHGGLSRSRWERACTQRVVDGSRTDRLARDWSRAWLIHHFITAKSAMNPDFNQPRGGRALGLMASGATCVQRLDGSRDSAIHTKYRISLRSSSMQEPRYPLPRVIDEEAGRTGRRGHPLPPDGIDNDPSAGSPTETLLRLLLPLNDKVQLDFSQRRGQRTAHVAAIRTLHRTIQSVGATGGVYHGQG

SEQ ID NO: 145287 - protein, 206 aa, Glycine max
  Coding DNA Sequence Number=SeqID_53602
DRARLIFGLVSRMDINIGALISSQMTSIAQSNSSRLGFPALIIALCRARGVVSDSLTFERLSLIINLTYIRKNCWNPDDLRVAIRGARRARARARPADLPSTSIAPTPPGAQPSLHREDEGPKTQVPQHVEDASSEATVLEPFIIEEEAGETKHAADPSTLILEIPEDPTTPVLTLNTSPPATPVLHLTDEEGVQTRDTQDESQEF

SEQ ID NO: 145288 - protein, 103 aa, Glycine max
  Coding DNA Sequence Number=SeqID_53603
  Subcellular localization annotation: CTP_CleavageSite=68; ConfidenceScore=5.34e-01
MACPLACVPKEPSWTSPSMLSASLAFTHQSKTMSWFLLYSMLPLKKKPAANLLNVLLSLLEASGLFAVSARTWTLKWQAHPPFDFPLEECDGRRSHQRTQPIP

SEQ ID NO: 145289 - protein, 79 aa, Glycine max
  Coding DNA Sequence Number=SeqID_53604
MSASDHAILRDRTHQPMKKSLIELSSHDALLAQNKLLAKQLEILTETLDKLPTKLSTLFCFAVTKVYSRRIFRLSVGSL

SEQ ID NO: 145290 - protein, 276 aa, Glycine max
  Coding DNA Sequence Number=SeqID_53605
  Subcellular localization annotation: CTP_CleavageSite=35; ConfidenceScore=5.45e-01
MDMNIGALISSQMTSIAQSNSSRLGFPALITALCRARGVVSNSLTFERLSPVINLAYIRKNCWNPDDLIVAIRGARRARARPADLPSTSAAPTLASTSATPLVPSQMDSQRFEAMLQSIHQGQIILLQSLQVVVPPGSIPSIEKFLKRVAWIGAQPSLHREDEGPTTQVPQHVEDASSVAIVPEPFIVEEEAGETQVIQEAVATPERSRKGTSDPPTPVVDLSSPQHTADPSTPILEISEDPTTPVLTLNTSPPTTPVLYLIDKEDVQTQDTQDQS

SEQ ID NO: 145291 - protein, 34 aa, Glycine max
  Coding DNA Sequence Number=SeqID_53606
MRGVRWPAGKREGFGRRGKIEIVRQRKLRSQSKN

SEQ ID NO: 145292 - protein, 70 aa, Glycine max
  Coding DNA Sequence Number=SeqID_53607
IVPARHPMDPKKSNKVLEGPSSNYGPLSVLRSVCRPQQGHQPPTNRAFIKKYYVPRRAQGETPQQPGDGR

SEQ ID NO: 145293 - protein, 119 aa, Glycine max
  Coding DNA Sequence Number=SeqID_53608
  Homolog annotation: Hit_ID=A0ST23; Match level="QueryCoverage=21%, HitCoverage=51%, E-value=3e-07, Identity=100%"; Hit description =Putative reverse transcriptase
MRGGNRRLRQSSATRASKSQQLTKIASDDQAYRYRRPRGGARYQLLFPLVRVNFELGVIMVIAVSFGKPVVPAALMNRPTRGERRFAYWALAECILAYYVGTDEGVSEVLHVAEKKGCT

SEQ ID NO: 145294 - protein, 24 aa, Glycine max
  Coding DNA Sequence Number=SeqID_53609
MEEKLACGASMEYGSLSFNVVLQW

SEQ ID NO: 145295 - protein, 113 aa, Glycine max
  Coding DNA Sequence Number=SeqID_53610
MAALDFPYTWWSGPIRNDLYSLRIRGNPLITVTTYPSAGGRRGAHRCVFQGRKACGVATNIYSRKTSKNWKGVVMQSYPARALDKRLQVNWARDPREGPRVLMSLKVDFEPMG

SEQ ID NO: 145296 - protein, 289 aa, Glycine max
  Coding DNA Sequence Number=SeqID_53611
  Homolog annotation: Hit_ID=Q6WAY4; Match level="QueryCoverage=79%, HitCoverage=41%, E-value=5e-07, Identity=24%"; Hit description =Putative uncharacterized protein
MGTRGCINYNPILAIRQLGYPMRGAPLEEDLTPIISRGFNTTNVEALQKVRKALEMVQKKDKELRGSSNGPIGGYHRWLKAYTQGLDWLPNLRTTKGVEENAELRDVNIATTKALEQETKRAHREDHGQNKFRGALWGSNSELKLWREERDQSRVDSLILKDELKVCLRSKRSLSQRLCETETNMLAIISKYQEELNLVTAHEHKAADENARVYAEKEARGRVVDSLHQEITMWMDRFALTLNGSQELPRLLAKAKAMADTYSAPEEIHRLLNYCQHMIDLMTYIIRNR

SEQ ID NO: 145297 - protein, 101 aa, Glycine max
  Coding DNA Sequence Number=SeqID_53612
MQLPQEPLNKRPRGLARKNMAVTNFTELCRVAIVNSSCKGKRGTSCEYIAWSKRSLSQRLCETETNMLAIIAKYQEELGLATAHELRVAGRVCPSIRGKRG

SEQ ID NO: 145298 - protein, 185 aa, Glycine max
  Coding DNA Sequence Number=SeqID_53613
MGQLQRQAFRKAYGKIWDLARVEVSMEPIASLSQYYDQPLRKPYLFSGFYPSTTRVAKVVKISAQELERLKQNRNGVVGVPRKFVLFPNMEGLVDLAAIDAFLAFHHGKESPVVAILAMYDTFDRGCPSIRYKVTARASKRERESRTSPIASQGQSSGGHLLRPRGDPRTSQLLSAYDRLNGPYD

SEQ ID NO: 145299 - protein, 29 aa, Glycine max
  Coding DNA Sequence Number=SeqID_53614
MDKVDIFVPHPLTNACLLIQLSPECNLRS

SEQ ID NO: 145300 - protein, 197 aa, Glycine max
  Coding DNA Sequence Number=SeqID_53615
LFVLQISKKNICTDNHSGISAHQRDSNVSMTDLVSVEDDYTEDDVSLCVLSGFSSYRHQKRIVYTDNHSGISARQRDSNVSMTDLVSAEDDTAKKNVYTDNHSGISARQRDSNVSMTELVSAEDDGAEDDVSLCVLSGLSSYRQQKRMFIRITTQGISARQRDSNVSMTDLVSAEDDVNLRVSTGFATVIDEGHRRQ

SEQ ID NO: 145301 - protein, 229 aa, Glycine max
  Coding DNA Sequence Number=SeqID_53616
MAPRKLASKRSRKDKAAEGTSSTLEYDSHRFRSAEHQQRFEAIKGWSFLRERRVQLKDDEYTDFHEEIVRRRWASLVTPMAKFDPDIVLEFYVNAWPTEESVRDMRSWVRGHWIPFDADAIGQFLGYPLVLEEGQQCEYGQRRNRSDGFDEEAIAHLLCIPGQDFSRTAAGRRVRIMRTNMITLTQIWMTLLLSNIQPSDHNSDLPLPKCQLVYAILTRMSISRGSVNR

SEQ ID NO: 145302 - protein, 82 aa, Glycine max
  Coding DNA Sequence Number=SeqID_53617
MWVSRERLLAYFRREEKEDNDFRQEDDKEKREDKKNQTRLLQRISNASRLIQDCFNKQSLVSRFTEDQALPQNKVFPRHARL

SEQ ID NO: 145303 - protein, 147 aa, Glycine max
  Coding DNA Sequence Number=SeqID_53618
  Gene Ontology: Mol. function=endonuclease activity
  Homolog annotation: Hit_ID=Q9AY32; Match level="QueryCoverage=40%, HitCoverage=90%, E-value=1e-14, Identity=71%"; Hit description=RRNA intron-encoded homing endonuclease
QSKSINEDPLEGKSGASSRARSWTLGWVDRSASGVHRSARPFCRGCGPVLNWPGGASGGDSDHIVLAFGIGVMINRDSRGHSYFIVRDTVLVSTINDADQGSADVAFRTPLAHSEKSKSLGSGGSMVARMKLKGIDGRAPPGVEHAA

SEQ ID NO: 145304 - protein, 141 aa, Glycine max
  Coding DNA Sequence Number=SeqID_53619
MTVTALGALYTSSASRPSRDGRFSGSDEYTDFQEEIGRQRWTSLVTPMAKFDPEIILEFYANAWPTEEGVRDMRSWVRGQWIPFDADAIGQLLGYPLVLEEGQECEYGQRRNRSDGFDEEAIAQLLCIPGQDFARTAAGRR

SEQ ID NO: 145305 - protein, 259 aa, Glycine max
  Coding DNA Sequence Number=SeqID_53620
  Pfam annotation: Domain name=Transposase_23; Domain location=114-184; Score=-3.2; E_value=0.0027; Accession=PF03017.5; Description =TNP1ENSPM transposase
MAEKTKKRLEEAAQSRSTEGVIDPPSPIGCHVKWKMARTKQIGQMTSEVPAGGVDHRKSDLVGNGILQPDAVPVLVLDAITGTCTASGARVGPLGARVNTKESCVDPLGNDPETGDSDKCRLYIEENHSCLVAQGRLYEGSTAVHNIPLLHGQVKVGVEEVKDVETPVPVPTNEVTLVGQTLNTFLAWPTHLTAVSPAKPPKSPDHEVEDPLYLMTLTIPQLFLKPLQVMWDASLFGLFNSDFPLYIKHEDLSEIAHDG

SEQ ID NO: 145306 - protein, 316 aa, Glycine max
  Coding DNA Sequence Number=SeqID_53621
GKDWLYYLAPRSITSWDDLKRVFLEKNFPASRTTAIRKDISGVHEVATNPSASSETKKLEGKLDALVNFGNPVSLESEILYLSQGFVVCASSADHHTDLCPSMQQPGAIEQPEAYAANITIDLLTFSSKINHSRAIYDLSSNRYNPGWRNHPNLRWSNPQQQQQQPAPSFQNAAGPSRPYIPPPIQQQQQPQKQPTVEAPPQPSLEELVRQMTMQNMQFQQETRASIQSLTNEMGQLATQLNQQQSHNSDKLPSQAVQNPKNVSAISLRSGKQCQGPQPVAPSSSANEPAKLHSIPEKGDDKNLPNNFCAGESSST

SEQ ID NO: 145307 - protein, 77 aa, Glycine max
  Coding DNA Sequence Number=SeqID_53622
MAPPLTSFPLSTATSPWWKIPLKDPIEAQRSNNLIFVEPNDDAQSKEDLDDDDGDGDGDESDDIHGDDPIRGLDMLL

SEQ ID NO: 145308 - protein, 244 aa, Glycine max
  Coding DNA Sequence Number=SeqID_53623
  Homolog annotation: Hit_ID=Q6UUU1; Match level="QueryCoverage=24%, HitCoverage=40%, E-value=3e-18, Identity=78%"; Hit description =Putative uncharacterized protein
  Subcellular localization annotation: CTP_CleavageSite=42; ConfidenceScore=5.16e-01
GTSYVPINVSFSPKVGPGLPAVPPVQLLTGWCVTAKAPPDISAGKCSGRVPFAIQAAQLLGRAIGAGLFAITPAGERGMCCKAIKLGRISNEEMRNPRLSAALHQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 145309 - protein, 84 aa, Glycine max
  Coding DNA Sequence Number=SeqID_53624
  Subcellular localization annotation: CTP_CleavageSite=51; ConfidenceScore=5.38e-01
MLQSCGIGTGLKEHSNWVTPKAYTPKSPSGPLPPNSGLSINSSSLKGLSINSSLLKGISINSSPLKDLSINSSLLKDISINSSP

SEQ ID NO: 145310 - protein, 135 aa, Glycine max
  Coding DNA Sequence Number=SeqID_53625
  Homolog annotation: Hit_ID=A5BRE5; Match level="QueryCoverage=81%, HitCoverage=26%, E-value=3e-07, Identity=29%"; Hit description =Putative uncharacterized protein
IPIGVNPKRKVVWDPIIRKFEARLNRAPKAVINRLSSIQRQFLWGGNREGKKIAWVSWRQCCVSRDVGDAWADDGIPLKDQFPELYRISSQRNLIVANMGSFSESGWEWNLLWRRNLFDNEMGIASKFIDQISAI

SEQ ID NO: 145311 - protein, 136 aa, Glycine max
  Coding DNA Sequence Number=SeqID_53626
  Gene Ontology: Mol. function=phosphoprotein phosphatase activity; Biological process=intracellular signaling cascade
  Homolog annotation: Hit_ID=A7R8Y3; Match level="QueryCoverage=85%, HitCoverage=34%, E-value=2e-22, Identity=42%"; Hit description =Chromosome undetermined scaffold_3090, whole genome shotgun sequence
MSNLGSKEDSFPSRKYTIGAQFVWEPYPSTVMSLLPPVCLVGSLAWYAVVPLICFQVIEWHQPDRALRQFGMQQPVPESPSQPLNIHGITLKGKHDENWGQLFAPMIQQWNNRHAFRVDAYPRQEGLLSFNSDYMV

SEQ ID NO: 145312 - protein, 164 aa, Glycine max
  Coding DNA Sequence Number=SeqID_53627
  Homolog annotation: Hit_ID=Q7Y2M3; Match level="QueryCoverage=28%, HitCoverage=55%, E-value=2e-19, Identity=93%"; Hit description =Putative uncharacterized protein
MVKVGTSYVPINVSFSPKVGPGLPGINRDTRIYLFCEVIFRHSCPSCSATDGVGFPSHDVVKRRPVNCNTTHYRANWSSTAVAAALELVDPPGCRNSIFPASVASAVLIRFIPLNQYQPGGEQWFQPCTGCVLPCAPETQQSSLSIPSTSRGGPVPAFVPFSEG

SEQ ID NO: 145313 - protein, 86 aa, Glycine max
  Coding DNA Sequence Number=SeqID_53628
  Subcellular localization annotation: CTP_CleavageSite=34; ConfidenceScore=5.12e-01
MWVQAIGLFAQATCAPKFGLPRPFNKRLLVLHVGGGAVKQRVKINRFFHSPLLQGCENKTTMDTLEAYTGAMKCTMHKPQVNLGAD

SEQ ID NO: 145314 - protein, 185 aa, Glycine max
  Coding DNA Sequence Number=SeqID_53629
KRGHNSGMTPVNRKAGTGERTREPPGGNAGIFIVLKFRPVGDKPLVLASPHDDRALFFHERFDWDTLAQCTQHSNRQYEHIRPLAPAGVIAKGPHSIARALAVIQLRSLTWFPEWKARPVAAAINAAGVEEQLMKPEATGAPRKTPSYTRIISLAASPEAHGIAPIRPVIPEASFEKKSGVLLKK

SEQ ID NO: 145315 - protein, 119 aa, Glycine max
  Coding DNA Sequence Number=SeqID_53630
  Subcellular localization annotation: CTP_CleavageSite=82; ConfidenceScore=5.21e-01
MDPRRTTRLHLHRATCPHLQRTSRPRLHRATCPHLQRTACPHLQRTTRPHLRRTTRLRLERATRPRHQRAARPNLQRVAHTRLQRVTSPHLQSTSRPRLHRATCPHLQRTACPHLQRTT

SEQ ID NO: 145316 - protein, 100 aa, Glycine max
  Coding DNA Sequence Number=SeqID_53631
  Subcellular localization annotation: CTP_CleavageSite=64; ConfidenceScore=5.41e-01
MVKVGTSYVPINVSFSPKVGPGKTNSRMQQGLRIFHSAKMIFRHRYSLFGQYRAPRLFPPVQLLTGMVPSIGKSIPTGHQRGKCKPVQYAELTTYMPVRA

SEQ ID NO: 145317 - protein, 70 aa, Glycine max
  Coding DNA Sequence Number=SeqID_53632
HGAVSTALGSLTGGQPPGADQFRVEVAWPEDWPEAQAGEAPTKAPGDADEARMEEEMTDLLGFLGGSGAT

SEQ ID NO: 145318 - protein, 565 aa, Glycine max
  Coding DNA Sequence Number=SeqID_53633
  Homolog annotation: Hit_ID=A5B5G7; Match level="QueryCoverage=35%, HitCoverage=14%, E-value=7e-11, Identity=27%"; Hit description =Putative uncharacterized protein
MDRQWPALKAGVRKTKAQQVKSAEGGVLIAEVQWAARSYVLSARPRAKRPGYITLSLARGLASADTRLAQLAELLPDRGARRNTRLASTDALSALMDFSERAKRALVALSACQKQRAGWRQARGWALGPPVLALCFLHPPSLLTSPLLMSSRKRRAVPTPGEASNWDSSRFTSEIAWHRYQDNIQLRNILPERNVELGPGIFDEFLQELRRCRWDQVLTHLPEKRIDVALVKEFYSNLYDPEDHNPRFCRVRGQVVRFDADTINDFLDTPVILEDGEEYPVYTRYLSTHPDPDTIAATLCTPGGRFVLNADGLPWKLLRKDMTTLAQTWSVLSYYDLAPTSHTSDVNLDRARLIYGLVSRMDMDVGSFISQQISQIAQSSTSRLGFPALITALCDIQGVVSDTLIFESLSPAINLAYVKKNCWNPADPSITFPGTRRTRTRASASASEAPLPTQPPSQPSQRPRPPHASTSASMDMHFQMLRSIHVGQQLIMENMHRLSLHLQMDPPLITPEAYRQQVAWSGDQPSTDRGEEPSGAAEDPAVDEDLIADLATADWGPWADLGGGS

SEQ ID NO: 145319 - protein, 22 aa, Glycine max
  Coding DNA Sequence Number=SeqID_53634
MTKARTRGEKKEKLATQLAQAS

SEQ ID NO: 145320 - protein, 72 aa, Glycine max; identical to SEQ ID NO: 107340
  Coding DNA Sequence Number=SeqID_53635
  Gene Ontology: Mol. function=protein binding
  Homolog annotation: Hit_ID=Q2HVB4; Match level="QueryCoverage=77%, HitCoverage=13%, E-value=9e-19, Identity=76%"; Hit description =BTB/POZ; MATH
  Pfam annotation: Domain name=BTB; Domain location=1-72; Score=-11.0; E_value=0.036; Accession=PF00651.22; Description=BTBPOZ domain

SEQ ID NO: 145321 - protein, 111 aa, Glycine max
  Coding DNA Sequence Number=SeqID_53636
MVKVGTSYVPINVSFSPKVGPGLPGINRDTRIYFVRCEVDTSDTVAYHGFYQLFPPVQLLTGWCVTAKATDRTSALASVAGADAARNHHTPLNCAATGLPVFPFDHSVPTV

SEQ ID NO: 145322 - protein, 172 aa, Glycine max
  Coding DNA Sequence Number=SeqID_53637
MKLCFYTKHPGRVRAVGANVTIKKYFGSAPQKSRSSSSLPPEELQQLTQQIRDQLEDSIIEKVTRQLMASFSQMQSQFQSQMQSQGLTLPPEPLVGPSGPSRNDPETGDSERSGLYIEANPTHLVALGKVYEGSTVVHNTPLLHVQVKVGMEEVKDPNAPVPVPTDEVSLMG

SEQ ID NO: 145323 - protein, 147 aa, Glycine max
  Coding DNA Sequence Number=SeqID_53638
MEEKKPKVNEIKTKAKKIRNELKVSDWKTYPLKNEERIKNGEERRKTFTDLLTETSRKHYGSTSAWIFFTETTFFTQKTSLRLFIRKRGRRLLPSSPRTLQIAQQCFFLASGMSRNFADYLTMNVKYLEAVKRRLHATKQWSSDEIR

SEQ ID NO: 145324 - protein, 171 aa, Glycine max
  Coding DNA Sequence Number=SeqID_53639
  Gene Ontology: Biological process=transposition, DNA-mediated
  Homolog annotation: Hit_ID=Q1J7G7; Match level="QueryCoverage=17%, HitCoverage=42%, E-value=3e-10, Identity=100%"; Hit description =Transposase
YIEQLTEMPQNVLYDAIGIYQRWYIPLEPLTCRSTSHFRQKVGPGLPGINRGHQDLFILRSDLPSQWLLFLSAVPPVQLLTGWCVTAKAPPDISAGKCSGHAARRVPFAIQAAQLLGRAIGAGLFAITPAGERGMCCKAIKLGNARVFPVTTLNSIAPQIRGAPNSLVEDA

SEQ ID NO: 145325 - protein, 179 aa, Glycine max
  Coding DNA Sequence Number=SeqID_53640
MASGNRLPKVGNLLQGLKVKTGSYGDLWLRNGIGMLKGPLVIDYQCCVIDYTEEQATEGAWETLEGNARCRFRGMIRFTATSLVHPDEPARTLQRTVEWILPTPTPYRLVEPVQVIEVTSSEEDPEEDSKELPPEPVMDALDFLVDDEDPLPEVDSPEDVMSASEADSMEDSGPGEMAI

SEQ ID NO: 145326 - protein, 133 aa, Glycine max
  Coding DNA Sequence Number=SeqID_53641
  Subcellular localization annotation: CTP_CleavageSite=18; ConfidenceScore=5.30e-01
MVSISCSSCSVLTGNWLSASQFGTQAYRPEHQRASVKPGVPDAAANSPFNSRLALNCAAFQSETLSPFAAFRMIANCCAKGDRVRAFAYYASGAKGRNTTHYRREFALSSYRSVVMRQRSEQWLTTGQEFDSG

SEQ ID NO: 145327 - protein, 71 aa, Glycine max
  Coding DNA Sequence Number=SeqID_53642
GQDHLGLPSGVETKHERQKPIKVLKDERKRGWGHDRPIVALLCAKQAGNVAARQPRILCILQLSSITSWLY

SEQ ID NO: 145328 - protein, 54 aa, Glycine max
  Coding DNA Sequence Number=SeqID_53643
MVFHLRLVMSFKTKKGEHRLKGAIKRINSSKKYQQESSQGYCPSNQWGKTHRIK

SEQ ID NO: 145329 - protein, 89 aa, Glycine max
  Coding DNA Sequence Number=SeqID_53644
  Subcellular localization annotation: CTP_CleavageSite=40; ConfidenceScore=5.02e-01
MATPLRSPPQSDGQSEATLKRSRTMTQLRTLTLRIVDQPRPAVYVDPAIGRASRPMREKFHSYLGVVAREKVPIIHKNWKDVPETLKEI

SEQ ID NO: 145330 - protein, 132 aa, Glycine max
  Coding DNA Sequence Number=SeqID_53645
MKNDGTYEFGDPTVMWLRMPSDSWVTHFVSNDHLEEALGFNKYRRKSLKVYQSAQCEVNKSPTHKILVGNQRERATLGRGQGLTFSPRVKVYDKLGFWLKACRTAGHDICQCLDSGSGIKGMPHIISMTHMQ

SEQ ID NO: 145331 - protein, 131 aa, Glycine max
  Coding DNA Sequence Number=SeqID_53646
MLLSSNVIYIRVRVVMLVRMIRTRLFVAARVKSCPGMHSSCVIASLSDCARTVGPPPISGGGPGTVQRKLLVWMWSTLKMRTRSPLKVRACSPLKARMCSPLEVRACSPLLARTCSPLQGEGMQPSVGEDV

SEQ ID NO: 145332 - protein, 164 aa, Glycine max
  Coding DNA Sequence Number=SeqID_53647
MVKVGTSYVPINCLIFPKVGPGLPGINREHQVFTFIPLTKLDRYRHLSGVSWFLSAVPPVQLLTGWSASQFHTTYRAGTSALASVAGGALSSSGNLSAAQLLNESANARAIECGLCVFPAALKGGCVILAITSWHCREFLAHELATLGRHAASAEMALQRGGIR

SEQ ID NO: 145333 - protein, 143 aa, Glycine max
  Coding DNA Sequence Number=SeqID_53648
MQDDAGHVCSPILEGEPPRQPDEVHEDHQEYAQGDAEFYPPIPVEGPTPNTLPQPNLTAQPIFLSTEGPPPATEERRKLDLLEERLRAVEGFGDYPFADMMNLCLVPDVVIPPKFKCPISTSIKGRLVLKPSQDVLSQDGGAL

SEQ ID NO: 145334 - protein, 70 aa, Glycine max
  Coding DNA Sequence Number=SeqID_53649
  Subcellular localization annotation: CTP_CleavageSite=38; ConfidenceScore=5.33e-01
MGYKKRMKTRIKIHETKCGPPRGRSLPPSSPRRAQLAQASKVASSRSNSLLEEGSGRPKWARLLFVPLFY

SEQ ID NO: 145335 - protein, 268 aa, Glycine max
  Coding DNA Sequence Number=SeqID_53650
MGDQEEVQEQMKADMSALKEKMASMMDAKLGMRQLMENNAATAAAVSSAAKVDPTLPATVHHLIPNVVGRERSTLGNINNPHSGYNRVAYPYGLPPNYTPPVIRDDAGHVPPPVLEGEPPRQSGEVHEDRLEHAQGDIDSYSPFPIDGPTPNALPQSNLTGEPRNPPTQPIFLSTRGPPPAAEEKRKLDLIEERLRAVESFGNYPFADMTDLCLVPDVVIPPKFNDVSSIGACRPRIFFINGFLCSLEDKWQRNGEGRERGDATSWRR

SEQ ID NO: 145336 - protein, 198 aa, Glycine max
  Coding DNA Sequence Number=SeqID_53651
  Homolog annotation: Hit_ID=Q6WAY4; Match level="QueryCoverage=84%, HitCoverage=30%, E-value=8e-20, Identity=36%"; Hit description =Putative uncharacterized protein
MGTNQNGKRFYQVKIKGLNVTSLKELGWLMGPLQRQAFRKVYGKILDLTTAEVFTEAIVSLAQYYDQSLRCFTFGDFQIVLTVEEFEESLGCPLGRRKPYLFSGFLPSLSKIAAVVGDSARELDCMKQTRNGIVGLPQKYLEGKARDMANQEEWVPFVDILALLIFGVVLFPNMDGLVDLAAIDAFLAYITIARRAQW

SEQ ID NO: 145337 - protein, 93 aa, Glycine max
  Coding DNA Sequence Number=SeqID_53652
MSGFTHDSPQISASPHQLDLAPYASGPYNAQWNAPGLLHDKHTLRSSRILGEMETDFVVDLGMAFVDNWVAGKEKEWQSQHGLLPHFHPLHLP

SEQ ID NO: 145338 - protein, 43 aa, Glycine max
  Coding DNA Sequence Number=SeqID_53653
MACTHIPVKVEYAKMRFQPASIRPCTLRFRALQCSMECPGASP

SEQ ID NO: 145339 - protein, 143 aa, Glycine max
  Coding DNA Sequence Number=SeqID_53654
EEHGRNNFRGVLWGSNNELKIRRDERDQSGVEGMILKDELKACLRSKRNLSQQLSETEGNMLAIIGKYREELNLAVAQENRLVDDYAKVLAEKEARGKVIDSLHGEAMMWMDRFDFTSLCSKQWQKSTQPLMKFTSSSTIVNT

SEQ ID NO: 145340 - protein, 102 aa, Glycine max
  Coding DNA Sequence Number=SeqID_53655
MEERERKIFRPDKFSAGLPFKVVLDWRYPTPPEQRGKDRNTQLPLQKTLPSRKSYWSVIVKKPGGPFGPANKPLFPEPHECHCLALFMCPPPSSLELCFMIA

SEQ ID NO: 145341 - protein, 211 aa, Glycine max
  Coding DNA Sequence Number=SeqID_53656
MKREKHASYSSHNSCKSLSEELHDYYEGRHRSHLRPHYHRRENERKPQEANINLPYFHGKDNVEAYLDWEISVEQKLERKSTLKSYGSHSYTKGHITSQCPTKKSMIMRSQDIYSSQDEATTSPSSNENEEAKGEESSEEIYPQEEGQPLMVKEECKEVSVSSKRLAKKERHFEIKTNITEISPLRQHPHFLLCKKTLVSIAKPLGLEFIP

SEQ ID NO: 145342 - protein, 372 aa, Glycine max
  Coding DNA Sequence Number=SeqID_53657
  Gene Ontology: Mol. function=4-(cytidine 5'-diphospho)-2-C-methyl-D -erythritol kinase activity; Biological process=isoprenoid biosynthetic process
  Homolog annotation: Hit_ID=A6WW89; Match level="QueryCoverage=77%, HitCoverage=100%, E-value=1e-115, Identity=74%"; Hit description=4 -diphosphocytidyl-2C-methyl-D-erythritol kinase
  Pfam annotation: Domain name=GHMP_kinases_C; Domain location=264-353; Score=34.7; E_value=3.5e-07; Accession=PF08544.4; Description=GHMP kinases C terminal
  Pfam annotation: Domain name=GHMP_kinases_N; Domain location=166-224; Score=62.7; E_value=1.2e-15; Accession=PF00288.17; Description=GHMP kinases N terminal domain
  Pfam module annotation: Pfam domain module=GHMP_kinases_C::GHMP _kinases_N; Domain location=264-353::166-224
MPQLIFLLLIIAAAWYGYRSFKREASRVSQRVRQAEKEAQNRAHGTLRCDRRVFSCHGPPAEMTLFPKTETHAHAGSAPAVTRLAPAKINLALHVTGRRADGYHLLDMLVVFARFGDIIRIEPAEVDSFTVCGPFATGIPLDGGNLVLKAREALRQQTQRALPPVAIHLEKNLPIASGIGGGSSDAAATLLALDELWGLDLGFEKLAAIGLDLGADLPMCLHGASKGTPLAARGIGEDLTPVAGFPALPMLLVNDGTAVATPDVFRALEKRDHPTLALASHPDIGPLCAYLQTTRNDLLSPALKLAPRIGDKLELLRQSGSLYAQMSGSGATCYAIYEDIAATERVAEHLSTERPDWFVVATQSVPSPKNNF

SEQ ID NO: 145343 - protein, 178 aa, Glycine max
  Coding DNA Sequence Number=SeqID_53658
  Subcellular localization annotation: CTP_CleavageSite=51; ConfidenceScore=5.22e-01
LEALACADQRPFSPKVVAQGSIPSFNNTRIFYRVISKLDRSVTSRFWEGPVSQLYDSLCSDGVNFELSGVSWFLSAVLPVQRELTHHHPCLALHAPLHRETLSAIAAFRMNRQRREGHRVRALRIPAGAKGRSVHTGDYYVGTDARVEGLELVGGDFPRKLQERYYSGSERPGFFQLA

SEQ ID NO: 145344 - protein, 159 aa, Glycine max
  Coding DNA Sequence Number=SeqID_53659
MVEEFEEILGCPLGGRKPYLFSGFYPSLARISKKGPNLGAGIRPPKASRKWGGRNTEKIFGAIDVFLTYHNHKESPVVAMLADLYDTFDRRCEESNARIVCCTPRRGCINYNLVLAIRQLGYPMRGAPLDESITPFITRGFSDHNARVLQGVRKACDAA

SEQ ID NO: 145345 - protein, 275 aa, Glycine max
  Coding DNA Sequence Number=SeqID_53660
PEEDEEGQALKNELGKVKLAKEKFKLAATHIRKECAELREENATTARALEQETKRARKEEYGRNKFHGALWGSNNELKLRREERDQSRAQSMVLKEELVACSRFKRSLSQRLCETETNMLAIIAKYQEELSLATAHEHRVANEYAQVYAEKEARGRVIDSLHQEATMWMDRFALTLNGSQELPRLLAKAKAMADTYSAPEEIHGLLGYWKNTISKRATRHPYRTRSKSRTMGDQEETQEQMKADMSALKEQMASMMEAMLGMRQLMEKNVATATA

SEQ ID NO: 145346 - protein, 185 aa, Glycine max
  Coding DNA Sequence Number=SeqID_53661
MVKVGTSYVPINVSFSPKVGPGLPGINRDTRIYLFWKCLPSQVSAYSAQTVPPVQLLTGWCVTAKAPPDISAGKCSGHAARRVPFAIQGCATVGKGDRCGPFAIDASWRKGMCCKAIKLGNARVFPVTTLANWSSTAVAAALELVDTGYIPPGCRNSSCGRSTAALADNGLRTGRRFPGRCQEDT

SEQ ID NO: 145347 - protein, 90 aa, Glycine max
  Coding DNA Sequence Number=SeqID_53662
MEHLLRHCEKVAVGPYSRDARALAHEVIDTISAGVPPEQLILPWMSVKEGLPDANSGRYVCAYTPAKSQDRRYQLVSAAMFRTVCRDATH

SEQ ID NO: 145348 - protein, 74 aa, Glycine max
  Coding DNA Sequence Number=SeqID_53663
  Subcellular localization annotation: CTP_CleavageSite=42; ConfidenceScore=5.01e-01
LPEVTKANSGRSASGNYFRRPSSGIGLLNFRKTSSGSDNGILPEEASSGNIPDDVLPEIVCEYFRKTQIILPEE

SEQ ID NO: 145349 - protein, 112 aa, Glycine max
  Coding DNA Sequence Number=SeqID_53664
MQRRSTIGDLIPINVEINVTCRRRNAERITNFLQDLEAATTPEEEPRSSVAPSSFPIPRQCHTYLIEKVIMVEEPRRVTLEDYSSSSVPQFFSSIARPEVQAQTITYPPSLI

SEQ ID NO: 145350 - protein, 278 aa, Glycine max
  Coding DNA Sequence Number=SeqID_53665
  Homolog annotation: Hit_ID=Q2AA09; Match level="QueryCoverage=51%, HitCoverage=50%, E-value=8e-08, Identity=31%"; Hit description =Retrotransposon gag protein
MERSMIDAASGGALGDMIPAEARNLIEKMAYNSQQLSARNDAIVIRGVHEVSTNSSASSETKKLEGKLDALVNLVTQLTLNQKSVPVARVCGLCSSADHHTDLCPSMKQPGAIEQPEAYAANIYNRHSQPQYNPGWRNHPNLRWSSPQQQQQQPAPSFQNDVGPCRPYIPPPIQQHQQPQKHQTVEAPPQPSLEELQCQGPQPVAPSASANKPAQLHSTPEKGDDKNLPNNLCAGESSTGNSDLQKQHIPLPFPPRAVSNKKMEEAEKEILETFRKVQ

SEQ ID NO: 145351 - protein, 189 aa, Glycine max
  Coding DNA Sequence Number=SeqID_53666
MVKVGTSYVPINVSFRQKLAQGFPVLINRDTNYYPCRSMFCNTVAYHGFYQLSSCSATDGDGVSAHNSAHKHTDRTSALASVAGGALSHSDLSGCATAYESANARAIECGLSLFARALKGGCAHTGDYYVGYTDARTTIGPRIPRSELATLGRHAASGNGLEQGRNSPGRLQEFDRSTMGMKGRGKLFP

SEQ ID NO: 145352 - protein, 111 aa, Glycine max
  Coding DNA Sequence Number=SeqID_53667
  Subcellular localization annotation: CTP_CleavageSite=40; ConfidenceScore=5.22e-01
MVHDISVKVKLEVIGTLTALNVFGSRRSNDVTRSIFCPNFCKMVTSMLQLDSMNLFVKARAWLNPITQGMAILIANTSSTIHMDERLGNMDAMHGKCNYEIEMPEETSFLN

SEQ ID NO: 145353 - protein, 51 aa, Glycine max
  Coding DNA Sequence Number=SeqID_53668
MTEIVCAEDYVNLRVSTGLLAAIDKGMTEIVCAEDDVNLRVSTGLLAAIDK

SEQ ID NO: 145354 - protein, 39 aa, Glycine max
  Coding DNA Sequence Number=SeqID_53669
MASERTWMPYVLLEQVRNQPYIKSGQETDDPCATLLAPS

SEQ ID NO: 145355 - protein, 50 aa, Glycine max
  Coding DNA Sequence Number=SeqID_53670
MQRGMFQQKAVPSGGSNPACLGELGGIHLPLFPYKYGKEGRTNSFNPPDI

SEQ ID NO: 145356 - protein, 180 aa, Glycine max
  Coding DNA Sequence Number=SeqID_53671
  Gene Ontology: Mol. function=hydrolase activity; Cellular component =intracellular
  Homolog annotation: Hit_ID=A4W7S8; Match level="QueryCoverage=100%, HitCoverage=49%, E-value=5e-88, Identity=84%"; Hit description=Beta -lactamase domain protein precursor
MKKTLFICVVFVMIIASAASLPFVLNAGFGQPPQGAQLTEVEASPHYYEGKFHNTLPTPGFTGQQNMLVAWWQFLTRKTENARPAQPLPLVKTDLASLPLEQDTLVWLGHSSWYLQLAGKRILIDPVLGNYAAPFSFLNKAFAGEYPWRAASMPEIDLLIISHDHYDHLDYATIRALLPK

SEQ ID NO: 145357 - protein, 47 aa, Glycine max
  Coding DNA Sequence Number=SeqID_53672
MALRFDALELQVDMQFDEMDSRITKVERDVSYIHTCFDLPLPLPPST

SEQ ID NO: 145358 - protein, 130 aa, Glycine max
  Coding DNA Sequence Number=SeqID_53673
  Gene Ontology: Mol. function=citrate CoA-transferase activity; Cellular component=citrate lyase complex; Biological process=acetyl -CoA metabolic process
  Homolog annotation: Hit_ID=A8GGM8; Match level="QueryCoverage=100%, HitCoverage=26%, E-value=1e-28, Identity=56%"; Hit description =Citrate lyase, alpha subunit
MNRQQRLMTFANPADLPGYQDVSKANLQARKPRDLKLCDSLQEAVRRSGLQDGMTISFPMRFAAGSGAQSGDGDAGGDGVPQPDAGVQLADRLPWPLVEHIRHGVVSRIYTSGLRGPLADAVSRGLLAEP

SEQ ID NO: 145359 - protein, 283 aa, Glycine max
  Coding DNA Sequence Number=SeqID_53674
  Gene Ontology: Mol. function=nucleoside-triphosphatase activity; Cellular component=chloroplast
  Homolog annotation: Hit_ID=Q2PMM5; Match level="QueryCoverage=100%, HitCoverage=15%, E-value=1e-100, Identity=96%"; Hit description =Protein ycf2
MNSIGPKNDTLEESSESSNINRLIVPLLYLPKGKKISESYFLDPKESTRVLPITKKYIMPESNWGSRWWRNWIGKKSDSSCKISNETIAGIEISFKEKDIKYLEFLFVYYMDDPIRKDHDWEFFDRLSPRKRRNIINLNSGQLFEILVKDWIYYLMFAFREKIPKEVEGFFKQQGTGIGFLARYGMYHQNIQYDSTRSSFIQVTGSSQLKGSSDQSKDYFDSIRNEDSKYHTLINQREIQQLKERSILCWDPSFLQTERTEIESERFPKILSGYSSMSRLFMD

SEQ ID NO: 145360 - protein, 123 aa, Glycine max
  Coding DNA Sequence Number=SeqID_53675
GGGAYGKTALPRPSHFPVKYLPGIFQEISAPFPFVLSACHTRWKLQLHDTLISAKSYSKPVFTAVVLAPNVRAGKPPSPALDRFNLMQPCSTIPQVSPDWRNSEGSEPAPIAHSQCAVSVSLH

SEQ ID NO: 145361 - protein, 144 aa, Glycine max
  Coding DNA Sequence Number=SeqID_53676
  Gene Ontology: Mol. function=phosphoprotein phosphatase activity; Biological process=intracellular signaling cascade
  Homolog annotation: Hit_ID=A7PHV0; Match level="QueryCoverage=94%, HitCoverage=42%, E-value=2e-22, Identity=35%"; Hit description =Chromosome chr13 scaffold_17, whole genome shotgun sequence
MWAWERCTTLAPKRTPPIMENKPLGHRWLRRGNQHIGNDDLIVFRRKLDMMKRHEFVWEPYPTTVMSMLPPICLVGSVAWCAVVPLICFHVVEWHQPDRVLRQFGMQQPIPESPSQSQNIHGLTLKGKQDENWFQLLAPLSVSG

SEQ ID NO: 145362 - protein, 239 aa, Glycine max
  Coding DNA Sequence Number=SeqID_53677
  Gene Ontology: Mol. function=UDP-N-acetylglucosamine 2-epimerase activity; Cellular component=cytoplasm; Biological process=UDP-N -acetylglucosamine metabolic process
  Homolog annotation: Hit_ID=A4WG25; Match level="QueryCoverage=100%, HitCoverage=63%, E-value=1e-118, Identity=88%"; Hit description=UDP -N-Acetylglucosamine 2-epimerase precursor
  Pfam annotation: Domain name=Epimerase_2; Domain location=6-239; Score=229.3; E_value=8.7e-66; Accession=PF02350.10; Description=UDP -N-acetylglucosamine 2-epimerase
MAPLVHALASDPDIEAKVCVTAQHREMLDQVLTLFSIVPDYDLNIMKPGQGLTEITCRILQELKPIQESFKPDVVMVHGDITTTVATSLAAFYQRIPVGHVEAGMRTGNLYLPWPEEVNRTLTGHRAMYHFAPTENSRQNLLRENIADNKIFVTGNTVIDALIWVRDRVLANRELQEDLGARYPFLHNGKKTILVTGHRRESFGRGFEQICHALAEIAAQNEDVQIVYPVHLNPNVSEP

SEQ ID NO: 145363 - protein, 164 aa, Glycine max
  Coding DNA Sequence Number=SeqID_53678
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=31%, HitCoverage=50%, E-value=5e-24, Identity=100%"; Hit description=LacZ protein
METPEIEPRKISRNSNGHNFSQGGASYIETLEIEVRKLSRSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 145364 - protein, 117 aa, Glycine max
  Coding DNA Sequence Number=SeqID_53679
MSRKFTDYASIPSLTSRMLRNFTDCAIIFPFDSRHVTKLHGLTNNGCQVPRSGHAKVASHQPDGPRTKLGYDKVQCGEEDRGTSTIGLPRQGLHNSREEHGNHGKDIPLNMHGDVAA

SEQ ID NO: 145365 - protein, 136 aa, Glycine max
  Coding DNA Sequence Number=SeqID_53680
MQALCQLKSPGSSLAREDGQNVGHSPYKWSRIGSSTCIQHYCWGTQQTVKWRNCPSKILLPEKVFSENFRKKVFRKVSEKKLLPEEEFMTSESTRKYFRKNVIRKFLEEPSSEISIGGPVKYLEIRWSRVPYLKFC

SEQ ID NO: 145366 - protein, 284 aa, Glycine max
  Coding DNA Sequence Number=SeqID_53681
  Gene Ontology: Mol. function=protein kinase activity; Cellular component=integral to membrane; Biological process=protein amino acid phosphorylation
  Homolog annotation: Hit_ID=A7PEW8; Match level="QueryCoverage=32%, HitCoverage=13%, E-value=7e-28, Identity=73%"; Hit description =Chromosome chr11 scaffold_13, whole genome shotgun sequence
MIQRVSSSLLKPAKREGALGIRECLESQGHHSTLSPMTKKDLILGYMGDGCLFTLSKGCDSLSIWNLFISQGIQPIHESLSFGHVLMHNDFIRSLKLLYLSTLTLNQQTCLQPWIRRNRCGLCSRLGVVAAVAVSEVAVETTSEVAEVGGGCASCHAGGGGDVVVEGGYNRGFGGGGEEQAHDLLRASMEVLGKGSVGTSYKAVLEEGTTVVVKRPKDVVVTKKEFEMQMKVLGKIKHENVVLLKAFYFSKDEKLLVYDYMSAGSLSALLHGTMLLKSLIHLSV

SEQ ID NO: 145367 - protein, 136 aa, Glycine max
  Coding DNA Sequence Number=SeqID_53682
PERVLRQFGYIQTIPPPPVTGLLSYKDIDDWWMHFRDHVALTGEICVVLGQENDEPKQPAAPDVDAYVEPHVSEVPVVADLPRHSVVVKRSQKGWSVCSTLGWSLQEQSYMRSWKIACGSLGVTPMEVLGRDVHNA

SEQ ID NO: 145368 - protein, 112 aa, Glycine max
  Coding DNA Sequence Number=SeqID_53683
MTDNGRTGWKAGCAEEERTHGRERKKFLKCWVHEKTKACGSNAFQGYFDDAKESRVKQSFKQRFKNQVSSFMIQESRITKIKIQDSRLKIQESREDSIKISIKMFFKILSST

SEQ ID NO: 145369 - protein, 252 aa, Glycine max
  Coding DNA Sequence Number=SeqID_53684
MAMSELSEYDGNHALSARFVLSAPLGFLVGLLCTKRELVANREDTLSLSFRSFNDAPTSSPPPIEVRPSPSHVDAHGPSPVLTFTPSPSPDVASMPIDEDVPNLAMEDPFLTSMIVLWLHLSMEQFEARLSQARSDVASSVGESQLTPLDPVEEQRLRTQCWVATVGPKSRNQMTPLPEMEDKLERKGCLYGTGDLAHSYKCGDDNFMQRTQGSSSHAQDSAEINRLREKLHQSKEEMHVFISVSRPSVPTS

SEQ ID NO: 145370 - protein, 343 aa, Glycine max
  Coding DNA Sequence Number=SeqID_53685
  Homolog annotation: Hit_ID=A7QI81; Match level="QueryCoverage=65%, HitCoverage=79%, E-value=9e-82, Identity=63%"; Hit description =Chromosome chr17 scaffold_101, whole genome shotgun sequence
MGRDLDEHGAAFLKHGETSQSLSLSDIFTLKDGSVTPVLKPANPPVRANVLYLSTEFSVPIAEAVKNVFNPYFDKAEASSVEAVVATLCPLKIVLDRVVLTSTGVLLGCWQVTSGTDPITIRAKLKNALPHAPEKQLYDAAILHTSFARLLGPPKALSPSEQLRMSDDVQFFHDLVDRLNSQIHGFKAVVSELWYVEEYDVLALALNGRMNTRKFRLRSCPSKKDQRKLPRRVHKAERDKMKREHLNELSWSCRCTSMSNDQDTPPTNLNLESPYYLHSSDNPGQTLVSDVLTGSSSAVGINNQGNVLENLSVGIGTIAVNFEKISNMMEKREKDRDRDRELE

SEQ ID NO: 145371 - protein, 214 aa, Glycine max
  Coding DNA Sequence Number=SeqID_53686
  Homolog annotation: Hit_ID=A7PZ91; Match level="QueryCoverage=97%, HitCoverage=36%, E-value=3e-84, Identity=65%"; Hit description =Chromosome chr15 scaffold_40, whole genome shotgun sequence
  Pfam annotation: Domain name=DUF1446; Domain location=29-214; Score =74.4; E_value=3.8e-19; Accession=PF07287.2; Description=Protein of unknown function (DUF1446)
MEPQDEEEIHNCLIKLRSNPERRRDKVYIGCGAGFGGDNPLAALKLLQRVQELNYLVLECFAERTLADHYQIMMSGGDGYDSQMDPLGAQQKVLEIANSLGLNVSVAVAHEVFVTNIVGSGFSPAKSYIMEGGINTYLGAAPIVPCLEKYQPNVIITSRIADAALFLAPMVYELGWNWDELEHLAQGSLAGHLLECCCQLTGGYFMHPACSLNS

SEQ ID NO: 145372 - protein, 377 aa, Glycine max
  Coding DNA Sequence Number=SeqID_53687
  Gene Ontology: Mol. function=catalytic activity; Cellular component =nucleus; Biological process=regulation of transcription
  Homolog annotation: Hit_ID=A7QI82; Match level="QueryCoverage=87%, HitCoverage=88%, E-value=3e-37, Identity=56%"; Hit description =Chromosome chr17 scaffold_101, whole genome shotgun sequence
  Pfam annotation: Domain name=TCP; Domain location=69-239; Score =167.9; E_value=2.7e-47; Accession=PF03634.4; Description=TCP family transcription factor
MEGGSDDFHYHHHLHNHNHHRQNFPFQLLEKKEDPQDPSSCSTSSPYPSLAISAEPSTSNNNNQLLPTPSSEPSPKKPPPKRTSTKDRHTKVDGRGRRIRMPALCAARVFQLTRELGHKSDGETIEWLLQQAEPSVIAATGTGTIPANFTSLNISLRSSGSSMSVPSQLRSSYFHNSSFSLQPRRSLFLENTNTNTPNTTTTTLLNFQSNNNNNPIFQIQPKHELRESSSLDLSSENNNNNEEALLSGTIPASHHAQIPANIWMLANSNSHHNQGGGVSVSGGEAPPLWTFPGGVSNSALYRGTMSSGLHFMNFPTPMALLPGQQLGSSGIGGNMNEGHLNMLSGLNPYRTTVIGVSESQASESQQSHHGGSEDQHE

SEQ ID NO: 145373 - protein, 83 aa, Glycine max
  Coding DNA Sequence Number=SeqID_53688
MEKRNKRLLSKLAAGVSLSEACALSENHALSEALSPLSDLRESRRESEKHLCTQHIISSLSETFVSSGAKRAQLAQRIFTNSS

SEQ ID NO: 145374 - protein, 97 aa, Glycine max
  Coding DNA Sequence Number=SeqID_53689
  Homolog annotation: Hit_ID=Q3ECJ1; Match level="QueryCoverage=62%, HitCoverage=54%, E-value=1e-13, Identity=58%"; Hit description =Uncharacterized protein At1g63855.2
MKEKDWNDDNLTMTIVSQHCFGDDSEAPSFSISIIENMKDEYGLFLWPCSVVLTEYVWQHNHRFSEASVVEVLELPCLAWLQQNSMPVSLLPMTSPD

SEQ ID NO: 145375 - protein, 248 aa, Glycine max
  Coding DNA Sequence Number=SeqID_53690
  Gene Ontology: Mol. function=voltage-gated anion channel activity; Cellular component=mitochondrial outer membrane; Biological process =anion transport
  Homolog annotation: Hit_ID=A7QI50; Match level="QueryCoverage=100%, HitCoverage=79%, E-value=1e-39, Identity=35%"; Hit description =Chromosome chr17 scaffold_101, whole genome shotgun sequence
  Pfam annotation: Domain name=Porin_3; Domain location=4-242; Score =30.6; E_value=1.4e-08; Accession=PF01459.13; Description=Eukaryotic porin
MSQGPGLYFDIGKKARDVLHKGYAQQPPIHFNYRFLNWNLDLSCQEELVHGLRGLFTCNIPDSGKLEIQHFSRFSGFSASIGLSGEAEKGYNPVANISGHIGTRILTLGANLACDLSGSSSARTTNNLNAGLSLNSPYLVAAATLHDNFQTLKGSCYFEVNPLTKTAIAAEVKYDLADDETTGVTVGAQHALFSWTLLKARLNNNGKVGGLIQQKFGTKFSITVAGEINLNEKAKEKFPKVGVSMALK

SEQ ID NO: 145376 - protein, 236 aa, Glycine max
  Coding DNA Sequence Number=SeqID_53691
  Homolog annotation: Hit_ID=A2Y842; Match level="QueryCoverage=37%, HitCoverage=28%, E-value=9e-09, Identity=35%"; Hit description =Putative uncharacterized protein
  Pfam annotation: Domain name=HSP20; Domain location=35-129; Score =17.4; E_value=7.4e-05; Accession=PF00011.12; Description=Hsp20alpha crystallin family
MASEAAGITRRDGTRTTSAAAAAAAVVEEIVPNSGWTDDHSSHFLLVDLPEFRKEEVTLQVDGSDGRIIVKGERQTNEQKRIHFELAFPLPPDSDVDNISGNFDSEILHVHVPKRASHQEHRESGHEIERASNNGSVGRPQEIVSEEHEVVNEGRDHGHYQHEEDRDKKEERRNENAQYMDNGYSKKLTRKLEQKRDMSRALVEVLMRNKGVVTTAVVAFSFGLYVSNKFHSWNEP

SEQ ID NO: 145377 - protein, 48 aa, Glycine max
  Coding DNA Sequence Number=SeqID_53692
  Pfam annotation: Domain name=ZF-HD_dimer; Domain location=4-37; Score= 30.4; E_value=5.2e-06; Accession=PF04770.3; Description=ZF-HD protein dimerisation region
MILEFMASTGEGAGGALTCAACGCHRNFHRREVNTEVVCEYSPPNSGR

SEQ ID NO: 145378 - protein, 189 aa, Glycine max
  Coding DNA Sequence Number=SeqID_53693
  Gene Ontology: Mol. function=metal ion binding
  Homolog annotation: Hit_ID=A7PDM1; Match level="QueryCoverage=98%, HitCoverage=72%, E-value=3e-23, Identity=36%"; Hit description =Chromosome chr17 scaffold_12, whole genome shotgun sequence
  Pfam annotation: Domain name=zf-C3HC4; Domain location=65-115; Score =13.9; E_value=0.0024; Accession=PF00097.16; Description=Zinc finger, C3HC4 type (RING finger)
MGEHVVLSVLDSLIAPATLQPQHDGDGDALGSLIEGATHVNDVGECDTLEEEEEEEEDLIKMVECRICQEDDTLQNLDIPCACSGTLKEFCVDFLVAVYGVGPFKPGYTANSPVCHPGDTSIDISDDWATTRNPLDLHNARLLAIAAVDYQVPETEHEDYVNAGTGGTTLWHSVVSDAVLLGMLLILGK

SEQ ID NO: 145379 - protein, 590 aa, Glycine max
  Coding DNA Sequence Number=SeqID_53694
  Gene Ontology: Mol. function=helicase activity; Biological process =viral genome replication
  Homolog annotation: Hit_ID=Q9LX60; Match level="QueryCoverage=99%, HitCoverage=39%, E-value=1e-124, Identity=36%"; Hit description =Putative uncharacterized protein F4M19_60
MARDKVQSSLVCDLKLKLISDKQSDGRLYNLPNTIEVVALIVGEEHTGNKRDIIIERQSGSLKRINELHPTYLPLQYPLLYPKGEDDYRPNILHKARPNSHVAKRKKVTMREYFCFRMQSRDNKAQTIMHSRRLFQQWIVDGYTMIESQALNYVRQHQQELRVDKYINLNVCNNGPETHGNDKGKRIILPSSFVGSRRYMEQLYFDGMAICGHIGFPDMFLTLTFVYTIEWQKRGLPHAHILIFLHPSNKYPNPKDIDNIIFAEIPNKDTHPELYELVSKHMIHGLCGLPNKRAPCMLDGKCIRFFPKKIQQATIVDNDGFLVYRRRNNGHMVEKNGIELDNQFVVSYSPHLLLKYRAHLNVKWCNQSTSIKYMFKYINKGSDRITAAIVCITTRGMLEDICILNACTCTRVERLYFQLENQQVVYWKDTEQIGSVLSKKTVKESMFTAWMDSNQRYPQGRDLTYAQYLSIFVYVARRRCWQPRKQGYTIGRLIWIPTSTGDFFYLRMMLSSAKGPQSYKDIRTVENMVYGTFREACFAKGFLGNDQEFIGALREANTWGFAHFLRKLFVKLLFMNTMDRPQYVWEQTWQ

SEQ ID NO: 145380 - protein, 142 aa, Glycine max
  Coding DNA Sequence Number=SeqID_53695
MPQTKLPPPPPLYVLCRTATVLNFHCYHLGRLHHHCSVSTAVKIMVRTIDLGFASDRVIGRALGREDNRDSGEALQRRRPTTFAHRQKEAVAEDVHHVDDTQLRRSSNSLKKQLLMPKECLELKLSSHGRKAQKFDKPAAEI

SEQ ID NO: 145381 - protein, 120 aa, Glycine max
  Coding DNA Sequence Number=SeqID_53696
  Gene Ontology: Mol. function=RNA-directed DNA polymerase activity; Biological process=RNA-dependent DNA replication
  Homolog annotation: Hit_ID=Q2HSQ4; Match level="QueryCoverage=41%, HitCoverage=52%, E-value=1e-12, Identity=66%"; Hit description=RNA -directed DNA polymerase ; Zinc finger, CCHC-type; Peptidase aspartic, catalytic, putative
METSLIKAQIEESQEAIMTRFLHGLNREIQDIVELHHYVSLEDLIHQAIKDITNASSSSSSSESGSECDVQSLEGDLLMLVVDRQVLICFFIGKYVDKILFNVVPMEVDHLLLGSPWQYD

SEQ ID NO: 145382 - protein, 604 aa, Glycine max
  Coding DNA Sequence Number=SeqID_53697
  Gene Ontology: Mol. function=sequence-specific DNA binding; Cellular component=nucleus; Biological process=regulation of transcription, DNA-dependent
  Homolog annotation: Hit_ID=A7QI61; Match level="QueryCoverage=83%, HitCoverage=95%, E-value=3e-92, Identity=44%"; Hit description =Chromosome chr17 scaffold_101, whole genome shotgun sequence
  Pfam annotation: Domain name=WRKY; Domain location=239-299; Score =134.8; E_value=2.5e-37; Accession=PF03106.6; Description=WRKY DNA -binding domain
MEFGSERSGHEVKDEKRSESSVGDEEDRREQEIVTQEPPLSTTERSTVEAGPNASSLTKKEEAVDELEVAKAEMGEVMEENQRLKTCLNRILNDYRALQMQFHNIVEQETKDSSDQKVNNNNDQYQIDESNLVSLSLGRLPTRNNNKVPNNKPLKEEAEKEDKEGLSLGLDCKFETSKSGISTTEYLPIHQSPNNSVEEVPKEEAAGESWQPGKGIKTARDATGEDEVSQQNPAKKARMNDGCQWRKYGQKISKGNPCPRAYYRCTVAPSCPVRKQVQRCAQDMSILFTTYEGNHNHPLPLSATAMASTTSAAASMLLSGSSTSHSGTRPSTAMTTADLHGMNFFLSDGSKLSKQYYLSHPAALSSSPSHPTITLDLTSNNNPSSSSSAALVKFTSNSNYNNTQRYPLSTSLNFSSSESNNATTSWSNNGFLSYNNTLPYNSNRNVTNVLSNINLGRQQQQPMENIYNSYMQRNNNVPISPPQHSLPDTIAAATKVITADPNFQSALAAALTTIIGSGSTTQGNHGGAGENLSQKMKWGELFPSSSSALPSSSTKVNGCASSFLNKSAANTQPGTALMFLQPPLPLSSPKSASGSPGDHIDKRN

SEQ ID NO: 145383 - protein, 358 aa, Glycine max
  Coding DNA Sequence Number=SeqID_53698
  Gene Ontology: Mol. function=carbohydrate binding; Cellular component= cytoplasm; Biological process=carbohydrate metabolic process
  Homolog annotation: Hit_ID=Q8LFH1; Match level="QueryCoverage=91%, HitCoverage=91%, E-value=1e-121, Identity=60%"; Hit description =Aldose 1-epimerase-like protein
  Pfam annotation: Domain name=Aldose_epim; Domain location=32-354; Score=395.2; E_value=1e-115; Accession=PF01263.11; Description =Aldose 1-epimerase
MVFYVMFKVYRVSSFLLWLLLLAQAHGNDKIGFYQLKRGNLHLNLTNYGASVISVFVPDKHGNLGDITLGYDDIEQYKNDSWYFGATIGRVANRIGHAQFTLDGHTYKLPANDHGNTLHGGFTGFSDVVWTVKSHKEDDHVTFTYDSYDHEQGFPGRLEVSVTYMVIGTNKYSVKMIAKPIDKATPVNLAHHTYWNLKGHNGGDILSHEVQIFGSKITPVDKKLIPTGKFESVKGTPYDFLEPREVGSRINDLPGLYDMNYVLDASSPNHFRKVLIVREKVSGRKLELWSNQIGLQFYTGGMLNATKGKDGAIYHKHGGMALETQGFPDAVNHSNFPSQIVRPGETYKHYMVYRFTAS

SEQ ID NO: 145384 - protein, 301 aa, Glycine max
  Coding DNA Sequence Number=SeqID_53699
  Gene Ontology: Mol. function=aspartic-type endopeptidase activity; Cellular component=integral to membrane; Biological process =cytochrome complex assembly
  Homolog annotation: Hit_ID=Q945B8; Match level="QueryCoverage=73%, HitCoverage=34%, E-value=7e-64, Identity=57%"; Hit description =Growth-on protein GRO10
  Pfam annotation: Domain name=MtN3_slv; Domain location=189-301; Score= 0.5; E_value=0.0039; Accession=PF03083.7; Description=MtN3saliva family
MWQLCRGIDENAIRACAQFVFAVRKLFYFSKLLYKMVCEPDETDLNMHIPAVMLPLDAVSVQLHSPLRPAVDVAEVFLWMMAVLTILCASYWSAWTTREAAIEQDKLLKDASDELPNTKYASVSGVVNMNVKAAVLFVVFASCFLFMLYKLMSSWFIDVLVVLFCIGGIEGLQTCLVALLSRWSNAVDGAFCFHIPGILYFSFIFLRRFYHTKPKDQDALIPSTLENHVTRWFKHAGESYIKVPFLGAISLEYMPFLLSFFFFLNGGVWLLYVVLVRDVILGVPNGTGFLLGAMQLVLYAI

SEQ ID NO: 145385 - protein, 40 aa, Glycine max
  Coding DNA Sequence Number=SeqID_53700
MEDCLEALGNNIHGAPKSGEWRIALRVRTKAIMIHSSKLE

SEQ ID NO: 145386 - protein, 74 aa, Glycine max
  Coding DNA Sequence Number=SeqID_53701
  Homolog annotation: Hit_ID=Q6WAY3; Match level="QueryCoverage=98%, HitCoverage=3%, E-value=3e-07, Identity=35%"; Hit description =Gag/pol polyprotein
MNPVKRIENQAEDEDEDLGFPPDLERMVAWEDREMKPHQEETEIENLGVGDEKKDVKVGMGMTTPVQDELVVLL

SEQ ID NO: 145387 - protein, 230 aa, Glycine max
  Coding DNA Sequence Number=SeqID_53702
MGEVKGVKEQIKANMEAMKEQMTTMIEAMKEQMTTMIEAMMSMKKIMKANAVAVAATSVVAKVNPTPSPGLNQMNHPTSDMVGKDLGSTGNPHYVQIQNKHAFPPYGLPPKYTPPNVAYTPREMHEIPHHNLADFKPCLGYATEGQAVGGIPLQNTLERPQFCPQPQPLYGKMVGYTPSSFADLVFSGERIKVGLERGKSDHPALMNAKNRANEEGENEGETYAATSIPT

SEQ ID NO: 145388 - protein, 153 aa, Glycine max
  Coding DNA Sequence Number=SeqID_53703
  Homolog annotation: Hit_ID=A5C6F5; Match level="QueryCoverage=53%, HitCoverage=7%, E-value=9e-09, Identity=42%"; Hit description =Putative uncharacterized protein
MELNHQWDEFPSKVVPDLLGRPASMIKNCRRRLNQVTKKDHFPLPFIDRCLNAWQEIPHSPAPSDFMLIGGSFRPVQCLLGIEKPSPSTTVQPTTPELKPLPSNLKYAYLDDSKSFPVIISVSLADEQEEKLLSVLKKHKKAYRLDLGGHSWY

SEQ ID NO: 145389 - protein, 68 aa, Glycine max
  Coding DNA Sequence Number=SeqID_53704
MVAEWRRKRHRRRHFKEKMSLEEAHNHRTTYGTKFFKIWHQSSFPIPYMATHKQGNKETCNNQRKKMK

SEQ ID NO: 145390 - protein, 53 aa, Glycine max
  Coding DNA Sequence Number=SeqID_53705
MGEYQQLSLRTILILRPKTGKRWNTQMRIVEYLVAVGKEEEVELQENPTSYLT

SEQ ID NO: 145391 - protein, 91 aa, Glycine max
  Coding DNA Sequence Number=SeqID_53706
MGVQIATRPTWALQKIPPERLLLLEEATLLAWASWALLSLSNLLGKIVSVKKIQAEALPKRFCNVSVRNFAKVLTVLRRSSFVLHRSSIFN

SEQ ID NO: 145392 - protein, 84 aa, Glycine max
  Coding DNA Sequence Number=SeqID_53707
MITADDAITDAPKFFILPQWTSPRLVDSLYNLEILRAEISHKERRKALFRWRSPHEMNGSGMEKEEREETPLQGEDESRRSSPP

SEQ ID NO: 145393 - protein, 235 aa, Glycine max
  Coding DNA Sequence Number=SeqID_53708
ENAATARALEQETKRARKEEHGREKFRGALWGSNNELKLRREERDRSRVHGMILKEELAACARSKKSLAQHLETMEQSMLAIIGQYKEELNQSVTHEQKLVEDFAQVYAEKEARGRVIDALHQEATMWMDRFALTLNGSQDLPRLLAKAKSMAEADLSALKDQMASISEVMLKLQKTIEDKATTTASSKVREAKPVLQPALIRAETETRQCLVEGIAEAYPYGLPPDFTCHPGKI

SEQ ID NO: 145394 - protein, 151 aa, Glycine max
  Coding DNA Sequence Number=SeqID_53709
GENINPCPQKKTQKEGKFPIKETEKAKKKGNSQSKEREKTKRENSQSKSGRKRKKRERKFSIKDRKKTEEIYRKVFGPDNIWTNTELPPSKHKKKGNHDLKWSSPFDCQPKSCASVTCSPRAKQKQKRKRPKTLKAKFPTKKNPIPKKKSY

SEQ ID NO: 145395 - protein, 49 aa, Glycine max
  Coding DNA Sequence Number=SeqID_53710
  Homolog annotation: Hit_ID=A5AV98; Match level="QueryCoverage=100%, HitCoverage=8%, E-value=3e-08, Identity=53%"; Hit description =Putative uncharacterized protein
MDALEIYYYEVKRQLDINVKIIRYDRGGPFAKLLQKRGICAQYTMSDTP

SEQ ID NO: 145396 - protein, 130 aa, Glycine max
  Coding DNA Sequence Number=SeqID_53711
METCSAVRDLLQWMIDQGRLKVGSERKEEQHVYMQSADEEGPKKPKPLVIHFTRNTAPQRPQHPSVVSGGRSILFPYENSRTVPWRYAPPCGRKEEATDINLLSAKVTNITGLSGITRSGRVFAPPSLPI

SEQ ID NO: 145397 - protein, 150 aa, Glycine max
  Coding DNA Sequence Number=SeqID_53712
  Homolog annotation: Hit_ID=Q6UUU1; Match level="QueryCoverage=48%, HitCoverage=50%, E-value=2e-18, Identity=67%"; Hit description =Putative uncharacterized protein
MVVMGWGQWLTPVIPALWEAEAHGSKLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCASGNGLRTGRRFLEDARKILNR

SEQ ID NO: 145398 - protein, 263 aa, Glycine max
  Coding DNA Sequence Number=SeqID_53713
  Gene Ontology: Mol. function=ligase activity, forming aminoacyl-tRNA and related compounds; Cellular component=cytoplasm; Biological process=tRNA aminoacylation for protein translation
  Homolog annotation: Hit_ID=A7FHG1; Match level="QueryCoverage=100%, HitCoverage=40%, E-value=1e-135, Identity=87%"; Hit description =Threonyl-tRNA synthetase
  Pfam annotation: Domain name=TGS; Domain location=2-61; Score=58.0; E_ value=3.2e-14; Accession=PF02824.12; Description=TGS domain
  Pfam annotation: Domain name=tRNA_SAD; Domain location=170-219; Score= 87.9; E_value=3.3e-23; Accession=PF07973.5; Description=Threonyl and Alanyl tRNA synthetase se
  Pfam module annotation: Pfam domain module=TGS::tRNA_SAD; Domain location=2-61::170-219
MPVITLPDGSQRVFDRPVSVMDIALDIGPGLAKACIAGRVNGELVDAVDPITSDAQVAIITAKDEAGLEIIRHSCAHLLGHAIKQLWPNTKMAIGPVIDNGFYYDVDLDHTLTQEDLELLEKRMHQLAETNYDVVKKKVSWQEARDVFAARGESYKTTILDENISHDDRPGLYHHEEYIDMCRGPHVPNMRFCHHFKLQKISGAYWRGNSDNKMLQRIYGTAWADKKQLAAYLQRLEEAAKRDHRKIGKQLDLYHMQEEAPGM

SEQ ID NO: 145399 - protein, 143 aa, Glycine max
  Coding DNA Sequence Number=SeqID_53714
MTIRYLRLPPDSLSLDDKRCRRRCQFLRVNGLVCPWLTKGAVKKRGADDHNLSLRVNGLACLWLTKGAGPYGSPACHRTRRLWMTKVQMTTLVSACQRARLPLVDKRCGTLWFPRMSSDSPSLDDNVRDLMVPPHVIGLAVSG

SEQ ID NO: 145400 - protein, 217 aa, Glycine max
  Coding DNA Sequence Number=SeqID_53715
  Gene Ontology: Mol. function=methyltransferase activity
  Homolog annotation: Hit_ID=Q2NRD4; Match level="QueryCoverage=76%, HitCoverage=57%, E-value=2e-13, Identity=27%"; Hit description =Putative uncharacterized protein
MALAQFILCLQHVNFDLHNRFAEVERFYDALLTELQSGKSLMDSGNLARSNAMKYLALSVMGTNVAKDSARDGFILEGHQHIAAYLDIAGSDDPADLEAKFDKINQQWRTLCEDSCLSEPYVLRNYLLYKLYSSYFPGKNTATIMRQFYRMVLDFFYVKCILSVKSMQGEIDQQVVMKTIASLSEKTMHNSTIDARMDFAINKINGGDDLSCLLLIG

SEQ ID NO: 145401 - protein, 74 aa, Glycine max
  Coding DNA Sequence Number=SeqID_53716
  Homolog annotation: Hit_ID=Q2NWQ2; Match level="QueryCoverage=100%, HitCoverage=46%, E-value=1e-22, Identity=66%"; Hit description =Putative uncharacterized protein
DGGADIRGSVDIQDREGSIEIIGLSHGINLPVDSANGKITGTRQHSSMVIEKEVDSSTPYLYKAAATGQTMKSA

SEQ ID NO: 145402 - protein, 148 aa, Glycine max
  Coding DNA Sequence Number=SeqID_53717
HQPTKKILLELSSQDVVLAQNKLLSKQLEALIETLSCTICGGAHEFGHCIPCEEQTQEVSYMGNQQRQGNNQGGFSGFLQGSYNQQGKWRSHRGNQFNKDQAKQLAEKSSNSFGANTKKNPKEECNVVMTRNKKHVVVEDEDTMALKE

SEQ ID NO: 145403 - protein, 82 aa, Glycine max
  Coding DNA Sequence Number=SeqID_53718
  Subcellular localization annotation: CTP_CleavageSite=9; ConfidenceScore=5.11e-01
GGGAAQLAQASQVASSRSTAFWRNILEGPSGPGGGSEEEKGSAPLALLSLSNLLGKIVSNFAKVSTVLRRSSFVLHRSSIFN

SEQ ID NO: 145404 - protein, 155 aa, Glycine max
  Coding DNA Sequence Number=SeqID_53719
MIEVSVEVVASLAQYYDQSLRCFTYGDFQLVPTIEEFEGILRCSLGGRKPYLFFGFYPTMARVAKAAKALADQREWTSFIDVLALLVFGIVLFPNVDGLVDLAMIDAFLAYHHSKENPVIAVLADAYDTFDLRCKKSSHHMCAEKGKVNWEELLA

SEQ ID NO: 145405 - protein, 77 aa, Glycine max
  Coding DNA Sequence Number=SeqID_53720
  Gene Ontology: Mol. function=aspartic-type endopeptidase activity; Biological process=RNA-dependent DNA replication
  Homolog annotation: Hit_ID=Q6VPE6; Match level="QueryCoverage=98%, HitCoverage=20%, E-value=7e-09, Identity=41%"; Hit description =Putative integrase
VLERINNNAFRLKLPEEYRVSNTFNITDFVPFADVVDSDDAGPADLRKNPLQEGGDDVTLPRRGPITRAMARRLQED

SEQ ID NO: 145406 - protein, 138 aa, Glycine max
  Coding DNA Sequence Number=SeqID_53721
  Gene Ontology: Biological process=transposition, DNA-mediated
  Homolog annotation: Hit_ID=Q1J7G7; Match level="QueryCoverage=29%, HitCoverage=71%, E-value=2e-12, Identity=74%"; Hit description =Transposase
MVKVGTSYVPINVSYSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPEFDVISGYTPQVGLAEHFK

SEQ ID NO: 145407 - protein, 334 aa, Glycine max
  Coding DNA Sequence Number=SeqID_53722
  Homolog annotation: Hit_ID=A3UTN1; Match level="QueryCoverage=36%, HitCoverage=39%, E-value=9e-15, Identity=35%"; Hit description =Putative uncharacterized protein
MDGRIERDVKFKKVEEDVKRGLCVVLGDKLYAVSYRLYAVSYKQEAEARCLRHKAHTVSDKLYAVSYKQEAETRCMWHKAHTLSDKLYAVSYKQEAETRCMWHKAHTLSDKLYAYVLTDASPVMDALVRNEGERDILLLLTGLIGERHAELESTETPNTWRISAEEGSEGIVRQVFRAWTTTEDLPVPLREARRNFYRRLKYYPKVTGVIFRWYGAEPEEGEERTIVRKEFARWLTPDPVVSDPEAVIDLIAPVLKGGKFAWKGLYQGEVIEFNLKDNAFRETIRKREIEFVSGMALKGVLTQRSVLEKVTEVLILDETLKKRKKYVNPKREQN

SEQ ID NO: 145408 - protein, 114 aa, Glycine max
  Coding DNA Sequence Number=SeqID_53723
  Homolog annotation: Hit_ID=Q1J7G7; Match level="QueryCoverage=29%, HitCoverage=47%, E-value=7e-09, Identity=88%"; Hit description =Transposase
MVKVGTSYVPINVSFSPKVGPGLPGINRDTRIYLFCEVLQWLLFLSAVPPVQLLTGWCVNGKKPPPDISAGKAAQLLGRAIGAGLFAITPAGERGMCCKAIKLGNARVFPVTTL

SEQ ID NO: 145409 - protein, 82 aa, Glycine max
  Coding DNA Sequence Number=SeqID_53724
MGETHEMPHHNLADFEPCLGYATEGQAAGGLGPFEGGEDYAFANLEELFLVPNIITPPRFKVSDFDKHKGTTCPKNHLEMCC

SEQ ID NO: 145410 - protein, 144 aa, Glycine max
  Coding DNA Sequence Number=SeqID_53725
ESEKAKGEEFSEEIYPQEEGQPLVVKEKCKEALASIATPLGLEFIPQVKKLLDEGLVCKSLNPCALLVPKIGGPMNPKRIKVIPEWPTPPTPLIELVRNHVPSWEDAQEMGVEGRSPEYEEPWDLRSNPFQGGGNDAILSRKGI

SEQ ID NO: 145411 - protein, 142 aa, Glycine max
  Coding DNA Sequence Number=SeqID_53726
MHKALRANAPLPYPHLITLFLRHFQIPLDDEPFVQVKHSFAIGAGVVTSFGYRKDRNGQWLKKNALPTQDERTPSPPPQHEDSALLNEVLTELRGLRSYVGERFESLDTRFVGMDIRLAQVEEDVSFIRTCFDPPPLPPSSS

SEQ ID NO: 145412 - protein, 42 aa, Glycine max
  Coding DNA Sequence Number=SeqID_53727
MKQFTDTLISANIGTIQGTRPPQSGAGSNQAQQAIHRAPDKI

SEQ ID NO: 145413 - protein, 268 aa, Glycine max
  Coding DNA Sequence Number=SeqID_53728
  Homolog annotation: Hit_ID=A5BY33; Match level="QueryCoverage=58%, HitCoverage=9%, E-value=6e-08, Identity=26%"; Hit description =Putative uncharacterized protein
MEFFSAETFDCIQAFQNLGLIPFMSLQLPVYPKLVKAFYCNLEIQDNTLISEVFGIKMVIDQSLFHDLTQLSSDGVPFEGILNDDWKFDFSAHDARQLVCTNNADMTGRLLAGSLAFESRILHYLIVRILLPLSSNLAQVSEEDLVIMWAFHTGRQLDWAHLRSFLIGAAVIASFGYRKDHDGSWVKKGAQPADEEGNLPVEDNSTLLRRLMDKFDGLQTFVGDKFDAMELQVDIRFDAMESRITKVEEDVSFIRTCFDPPPPPPSSS

SEQ ID NO: 145414 - protein, 75 aa, Glycine max
  Coding DNA Sequence Number=SeqID_53729
  Subcellular localization annotation: CTP_CleavageSite=59; ConfidenceScore=5.85e-01
MARTRSPMKVRRCSPLMARTCSPLKARTSSPLMARTRSPLKVRVCSPLMVRTCSSMGCVSSREMRTSRMQGCLVL

SEQ ID NO: 145415 - protein, 86 aa, Glycine max
  Coding DNA Sequence Number=SeqID_53730
MVGYTPSSFTDLVFASKKIEVGLKRGKFNHPAWTNEKTGANEEGLRSSSSMDSFASWKINGSGMEKEEREETPLQGEDESRRSSPP

SEQ ID NO: 145416 - protein, 314 aa, Glycine max
  Coding DNA Sequence Number=SeqID_53731
MAPRKLSLKRSRRDTAAKGTSAATEFDSHQEGQECEFSQRRNRADVFDEEAIAQLLCIPGQDFARTAAGRQVRIMRTSITTLTQMWMTLLLSNVLPSDHNFNLPLPKCQLVYAILTRMSIHVAQLIADAIYLFAGMPPTRHPLDLDKSKRALGFPALITSLCQSFGVPVTPSKVIWPPITQAFIEKYCTPRQVQGDAPQAADAPPPPHQADPAGSLGMERYLQHLVRQQAANHRGQVQIHECLYQLSLSQQGQGFAPFACPTPDQFRVEVAWPGDWPEDQTEEAPTGAPDDAEDACMDEEMTDLLGFLGGSGAT

SEQ ID NO: 145417 - protein, 61 aa, Glycine max
  Coding DNA Sequence Number=SeqID_53732
MTPSQQYYGPIPTPNAPSGTQWNKKRGGIGAEEILIAKHEDGIDHVAHPHDITDTKMNDLH

SEQ ID NO: 145418 - protein, 44 aa, Glycine max
  Coding DNA Sequence Number=SeqID_53733
MAETSQGRDERKRGWGHDRPIVALLFAKQAGNVAAGQPRILSIL

SEQ ID NO: 145419 - protein, 68 aa, Glycine max
  Coding DNA Sequence Number=SeqID_53734
MWTTTGEKLAAQLAQASKVASSRSNSLLEGPSGPAFEEVTETYGLRKNTSFRLPPHYGISRIAQACFL

SEQ ID NO: 145420 - protein, 289 aa, Glycine max
  Coding DNA Sequence Number=SeqID_53735
  Gene Ontology: Biological process=transposition, DNA-mediated
  Homolog annotation: Hit_ID=Q6UUU1; Match level="QueryCoverage=20%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGIRSQPSPAHPHHMYFQSHHEHHEGAIVIAKKRRYCDQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 145421 - protein, 74 aa, Glycine max
  Coding DNA Sequence Number=SeqID_53736
  Homolog annotation: Hit_ID=A5B7I7; Match level="QueryCoverage=47%, HitCoverage=4%, E-value=9e-12, Identity=88%"; Hit description =Putative uncharacterized protein
MKNKLKILKNLCFMSQYLCGDLQEKGEEHEENNGMMEDDPINFHQAMQGSNSEKWIEAMNEEYKSMQDNKVWRD

SEQ ID NO: 145422 - protein, 182 aa, Glycine max
  Coding DNA Sequence Number=SeqID_53737
  Pfam annotation: Domain name=zf-CCHC; Domain location=95-112; Score =25.2; E_value=0.00023; Accession=PF00098.14; Description=Zinc knuckle
MSLATHFGKLQEHEMELMRLHQHEENDKKNKGISLRALSSSIQEESDKEDLNEIEEDDDFKFFVKRFNKFMRNKRNKNKSNINPKKKGKDSSLAPKCYECNQPGHMRFDCLVFKRRMKKSDKRNFKEKKEKKAYITWQDNDMDSSCGSENEIIYLCLMVKDYESGEEMHSMICIKNLSNLPN

SEQ ID NO: 145423 - protein, 99 aa, Glycine max
  Coding DNA Sequence Number=SeqID_53738
  Subcellular localization annotation: CTP_CleavageSite=51; ConfidenceScore=5.09e-01
MIKRQTAPLSSLQNGQVTKSNRIYTLREFSERFAKDSVATYPLAGGRRVTRGMRVPRKEYARSRHQRLFEENVGKTGKDAIYELFSERFGSCIYARGRY

SEQ ID NO: 145424 - protein, 102 aa, Glycine max
  Coding DNA Sequence Number=SeqID_53739
METTTKGENVNHASFDDVKVESNKVASTNIQRLIIASRLIQGCFNKNSNKHCFKINSRSSKQDQEKIRPQTISLVYQAFTSKHIVSNTQGSSNRLPGSVIDY

SEQ ID NO: 145425 - protein, 59 aa, Glycine max
  Coding DNA Sequence Number=SeqID_53740
MKKQQWKRSGRQRRRGEGRHHPLGNKPWKKELHHQECALDKKLEEDALMEENIERGGAG

SEQ ID NO: 145426 - protein, 103 aa, Glycine max
  Coding DNA Sequence Number=SeqID_53741
MEACLAVEDLLQQMIDQGRLEVGDEGGEEQHICMQSVDEEGLRKPKPLVIYFTRDVAPQTTRYPSVVRRILFPYQNSHTVPWRYARPSERKEEATDISSLSAK

SEQ ID NO: 145427 - protein, 368 aa, Glycine max
  Coding DNA Sequence Number=SeqID_53742
  Homolog annotation: Hit_ID=Q6WAY6; Match level="QueryCoverage=91%, HitCoverage=60%, E-value=3e-31, Identity=30%"; Hit description =Putative uncharacterized protein
MGTNQNSKRFYQVKVKSLDVTSLKELGRLMGALQRQAFCKVYRKILDLTAAQVFTEAVVSLAQYYDQPLRYFTFGDFQMVPTIEEFEEILGCPLGGRKPYLFSGFLPSLSKIAAVVGDSAKEARQGIWRAKRSGARLRIFSFVDFWGCPLSNVDGLVDLAAIDAFLAYHHSKKSPVVAILADLFDTFDRRCEKNSARIVCCLPALCVWLASHLFQQDTRHRCPLQSYRSCAEKGRVDWDQHLAGIGGNAINWFPRWKEGKEGVLFSCGDYPNVPLIGTRGCINYNPALAIRQLGYPMRGAPTEESLSPFLVRDLGAQSLKVIQRVHKAWRSPLRKDKELRGIRNGVIDGYHGWLRVHTRGLDWLSKLK

SEQ ID NO: 145428 - protein, 215 aa, Glycine max
  Coding DNA Sequence Number=SeqID_53743
MARAGDNGGVYHQLDESQRLFLDAWTTQMQRLLNRNKEEPYRRIVKSSSFTLKPLSPREMSFPRRFLMDCHLQEASLPNKPTYNSKPQETQHKDAQVKVEYVKRLYDQVKVQIAKKNESYTKQANKKKEGSGNDENHETGQIEAKGPSGEGRRPKWRRTKAQVEKDKAPEWRRTYQGNPCGVYPDLSSFIGSGVYPDLSSFTGSGVYPDLSSFTG

SEQ ID NO: 145429 - protein, 245 aa, Glycine max
  Coding DNA Sequence Number=SeqID_53744
  Gene Ontology: Biological process=transposition, DNA-mediated
  Homolog annotation: Hit_ID=Q6UUU1; Match level="QueryCoverage=24%, HitCoverage=40%, E-value=3e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTGKTIRYQAFPPGGSLVRSPVPAFRFT

SEQ ID NO: 145430 - protein, 120 aa, Glycine max
  Coding DNA Sequence Number=SeqID_53745
MAKFDLEVVLEFYANAWPTEEGVRDMCSWVRGQWIPFDTDALSQFLGDPLVLEEGQECEFSQRRNKADGFDEEAIAQLLCTPGQDFTRTAAGRRVRIMRTNMTTLTQIWMTLLLSNVLPS

SEQ ID NO: 145431 - protein, 117 aa, Glycine max
  Coding DNA Sequence Number=SeqID_53746
  Homolog annotation: Hit_ID=Q6WAY6; Match level="QueryCoverage=58%, HitCoverage=12%, E-value=6e-08, Identity=42%"; Hit description =Putative uncharacterized protein
MSVYPTRFLPLAKRTVRIWVTPAFYSWLAWGIVFGLPSLGKPEESRFYLLNAKDVTNVTLMGTRGCINYNPVLAIRQLGYPMRGAPLDESITPFIARGFSDHNARVLQGVRKAWDAA

SEQ ID NO: 145432 - protein, 68 aa, Glycine max
  Coding DNA Sequence Number=SeqID_53747
MVSEGWVTGNRLPDEPARTLQRTVEWILPTPPPYRLVEPVQVIEVTSSEEDPEEDLEELPPEPTVECP

SEQ ID NO: 145433 - protein, 68 aa, Glycine max
  Coding DNA Sequence Number=SeqID_53748
MHEEIQALEANSTWTLVPLPPVDVPSTRTDPQEMYPLLFSVNNPSRCTLYLYHKGCTLQCVKTKISGC

SEQ ID NO: 145434 - protein, 158 aa, Glycine max
  Coding DNA Sequence Number=SeqID_53749
MTPRKLASKRSRKDKAAEETSSAPKYDSHRFRSAEHQQRFEAIKGWSFLWERRVQLRDNEYTDFQEEIVHRRWASLVTPMAKFDPDIVLEFYANAWPTEEGVRDMRSWVRGQWIPFDADALCQFLGYPLVLEEGQECEYGQRRNRADGFYEEAIAQLL

SEQ ID NO: 145435 - protein, 68 aa, Glycine max
  Coding DNA Sequence Number=SeqID_53750
MEIRMDKSYNLFDPFIGAHNVRQCIMCHIQQQEGTNMVDMSSGGVDPPQPHSHDSSGKGAVAKKRRYV

SEQ ID NO: 145436 - protein, 115 aa, Glycine max
  Coding DNA Sequence Number=SeqID_53751
MVMGDPISRLSFPVEKTPRLFQVSQSYLELRRSEFLIGGYVGARALLLSTAPPFAVMTQELVTRGDTLRLSVPRHSVTPSVIDEQRPVWSFAPFPEMSTSSGRDFFKSHKLSRTT

SEQ ID NO: 145437 - protein, 29 aa, Glycine max
  Coding DNA Sequence Number=SeqID_53752
MDKSLKVGEDEWRERERERGGHEFYASNE

SEQ ID NO: 145438 - protein, 303 aa, Glycine max
  Coding DNA Sequence Number=SeqID_53753
  Gene Ontology: Cellular component=mitochondrion
  Homolog annotation: Hit_ID=A5AFX7; Match level="QueryCoverage=27%, HitCoverage=48%, E-value=3e-12, Identity=43%"; Hit description =Putative uncharacterized protein
TPRARAAIHNRDDDVSTSISTARAWATIAIRVGQCPESIGGPALTSFSSFPRGTCSLSVSRQYLALDGIYRPIGAAFPNNPTRRQRLVGTWARSATEDASPDYNSDAEGERFSWWAFPGSLAVTKGILVSFVVARIDKLKLSGTDRLARDWSRAWLIHHFITAKSAMNPDFNQPRGGRALGLMASGATCVQRLDGSRDSAIHTQVSHFATFFIDARAEISVAESHCIAGVCVCREDEEAGRTGRRGHPLPPDGSVDFSQRRGQRTAHVAAIRTLHRTIQSVGATGGVYKGQGRSQRELMTRAY

SEQ ID NO: 145439 - protein, 279 aa, Glycine max
  Coding DNA Sequence Number=SeqID_53754
  Gene Ontology: Biological process=transposition, DNA-mediated
  Homolog annotation: Hit_ID=Q6UUU1; Match level="QueryCoverage=21%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPVTTLANWSSTAVAAALELVDPPGCRNSIPTGGSTGSECGIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 145440 - protein, 123 aa, Glycine max
  Coding DNA Sequence Number=SeqID_53755
  Subcellular localization annotation: CTP_CleavageSite=15; ConfidenceScore=5.04e-01
MHPHLERTTRPRLLRAAHPRLKRTTLPPLKRTTRPLLERVSMHVAQLFLMSSTVCRDHARKTPSGPGEVQQGPGVSSSDYESLPFLRSSHRPQQGHQAPINRAFIEKYCAPRQAQGEANRGRT

SEQ ID NO: 145441 - protein, 86 aa, Glycine max
  Coding DNA Sequence Number=SeqID_53756
  Subcellular localization annotation: CTP_CleavageSite=73; ConfidenceScore=5.73e-01
MAESSKKRKGSSASASASRAHRFGATSASTAPIPPSLSSSTLFSSEEQQKRYSNLFSSRSIIDPKFIDMEFFSAETFDCLPAFQNL

SEQ ID NO: 145442 - protein, 234 aa, Glycine max
  Coding DNA Sequence Number=SeqID_53757
  Homolog annotation: Hit_ID=A7UQU7; Match level="QueryCoverage=46%, HitCoverage=18%, E-value=5e-17, Identity=44%"; Hit description=IMP dehydrogenase/GMP reductase, putative
CWIYEHFSSVAESTADQDYDEASPRACRWIVTKKTVKSICMPSYREHLNRLRIPDVCWIPYGEHREVRDFHVRSCYSGLLRWGHVAVYYRPERVVRQFGYTQTIPAPPVDHGSRMMIYTTGEVCVVPGACSSDYIDWFFRISHPFMTPGHAVDPLPHGHAPQPRVVPQAPQTDIPHEVCDDIAERLEHHLSLGVLTPGSSTHEVIEECLRLARSVTQDHLVYVRCRRRRRTDQA

SEQ ID NO: 145443 - protein, 100 aa, Glycine max
  Coding DNA Sequence Number=SeqID_53758
MGVQIAARPTWGPPEDSSRRAVASGGSHLARLGELGGKHLPHFPINRGRSEEEFRSALMKSEPRRFRNASVTFPWGFSRRFSAVLRHSLFVLHRSSVFNR

SEQ ID NO: 145444 - protein, 111 aa, Glycine max
  Coding DNA Sequence Number=SeqID_53759
MILHENRRPNSLKIVPSGVIDCRNLPFGGKAMWGSRARLPRKEGARSRHQRLFEENVRKTGKVDKGVSLAPTYSSIAMRKSDLRSSFRTKRWLSCFYLSPRKIYSNRTKVV

SEQ ID NO: 145445 - protein, 157 aa, Glycine max
  Coding DNA Sequence Number=SeqID_53760
  Gene Ontology: Mol. function=peptide-aspartate beta-dioxygenase activity; Cellular component=integral to endoplasmic reticulum membrane; Biological process=peptidyl-amino acid modification
  Homolog annotation: Hit_ID=A8GGQ6; Match level="QueryCoverage=100%, HitCoverage=69%, E-value=1e-71, Identity=85%"; Hit description =Aspartyl/Asparaginyl beta-hydroxylase
  Pfam annotation: Domain name=Asp_Arg_Hydrox; Domain location=37-157; Score=-16.9; E_value=0.00011; Accession=PF05118.6; Description =AspartylAsparaginyl beta-hydroxylase
MSAIYDWSVLALRNVYDRRIQGKPVLDSAALFPDAERFTAQWRQIREEALTVAHDLHNIPRFHEIMIQQASISANDARDWRMFIMKAYGQPIARNLARCPTLAALIASSPDVLSASLSFLAPGKQVPPHRGPFRGILRGYLVLDMPKRADGCRAVLK

SEQ ID NO: 145446 - protein, 97 aa, Glycine max
  Coding DNA Sequence Number=SeqID_53761
MVEPLKKRKGTSSWSQRHSESPRALIDNWKFDFSVHDARRLVCTNQADMTGRLLAGSLAFESRILHYLIVRILLPRSSNLAQVSEEYLIVMWAFHKG

SEQ ID NO: 145447 - protein, 177 aa, Glycine max
  Coding DNA Sequence Number=SeqID_53762
  Gene Ontology: Mol. function=helicase activity; Biological process =viral genome replication
  Homolog annotation: Hit_ID=Q2R1R7; Match level="QueryCoverage=96%, HitCoverage=10%, E-value=4e-37, Identity=45%"; Hit description=AT hook motif-containing protein, putative
  Subcellular localization annotation: CTP_CleavageSite=49; ConfidenceScore=5.07e-01
MFVLENAPQPLRQLLFDSNDSQAKNFQQNIRSYNVMFAFTSPGLQLDTRYNTGRGPPTFRVHGQGHHLIGSLLPLANKSPKFAQLYIYDTDNEVNNKLSQNPNKDVLDEDIIIATKNMLDNNNHYAQKFRMARDKLQSSIVSDLKLKLIYDRQSDGRLSNLPNTAEVAALIVGDEHT

SEQ ID NO: 145448 - protein, 324 aa, Glycine max
  Coding DNA Sequence Number=SeqID_53763
  Homolog annotation: Hit_ID=Q6WAY6; Match level="QueryCoverage=94%, HitCoverage=51%, E-value=2e-36, Identity=33%"; Hit description =Putative uncharacterized protein
MGTNQIGKRFYQVKIKGLDVTSLKELGRLMGPLQRQAFRKIYGKILDLTTAEVFTEAIVSLAQYFDQPLRCFTFGDFQIVPTVEEFEEVLGCPLGGRKPYLFSGFLPSLSKIAAVVGDSARELDRMKQTRNGVVGLSWKYLEGKARDMVNQEEWVPFADILALLIFGVVLFPNVDGLVDLAVIDAFLAYHHSKESLVVAFLADLFDTFDRRCVKNSARIFCYLPVLCMWLVLHLFQQDIRHSCLLQSYRSCVEKRRVDWDQYLAGIGGRTINWFPRWKEGKEGVLFSCGDYPNIPLIGTRGCINYNPALSIRQLGYPMRGAPTE

SEQ ID NO: 145449 - protein, 112 aa, Glycine max
  Coding DNA Sequence Number=SeqID_53764
MTKVYTDNHSDISARQRDSKVSMTDLASAEDDVNLRVSTGLSVAIDEGRRRRCQSLRAIRLFVLQIAKRNVYTDNHSGISARQRDSKVSMTDLVSAEDDCKSPRVNGLVGRD

SEQ ID NO: 145450 - protein, 162 aa, Glycine max
  Coding DNA Sequence Number=SeqID_53765
  Homolog annotation: Hit_ID=Q6UUU1; Match level="QueryCoverage=37%, HitCoverage=40%, E-value=1e-18, Identity=78%"; Hit description =Putative uncharacterized protein
HGTLTILITGKVDEFKPEHNPHPFLAESSFATLFPKYRETYLREVIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 145451 - protein, 280 aa, Glycine max
  Coding DNA Sequence Number=SeqID_53766
  Gene Ontology: Mol. function=ferrochelatase activity; Cellular component=cytoplasm; Biological process=porphyrin biosynthetic process
  Homolog annotation: Hit_ID=Q1H397; Match level="QueryCoverage=90%, HitCoverage=73%, E-value=9e-92, Identity=61%"; Hit description =Ferrochelatase
  Pfam annotation: Domain name=Ferrochelatase; Domain location=1-249; Score=213.2; E_value=6.3e-61; Accession=PF00762.10; Description =Ferrochelatase
MVYAQQQKKLLQGYLSQTIDSPFAIELGMTYGNPSMQSAIESLKEQGCDRILVFPLYPQYAASSTAAAMDAVWRVLLKMRNVPAIRTIKHYHDHPLYIQALATHIQTYWKQHGKPEKLVMSFHGVPKFHLLKGDPYHCECHKTARLLAEALGLNKEQYQVAFQSRFGRQEWLQPYLANTLDALGKQQLKRIDVVCPGFSSDCLETLEEIAMEGKHLFQSVGGGDYHYIPALNSEAVWIEAMRDIALENLQGWVSNALDQTKANAEAQTSKQLALTMGADR

SEQ ID NO: 145452 - protein, 44 aa, Glycine max
  Coding DNA Sequence Number=SeqID_53767
GADNRKGADNRKGQYDKDYGAADKSKALAPTYTAMRNSDLRSSG

SEQ ID NO: 145453 - protein, 276 aa, Glycine max
  Coding DNA Sequence Number=SeqID_53768
  Gene Ontology: Biological process=transposition, DNA-mediated
  Homolog annotation: Hit_ID=Q1J7G7; Match level="QueryCoverage=14%, HitCoverage=70%, E-value=3e-11, Identity=73%"; Hit description =Transposase
GPGLPGINRDTRIYLFCEVIFRHRYLFGAKCVGVLQWLLFLSAVPPVQLLTGWCVTAKAPPDISAGKCSGRVPFAIQAAQLLGRAIGAGLFAITPAGERGMCCKAIKLGNARVFPEFDVIKVAMSDGINKYVMVVYSLALSTILLLPFALFLHSDQAYRYRRPRGGARYQLLFPLVRVNFELGVIMVIAVSFGKPVVPAALMNRPTRGERRFAYWALAECILAYYVGTDEEYVIQDIFPLPRSLTRYARSFDCGERKWLTNGAEISWKMPGRYLTG

SEQ ID NO: 145454 - protein, 120 aa, Glycine max
  Coding DNA Sequence Number=SeqID_53769
  Homolog annotation: Hit_ID=Q6UUU1; Match level="QueryCoverage=50%, HitCoverage=40%, E-value=3e-18, Identity=76%"; Hit description =Putative uncharacterized protein
MPAALMNRPTRGERRFAYWALAECILAYYVGTDEGVSEVLHVAGKKRLHRCVSRICDTGYIPLPRSLTRYARSFDCGERKWLTNGAEISWKMPGRYLTGNSLQAGLYARTPRSVRPLRLI

SEQ ID NO: 145455 - protein, 240 aa, Glycine max
  Coding DNA Sequence Number=SeqID_53770
CTICGGAHESGCCIPIEEHPTREVNYMGNQPRNNFNAGGFSRFQHGQQYNQQQGQWRNHLGNQFNRDQGGPSTRPQQQGPSLYDRTTKLEETLAQLMHVSMSNQKSTKSAIKNLEVQVGELAKQLADRSSSIFTANTEKNPKEECKAVMTRSRMAIHVDESEAEKKIEEHKPQLAPKPTLEPVSDFVELEEINEEAEDEKEEKTPIKEKEKERIKEEEKEKKLKNEKQLAERRLGNINNS

SEQ ID NO: 145456 - protein, 158 aa, Glycine max
  Coding DNA Sequence Number=SeqID_53771
KLLPERNVVVYYTEFDEFKEELERCHWDEELTEFGDDNIDVAIVKEFYANLYDPEDKSPKQVRVRGHLIKFDQDTLNTFLKTPVIVEEGESLFAYSRLALLRPDPQELATKLCIPGRGFELNADGYPLKILRKKMTTLAQTWSALSFSNLIPTSHTSD

SEQ ID NO: 145457 - protein, 161 aa, Glycine max
  Coding DNA Sequence Number=SeqID_53772
MAPTRHPLDPDKSNRALGFPALITGLCQSFGVPVAPTKVIRPPITRVFIEKYCTQRQGQGDAPQAVGAPPPPHQAGQAGAFDMEQYLRHLVRQQAANHRAHGSASFSCPTPDQFRAEVAWPGDWPEAQAGEAPPEAPGDGEEAHEDEEMADLLDFLGGSGD

SEQ ID NO: 145458 - protein, 197 aa, Glycine max
  Coding DNA Sequence Number=SeqID_53773
  Gene Ontology: Mol. function=motor activity; Cellular component=cell projection
  Homolog annotation: Hit_ID=UPI00006A2D9E; Match level="QueryCoverage =69%, HitCoverage=85%, E-value=1e-14, Identity=17%"; Hit description =UPI00006A2D9E related cluster
MLLHRFPTSNVQSCEFGMTSPSDESISCFLIRVDLWVLVPIALRGLHALTFRGLHVLAFRGLHVLALRGLHALAFRELHVLTFRGLHTLTFRGLHALAFRGLHALAFRGLHALAFRGLHVLAFRGLHVLAFRGLHALAFRGLHILTFKGLHVPAFRGLHVLTFRGLHALPFRGLHVLVMCHYFLLFLNPFCTILSTD

SEQ ID NO: 145459 - protein, 138 aa, Glycine max
  Coding DNA Sequence Number=SeqID_53774
MGPDGCRETRGTGTREAARKPRQGFSIQKVKFFSPCGWLFLLPSSPPLFSIKAPNFAHHFYSKLQKEAIFGVVKCTSMLWDFEFQEFAESMLNLTCLITLVEMMGRVNLGLNVRMVVMKAWAEQMRKMSDKCESKSHF

SEQ ID NO: 145460 - protein, 124 aa, Glycine max
  Coding DNA Sequence Number=SeqID_53775
  Homolog annotation: Hit_ID=Q6VPQ1; Match level="QueryCoverage=44%, HitCoverage=12%, E-value=6e-07, Identity=43%"; Hit description =Putative gag-pol polyprotein
RIPMTTQMQRLLNRNNEELYGRIEGLENQLNQNAGRHYGGNKGGNDGPRQNRMEEQNKIEGVKLNVSPFKGKSDPDAYLDWEMKIEHESLTVEEYYKKMEMTLVRANIEEEIEDNDSFSEWSKS

SEQ ID NO: 145461 - protein, 34 aa, Glycine max
  Coding DNA Sequence Number=SeqID_53776
MWDRHMLKGALKPGVFTPKVYTPKSSSGPLPPDL

SEQ ID NO: 145462 - protein, 71 aa, Glycine max
  Coding DNA Sequence Number=SeqID_53777
MLLWFPPLVNAKSVMALWFDGLQTYVGERFDSLERQVDTRFEEMNSRIAKVEEDVTIIRDYLDLPPPPPSV

SEQ ID NO: 145463 - protein, 102 aa, Glycine max
  Coding DNA Sequence Number=SeqID_53778
IAPPRHPVDSEKSNRVLGFPALTTGLCQFYKVPVAPNKVIRPPTNRAFIKKYCAPQAGTGRDTTVAWGWSAAGNKHTATTSRVHLNSSTKRLERCLQHMADQ

SEQ ID NO: 145464 - protein, 70 aa, Glycine max
  Coding DNA Sequence Number=SeqID_53779
MVCLTEMIWVDDPSKLVFWVDDPAWVGDPKEVEDDFIVIGSGRDNLDPLPVLRPPFREAPDALGGITAFL

SEQ ID NO: 145465 - protein, 51 aa, Glycine max
  Coding DNA Sequence Number=SeqID_53780
MKGKERTGQPSGVEVVEPERKECKIAYPAFTGRVASLGEWRGRRGQVQPSE

SEQ ID NO: 145466 - protein, 48 aa, Glycine max
  Coding DNA Sequence Number=SeqID_53781
MENWRTALGNDIRGAPDLKNGELANSARQWHSRGCRLEGGGHMNSARQ

SEQ ID NO: 145467 - protein, 60 aa, Glycine max
  Coding DNA Sequence Number=SeqID_53782
MVRISIAKRGFIALSVKKESGRVPESKQCTKREISLLSESSVSCQAQRSIGAKPKSTYSR

SEQ ID NO: 145468 - protein, 147 aa, Glycine max
  Coding DNA Sequence Number=SeqID_53783
MHPCAIKAPLLPRFIYVYFQGVFATYITRTSLAKFTYMHTQSILATKNCTRAHSGISNTYAYTNLVMNLGYLHNKDICGAITLALSKLNACPKKYVQTKLPHGLFPYKNHALMPLRHFTEHLVGARLGINSKRTGTMWHAPLLQNAL

SEQ ID NO: 145469 - protein, 97 aa, Glycine max
  Coding DNA Sequence Number=SeqID_53784
  Gene Ontology: Biological process=transposition, DNA-mediated
  Homolog annotation: Hit_ID=Q1J7G7; Match level="QueryCoverage=40%, HitCoverage=55%, E-value=2e-15, Identity=97%"; Hit description =Transposase
MVKVGTSYVPINVSFSPKVGPGLPGIYSAQSASGDAANLLILVYDGVFEVLQWLLFLSAVPPVQLLTGWCVTAKAPPDISAGKCSGHAARNHHTRRA

SEQ ID NO: 145470 - protein, 113 aa, Glycine max
  Coding DNA Sequence Number=SeqID_53785
  Subcellular localization annotation: CTP_CleavageSite=26; ConfidenceScore=5.32e-01
ITPPRHPVDPKKSNSGLGFKLWLRVSVSPTGCPFPQQGIAPTKTPSGPGEVQQGPEGSRPQDTQWTRRSPTGSWSCQALITGLCQFYGVPVTPSKVIRPPTNRVFIKKYCVPR

SEQ ID NO: 145471 - protein, 74 aa, Glycine max
  Coding DNA Sequence Number=SeqID_53786
MASMGIFGESAYEHNDTAPQDVETSPLLFDQPSTLSSKSTLPLSGRRRRILHERGRRSLLRYIQKGHKAGIRFK

SEQ ID NO: 145472 - protein, 181 aa, Glycine max
  Coding DNA Sequence Number=SeqID_53787
  Gene Ontology: Mol. function=chitin binding; Cellular component =extracellular region; Biological process=chitin metabolic process
  Homolog annotation: Hit_ID=UPI00006A17C9; Match level="QueryCoverage =65%, HitCoverage=98%, E-value=6e-09, Identity=35%"; Hit description =UPI00006A17C9 related cluster
MLLSSNVIYICVRVVMLVRMIRTRLFAVARVKSCPGMHSSCVIASLSGCACTVGPPPISGGGPGTVRMWSTLKMRTRSPLKVRACSPLKARMCSPLEVRPCSPLMARRCSPLKVRTCSPLKARTCSPLEVRACSPLMVRTCSPLKARMCSPLTVRGPPFHEKARDRLIERAGHPKSTRFGH

SEQ ID NO: 145473 - protein, 57 aa, Glycine max
  Coding DNA Sequence Number=SeqID_53788
MELLFKQRNQDHTKSPNIFVKVDGKENAADPFTKTLGIKEFDKHKWELGMKFMNDWL

SEQ ID NO: 145474 - protein, 210 aa, Glycine max
  Coding DNA Sequence Number=SeqID_53789
MGDQEETQEQMKADMSALKEQMASMMEAMLGMRQLMEKNVATAAAVSSAAEADPTLLATARHPPSNIVGRGRNTLGHDGNPHLGYNRAAYPYGLPPNYSPPVLQDDAGHIASPVLEREPPQQPDEVHEDPQDYARRDVEFYPPIPEGPAPSTLPQPNITTQPIVLSMEGPPPATEERRKLDLLEERLRAVEGFGNYPFADMTDLCLVPDV

SEQ ID NO: 145475 - protein, 78 aa, Glycine max
  Coding DNA Sequence Number=SeqID_53790
MPISPCKWISWDRAHKTPSGPEEVQRGLGVSSSGIVPTKTPSGPEEVQKGPGFPAFGYGPLSVLQGARSPQRGHAIVT

SEQ ID NO: 145476 - protein, 234 aa, Glycine max
  Coding DNA Sequence Number=SeqID_53791
APHGRMCGKKHRPSSSKTLPLHVLSRGGYEYLEQKLMAEKTKKRLEEAAQSRSTEGVIDPPSPIGCHVKWKMARTKQIGQMTSEASQGSFVPHGRQNVLTAAIGPIVVDPTNQVPAGGVDHRKSDLVGNGILQPDAVPVLVLDAITGTCTASGARVGPLGARVNTKESCVDPLGNDPETGDSDKCRLYIEENHSCLVAQGRLYEGSTAVHNIPLLHGQVKVGVEEVKDVETPVP

SEQ ID NO: 145477 - protein, 111 aa, Glycine max
  Coding DNA Sequence Number=SeqID_53792
MSGLATNVYSRKTLEKPKRGLRILKIRVSELFTHGEGQQGGALAPTYPQGPLRVHRSHSIPKIKLTDGCTKNAKQEKDIGNDHGCYLVAPQLRFFFLLPLPSCWTCGLKKS

SEQ ID NO: 145478 - protein, 40 aa, Glycine max
  Coding DNA Sequence Number=SeqID_53793
MDNEYLRGGATLFCYHPIQHLHISLGLISAGVDGKKPRVS

SEQ ID NO: 145479 - protein, 254 aa, Glycine max
  Coding DNA Sequence Number=SeqID_53794
  Gene Ontology: Mol. function=porin activity; Cellular component =membrane; Biological process=transport
  Homolog annotation: Hit_ID=A6X2A5; Match level="QueryCoverage=100%, HitCoverage=70%, E-value=1e-104, Identity=70%"; Hit description =Porin precursor
  Pfam annotation: Domain name=Porin_2; Domain location=1-247; Score =173.5; E_value=5.6e-49; Accession=PF02530.5; Description=Porin subfamily
TYTELRFNYLGLSNPDDGADETYGLASDSSYVQFAYIQLGGLKVGIDESEFQTFTGYLGDVINDDVVDVGAYRTGKISYTFAGGNGFSAVIALEQGGDDHLITDYVPHIVGGLKYAGGWGSIAAVAAYDSVIEEWAAKVRGDVNITDRFSVWVQGGYASAETTDQNYGSWGGDWAVWGGLKYKATEKATFNVQAAYEDWGKTALTANVAYELVPGFTITPEVSYTKWDDDHPVREAGFAGKDAFQGMIRFQRSF

SEQ ID NO: 145480 - protein, 153 aa, Glycine max
  Coding DNA Sequence Number=SeqID_53795
LPSPLRGLHVLALRGLHVLTSKGLHALTSRGLHLLALRGLHVLTSRGLHILTIRGLHALTSRGLHVLALRGLHALTLVTLTVERTTRPRLERTTRPHHQGLHALTSRGLHLLALRGLHILTIRGLHALTSRGLHVLALRGLHALTLGTSYPHR

SEQ ID NO: 145481 - protein, 107 aa, Glycine max
  Coding DNA Sequence Number=SeqID_53796
MTDLVSAEDDVNLRVSTGLSAAIDEGAEDDVSLCVLSGFSSYRQQKVYTDNQLGQQKVYTDNRSGISARQRDSKVSMTDLVSAEDDVNLRVSTGLSAAIDEGRRRRR

SEQ ID NO: 145482 - protein, 51 aa, Glycine max
  Coding DNA Sequence Number=SeqID_53797
MITFQVKRITWFTHKKELRRSDFLFDGGLLSFETNVRGANTFLKRKYNSRT

SEQ ID NO: 145483 - protein, 134 aa, Glycine max
  Coding DNA Sequence Number=SeqID_53798
MERSMIDAASGGALGDMTPAEAKNLIEKMASNSQQFSARSDAIVIRGVHEVATNSLGETKKLEGTIPGGGIIPTLDGRILHNNSNNNNNLIFRMLLAQADHTFLHQSSSNNNNNNSPRNNKQLRPLRNLPLKNL

SEQ ID NO: 145484 - protein, 99 aa, Glycine max
  Coding DNA Sequence Number=SeqID_53799
MSQGKIPKSFHGPQSFLKEIELPPFFSCRGRSFRGQNYWLCRDVGLRQRTGCQPFGDRGIELDIPSSVVLRVFVAFFGLLRGSLSRTEKQYGPHRLADG

SEQ ID NO: 145485 - protein, 136 aa, Glycine max
  Coding DNA Sequence Number=SeqID_53800
MGSNQAPSFKKRFYNVKIKSLEVANLQELGQWMDQLQHQAFHKTYGKIWDLAMIEVSVEAIASLVQYYDQSLRVILFPNVDGLVDLAAINVFLAYHHNKESLVVAVLADAYDTFDRRCEKSGARIAYCTLALYVWL

SEQ ID NO: 145486 - protein, 296 aa, Glycine max
  Coding DNA Sequence Number=SeqID_53801
  Gene Ontology: Mol. function=oxidoreductase activity, acting on paired donors, with oxidation of a pair of donors resulting in the reduction of molecular oxygen to two molecules of water; Cellular component=endoplasmic ...
  Gene Ontology: Cellular component=reticulum; Biological process=fatty acid biosynthetic process
  Homolog annotation: Hit_ID=Q2SQ27; Match level="QueryCoverage=83%, HitCoverage=78%, E-value=8e-80, Identity=55%"; Hit description=Fatty- acid desaturase
  Pfam annotation: Domain name=FA_desaturase; Domain location=96-296; Score=38.8; E_value=1.9e-08; Accession=PF00487.15; Description=Fatty acid desaturase
MQFVWPFKSEYLIAYLSEDYQHTIIARNKRDYVWLMRGDSMSERIYGYLWRLVGWLDNHRYQAPADVGAESIDWWRVLPFVALHIALFALYWVGWSPFAVLFAVAMYVVRMFAVTGFYHRYFAHKTFQTSRAGQFIFALIGATAVQRGPLWWAAHHRHHHVHADQPQDVHSPHQHGLLWSHLGWFLSHANFKTQLERVRELTRYRELCWLDRFDSLVPIGMALSIYALGELLAHYAPQLQTNGWQLLVWGFVVSTIALYHATFCVNSLAHVWGSRRYATRDHSRNNWLIAIITLGE

SEQ ID NO: 145487 - protein, 74 aa, Glycine max
  Coding DNA Sequence Number=SeqID_53802
MENHDHQSQEMRQQMQEQNEKIRQQNEQMKRILQHLHIQSIMPTPSLSPTIADGTEHHVNDAQVDRPHDMGNDR

SEQ ID NO: 145488 - protein, 78 aa, Glycine max
  Coding DNA Sequence Number=SeqID_53803
  Homolog annotation: Hit_ID=A5BUY0; Match level="QueryCoverage=94%, HitCoverage=15%, E-value=5e-09, Identity=41%"; Hit description =Putative uncharacterized protein
SVDASEYMKTGQKIFELLDSFVEEIGEKNVIQVVTELHKQKANLRRMFTSDEWLKSKATKEPKGKQATASCKCVEVGG

SEQ ID NO: 145489 - protein, 154 aa, Glycine max
  Coding DNA Sequence Number=SeqID_53804
  Subcellular localization annotation: CTP_CleavageSite=30; ConfidenceScore=5.13e-01
MVKVGTSYVPIEVSFSQKLGPGRCPSPFVQLSGRPDRCQGLAIMNRQRGERGMCCSLRNWVTPGFPSTECINDGLLCCNDSLMRVSEVGFHRGGRPQKKVVPGASQEYRYGIDSAIPRHCQRRYARSFDCGERKWLTNGAEISWKMPGRYLTGK

SEQ ID NO: 145490 - protein, 156 aa, Glycine max
  Coding DNA Sequence Number=SeqID_53805
CSPILFLDITLDIMCSNSSFPSLSKCLCFNKILANLLSSVELSTNNLPLWQILSKTYLDTSEQVRAVMQVGSATFIIRVIKHNGNSSSCKSTSLLQDVKTSHVTSAFCSCSPCLHAYCSVFYQLLVFSRSVKTSHVSHQLSAPPVFCSYCSIFISY

SEQ ID NO: 145491 - protein, 102 aa, Glycine max
  Coding DNA Sequence Number=SeqID_53806
  Subcellular localization annotation: CTP_CleavageSite=55; ConfidenceScore=5.68e-01
AKRSSRAKRTLWAQCTSTAKRNFSVLSVTRESGRAQGSRSRTKREISLPSEMFVSCQAQRTTGAKAHNFSKQYRIPEQVHHSANFEIEDLEAARGATLQRSL

SEQ ID NO: 145492 - protein, 297 aa, Glycine max
  Coding DNA Sequence Number=SeqID_53807
  Gene Ontology: Biological process=transposition, DNA-mediated
  Homolog annotation: Hit_ID=Q6UUU1; Match level="QueryCoverage=20%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPVTTLNSMALPLLETAFPQSRTSDSRSSASSASAGRPARSSPTSITSQKAEMSHHCPVRCALIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 145493 - protein, 176 aa, Glycine max
  Coding DNA Sequence Number=SeqID_53808
  Subcellular localization annotation: CTP_CleavageSite=16; ConfidenceScore=5.24e-01
MVKVGTSYVPINVSFCAKSGGAALGASCGPAARAPGSAYFRMISVTSAVPPVQLKSDPGWCVTIRHTSIPAGSISAASCPSPFGAQLSGKGPDRCGPLAINESPTRRKGDVLQVCVSWALTPECILAYYVGTEKFVVFPSSLIATARSLRPAAQPEMAYERGGDFLEDARKILNRE

SEQ ID NO: 145494 - protein, 150 aa, Glycine max
  Coding DNA Sequence Number=SeqID_53809
  Homolog annotation: Hit_ID=A5AZ88; Match level="QueryCoverage=40%, HitCoverage=5%, E-value=1e-07, Identity=43%"; Hit description =Putative uncharacterized protein
MEEGFSHGSVPIVLGRPFMKTTRTKIDVYAGTLSMEFGDIVVHFNILDAMKHPSEDHSIFRAEIIDQIVDDYMFDSVLHGRKHPFLSDLHTCYSSCNESESEFEFDPVSDFYAESKFEFESDSDFLGVVPLDVDFLESECTNHVAGMIEA

SEQ ID NO: 145495 - protein, 278 aa, Glycine max
  Coding DNA Sequence Number=SeqID_53810
  Homolog annotation: Hit_ID=Q5CDC4; Match level="QueryCoverage=14%, HitCoverage=32%, E-value=1e-14, Identity=100%"; Hit description =LacOPZ-alpha peptide from pUC9
  Subcellular localization annotation: CTP_CleavageSite=41; ConfidenceScore=5.60e-01
MAEPSKKRKGSSSTATAAAHRRHGPSGAPTAPIPPSLSSPRSSTLFSSDDQRLRYLSQFSSRIILDPKYLDVEFFNDETFDCYQVFQNSGLVDFMSFKLPYYPELVKVFYCNLKIQDGIIMSEVHGTSMVIDQSLFFSLTHLPSQGAPFEGTIVDDWKFDYSSHDARRMVCNDQADMTGRLLAGSLTFDNRIMHYIIVRILLPRSSNLAQASEEDLILMWAYQAYRYRRPRGGARYQLLFPLVRVNFELGVIMVIAVSCVKLLSAHNSTQHTSRKHKV

SEQ ID NO: 145496 - protein, 107 aa, Glycine max
  Coding DNA Sequence Number=SeqID_53811
GGPLGTSTLTFRGLHVLTFRGLHVLTFRGLHVLAFRGLHTLSFSGLHALAFRGLHALAFKGSVPGPPPDPGRGPTVQAQLEEEAIVQPLCILDQDFTRAVTKRRVRI

SEQ ID NO: 145497 - protein, 212 aa, Glycine max
  Coding DNA Sequence Number=SeqID_53812
MAPKKLSAKRSRRDATAEGTSAAPDFDSHHFRSAEHQQRFEAIKGWSFHRERHVQLKDDEYADFQEEIAHRHGTSLVTPMAKFDPDIVLEFYANAWPTKEGVRDIRSWVRGQWIPFDADALSQFLGDPLVLEEGQECEFNQRRNRADGFDEEAIAQLLCTPGPDFARIAAGRRVRIMRTSMTTLTQMWMKLLLSNILPSDHNSDLPLPKCQL

SEQ ID NO: 145498 - protein, 78 aa, Glycine max
  Coding DNA Sequence Number=SeqID_53813
MGIQKNSQAISPLNTFVLGKGKNQKNSQIVSFEFFDKGEGRHKRIQAVSPLFFWKREKRDRKRIQANSFWQREKRMKR

SEQ ID NO: 145499 - protein, 115 aa, Glycine max
  Coding DNA Sequence Number=SeqID_53814
MVKVGTSYVPINGCLDFAKSECPSDRFNMLFPPVQLLTGNGVIRHNSAHKHTEPEASARQGCPLSHVRETCRANCLMNRPTRGRSSAGLCAITPAGAKGRMCCILAITMLGTLSQ

SEQ ID NO: 145500 - protein, 136 aa, Glycine max
  Coding DNA Sequence Number=SeqID_53815
MALLIAAKCILTVYDGVNFEVLQWRICCLSAVPSCSATEIRGGIRVQFHKAYQPEASALASVKPGCQDADANSPHRRVNCLPLQGCRFPFGKPCQVRNCINESANARAIGAGLCAITPAGAKGRMCAYWRLLCWRN

SEQ ID NO: 145501 - protein, 242 aa, Glycine max
  Coding DNA Sequence Number=SeqID_53816
  Homolog annotation: Hit_ID=Q2HRM6; Match level="QueryCoverage=19%, HitCoverage=12%, E-value=5e-08, Identity=54%"; Hit description=RNA -directed DNA polymerase
VFSKEIPHGLPPSRSIEHQVDLLLEASLPNKPTYNYKRQETQHKDAQVKVEYVKRLYDQVKVQIAKKNESYTKQAYKKRKVLVLEPGDDPRHLRANVFQEGGNDENHETGQIQAKGLCGEGRRPKWRRTKHPEWRRMKAQVEKDEAPEAETLSRLLITYQGNPCGVYPDLSSFTGSGVNPDLSSFTGSGVYPDLSSFTGSGVYPDLSSFTGSGVVQKLYSLYQTIRPVRFTSSGIRASALDT

SEQ ID NO: 145502 - protein, 83 aa, Glycine max
  Coding DNA Sequence Number=SeqID_53817
MVKSWNLLRADQRLIFAKKLAQGFPVSTGTPGFIYSAKVIFRHSCPSCSATDGVVRNGKKHRRTSALASVAVTAARNHHTRRA

SEQ ID NO: 145503 - protein, 136 aa, Glycine max
  Coding DNA Sequence Number=SeqID_53818
MKREKHASYSSHNSCKSLSEELRNYYEGRHRSHLRPHSHRRENERKPQDVNIKLTYFHGKDNVEAYLDWEIRVEQKLKRKPTLKSYGYHSYPKKDQGLGILGAAPSKPNDHKGKTIEKQPPKAKDTLLLNAPPRKP

SEQ ID NO: 145504 - protein, 312 aa, Glycine max
  Coding DNA Sequence Number=SeqID_53819
  Homolog annotation: Hit_ID=Q2HW90; Match level="QueryCoverage=66%, HitCoverage=39%, E-value=3e-23, Identity=35%"; Hit description =Putative uncharacterized protein
MGSSQKPSLKKRFYPVKVKSLGITSLRELGQLMGKIWDLAMVEVSTEAIASLAQYYDQPLRCFIFGDFQLSPMVEEFEEILGCEWAPFIDILALLIFGGVLFPNVDGLVDLAAIDAFLAYHNHKESLVVAMLADLYDTFGRRCEKSNTRIVCCTSALYVWLVSHLFRQEMRHACPLESYRSCTEKGGANWDQLLASKEGASINWFPRWKEGRTGVLISCGGFPNVPLMGTRGCISYNLVLATRQLGYPMRGAPLEDELTPVISRGFNKTNMETLQKVRKAWEVVKKKDKELRGNNNGPIGGYRGWLKARGIL

SEQ ID NO: 145505 - protein, 276 aa, Glycine max
  Coding DNA Sequence Number=SeqID_53820
MIMRGQDIYSSQDEATTSPSTNENEEAIGEESREEIYPQEEGQPLMVKEECKEVSVSSKRLAKKESHFEIKTNIKETSPLRQPPHLILCKKTLVSTVTPLGLEVIPQVKELLDEGLVHKSLNPSALLVPKIGIIRHQIPKISDMMNVLSVATFFCKIGHAHNIFMIHVHRDSLGSGQGVPMNPKRIKVTPEWPTPPTPLIELVRNHVPSWEDAQEMGFQTLPYFNIPNTTNTYVEGMMQSYPARALGRRLQVDWARDPRVGPRVLMSLRVDFEPMG

SEQ ID NO: 145506 - protein, 105 aa, Glycine max
  Coding DNA Sequence Number=SeqID_53821
  Subcellular localization annotation: CTP_CleavageSite=33; ConfidenceScore=5.01e-01
MEAMLSNSKYWKAVSNDSSAASTYGIEEGQLTRTSSSPDTMTKCPSTTNFNFWWSMRPYLYWEVDLSAYLLAATVKGMDNHGTWPQMGSVKWQFLQRAFGHHVQA

SEQ ID NO: 145507 - protein, 167 aa, Glycine max
  Coding DNA Sequence Number=SeqID_53822
MVLISRCSSGVSCVYQLSLPVQLLTEWCYPSQFGTQAYTPEASALASVKPGVPKTLQLTHHTRRLNCLPLQGCPLSHVRETCRANCINESANARAIECGPLRITPAALKGGCVHTGDYYVGYTDARVFQSRSAFMWQEKKGCTGLSERAAAKPFFHRLRPPDKHHEI

SEQ ID NO: 145508 - protein, 332 aa, Glycine max
  Coding DNA Sequence Number=SeqID_53823
  Homolog annotation: Hit_ID=Q6WAY6; Match level="QueryCoverage=37%, HitCoverage=21%, E-value=2e-13, Identity=34%"; Hit description =Putative uncharacterized protein
MDWDQLLAGIGGRIISWFPRWKEGKEGVLFSCGRYPNVPLVGTRGCINYNPALAIRQLGYPMRGAPTEESMSPFLVRDLGAQNSKTIQRIHKAWETPLRKDQELRGIRNGIIGGYHEWLKVRIRGLDWLAKLKVVSKENFEAPEEDEEVQALKSELGKAKLAKEKFKLAATHVRKECAGARKEEYGRNKFRGALWGSNSELKLRREERDQSRAHGMVLKKELIACSRSKRSLSQRLCETETNMLAIIAKYQEELGLAAAHEHRIADEYAQVYAEKEARGRVIDSLHQEATMWMDRFALTLNGSQELPRLLAKAKAMADTYSAPEEIHGLLGY

SEQ ID NO: 145509 - protein, 101 aa, Glycine max
  Coding DNA Sequence Number=SeqID_53824
  Subcellular localization annotation: CTP_CleavageSite=40; ConfidenceScore=5.03e-01
MVKVGTSYVPINVSFSPKVGPGLPGAPVAYHGFYQLFPPVQLLKRGGRCHSPFRLRNCSGKGLIGAGPFAIMNRQRAKGDVLQVAIKLGNARSVPSRLTCW

SEQ ID NO: 145510 - protein, 142 aa, Glycine max
  Coding DNA Sequence Number=SeqID_53825
  Homolog annotation: Hit_ID=Q6UUU1; Match level="QueryCoverage=42%, HitCoverage=40%, E-value=9e-19, Identity=78%"; Hit description =Putative uncharacterized protein
MELYLRIAPELYLKRLVLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 145511 - protein, 72 aa, Glycine max
  Coding DNA Sequence Number=SeqID_53826
MLVTLADNELMLVASSSFSLGGVYLHGTAWLFCYGKGTGLAVEGAKHFSMEWPGVFPWYVQVALRSYPFGKR

SEQ ID NO: 145512 - protein, 40 aa, Glycine max
  Coding DNA Sequence Number=SeqID_53827
MKNWERGFHESNGGAGTHCNRLQHLVIDYSIVVIDYQSDF

SEQ ID NO: 145513 - protein, 92 aa, Glycine max
  Coding DNA Sequence Number=SeqID_53828
MEIYPNLWQQWKYDWWVPSLQRQSCAGLHTVATYPSAGGRRETRGMRVPRKEYAWSRHQRLFEENVGKTGKDEIYELFSERFGSCIYARGRY

SEQ ID NO: 145514 - protein, 88 aa, Glycine max
  Coding DNA Sequence Number=SeqID_53829
MLHRPQARHHHLIRLARLGHLTWSSIYGIWFASRRPTTEHMAEVAWPGDWPEAQAGEAPPEAPGDGEEAHEDEEMADLLDFLGGSEDT

SEQ ID NO: 145515 - protein, 240 aa, Glycine max
  Coding DNA Sequence Number=SeqID_53830
  Gene Ontology: Mol. function=endopeptidase Clp activity; Biological process=proteolysis
  Homolog annotation: Hit_ID=Q8VNN5; Match level="QueryCoverage=99%, HitCoverage=33%, E-value=2e-90, Identity=68%"; Hit description =Putative protease/scaffold protein
LDSFPTLRKVRAGAEYKYVTLKDRGEPIALATYGELFSIDRQTIINDDMDMLTRIPMAMGGAARATVGDLVWAVLTSNPKMSDGKPLFHADHGNLVSSDLSIEGLDAGRQAMLLQKSGERRLNIRPAFMLTPVAIESRANQLIKSASVPGADANSGINNPIQNFVTVLSEARLDDSSPTDYYLAAAQGRDTIEVAYLDGIDTPYLEQQQGFTVDGAAFKVRIDAGVAPLDWRGLVKATKK

SEQ ID NO: 145516 - protein, 77 aa, Glycine max
  Coding DNA Sequence Number=SeqID_53831
MSLHVLYLYAFSGFPPGISRLLYPSLQSFKEMDGQDHLELPSWVRTKCGQQKPIKVLRNGCKWGWGHDRLIVALSLR

SEQ ID NO: 145517 - protein, 176 aa, Glycine max
  Coding DNA Sequence Number=SeqID_53832
METQIGQLPKQLQTSSIGFFAAIEENPKGHCKAIISTIECDMGGEEKEEEVKENNMLEEEIKAQANPSTQDMQSSLNPPLFDFCKLSIYKQGDDGRMAKFEKYMEMLQGKKDEPLIEKLTWDMLNQVRPTRHLEDKGCFMIPITLGNLSIDHALLDFGTSCNLMPHSFFERLVALT

SEQ ID NO: 145518 - protein, 409 aa, Glycine max
  Coding DNA Sequence Number=SeqID_53833
  Homolog annotation: Hit_ID=A5C0K9; Match level="QueryCoverage=65%, HitCoverage=57%, E-value=1e-10, Identity=26%"; Hit description =Putative uncharacterized protein
HHFIPFDHPEHSITGEFVHSIIGDFEHPDLEHYNFEHSDSEHSDFAHSENMAQPPPHERTLREMAAPDFTYESLCIQYADEDVPYVLKTRLIHLLPKFHGLAEGVVKDWLYYLAPRSITSWDDLKRVFLEKNFPASRTIAIRKDISEKYDRCCQWWSPGDMTPAEARNLIEKMASNSQQFSARNDAIVIRGVHEVATNPSTSSETKKLEGKLDALVNLVTQLALNQKSVPVARVCGLCSSADHHTDLCPSMQQPGAIEQPEAYAANIYNRPPQPQQQNQPQQNNYDLSSNRYNPGWRNHPNLRWSSPQQQQQPAPSFQNAAGPSRPYIPPPIQQQQQPQKQPTVEAPPQPSLEELVRQMTMQNMQFQQETRASIQSLTNQMGQLATQLNQQQSQNSDKLPSQAVQNPKN

SEQ ID NO: 145519 - protein, 150 aa, Glycine max
  Coding DNA Sequence Number=SeqID_53834
MAFVDNWVVGKEEVCYWLITTLLGWWETWPYRNGSHSMGFSLFLTLFICPNFLSRPSRMIKFASFQTHIDPFTGEDQIRKALRVRSPPSFHSRVSIMCLPSRLSSPFPSLGVPPGPPDPSTFWACSLKDPSPFLHMFYSCILSGTISKLY

SEQ ID NO: 145520 - protein, 103 aa, Glycine max
  Coding DNA Sequence Number=SeqID_53835
  Subcellular localization annotation: CTP_CleavageSite=23; ConfidenceScore=5.35e-01
TAGNRRGIHSRAMKTFQFAHGKRCNKVGTSYVPINVSFSPKVGPGLPAVPPVQLLTGWCVTAKAPPDISAGKCSGCATVGKGDRCGPLRYYASWRKGDVLQGD

SEQ ID NO: 145521 - protein, 105 aa, Glycine max
  Coding DNA Sequence Number=SeqID_53836
MEVIKIDWGVPCIHGINDCSIAVVETMKRSIWILEEIIVIKESFNLLFPIRIIVGKKFGDIGESDASKGFGWLMGVGNEGVVVGHRRQGWGTTSLIEEIGNEWIV

SEQ ID NO: 145522 - protein, 282 aa, Glycine max
  Coding DNA Sequence Number=SeqID_53837
EETSAEGKEKFKSAAVRIRKKNAELRDVNIATTKALEQETKRASKEEHGRNKFRGAQWGSNNELKLQREERDQLRLDGIILKDKLKTCLRSKRSLSQQLCETETNMLAIISQYKEELNLATAHEHKVADEYAQVYAEKEARGRVIDSLHQEATMWMDRFALTLNGSHKLPRLLAKAKAMADVYSAPEEIHGLLSYCQHMIDLMEHMKVDMSAFKEQMTSMMEAMLGMKQLMESNAATATATSTAAEADPALPTAAHHPVPNMVGRERSTSGHIRKPHPGYNR

SEQ ID NO: 145523 - protein, 108 aa, Glycine max
  Coding DNA Sequence Number=SeqID_53838
MRYELVPVSLFVKTKEERAKLIDGSLLVELLWRLDLRASMWSFNGDFPPWRCSGRQRKIGERRRHPLRNKPWKKELHHQDEPWIRSLERMLQWRKRKRERKREGGARN

SEQ ID NO: 145524 - protein, 240 aa, Glycine max
  Coding DNA Sequence Number=SeqID_53839
  Homolog annotation: Hit_ID=Q72G40; Match level="QueryCoverage=77%, HitCoverage=55%, E-value=7e-17, Identity=32%"; Hit description =Conserved domain protein
CHGQYLQTRLGIAKVDGQQLSQFISDAQQAVWASREVREQLQKNQVSVVPANFYSNIPTLEEIADSFEYRNISEPPYLDVGIFDSLSLREELISLAEYSADFDPPKDGDSENPTAFFWGNDQFPFIDGMVYHAVLRKLKPRNVVEIGSGFSSLVAIEALRLNGSGKLTCIEPFPRRFLQDRAESGQLELIRQKAQSFADLNDLLQDGDVLFIDSTHTVKIGSDCLHLYLRLLPKIKRRIW

SEQ ID NO: 145525 - protein, 89 aa, Glycine max
  Coding DNA Sequence Number=SeqID_53840
MDRRHPAAGHHRAGAAFQLRQRALHHVARRVAAARIIMGSGLVEVGKVIGAGQMNRRDNAAVLFVVVQAAAYGNRGWFTRHGLARLSVR

SEQ ID NO: 145526 - protein, 66 aa, Glycine max
  Coding DNA Sequence Number=SeqID_53841
MTPGGGAYGKTALPRPSHFPVKYLPGIFQEISAPFVSLSGARPQLFRDAGRAHIEFTAARGGYILH

SEQ ID NO: 145527 - protein, 76 aa, Glycine max
  Coding DNA Sequence Number=SeqID_53842
MVKVGTSYVPINVSFSPKVGPGLPGSEILEACIYKNILTVKLIRNTVRPRGGSPGCPFAFRLPTVREGPDRCGLCY

SEQ ID NO: 145528 - protein, 184 aa, Glycine max
  Coding DNA Sequence Number=SeqID_53843
IPFDADASASSWEDLLVLEKGQECEFSQRRNRADGFDEEAIAQLEAGADHAHQHDYPNPDMDDVAAQQCPAQDRAHKTPSGPGELQQGPRVSSFGYGPLSVLQGARSPQQGITPARHPVHPEKSNRVLGFPALITSFWRDTTTTLGWTIVGNRRTTTTSRVHLISSTKRRLAQDVNEALLGGNL

SEQ ID NO: 145529 - protein, 222 aa, Glycine max
  Coding DNA Sequence Number=SeqID_53844
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=39%, HitCoverage=73%, E-value=7e-24, Identity=66%"; Hit description=LacZ protein
MTPVNRKAGTGERTREPPGGNAGIFIVLSGFATTDLSVRFRDACQGGGAYGKTALPRPSHFPVKYLPGIFQEISAPFPFFSCHMKHFTDTLISANILQSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 145530 - protein, 223 aa, Glycine max
  Coding DNA Sequence Number=SeqID_53845
  Subcellular localization annotation: CTP_CleavageSite=80; ConfidenceScore=5.30e-01
TYQGNPCGVYPDLSSFTGSGVYPDLSSFTGSGVYPDLSSFTGSGVYPDLSSFTGSGVIQTFVACIKRSTPTQIDWAHLVRYRMLKALRANAPLPYPQLITLFLRHFQIPFDDEPFVQVKRSFAIGAGAVTSFGYRKDRNVQWLKKDALPPQDERTPSPPSQREDSTLMNEVLTELRGLRSYVGERFDSLDTRFAVMDIRLTQLEEDVGYIRQSFDLPPPPPPS

SEQ ID NO: 145531 - protein, 104 aa, Glycine max
  Coding DNA Sequence Number=SeqID_53846
  Subcellular localization annotation: CTP_CleavageSite=66; ConfidenceScore=5.47e-01
MLVRMIRTRLFAAARVKSCPGMHSSCVTASLSGCARTFGPPPISGGGLGTMWSTLKMRTCSPLKVRACSPLKTRMCSPLEVRACSPLMARTCSPLKVRACSPLK

SEQ ID NO: 145532 - protein, 127 aa, Glycine max
  Coding DNA Sequence Number=SeqID_53847
  Subcellular localization annotation: CTP_CleavageSite=43; ConfidenceScore=5.19e-01
MSACAVFGTPKCFEYACMKWPRGSLPQRGPGRTRRPKELVPPRSTTVTALGELYTSSASKPSRDGRFSGERRVQLRDDEYTDFQEEIGRRRWAPLVTPMAKFDPEIVLEFYANAWPTKEGVRDMRSW

SEQ ID NO: 145533 - protein, 73 aa, Glycine max
  Coding DNA Sequence Number=SeqID_53848
MKDDELIQSKLPPATQYQLPNVKDSNNKPVMAVPFKTKDVNEEVTSKDIKSLMEQANYTNKYLQVLGETIKSK

SEQ ID NO: 145534 - protein, 141 aa, Glycine max
  Coding DNA Sequence Number=SeqID_53849
MSALKEQMAFMMEAMLGMRQLMENNVATTAIVSSTTEADPTLPATAHHPLPNAVERERSTLGHISNPHLGYNWVAYPYGLPPNFTPPAMRDDAGHVPSPILEGELPRQSDEVHEDHRVYAQVDVDFYPPVPVEGPAPNVLP

SEQ ID NO: 145535 - protein, 216 aa, Glycine max
  Coding DNA Sequence Number=SeqID_53850
  Gene Ontology: Mol. function=oxidoreductase activity, acting on NADH or NADPH; Cellular component=chloroplast; Biological process =electron transport
  Homolog annotation: Hit_ID=Q2PMN8; Match level="QueryCoverage=98%, HitCoverage=86%, E-value=2e-75, Identity=85%"; Hit description =NAD(P)H-quinone oxidoreductase chain H, chloroplast (EC 1.6.5.-) (NAD(P)H dehydrogenase, chain H)
  Pfam annotation: Domain name=Complex1_49kDa; Domain location=22-215; Score=101.8; E_value=2e-27; Accession=PF00346.10; Description =Respiratory-chain NADH dehydrogenase,
MGPHHPSMHGVLRLIVTLDGEDVIDCEPILGYLHRGMEKIAENRTIIQYLPYVTRWDYLATMFTEAITVNGPEQLGNISRPMLRASGIQWDLRKVDNYECYEEFDWEVQWQKEGDSLARYLVRIGEMMESIKIIQQALEGIPGGPYENLEIRCFDREKEPEWNEFEYRFISKKPSPTFELPKQELYVRIEAPTGELGIFLIGDQNGFPWRWKFVRQ

SEQ ID NO: 145536 - protein, 138 aa, Glycine max
  Coding DNA Sequence Number=SeqID_53851
MKKSLHQLLSKNPQLRVLAFHGKETPFTLKKRNQEKLLAHKGVGMSPPPLGISQSLKNSLISLKDENLAPCSALCSLKFTLFRPFYCEKFSFWLSFYSVQIRIKKGFLILMSRLAPFSRLARVSEFELSVEGVNKYSG

SEQ ID NO: 145537 - protein, 74 aa, Glycine max
  Coding DNA Sequence Number=SeqID_53852
MTKARQKEVRKVNEMKIKVRETSGDHQGLKNDVERMKDGGKSSRNQARKRFGRVTEAPRLGFSSRKQFFFTNFK

SEQ ID NO: 145538 - protein, 53 aa, Glycine max
  Coding DNA Sequence Number=SeqID_53853
MELELKIIRLSESGIDDEEAAEEEGEAAEEEEEAAEEEGELYDFEGETAADDD

SEQ ID NO: 145539 - protein, 95 aa, Glycine max
  Coding DNA Sequence Number=SeqID_53854
MNEIKMKVKKTRNELKVSDSKTYPLKNEERMKNGEEQQKTFTDSLTETSRKRYGSTSAWIFFTETFFSTQPIYRKRGEEVAAQLAQASWVASGRA

SEQ ID NO: 145540 - protein, 123 aa, Glycine max
  Coding DNA Sequence Number=SeqID_53855
  Pfam annotation: Domain name=zf-CCHC; Domain location=50-67; Score =18.3; E_value=0.0026; Accession=PF00098.14; Description=Zinc knuckle
EGIGHILDLTPIGEKMKESLKRPSKPKDDKGKTIEKQPLKASKQEKTSSMKCFKCLGRGHITSRCPTKKTMIMRGQEIYRSQDEATTSPSSSKSEEAKGEESSEEIYPQEEGQPLMVKEECKE

SEQ ID NO: 145541 - protein, 67 aa, Glycine max
  Coding DNA Sequence Number=SeqID_53856
MGAWEIVSFLDTTSWGSTVPDGFLVIIPKVVISLLMVSRGIIPFEEYIAAVGTTSNNMLSKRKTLDE

SEQ ID NO: 145542 - protein, 154 aa, Glycine max
  Coding DNA Sequence Number=SeqID_53857
  Homolog annotation: Hit_ID=Q0KIL1; Match level="QueryCoverage=62%, HitCoverage=10%, E-value=1e-07, Identity=33%"; Hit description =Gag/pol polyprotein, 3'-partial, putative
  Pfam annotation: Domain name=G-patch; Domain location=38-82; Score =35.6; E_value=1.8e-07; Accession=PF01585.14; Description=G-patch domain
MPYVEATEESLETAFHSFEVVSISSMDSFSGQPCLSDTAVMVARVMLGNGYEPGMGLGKDNCGITSLISAKGNRGKFGLGYKPTQADIRKSIAGRKNGGQGSRLRQEDEGSPPCHISRSFLSTGLGDEGQVVAICEDDAPSGSDLVDHALLISN

SEQ ID NO: 145543 - protein, 64 aa, Glycine max
  Coding DNA Sequence Number=SeqID_53858
MEKNEETTMEEKLLCSDYHLMEACLWGFYGGWIFELQWGPLMVIFHHGDAAEDKGEEVRGGAIH

SEQ ID NO: 145544 - protein, 136 aa, Glycine max
  Coding DNA Sequence Number=SeqID_53859
MASNSQQFSARNDAIVIRGVHEVATNLSSSAEAKKLEAYAANIYNRPPQPQQQNQPQQNNYDLSNNRYNPGWRNHPNLRWLNPSQQQQQQQQQPYFQNVAGPSRPYVPPPIQHQQQQQPQKQQTVKAPPQPSLEEL

SEQ ID NO: 145545 - protein, 279 aa, Glycine max
  Coding DNA Sequence Number=SeqID_53860
  Gene Ontology: Biological process=transposition, DNA-mediated
  Homolog annotation: Hit_ID=Q6UUU1; Match level="QueryCoverage=21%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPEFDKKDYKTSLPPRLCVRSVMSWHRILLDYPYRSRLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 145546 - protein, 44 aa, Glycine max
  Coding DNA Sequence Number=SeqID_53861
APNTLPMKGLFVTKFESNRVLLSLIALKVVGPLLLDSNSSSDVA

SEQ ID NO: 145547 - protein, 125 aa, Glycine max
  Coding DNA Sequence Number=SeqID_53862
MVKKECKEVSVSFKRLAKKESHFEIKTNIKETSPLRQPPHLLLCKKTLVSTTTPLSLSDQGVRTYPKRIKVILDWPTPPNIKEIWGCHDLTNFYKRLVAPVIELVSRERAQSMKNLGSQVLGAVN

SEQ ID NO: 145548 - protein, 54 aa, Glycine max
  Coding DNA Sequence Number=SeqID_53863
MTGDASKFTHISPKNSGHVTYGDNNKGRILGVENIDKTSNHAQCFLSKDDYSLL

SEQ ID NO: 145549 - protein, 117 aa, Glycine max
  Coding DNA Sequence Number=SeqID_53864
  Homolog annotation: Hit_ID=Q949K7; Match level="QueryCoverage=37%, HitCoverage=50%, E-value=3e-09, Identity=59%"; Hit description =Putative gag polyprotein
MTFTAPLKAQLIQLVPKRGHSLSSMCRTSPDKYKGSTCPKNQLKMYCQKMGAYTKDEKLLIHFFQESLTGAAVTCISTILIWLRIGCNYRAYIRGGTDLSKNTPKGGGIWQPKWHPQ

SEQ ID NO: 145550 - protein, 103 aa, Glycine max
  Coding DNA Sequence Number=SeqID_53865
HDSKVNMTDLVSAEDDTAKNNFYTDNNSGISARQRDSNVSMTDLVSAEDDTAKKNVYTDNHSGISARQRDSKVNMTDLVSAEDDIAQKVLKVRTTTWVSPHVT

SEQ ID NO: 145551 - protein, 132 aa, Glycine max
  Coding DNA Sequence Number=SeqID_53866
MPQNVLYDAIGIYQRCFLALKISITQKIRPVVILFHYGESWNLLRADQRLIFAKSWPRASRYQQGHQDLSVLRSGGGLPVVDEFFDAQRLSGSSLSIYRRTRGFEGSRVLFQLLFPPSATDGVGNFEKHLGR

SEQ ID NO: 145552 - protein, 182 aa, Glycine max
  Coding DNA Sequence Number=SeqID_53867
  Gene Ontology: Mol. function=motor activity; Cellular component=cell projection
  Homolog annotation: Hit_ID=UPI00016621D1; Match level="QueryCoverage =97%, HitCoverage=40%, E-value=5e-22, Identity=39%"; Hit description =UPI00016621D1 related cluster
DCTLAIRGLHVLTFRGLHVLTFRGLHVLTFRGLHILAIRGLHALTFRGLHVLTFRGLHVLTFRGLHVLSFRGLHVLAVRGLHVLAFRGLHVLTFRGLHALAFRGLYVLTFRGLHALTFRELHVLAIIGLHALTFRGLHVLTFRGLHVLTFRGLHVLAFRGLHVLTFSGLHSHTLREFKVLYP

SEQ ID NO: 145553 - protein, 652 aa, Glycine max
  Coding DNA Sequence Number=SeqID_53868
  Gene Ontology: Mol. function=formate C-acetyltransferase activity; Cellular component=membrane fraction; Biological process =carbohydrate metabolic process
  Homolog annotation: Hit_ID=P09373; Match level="QueryCoverage=100%, HitCoverage=87%, E-value=0.0, Identity=90%"; Hit description=Formate acetyltransferase 1
  Pfam annotation: Domain name=PFL; Domain location=11-604; Score =1230.5; E_value=0; Accession=PF02901.6; Description=Pyruvate formate lyase
MSELNEKLATAWEGFAKGDWQNEVNVRDFIQKNYTPYEGDESFLAGATDATTKLWDSVMEGVKLENRTHAPVDFDTSVASTITSHDAGYINKALEKIVGLQTEAPLKRAIIPFGAYNRELDPMLKKIFTEYRKTHNQGVFDVYTKDILNCRKSGVLTGLPDAYGRGRIIGDYRRVALYGIDFLMKDKYAQFVSLQSDLENGVNLEATIRLREEIAEQHRALGQIKEMAAKYGCDISGPATNAQEAIQWTYFGYLAAVKSQNGAAMSFGRVSTFLDAYIERDLKAGKITEQDAQEMIDHLVMKLRMVRFLRTPEYDELFSGDPIWATESIGGMGVDGRTLVTKNSFRFLNTLYTMGPSPEPNITVLWSEKLPLNFKKFAAKVSIDTSSLQYENDDLMRPDFNNDDYAIACCVSPMVVGKQMQFFGARANLAKTMLYAINGGVDEKLKMQVGPKSEPIKGDVLNFDEVMDRMDHFMDWLAKQYVTALNVIHYMHDKYSYEASLMALHDRDVIRTMACGIAGLSVAADSLSAIKYAKVKPIRDEDGLAIDFEIEGEYPQFGNNDARVDDMAVDLVERFMKKIQKLTTYRNAIPTQSVLTITSNVVYGKKTGNTPDGRRAGAPFGPGANPMHGRDQKGAVASLTSVAKLPFAYAKD

SEQ ID NO: 145554 - protein, 224 aa, Glycine max
  Coding DNA Sequence Number=SeqID_53869
AKAANRNSQKARRRDRPFENAGGALCRARHADDRPTPRHRPCPSGICGPPRCRGALPPFIRRGSAHPRFWRIAENVSVRSLISHEVSRDGRFSAGLEPGCQKSIFVHLIEQKRTPASSNFIRRDRQPHGHGKDCACPAKHAGRYRLYAGVHGMMWLRTRSILRSFSWIGSRSCRIAAAAIAQGLALDVDGFAGRIPFAWTPHRDWPCSGHPLHVHGDVASARNR

SEQ ID NO: 145555 - protein, 99 aa, Glycine max
  Coding DNA Sequence Number=SeqID_53870
TVPRDRVRVMLHRLQARPPHLIRAGQAGAFDMEQYLRHLGSASFSSPTPAQFRAEVAWPGDWPEAQAGEAPPEAPGDGEEAHEDEEMADLLDFLGGSGD

SEQ ID NO: 145556 - protein, 347 aa, Glycine max
  Coding DNA Sequence Number=SeqID_53871
  Gene Ontology: Mol. function=hydrolase activity, acting on acid anhydrides, catalyzing transmembrane movement of substances; Cellular component=integral to membrane; Biological process=copper ion transport
  Homolog annotation: Hit_ID=A1W5R4; Match level="QueryCoverage=99%, HitCoverage=47%, E-value=1e-127, Identity=62%"; Hit description =Heavy metal translocating P-type ATPase
  Pfam annotation: Domain name=E1-E2_ATPase; Domain location=233-347; Score=-0.4; E_value=1.5e-08; Accession=PF00122.11; Description=E1-E2 ATPase
  Pfam annotation: Domain name=HMA; Domain location=17-80; Score=67.6; E_value=4.1e-17; Accession=PF00403.17; Description=Heavy-metal -associated domain
  Pfam annotation: Domain name=HMA; Domain location=84-149; Score=12.9; E_value=0.075; Accession=PF00403.17; Description=Heavy-metal -associated domain
  Pfam module annotation: Pfam domain module=E1-E2_ATPase::HMA::HMA; Domain location=233-347::17-80::84-149
MMRMSKKTLSDTIQAILIPIEGMTCASCAGRVEKALTKVPGVKSVSVNLATERATIQASGEVDRNALIEAIHKTGYEVPTSRVELNVMGMTCASCVGRVEKSTQLQGVAERQKETELLSLKWDLIVAAALSLPVFVMEMGAHLIPGVHELIMDTIGMKSSWYTQFVLTTLVLVFPGRRFYQKGFPALLKLAPDMNSLVAVGTAAAFGYSVVATFAAGLLPQGTVNVYYEAAAVIVVLILLGRFLEARAKGRTSEAIRRLANMQVKQAHVMRNHRFLDVPITEVVLNDVLEVRPGESVPVDGEVTNGKSFVDESMITGEPMPVEKGLGNSIVGGTINQKGVLEMRATA

SEQ ID NO: 145557 - protein, 237 aa, Glycine max
  Coding DNA Sequence Number=SeqID_53872
  Gene Ontology: Mol. function=hydrolase activity; Cellular component =soluble fraction; Biological process=xenobiotic metabolic process
  Homolog annotation: Hit_ID=A8V818; Match level="QueryCoverage=94%, HitCoverage=65%, E-value=3e-72, Identity=59%"; Hit description =Alpha/beta hydrolase fold precursor
MMKNATFKWMVRPILLGAVMTAFAMPFEVTAAPASNSSTLNETSVTYHTEVVDGVKVFYREAGPKNAPTVLLLHGFPTSSHMFRNLIPQLADRYHVIAPDYPGYGQSDQPAMDKFNYSFDHLASIVDKFTVQRGLSKYAIYVQDYGAPIGYRLASAHPEKITAIVVQNGNAYNEGINNPFWDPIKALWKNKTEANAAKLRPFLELNATKWQYIEGLRDPSHVSPDTWMLDQAYLDRP

SEQ ID NO: 145558 - protein, 183 aa, Glycine max
  Coding DNA Sequence Number=SeqID_53873
  Subcellular localization annotation: CTP_CleavageSite=17; ConfidenceScore=5.10e-01
FCSTLALSRKVHWAKTCAILFSSSPPFLQKAFQETYSWLQTLNTRDQRSLGSLQEAGIASWFITRHKRPTSFGFIARSEYNFLVVITGHKGPMFLGVHCKKFYKDSGNLKRVAWGLDVGMGCGRTTSRYIMDLRHIPESKGKDHLIFSRASVVHFRASRYITGLKHIPESKGMAIRICRGLPC

SEQ ID NO: 145559 - protein, 393 aa, Glycine max
  Coding DNA Sequence Number=SeqID_53874
  Gene Ontology: Mol. function=tRNA nucleotidyltransferase activity; Cellular component=exosome (RNase complex); Biological process=tRNA processing
  Homolog annotation: Hit_ID=A7ZTJ4; Match level="QueryCoverage=60%, HitCoverage=100%, E-value=1e-110, Identity=86%"; Hit description =Ribonuclease PH
  Pfam annotation: Domain name=RNase_PH; Domain location=165-298; Score= 203.0; E_value=7e-58; Accession=PF01138.12; Description=3' exoribonuclease family, domain 1
  Pfam annotation: Domain name=RNase_PH_C; Domain location=312-379; Score=89.7; E_value=9.1e-24; Accession=PF03725.6; Description=3' exoribonuclease family, domain 2
  Pfam module annotation: Pfam domain module=RNase_PH::RNase_PH_C; Domain location=165-298::312-379
MGADFCHFGAYAFKTLLNHRFQRLAFGFAGHDKVIQGTVEGGKDFGGDGIQILLTGSHDARPAQNINRVDFAFITLHFDPVRRIHELFSQFFIQDQFALRTGIRLKTQVTFHFTARQTSTDALAYNGLEAAELLRHTEICFQIALPHSFQAGEFIMRPAGRSANQVRPVTLTRNYTKHAEGSVLVEFGDTKVLCTASIEEGVPRFLKGQGQGWITAEYGMLPRATHTRNAREAAKGKQGGRTMEIQRLIARALRAAVDLKTLGEFTITLDCDVIQADGGTRTASITGACVALADALNKLVAAGKLKTNPMKGMVAAVSVGIVNGEALCDLEYVEDSAAETDMNVVMTEDGRIIEVQGTAEGEPFTHEELLTLLALARGGIESIVTTQKAALEN

SEQ ID NO: 145560 - protein, 49 aa, Glycine max
  Coding DNA Sequence Number=SeqID_53875
MKKQQWKRRCGGRQRRRGEGRHHLLGNKPRKKELHHQELPWIRSLKRML

SEQ ID NO: 145561 - protein, 61 aa, Glycine max
  Coding DNA Sequence Number=SeqID_53876
  Homolog annotation: Hit_ID=A9PA58; Match level="QueryCoverage=55%, HitCoverage=10%, E-value=1e-07, Identity=88%"; Hit description =Putative uncharacterized protein
MEVVEVTDGSEDNDDGDNSGGVGEMVEIASHRLDELQPASDEVISRSITGLKLHMVAPFLA

SEQ ID NO: 145562 - protein, 95 aa, Glycine max
  Coding DNA Sequence Number=SeqID_53877
  Gene Ontology: Mol. function=sphinganine-1-phosphate aldolase activity; Cellular component=endoplasmic reticulum membrane; Biological process=carboxylic acid metabolic process
  Homolog annotation: Hit_ID=Q9C509; Match level="QueryCoverage=64%, HitCoverage=11%, E-value=2e-18, Identity=75%"; Hit description =Sphingosine-1-phosphate lyase
MRVHININLVSNFDLGIVGSFPICLKLKIFKACLWFAHTNPLHLDVFKSVACFEAEVVAMTAALLGSKEKNSGGQICGNMTPSGTEYIISYQVMS

SEQ ID NO: 145563 - protein, 135 aa, Glycine max
  Coding DNA Sequence Number=SeqID_53878
MPTGRKEAISFLWVLSLHDKSCQGSENLSTRVGPCKAKQKWSSRSTKEVFGGKGQRPWQNQGEWASFIDILALLIFGVVLFPNMEGLVDLAVIDAFLAYHNHKESPVVAILAMYDTFNRGCKTSNARIFCCALAL

SEQ ID NO: 145564 - protein, 78 aa, Glycine max
  Coding DNA Sequence Number=SeqID_53879
PYDSASSKEKVHHIGHVIVFLGLVSISGGPCGPCPCLKIGPISRPCCRNLPFGGRATRDSRDACSTKGIHAESPPTFI

SEQ ID NO: 145565 - protein, 134 aa, Glycine max
  Coding DNA Sequence Number=SeqID_53880
MGEVEEIQEKMKPDMEAMKERMATMMAMMSKRKIMEANAVTISATSTVAKVNPMPPSGLNQMNHPTSAMVGKDLGSTGGPHDVQIQNEHAFPPYGLPPNYTPPNVAYTPNKDVNNSTPIPIESQQPQTDHTHVS

SEQ ID NO: 145566 - protein, 470 aa, Glycine max
  Coding DNA Sequence Number=SeqID_53881
AHCVGSTYSAAGDHSCAHGAAAGDGAAASHRHRGGGNDRCGTTQPFRAGVNRHVDQRGVVTGAGLTRATEREEIDQNLQLVSDSMARFIQLAEEERHIYINRTKLADRYSWFICQNPIEQKDALWGITDAGAGTGGYPDLSAVAPEAGQLVVSHGQWKVQNSLFQATGNYSGMISYYSPQQQLQRREPVDVSFELRHSFSGAALRSETTAISYNLANRASPQNIERYISAGLAPGHVNYGWIYRLQNVRYVIGNNANPMNSAIAGLEESCWTEPTQLMVLDTKALKFNSYKKGAESSLGNRTLLPRIFPVICNKSKITRPPGNLSDVLWLEGDMGPLLTPSDQNNRFFVPLPPRPDKPLAHIITDPLGVVIPVPIVCNINEGNALNVEFGRMVDAAIQLATGVTDFSSDLIATSNKDLGVAVFHRGQLMKPYQPSPVKLVNGEALETITLSPVKRKGAKLSGGEFTASAT

SEQ ID NO: 145567 - protein, 149 aa, Glycine max
  Coding DNA Sequence Number=SeqID_53882
MLTSKISVKVVGDFINILSFPACLHFSEENTETFSSLTSYPELRRSEFLIGGYVGARASLLSTTPPFVAMTQELVARGDTLRLSAPRHSVTPSVIDEQRPMWSSAPFPEMSAFSDGDFSSLTSYPELRRSKFLIGGYVGARALLLSAAP

SEQ ID NO: 145568 - protein, 15 aa, Glycine max
  Coding DNA Sequence Number=SeqID_53883
MALAWALSGGIWVWS

SEQ ID NO: 145569 - protein, 55 aa, Glycine max
  Coding DNA Sequence Number=SeqID_53884
DRARKTPSGPEEGQLGLGVASSKYRSLSVQGSACCPQQGHQAPYQSSFHPEVLRP

SEQ ID NO: 145570 - protein, 190 aa, Glycine max
  Coding DNA Sequence Number=SeqID_53885
MAPKKHSAKRSRRDVAVEGTSAAPEFDSHRFRSAEHQQRFEAIKGWSFHIERRVQPRDDEYTDFQEEIARRHWTSLVTPMAKFDPDIVLEFYANAWPTEEGVRDMRSWVRGQWIPFDADALSQFLGDPLVVEEGQECEFSQRRNRADGFDEEAIAQLLCTPGQDFARTAAGRRVRILRTSMPPTSTSRLG

SEQ ID NO: 145571 - protein, 73 aa, Glycine max
  Coding DNA Sequence Number=SeqID_53886
MVGCCITWMLWKLERIDGDPALRGTRIRATWEYVSSVKSGTWRYVAGVRRPWGRQVGCYCPKPSLTNPDPTRT

SEQ ID NO: 145572 - protein, 213 aa, Glycine max
  Coding DNA Sequence Number=SeqID_53887
MDLSGFANHAKALATEFAGIRHRDNLARHLAHHAIEVRLTGVRRGNAGAQIEPVDAQKQLVEAVLTQLLLGGRTVERVRVAAHAAPQHHDLHPVVSRKLVGNVQRIGHHHQIAPPLQERHDLRGGGAGIEDQRIAVAHIAGRRVGDQRFDVAIQPPLVPQRPIESELLIEHRAAVSAQRTPFSFQKAQIVADRHRGYRKLFAELLHAHAAVLA

SEQ ID NO: 145573 - protein, 216 aa, Glycine max
  Coding DNA Sequence Number=SeqID_53888
MQHYPISTYDFGQALNHNREYSSGIHGGIAQITVPVSEPRNPKSLFGDGDTEVDDNRDEDGEEEVDPEQGGAFGDVSDGGFGEAVGEGGGAGGEVEGEEDGEGEGGEGEEEGTAAALDEEELRGVGAAVSSDFAAGGVPDGEELRGEGGGTRHAAVVAAELHEEEDQKAARRADRGYVEQVVDVAVPGAEGVAVVTGGRRRRREGVSHRKLGFSEV

SEQ ID NO: 145574 - protein, 28 aa, Glycine max
  Coding DNA Sequence Number=SeqID_53889
MAAEWRRKRERRRHFKEKMSLEEVHHHR

SEQ ID NO: 145575 - protein, 57 aa, Glycine max
  Coding DNA Sequence Number=SeqID_53890
MAKGCGMTIICLRMSSGPPPLDDKRGQYDRDCGAANKSKALAPTYPPMRNSDLRSSG

SEQ ID NO: 145576 - protein, 285 aa, Glycine max
  Coding DNA Sequence Number=SeqID_53891
  Gene Ontology: Mol. function=RNA-directed DNA polymerase activity; Cellular component=mitochondrion; Biological process=RNA-dependent DNA replication
  Homolog annotation: Hit_ID=Q33883; Match level="QueryCoverage=52%, HitCoverage=22%, E-value=3e-67, Identity=84%"; Hit description =Maturase
  Pfam annotation: Domain name=Intron_maturas2; Domain location=24-180; Score=139.0; E_value=1.4e-38; Accession=PF01348.12; Description=Type II intron maturase
LYTPAGRKAAGEGGGHWAGSISSEFPIQIEAPIKKILRRLRDRGIISRRRPWPIHVACLTNVSDGDIVNWSAGIAISPLSYYRCRDNLYQVRTIVDHQIRWSAIFTLAHKHKSSARHIIPKYSKDSNIVNQEGGKTLAEFPNSIELGKLGPVAAASAPARYGRRSQSNTKQARKALSILLVKPKLIENESANEQENGKGVIPPPIRPDERSTELHPYSPGPCTSLSPGGWPPILDLPIFKRIPGSIWFSIKEFPSCLSNGKRASPRKCPFACRWGSKSYLLKLYL

SEQ ID NO: 145577 - protein, 212 aa, Glycine max
  Coding DNA Sequence Number=SeqID_53892
MAPAHVQRIVEALWVVGADVQHYRQGVGRADAAAGGVQRQFADRNAHAADALVAQAENALAVGDHDHLDVLLGGVLQHVIDAIAVRVGDEQPARAAIDIGEVLAGLADGRGVDDRHHLAQVRVQQAVEQGFVGVLDVAQVDVLVVIVLEILILTVGAFHLFFDGFHRFRQQAVQVEVATFFLGESAAFVQQRKFQQNRAGVRDVERAFAFVF

SEQ ID NO: 145578 - protein, 74 aa, Glycine max
  Coding DNA Sequence Number=SeqID_53893
VDSRGSPFIEKYCTQRQAQGDAPQAADAPPPHQASPADSFDTEQYLRHLVRQEAANHQAHVQTHDCLYQMSLSL

SEQ ID NO: 145579 - protein, 59 aa, Glycine max
  Coding DNA Sequence Number=SeqID_53894
MEERKIMEKLPEEEKAKDETLLQQAVTESQSFPKELLGAKCQRSVVITLQAKALSWEDR

SEQ ID NO: 145580 - protein, 66 aa, Glycine max
  Coding DNA Sequence Number=SeqID_53895
MYMVTLQGSFVPHGRQDITEHLAAILDDLTMGVAYRAAGQVSLLLSTTEGHQGHAAARPRPSANNN

SEQ ID NO: 145581 - protein, 176 aa, Glycine max
  Coding DNA Sequence Number=SeqID_53896
  Pfam annotation: Domain name=Transposase_23; Domain location=11-81; Score=2.2; E_value=0.00069; Accession=PF03017.5; Description =TNP1ENSPM transposase
MQSQGLAVPPEPLVLKCGLYIEADPARQVAVGRVYEGSTVVHNTHLLPGQVKVSVEEVTDADAPVPVPTDEVSLVGQALHTFLAWPTHLVKSLSQQVAVPPAKPPPKPDPEVDDPLYLMTLTIPELFLRPYQVRWDATVFGVFNPDFPLYIKHEDLSKIAHGGQCLSISVLQLWIL

SEQ ID NO: 145582 - protein, 133 aa, Glycine max
  Coding DNA Sequence Number=SeqID_53897
  Subcellular localization annotation: CTP_CleavageSite=49; ConfidenceScore=5.48e-01
VVLPETLRKKGSSGKVFRKFETSSGSGRLPEFFRMNHFFRKVPGRRFPEVFRKKCSFGRRLVTSGRTLLPETFRKTYYPKVPLLQAITMLYQRGVRETNLVRGEEEDDVRACLAGEEEAVRGEEEAVRGRNEE

SEQ ID NO: 145583 - protein, 107 aa, Glycine max
  Coding DNA Sequence Number=SeqID_53898
MGVGRGGNQEEAKVLGYKTIVFGWKSIGDENPETGQIQAKGPSGEGRRPNFSLGSLLNQSQTYQGNPCGVYPDLSSFTGRGVYPDLSSFIGSGVIQISIACIKRSAP

SEQ ID NO: 145584 - protein, 75 aa, Glycine max
  Coding DNA Sequence Number=SeqID_53899
MWVSRERFPTVFRQEEKEKSDFRQEDDKEKKEGKKTFFFSSDRYLPPHARPRCGHLRLPWNWNRKGRSFESLEQR

SEQ ID NO: 145585 - protein, 57 aa, Glycine max
  Coding DNA Sequence Number=SeqID_53900
MYQERTSLEEYFLEASTLKSNQGVMDGRNDCAIADALQALAQAIRNPYRGEAAGAVE

SEQ ID NO: 145586 - protein, 137 aa, Glycine max
  Coding DNA Sequence Number=SeqID_53901
MALQIGHQIDWAHLVRYHMHKALRVNAPLPYPHLVTLILQHFGIPLTNEPFVKVKCSFAIGATAVESFGYRKDLDGQWVRKQDLPTNAPDECIPSPPPRDPSSSLLNDILSELRDLHAFAEKGLIQWIDESCNMRMT

SEQ ID NO: 145587 - protein, 92 aa, Glycine max
  Coding DNA Sequence Number=SeqID_53902
MERIVMLFGAFGRTEILDYIRLTMFTESQSQSQDYFGECGYYVMHWMSTIILGTFRNNWEAYFNDARPLEPERLKALRIQWAQFYLRVRDQA

SEQ ID NO: 145588 - protein, 29 aa, Glycine max
  Coding DNA Sequence Number=SeqID_53903
MAALPDELRLTPEVTGSPKRVATSPGELV

SEQ ID NO: 145589 - protein, 99 aa, Glycine max
  Coding DNA Sequence Number=SeqID_53904
  Gene Ontology: Mol. function=aspartic-type endopeptidase activity; Biological process=DNA integration
  Homolog annotation: Hit_ID=A5AKY6; Match level="QueryCoverage=95%, HitCoverage=8%, E-value=2e-32, Identity=71%"; Hit description =Putative uncharacterized protein
MALEEGKMKIEKFDGRDFSFWKMQIEDYLYQKKLYQPLSGVKPEDMKQEEWNLLDRHALGVIRLTLAKNVAFNIMNEKTTAGLMKALSDMYEKPSAANK

SEQ ID NO: 145590 - protein, 170 aa, Glycine max
  Coding DNA Sequence Number=SeqID_53905
  Gene Ontology: Mol. function=protein binding; Cellular component =nucleus; Biological process=hermaphrodite genitalia development
  Homolog annotation: Hit_ID=Q9LIQ0; Match level="QueryCoverage=65%, HitCoverage=17%, E-value=5e-22, Identity=46%"; Hit description =Genomic DNA, chromosome 3, BAC clone:F14O13
MWDKGTKTTNSNIKLIRESSMDHLDPYVDFTSMDRVWFMDQVDPFQENPEDRVLGHARKVEGSMRKKTNARKEQRKSKEERMAIEQKEREEELKRLKNLNKQEIQEKVKKIMKTAGIHGDDIIPLSREEIEEEFDPQEYDRMMKKAFDEKYYNVEDADPDFCSDMMTMRS

SEQ ID NO: 145591 - protein, 296 aa, Glycine max
  Coding DNA Sequence Number=SeqID_53906
  Gene Ontology: Mol. function=zinc ion binding
  Homolog annotation: Hit_ID=A7UQU7; Match level="QueryCoverage=75%, HitCoverage=44%, E-value=1e-21, Identity=29%"; Hit description=IMP dehydrogenase/GMP reductase, putative
  Pfam annotation: Domain name=DUF1723; Domain location=156-205; Score =49.2; E_value=1.5e-11; Accession=PF08330.1; Description=Protein of unknown function (DUF1723)
MVKTRGLGRALGRVGAKGLGRGGDGDDTDVILDDDVPVVPANSPAVPEAEAAVAGDEPMVDAATQDTGAETDAQDTGAETDGDELEGFLGGPRDPLVLTEYADHVAGSVWSGQEHLELKLCSHGRKVHNLGRSIPAIEDMVAGTGLSPLIACSIDTGDRGLISSFVERWHRETSNFHLPVGEVSITLDDIASLLHLPIVGAFHDFQPLCTDETVLLLVELLMVSAEHWTVAAHAYLLHLLGCTLFANKSATHVHVAHIQALRNLTLAGRYAWRAAGLVHMYNQLNDASLSTSRQFA

SEQ ID NO: 145592 - protein, 118 aa, Glycine max
  Coding DNA Sequence Number=SeqID_53907
  Gene Ontology: Mol. function=protein serine/threonine kinase activity; Cellular component=cytoplasm; Biological process=protein amino acid phosphorylation
  Homolog annotation: Hit_ID=Q53VM2; Match level="QueryCoverage=51%, HitCoverage=13%, E-value=1e-14, Identity=63%"; Hit description =Ser/Thr protein kinase
MVRWIILKNLALEDAETQHYDMMCLGRFKVQKLIDFDNITRENTTLKIYHGHLSEVDSRRYFQQLIDNVDYCHCNGVYHIDLKLENLLLDSLGNIKIFDFGLSAFPKQMNLLPNNFYI

SEQ ID NO: 145593 - protein, 155 aa, Glycine max
  Coding DNA Sequence Number=SeqID_53908
  Gene Ontology: Mol. function=nucleic acid binding; Biological process= DNA integration
  Homolog annotation: Hit_ID=A5BTC5; Match level="QueryCoverage=84%, HitCoverage=30%, E-value=4e-13, Identity=36%"; Hit description =Putative uncharacterized protein
MAKNYESDEEVSLKKSWYIDSGCSKHMTGDASKFTHISPKNSGHVTYGDNNKGIILGVGKIESIHVAFDETNLILPRKDTLDDISNSLEGMHIHGEDHKGKGKGNDEDFQIDETKSSAYLPKGWRTSRYHPLDNIIGDISKGNSLKICKMNLECQ

SEQ ID NO: 145594 - protein, 167 aa, Glycine max
  Coding DNA Sequence Number=SeqID_53909
  Subcellular localization annotation: CTP_CleavageSite=22; ConfidenceScore=5.36e-01
MAESSKKRKGSSSTTTAVGQCRHDTSGDPPAPNPPSFSSHRSLTLFSSNDQHQRYYSQFSNRVILDPKYLDALLANAHFLYPHLVTLFLQHFNVPLEDEPFVKVKRSFAIGAGVVTSFGYWKDMDGQWVHKQDLPPPILDEHTPSPPPQRDTSSSLLNDVLIELRDL

SEQ ID NO: 145595 - protein, 42 aa, Glycine max
  Coding DNA Sequence Number=SeqID_53910
MVDFEPRKKVDFGGGDFLEKASEKGPLKDTSSLSISKGSTYI

SEQ ID NO: 145596 - protein, 137 aa, Glycine max
  Coding DNA Sequence Number=SeqID_53911
MGTINTFGVEFDAGASCMSKLCQELGFVKVAFDDEDIMLGYVGADEANCADDENGHVALTVDMGGGVDLLLPLDPALGGGEVEAAEINEPLEVEIKAEELEGEDFGGDSEAKEGGEGLEEVRVTVRVTERVWRKCEK

SEQ ID NO: 145597 - protein, 118 aa, Glycine max
  Coding DNA Sequence Number=SeqID_53912
  Gene Ontology: Mol. function=oxidoreductase activity; Biological process=electron transport
  Homolog annotation: Hit_ID=A7PAQ2; Match level="QueryCoverage=77%, HitCoverage=17%, E-value=4e-34, Identity=72%"; Hit description =Chromosome chr14 scaffold_9, whole genome shotgun sequence
MGLCRKEVPIVEWYRTKVVPDTEMIKEFLSKYSTTSGKLWQQQQGTKHFIGRGLLMANGEDWRHQRHMVAPAFMGDRLKNYVGHMVECTKDMFQSLQDALEGGQTEVEIGECFIESQE

SEQ ID NO: 145598 - protein, 176 aa, Glycine max
  Coding DNA Sequence Number=SeqID_53913
  Homolog annotation: Hit_ID=A2Q4P8; Match level="QueryCoverage=27%, HitCoverage=21%, E-value=1e-10, Identity=61%"; Hit description=IMP dehydrogenase/GMP reductase, related
  Pfam annotation: Domain name=DUF1723; Domain location=57-106; Score =32.6; E_value=1.4e-06; Accession=PF08330.1; Description=Protein of unknown function (DUF1723)
MDDAAEEVFQHAEEVFDDAKGFPSGSCDPSMLTAYADHVAVIVCNREERPKLKLFSHGRKGLILAFVERWYKETSNFHLPVEEVTITLDNVASLLHLPIIGAFHNFETLHVDEAVLMLVELLEVGRDEARAETVQCHRAYVALFFLTRVQHMCMSCSWMPFETTVRVEPAHGELPA

SEQ ID NO: 145599 - protein, 128 aa, Glycine max
  Coding DNA Sequence Number=SeqID_53914
MHYVAGNDNIVPPKWIVLNKDKATTQLQMFLKPTTPVLTPQGLDIYVSGIAKKMAEKSREAGKNIRESDDNTVHLMSSFLQKNEKNEKKCPSKIGLMTSGSEKNDGVQVEDLRMSGGERITCGGDRES

SEQ ID NO: 145600 - protein, 86 aa, Glycine max
  Coding DNA Sequence Number=SeqID_53915
MSSSIIHAPPSSRPDINIALYSCSTSEGACAGASSIVVATIGNSGIFGSTCLILHDRWMSRRIPRLCLRHEWMQNHVEPVDVVRCM

SEQ ID NO: 145601 - protein, 130 aa, Glycine max
  Coding DNA Sequence Number=SeqID_53916
MTPPPPMSLSSRTSDVEDDDLPNTIDGLVGSGGREVDGVAHRSSLGDGVWFMAVVFASIGDKIGDVDVGGMIVVVVGWHAHNDVVLAVTRQRQGDMKWCNDIVGMVVIVAQRDIGMVMVGLVAHGATVDW

SEQ ID NO: 145602 - protein, 91 aa, Glycine max
  Coding DNA Sequence Number=SeqID_53917
MYLNNLITRDRISGNDLAPLDIEIEGTCRRNNVARRMREQQEVQANQGPSSSISSSFFPVINPHQNFEEHIMEEGQPQRITLEDYSSSSTP

SEQ ID NO: 145603 - protein, 133 aa, Glycine max
  Coding DNA Sequence Number=SeqID_53918
MGFNLELAKGPRLPVQKQPERGMPLVSSLATRKIISEGSGPRDICHGGGSTTWGRTALVEKKKASGKAESGRTGLGYLSNLQRNHDAHVHVYLHHEPIYQASPIHVEGGRVGGKSEPGRNGLMIRIDMEVLGV

SEQ ID NO: 145604 - protein, 125 aa, Glycine max
  Coding DNA Sequence Number=SeqID_53919
MTLTNSFEREKCVGARIRCNEGEGALQWSAVTNEVRRRCCVCRERTDHFRIKLIHEWMYEIMSERANMDYENAEACGVNEPHVDCLDAFKTPQVFECREDVLRWARSVTHENGFVAVILRLDTNT

SEQ ID NO: 145605 - protein, 492 aa, Glycine max
  Coding DNA Sequence Number=SeqID_53920
  Homolog annotation: Hit_ID=A7PJ55; Match level="QueryCoverage=82%, HitCoverage=95%, E-value=1e-125, Identity=50%"; Hit description =Chromosome chr12 scaffold_18, whole genome shotgun sequence
  Pfam annotation: Domain name=AATase; Domain location=86-487; Score= -204.0; E_value=0.011; Accession=PF07247.3; Description=Alcohol acetyltransferase
  Pfam annotation: Domain name=DUF1298; Domain location=333-486; Score =32.8; E_value=4.7e-12; Accession=PF06974.4; Description=Protein of unknown function (DUF1298)
  Pfam annotation: Domain name=UPF0089; Domain location=84-329; Score= -102.9; E_value=0.0054; Accession=PF03007.7; Description =Uncharacterised protein family (UPF0089)
  Pfam module annotation: Pfam domain module=AATase::DUF1298::UPF0089; Domain location=86-487::333-486::84-329
METQMTSREKSAYLDNVDELKKKKKKKKNKATGQEAEEKTTPHNGTGPQGRRRRKKVAEQEEEAQKKNEGIMERFHEEEIEEPVSPTGQYLTSSSLSVYILGVLESEVPIDDSQTVPLLQNLFLPINSRFSSIMIRDKNGEKKWKKVEVKLEDHIKVPTFPNGKSSNLFLYDEYLDEYMSTIAVEHLPQNRPLWELHIIKYPTSNAKGTLVFKLHHALGDGFSLMGALLSCMQRADNTSLPFTLPSSQRPKASSISNTKGFFKKLPSIFFQTISEFGWSFLKSKLIEDDQTPIRSCAEDFKTRQMTISDVTFSLDLIKDVKSKLGVEMIEKTNSRSAWGNQYAFLHVSIPELSDSKYANPLEFIREAHKDMTKKKNSLATPLTGMLLDMLRKLRGPEAAASYLRSTLRNSSTTISNIIGPVEQMAVANHPIKGFYFMVAGSPESLTMTIMSYMGKIRIAFGVEKNFIDKQLFKSCLENSLEMIKEAAKKISA

SEQ ID NO: 145606 - protein, 172 aa, Glycine max
  Coding DNA Sequence Number=SeqID_53921
MSLRGMRDLPRPFGIEEIFENTKNMVEANNIMQNMAWGSASSSHIPSQITPTPNNNGRVYVANPINQFDGASKHGMNMQQINACFGYIPTMAQESTNSTSSYPRQFNCLQNIPQSQPIFEDLKPLDYKNEMVDFSYQVDVPLDSTNQLVNGDLVGLDNKPNESILQNIPVQY

SEQ ID NO: 145607 - protein, 73 aa, Glycine max
  Coding DNA Sequence Number=SeqID_53922
MGGCAILLQSWAWYRMPFIAPRVPRPETTFPLAKKLFTYSEIWSGGRLEYRATPHGDLVGYRSRIDHMESHEV

SEQ ID NO: 145608 - protein, 91 aa, Glycine max
  Coding DNA Sequence Number=SeqID_53923
MFSGLNLNQEGETLIDSLDLGLAGKYTRFKCSFKLVPIPHGWSILAKQCDLDLSPYDFTYAPPAHPASRLSLLALSEPISLSKPSEVETSK

SEQ ID NO: 145609 - protein, 426 aa, Glycine max
  Coding DNA Sequence Number=SeqID_53924
  Homolog annotation: Hit_ID=A5B5G7; Match level="QueryCoverage=47%, HitCoverage=14%, E-value=1e-09, Identity=27%"; Hit description =Putative uncharacterized protein
MHFASMLFLPSSLLIYLSNPKVAWERYEQNVHSRNILPKRNVTLYVIEYDEFRRELERRRWHKALTRQPDGRIDVALVKEFYANFFDPEEKSSRQVQVRGKLIKFDGETLNTFLETPVVFEPGERYLAYSRFCHTHLDPQELALSSAFQGHGFVLNTEGAPWKLLRKDLTTLVQTWSILSYSNLASISNTSDLNMDRARLVYGLVTNMDMDVGSFISRQISQMAQSNSSRLGFPALINALCIARGVVPDSLTFKSLSPAINLAYIRKNCWNPDDPTITFPGTRKAQARAPSDASAPSSSAPTSPAPTPAPPAPAPTPSGTSAQSTEILVSMLQSLHHGLCLVMQSIHNLAQHRPIISMEDFMAQVAWPGVQPSPMGEGEAPTAQELQPEVEAEAEETPKVTPATTKEGDGAASADYIANMAAAQST

SEQ ID NO: 145610 - protein, 179 aa, Glycine max
  Coding DNA Sequence Number=SeqID_53925
MDVNTMLMCNDQFSCVGPIELLCTVGRTPDAILKLLECPNIPTHDAVLYYNGRWKMPCQNNFVGYAFTGINPQKFDIPKGCTIDELKDLIKQVAPKGNPPHGIHESQLVRRLFYRQPAHLEYSDKVLKFEIIELKSDDDVLKVLLESNYWKQFVPIEILALFSKVVLENDDEVVTSLHF

SEQ ID NO: 145611 - protein, 110 aa, Glycine max
  Coding DNA Sequence Number=SeqID_53926
MLQPYEISIGLKEHSNPVTPKAYTPKSLSGPLPPDSGFSSKLRYYFEIPNGENVRNWVANMILKFHDDPTVNGFKIVIFLRMVWWAAGKRKGFERRRGKTKMRPKRRQLT

SEQ ID NO: 145612 - protein, 246 aa, Glycine max
  Coding DNA Sequence Number=SeqID_53927
ESGYKNLVVYVCLNAVLVEFSLTRGICGRGLIRTRLGYHEELGSSSPGDNIGTGKMNILTTHDQEWEQELSPYNQYEEERTPNLESVFEEFMAYHASSKANQNSMKNHEIHFGKSYSIENFHGGPKLQPYHQNEAERGSNLDKLLMQFMETTKSTQRALQSVEIQVGELAEAVTQFMVRQEKSFVEVEAQKKSHVKEHESREKDEEKDGEQAQQQWEKYSTVENQQENILQSNNLPHQLIDKKGRQ

SEQ ID NO: 145613 - protein, 278 aa, Glycine max
  Coding DNA Sequence Number=SeqID_53928
MSTTSSTASTEMKNGIIRPPLIIQFITAFNNDKNTIQLPAFYHTQWAPNYPEFVHLRYNGAIYEIRVRQHKDKVYLADGLQNFRKDLKIYESTSINFFACDHHSVFDIHFIPPLERQTCGRQRHSSRKHIWTLQLTQEMLDDPEPLKLPHCTEVPLKACGNHMTVLRRHGPPLQWKVETLNPAIGGKGQPQNLLPKCAVVNVVHTTANCSQSQIGDNAAPPLTLLLAPRSPDKFLMPPNEEPSNDNISKEKMKLILLPIVTYLTSQAMSPDTYTGYKH

SEQ ID NO: 145614 - protein, 111 aa, Glycine max
  Coding DNA Sequence Number=SeqID_53929
MEALKEQMITMMEVMMSMKKIMEVNVAAVAATSTVAEVEPTPPFGLNQINHLTSDRVGQGSKELGVDKTTLFCFLLCHDTSAEPIEWQVPLVFFLSGLNPAKSESEYSTKL

SEQ ID NO: 145615 - protein, 252 aa, Glycine max
  Coding DNA Sequence Number=SeqID_53930
  Gene Ontology: Mol. function=RNA binding
  Homolog annotation: Hit_ID=A9PA72; Match level="QueryCoverage=58%, HitCoverage=67%, E-value=1e-30, Identity=50%"; Hit description =Putative uncharacterized protein
MAHAANWVSVLSIPSKEFMLQKGITQGDLLAPFLLTITTKGLSDLMREVVSKNQYKGFKVGTKEVERGLWERVLNSKYSGLKGLGEGGVRSHESIWWRDLKLKIGDGPLGIVVDSRSHDQLWHFLPVLAFEGGTRRNIPRFEVVKANPGMNPELSCTDDLTLPFILFSQWNSSRIWWPKRWLYVPMYNGSLKDVCMLLNSPTCPVLDGLGQVWVNATSPHTTILVANEIMNSETLSGTQQRIMGEKLLQRIQ

SEQ ID NO: 145616 - protein, 112 aa, Glycine max
  Coding DNA Sequence Number=SeqID_53931
MFQYFTDQVIRKYVTDQVIRKYVTDQVDPEHAYGSDRVLRHRWQQWWKKDRVTVLTSTVDGHEAPSTWTVALLFAEASSMHHDNLLITATMAATSSTKKKKKSSKVKRMKKK

SEQ ID NO: 145617 - protein, 432 aa, Glycine max
  Coding DNA Sequence Number=SeqID_53932
  Gene Ontology: Mol. function=phosphoprotein phosphatase activity
  Homolog annotation: Hit_ID=A7P7E6; Match level="QueryCoverage=44%, HitCoverage=35%, E-value=2e-23, Identity=36%"; Hit description =Chromosome chr9 scaffold_7, whole genome shotgun sequence
  Pfam annotation: Domain name=DUF1723; Domain location=140-189; Score =54.7; E_value=3.2e-13; Accession=PF08330.1; Description=Protein of unknown function (DUF1723)
MVRTRGLGRVLGHVTGRVIVTATHDEPVVPAPDVEADVFPDEPMAPVDSEDIVANIPMDTGAEATEDEHEGFPGGPSDPSVLTQYGEHVACSVWTGEERPELKLSSHGRKVHSLGKLVPAIEGLVVGTRLSPLIACSVDTDDQRLLSSFVERWPRETSSFHLPVGELTITLDDVSSLLHLPVVGDLHAFQPLHVDDAVQMLVDLLMVSVKSARAGHWTVAACAYLLHLLDCTLFANKSATNVHVVYLDALRDLSMTGRYAWGVAALVDCDEEDREEHKYTGVQGAPGPTSDSGCLLNPVWGTPTGPGLPCHIMLFRWMHYSDHIVPVGKVCTMSGQCASDYMDWFFRISHPFMTPGHASDLLPDGHALQPRVVPQVPQTDIPHVSEPGASSTSVEELGHAVDVYDEIVERLERHLSLGVDDQEYDTGPSSIC

SEQ ID NO: 145618 - protein, 46 aa, Glycine max
  Coding DNA Sequence Number=SeqID_53933
MVIFHHEDVAEDKGEEEKLHHQESVLDKKLREEASMEEENEREKVA

SEQ ID NO: 145619 - protein, 98 aa, Glycine max
  Coding DNA Sequence Number=SeqID_53934
MRPSSMVVRAFDGSHRDLVIVSGEEDILVSCSSSMPYVEVAKESLETLFQALEIMNSAYVESPSIQPCLFDTSLMVARVMLKDRYEPGMGLGRNGGAA

SEQ ID NO: 145620 - protein, 48 aa, Glycine max
  Coding DNA Sequence Number=SeqID_53935
MVENLHEIAHGNVSEALRKGNEGGGCRPARPGELGCFHQKAPPSVGTP

SEQ ID NO: 145621 - protein, 76 aa, Glycine max
  Coding DNA Sequence Number=SeqID_53936
  Homolog annotation: Hit_ID=O52175; Match level="QueryCoverage=92%, HitCoverage=80%, E-value=4e-28, Identity=87%"; Hit description =Salmonella berta plasmid pBERT, complete plasmid sequence
MAAAKGFSVGSPPLTFIRKSDAQITGGETLQDYKDTRRFPLAAPSCALLFLPFGLPVSFRCYGHVCLIPRLTLSSG

SEQ ID NO: 145622 - protein, 178 aa, Glycine max
  Coding DNA Sequence Number=SeqID_53937
MAPTRHPLDPDKSNRALGFPALIKGLYQSFGVPVAPSKVIRPPITRAFIEKYCMQRQAQGDAPQAADVPPPHQAGPAGLFDTKQYLRHLVHQQAANHRAHVRTHDCLYQMSLSLQSQGFTSFPCPTPDQFRAEVAWPGDWPEARAGEAPAEAPDEADEAREDEEMTDLLDFLGGSGAT

SEQ ID NO: 145623 - protein, 59 aa, Glycine max
  Coding DNA Sequence Number=SeqID_53938
SEWVKEPFSAFRLSSQAVNPVIDSAAMESKPIESATAGTVSGVQIAVVGIFSAASSSSY

SEQ ID NO: 145624 - protein, 135 aa, Glycine max
  Coding DNA Sequence Number=SeqID_53939
MALKEAIKIELSHKGSSESLIIQPDIQQLGACVSTKGSNAQSNAQPSRENDGDVIPKMGLYVQRKDGTLGLVAMGKIMDGDSVIHTVAYVDDVARDEEIIPHKVYAHGDKPANVDADDPMCGLIKCTYIDIPNIF

SEQ ID NO: 145625 - protein, 158 aa, Glycine max
  Coding DNA Sequence Number=SeqID_53940
  Homolog annotation: Hit_ID=UPI00006A2939; Match level="QueryCoverage =77%, HitCoverage=75%, E-value=7e-09, Identity=32%"; Hit description =UPI00006A2939 related cluster
RLHALAIRGLHVLTFVGLHALTFRGLHVLANRGLHALTLRGLHVLANVGLHALTFRGLHVLANRGLHALTFRGLHILVFRGLHVLTLRGLHVLALRGLHVLALRGLHVLTIRGLHALTSRGLHVLALRGLPALALGTSYPHLQRTTCPHLRRATCPHL

SEQ ID NO: 145626 - protein, 41 aa, Glycine max
  Coding DNA Sequence Number=SeqID_53941
MLLQSLSEWATTMSTKNVVLADLLRCSFCYIHNCYRPPILQ

SEQ ID NO: 145627 - protein, 176 aa, Glycine max
  Coding DNA Sequence Number=SeqID_53942
  Pfam annotation: Domain name=G-patch; Domain location=2-41; Score =24.3; E_value=0.00022; Accession=PF01585.14; Description=G-patch domain
MARVMLGNGYEPGMGLGKDNGGITSLIKTQGNRGKYGLGYKPTQADMKRSIAGRKNSGQSSRWKQESEGNPPCHISRSFISAGLGDEGQVVAICEDDVPSTLDLVRPCPPDFQLGNWRVEERPGIYATSIIFDDESPEGTNTWDPSINFEQEMNQTEDEGDEDVGLSFGARKNGRP

SEQ ID NO: 145628 - protein, 93 aa, Glycine max
  Coding DNA Sequence Number=SeqID_53943
MAVPKSEKMQRQDETNKKQKSSRERKLRAHSRHMIKDPNGQIVDNCHVKLLAKVGEDPTVNEGWTAFLLRQLHVASSRSFIKRLLQEASPWLL

SEQ ID NO: 145629 - protein, 147 aa, Glycine max
  Coding DNA Sequence Number=SeqID_53944
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=59%, HitCoverage=74%, E-value=3e-24, Identity=69%"; Hit description=LacZ protein
MERGKEIQTKSTALMLSLVRSMGSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 145630 - protein, 137 aa, Glycine max
  Coding DNA Sequence Number=SeqID_53945
  Subcellular localization annotation: CTP_CleavageSite=45; ConfidenceScore=5.20e-01
MVKVGTSYVRSTSHFAKSGPGLPAVPPVQLLTGWCVTAKAPPDISAGKCSGHAARRVPFAIQAAQLLGRAIGAGLFAITPAGERGMCCKAIKLGNARVFPVTTLANWSSTAVAAALELVDPPGCRNSMEQVGSGNGV

SEQ ID NO: 145631 - protein, 190 aa, Glycine max
  Coding DNA Sequence Number=SeqID_53946
  Gene Ontology: Mol. function=potassium-transporting ATPase activity; Cellular component=integral to membrane; Biological process =potassium ion transport
  Homolog annotation: Hit_ID=A6X5I0; Match level="QueryCoverage=100%, HitCoverage=100%, E-value=6e-91, Identity=91%"; Hit description =Potassium-transporting ATPase C chain
  Pfam annotation: Domain name=KdpC; Domain location=2-187; Score =297.5; E_value=2.6e-86; Accession=PF02669.6; Description=K+ -transporting ATPase, c chain
MLKQLRPALVMIVSLTVITGLLYPLGMTGIAQAIFPTNATGSLIEKDGTIIGSELIGQGFTGDRYFHGRPSAAGQNGYDAASSGGSNLGPTNPKLIERIKADVTALSQDEGSAPPPIDLVTTSASGLDPHISPEAAFYQVPRVAKARGIDEAALREIVEQQVEARELGFLGEPVVNVLKLNLVLDRTSTK

SEQ ID NO: 145632 - protein, 110 aa, Glycine max
  Coding DNA Sequence Number=SeqID_53947
MENCTKQSNQHGSKLVGGGRMNENAIHGAPKKGCREWRIALSNHYAWLQTRGWRRHEQKTQFMRLRIKRLRMENSTKQSLRMAPNSWVEDACTKTQFMGLRKRVENGELH

SEQ ID NO: 145633 - protein, 59 aa, Glycine max
  Coding DNA Sequence Number=SeqID_53948
MGTRGCINYNPVLAIRQLGYPMRRAPSEEGLTPFIAGEDNHSGGSRDEATSRRDRTRRL

SEQ ID NO: 145634 - protein, 76 aa, Glycine max
  Coding DNA Sequence Number=SeqID_53949
MGRVCEGSTVVHKTPLLLGQVKVVVSLAKPPSKPDLEVDDPLYLMTLMIPKLFLRPYQVRWDAIVFGVFNPDFPST

SEQ ID NO: 145635 - protein, 74 aa, Glycine max
  Coding DNA Sequence Number=SeqID_53950
MVSPQGRNTWTVDDLVPYVEKITILSKEQERITRRVVVEVEEYSQQMAERGLGMYYTPPTFSQYPTQMYQYPST

SEQ ID NO: 145636 - protein, 189 aa, Glycine max
  Coding DNA Sequence Number=SeqID_53951
MAPRKLASKRSRKDKAAEGTSSAPEYDSHRFRSAIHQQRFEAIKGWSFLRKRRVQLRDDEGQWIPFDVDAIGQLLGYPLVLEEGQECEYGQRRNRSDGFDEEAIAQLLCIPGQDFARTAAGRRVPIMRTNMTTLTHIWMTLLLSNILPTDHNSELPLPKCQLVMAPTRHPLDPDKSNRALGFPELITRL

SEQ ID NO: 145637 - protein, 72 aa, Glycine max
  Coding DNA Sequence Number=SeqID_53952
MKGNQQRGKSRPQWSRQLSQPTLRREGDARLAGRETRETRVSRKEYARSRHQRLFEENVGKTGKDAIYELLS

SEQ ID NO: 145638 - protein, 81 aa, Glycine max
  Coding DNA Sequence Number=SeqID_53953
MELSFAQHVADPPTPVHERPADPSTPILEIPKDSTTLVLTLNTTPPSTPELQFSDEEGGRITTPPGTPVLHFHDEEQDRDE

SEQ ID NO: 145639 - protein, 106 aa, Glycine max
  Coding DNA Sequence Number=SeqID_53954
FIEKYCTPRQAQGDAPQAADAPPPPHQADPAGSFGMERYLQHLSQGFAPFACPTLDQFRAEVAWPGDWPEAQAGEVPAEAPGDADEAHMDEEMSDLLGFLGGSGAT

SEQ ID NO: 145640 - protein, 157 aa, Glycine max
  Coding DNA Sequence Number=SeqID_53955
  Subcellular localization annotation: CTP_CleavageSite=15; ConfidenceScore=5.12e-01
MSCTCSLSALLHLTKCTTSVHPLSEKGALSQKSLMCTKRSIRSLDWDSELCMSRVSRLRKVQVPESFKRFCCVKICRDQSLKQESASWYGKLNPLLDHPCSNAFKGYFDDVKEFKNQEKFQVSSFQESRIIKNKIQESREDSIKISIKKFFKTLNST

SEQ ID NO: 145641 - protein, 83 aa, Glycine max
  Coding DNA Sequence Number=SeqID_53956
MFINCCYCKPFLATGNRLHPLRICIKSSRSSSKHLRHLLLQEALLGGNLELVTKKLPLKRSWKGTIEEGSSAAPQADTGFDKH

SEQ ID NO: 145642 - protein, 126 aa, Glycine max
  Coding DNA Sequence Number=SeqID_53957
MGETHEMIEMGLKRGKSDRHALINAKKKKRANEEGENEGETHAVTAIPIQRSFPPTQQCRYSANNKPSPSPPPNYPQKSSLNQPQNLSTTQPMLNTTFSTNQNTNQGRNFATKKPVGFTPNSGVIC

SEQ ID NO: 145643 - protein, 103 aa, Glycine max
  Coding DNA Sequence Number=SeqID_53958
MHAGPKSPEPVASLVSLSKSPAPMAIHACKEETASLNGDMLSALGTASQTGEFHGMRLQGYVAGHGSAADGRVSAGETAITIGGLPCTGIAKKTLLPLAGCFV

SEQ ID NO: 145644 - protein, 203 aa, Glycine max
  Coding DNA Sequence Number=SeqID_53959
MASMMEAMLGMRQLMEKNVATAAAVNSAAEADPTLLATAHHPPPNTVGRGRSTLGHNSNPHLRYNRVAYPYGLPPNYTPPVMQDDADHVSSPILEGEPPRQPDEVHEDHQEYAQGDVEFYPPIPIEGPAPNTLPQPNLTAQPIFLSIEGPPPATEERRKLDLLEERLGAVEGFGDYPFADMTDLCLVPDVVIPPKFKVPDFNK

SEQ ID NO: 145645 - protein, 130 aa, Glycine max
  Coding DNA Sequence Number=SeqID_53960
  Pfam annotation: Domain name=G-patch; Domain location=1-42; Score =7.1; E_value=0.026; Accession=PF01585.14; Description=G-patch domain
MVTRVMLRNGFEPRMGLGKDGLRNADMVDIKGNPYKYGLGYEPGMPGRRNVPSRLRVDRDEEPPLIAISLGPLSSVESASDADMTSSGESTSRSGSSSPSRKSRASTAGSGGSSSRSSSGSSSDDVTSIT

SEQ ID NO: 145646 - protein, 89 aa, Glycine max
  Coding DNA Sequence Number=SeqID_53961
MLWKLGGINGDPVLRRTRIGATWEYVSSVEGGQLGMVDLCVICRCEESTCTITRSPPSTTYDGVVPGDMSRGSGDLGDVRWGAIAQNQA

SEQ ID NO: 145647 - protein, 98 aa, Glycine max
  Coding DNA Sequence Number=SeqID_53962
  Homolog annotation: Hit_ID=A5BEV8; Match level="QueryCoverage=89%, HitCoverage=11%, E-value=5e-10, Identity=39%"; Hit description =Putative uncharacterized protein
MAMLDQFHPFIHDFIENIVDVKANDNCGYRVIATLLGMGEDSWALVRNHLLKELGKWSYEYINLFGGTNRFEELRRSLLVDGLSMWMDITEMGYVIAS

SEQ ID NO: 145648 - protein, 94 aa, Glycine max
  Coding DNA Sequence Number=SeqID_53963
MVPVGDGETTRKQRLKCLNEKCSWERKLRAYSRHRLQDPNGQIVDKCLVKLQTKFKDNPTVNEGCTVFLPRQLHVASSTSFIKRLPQKASSWLL

SEQ ID NO: 145649 - protein, 166 aa, Glycine max
  Coding DNA Sequence Number=SeqID_53964
MSVAPSFLSLGGTYLHGTAWLFLYGNGIGLTTEGCRGVWGAVSLVKCITKGLGFLRPSSSADCMHMCCSSPPSSLTSSQPWSIICCNRSPTAKHASIGLVDKPSRGHHVLQRFGPARPTRLDDINRSPSMIGKRVCFYVGSVLLKRQPSGFYQTLDLAFEGHALFD

SEQ ID NO: 145650 - protein, 160 aa, Glycine max
  Coding DNA Sequence Number=SeqID_53965
MESSNEKMMDKRKVLGKNNEETRSYFTWNFEMERVLTDVLRDQRNLDNKGDEGWKSDILGQSGFDWDGIKHMITIENENVWNEYCISHKSAKPFRFKVLQNWDDIVDLCAKDRVTGHGAETAMDADEAMSRETNEVEFMGLGATAIDLEEPSSNTKGKRQ

SEQ ID NO: 145651 - protein, 55 aa, Glycine max
  Coding DNA Sequence Number=SeqID_53966
MAARNERERLLTEALNNLAQVMANQGGGGGATMYHGLDRFLRNNPPTFKGGYDPE

SEQ ID NO: 145652 - protein, 25 aa, Glycine max
  Coding DNA Sequence Number=SeqID_53967
MAPQQKCMRTNGTERVCSMPIIGNL

SEQ ID NO: 145653 - protein, 84 aa, Glycine max
  Coding DNA Sequence Number=SeqID_53968
  Subcellular localization annotation: CTP_CleavageSite=42; ConfidenceScore=5.41e-01
MHTQGFTIPQFLRIGITHKKVPSGVANCRNMPFCGRAKARLSGALSKGGKMRGVATNVYLWETSEKPKETGQDENSKFRSCIYT

SEQ ID NO: 145654 - protein, 85 aa, Glycine max
  Coding DNA Sequence Number=SeqID_53969
MKAMPSKPTRKGRKWYLNPTYQGNPSGVYPDLSSFIGSGVYPDLSSLTGSGVYPDLSSFTGSGVYPDLSSFTGSGVIQTFVACIK

SEQ ID NO: 145655 - protein, 190 aa, Glycine max
  Coding DNA Sequence Number=SeqID_53970
MQSQGLTLPPEAEVGPSGARASTKESCVDPSGNDPETGHSDKCGLFYEGSTTVYNIPLLHGQVKVGVEKVKDVEALIPVPTDEVAVSPAKPPESPDHEVDDPLYLMTLTIPHLFLKPLQVMWDATVFGVFNQNFPLYIKHEDLFEIVHDGQCLSISVIQLWIQHMTETSMRAGNSDVYGFLEPQSIQRTG

SEQ ID NO: 145656 - protein, 222 aa, Glycine max
  Coding DNA Sequence Number=SeqID_53971
MGPSMATALRAELEQAQTVKERFKSAALKIRKENAELRDTNIATTKALELETKRARREEHGRNKFRGALWGSNSELKLRREERDHSRVDSLILKDELKVCSRSKRNLSQWLCKTETNMLAIISKYQEELKLATAHEHRVADEYAQMYAQKEARGKVIDSLHQEAMMCMDRFALTMNGSQELPRLLAKAKAMADTYSAPVEIHGLLGYCQHMIDLKTHIIRNR

SEQ ID NO: 145657 - protein, 152 aa, Glycine max
  Coding DNA Sequence Number=SeqID_53972
  Gene Ontology: Mol. function=DNA binding; Cellular component =cytoplasm; Biological process=regulation of transcription, DNA -dependent
  Homolog annotation: Hit_ID=A5AI33; Match level="QueryCoverage=48%, HitCoverage=31%, E-value=2e-09, Identity=43%"; Hit description =Putative uncharacterized protein
MRKRKKKRILLKWILMIIEVILNEVKNKIKGFLSLDLVTGDPPQQKRSLIIEIEEELKNITKGKGVEGGRETSGFIAKTKTPLIKYYTHQANVANRKGSAMRKQNIHRDEFPRCKRCGKERRFHLKSTPDIKNYHDALNNKCRTCSLWPYQK

SEQ ID NO: 145658 - protein, 175 aa, Glycine max
  Coding DNA Sequence Number=SeqID_53973
MKLAKYRLKAQVEKDEGPSGEGQSPRVEKDEGPSNPCGVYPDLSSFTGSGVYPDLSSLTGSGVYPDLSSFIGSGVYPDLSSFTGSGVIQNLRSLYQTIHNLRLIKVILVASNLTYLPSPEVASTQTYLPLPEVASTPTYLPSPEVASTQTYLPSLEVASTMTYLPSPEVASSKPS

SEQ ID NO: 145659 - protein, 163 aa, Glycine max
  Coding DNA Sequence Number=SeqID_53974
  Homolog annotation: Hit_ID=Q2HST2; Match level="QueryCoverage=34%, HitCoverage=11%, E-value=6e-07, Identity=47%"; Hit description =Peptidase aspartic, active site
METCLVVEDLLQHMIDRGRLEVGDEGTEEQHICMQSAYERSFGRPKPLVLNLFRFHTETAMQFRGGMRLRAKGRKKPPTSARCRPSSEPHRALLVKVLNEAHVAQDISVEGFGGLVNNITANNYLAFAKEEILVEGRGHNRATVCRAMSFPAFRYLGTDASRG

SEQ ID NO: 145660 - protein, 89 aa, Glycine max
  Coding DNA Sequence Number=SeqID_53975
MPDNAQRLTSSSAPFVFQGQRVEWWAEIPYGHLRLSSTERNEFGSFFTLIVQKHSSPETCGILLCWAETIGWNGKGKCRGCPNLSFSKH

SEQ ID NO: 145661 - protein, 57 aa, Glycine max
  Coding DNA Sequence Number=SeqID_53976
MGEHMKCHQPRKKWEKFDHLEERLRAIEGGEDYASADIEELFLVPEHGHPQVQGARL

SEQ ID NO: 145662 - protein, 235 aa, Glycine max
  Coding DNA Sequence Number=SeqID_53977
  Gene Ontology: Mol. function=transcription factor activity; Biological process=regulation of transcription, DNA-dependent
  Homolog annotation: Hit_ID=A8GF46; Match level="QueryCoverage=99%, HitCoverage=78%, E-value=2e-82, Identity=65%"; Hit description =Transcriptional regulator, LysR family
  Pfam annotation: Domain name=LysR_substrate; Domain location=53-233; Score=28.0; E_value=3.4e-05; Accession=PF03466.11; Description=LysR substrate binding domain
MRLKNLERELGLSLINRSNNFDGFTPEGERVLTWAREIVSVYQGLKLEVESLKHGVNGTLRLGVMPQCSVALPALLKAVEARYPQLDYRVSAMSADQLLEALNSHTVDGGIGFFELTSLRELHFQTALLNDRGVEAIFHPDHFPALLQHERLSLYTLASQPLCLAEPTRYFRRYLDGQLRETGVLPRVIVESASVMQLIQSAQVGLGVMVSPCGHLLPEMLHHLARRPIDIAPMG

SEQ ID NO: 145663 - protein, 202 aa, Glycine max
  Coding DNA Sequence Number=SeqID_53978
  Homolog annotation: Hit_ID=Q2HTA0; Match level="QueryCoverage=74%, HitCoverage=23%, E-value=2e-12, Identity=34%"; Hit description=IMP dehydrogenase/GMP reductase, related
STLEDPRSRQLDGYITLLQCWIYEHFPSVAESNTDQDYDEDSPRAYVCWIPYGEHRPIRDFHMISCYSGLQRSGPFAVYYRPERVMRQFGYTQTIPAPPVDSWVSYDDIHDRWMHYSDHMFPAGAVCAVTGQCASDYIDWFFRISHPFMKPCQASVPLPDGHAPQPRVVPQAPETDIPHVSELGALLTSARPAVEEPRHAVI

SEQ ID NO: 145664 - protein, 162 aa, Glycine max
  Coding DNA Sequence Number=SeqID_53979
MIQFHEIESFLKGGMNILTAHSQEWEQELSSNYQYEEERTPNLESVFDEFMAYHASSKANQNSMKNHEIHFVTTFLSKCSKRGSNMDKLLMQFMETTKSTQQALQSVEIQVGELAEAVTQFMSRREKSFVEAEAQEKSPIKEHESREKDEEKDDEQTQQQWE

SEQ ID NO: 145665 - protein, 140 aa, Glycine max
  Coding DNA Sequence Number=SeqID_53980
MMPYFYVFSPRMHDRIFMECATQACFLQFQDTTELPNRWHVPLVLFLCNLQPAKSKSEKPVRFKEVTLGYHKPTLVVPLSSVHIASQCPTKKTMIMRGQDIYSSQDEATASPSSSESEEAKGEVSSEEIYPHEEGGPFNG

SEQ ID NO: 145666 - protein, 246 aa, Glycine max
  Coding DNA Sequence Number=SeqID_53981
MEESMSPFLVRDFGAQNFKAIQRIHKAWETPLRKDQELRGIRNSIIGGYHEWLKVHIRGLDWLAKLKVVSEDSFEALEEDEEVQALKNELGKAKLAKEKFKLAATHIRKECAGLREENATTAKALEQETKRARKEEYGRNKFRGALWGSNSEIKLRREERDQSRAHSMVLKEELVACSRSKRSLSQRLCETETNMLAIIAKYQEELGLATAHEHRVVDEYAQVYAEKEARGRVIDSLHQEATMWMD

SEQ ID NO: 145667 - protein, 133 aa, Glycine max
  Coding DNA Sequence Number=SeqID_53982
  Subcellular localization annotation: CTP_CleavageSite=24; ConfidenceScore=5.59e-01
MEESSKKRKGSSASTSTSRAHRSKATSASTTPIPPSLSSSTLFSSEEQQKRDGVPFEGTLNDDWKFDFSAHDARQLVCTNNADMTGRLLVGSLAFESRILHYLIVRILLPRSSNLAQVSEEDLVMGLSYRAST

SEQ ID NO: 145668 - protein, 99 aa, Glycine max
  Coding DNA Sequence Number=SeqID_53983
  Gene Ontology: Cellular component=mitochondrion
  Homolog annotation: Hit_ID=Q5M9Z0; Match level="QueryCoverage=43%, HitCoverage=37%, E-value=1e-14, Identity=76%"; Hit description =Putative uncharacterized protein orf116
MCSNFWPCTDHLMDHGLNGHCLKGLCPVDRRPPTREYSNPGNRGLAKVQGGSKFDQGDPCPVPYSLRGGNLGQYQSIFGFYKPGGIYYPGNTPPGYKAH

SEQ ID NO: 145669 - protein, 195 aa, Glycine max
  Coding DNA Sequence Number=SeqID_53984
MGAYSRDEKLLMHFFQDSLVEAAIGFGGEMITMIVDTLPVFYFEKLVGYMPSSFVDLVFTGERIEVGTSNRRIGAARAKRKEGDAHVVTSAPAWLKAQQASHGTHQYAQHHSSFLARARNSSNLAPVQPRTSAPSQRAPAQTSALAQPRPANNANLGMNSNMGRNPLVKKILEFTPIPMTYGDLLSLLVTNQLAV

SEQ ID NO: 145670 - protein, 210 aa, Glycine max
  Coding DNA Sequence Number=SeqID_53985
  Gene Ontology: Mol. function=zinc ion binding
  Homolog annotation: Hit_ID=A7UQU7; Match level="QueryCoverage=49%, HitCoverage=20%, E-value=3e-17, Identity=41%"; Hit description=IMP dehydrogenase/GMP reductase, putative
  Pfam annotation: Domain name=DUF1723; Domain location=151-200; Score =59.3; E_value=1.3e-14; Accession=PF08330.1; Description=Protein of unknown function (DUF1723)
MARTRGLGYAIGRLIGRDKHDHHDAADVPERCRSTASARRQRVHQMTADARDMVKEVADMVEDVPDLAEEAPEMRADVQGADGAEGSDADDVEGFPSGPRDPSVLTSFAGHVAHAFWSGQEHPDLKLVSHGRKVTLIGRPVPEIEGLVVVTGDPGLISAFVERWHNETSTFHLPVGELMITLDDVSSLLHLPITGALHSFHALSMEEGIL

SEQ ID NO: 145671 - protein, 140 aa, Glycine max
  Coding DNA Sequence Number=SeqID_53986
  Homolog annotation: Hit_ID=A0ST23; Match level="QueryCoverage=32%, HitCoverage=91%, E-value=1e-11, Identity=73%"; Hit description =Putative reverse transcriptase
MTVKTSDTCSSRRRSQLVCKRMPGADKPVRARQRMRKEKIPHQAPFAIQAAQLLGRAIGAGLFAITPAGERGMCCKAIKLGNARVFPGMGNSNDGTELEFVIMVIAVSFGKPVVPAALMNRPTRGERRFAYWALFRFLAH

SEQ ID NO: 145672 - protein, 191 aa, Glycine max
  Coding DNA Sequence Number=SeqID_53987
MEQSMLAIIGQYKEELNQSLTHEQTIVEDFAQAYAEKEARGRVIDALHQEATMWMDRELTITKKAQRHPYNTQSKSKMDNEEGVQEQMKADMSALKDQMASITETMLKIQKSIEDNATAAASNIVREAEPVLQPAMNMGRDRSAMGFNRRYSPQAYPYGLPPYFTPRTAPDDLSQAPTFEGQLPPHVDYPL

SEQ ID NO: 145673 - protein, 118 aa, Glycine max
  Coding DNA Sequence Number=SeqID_53988
MGRGGGEVPEELLDAFADGKIKLKTPEEAMELTENITANDHTILRDRAYMPTKKSLLELTSQDVMLAQNKLLAKTLETLTTSLSNVPQQLHVVQPLPAMHSEGYNICGAAHESGSCMV

SEQ ID NO: 145674 - protein, 127 aa, Glycine max
  Coding DNA Sequence Number=SeqID_53989
MTTLTQILYQTYRVPVPPQQGIVPAGHPVDPETSNRVLGFPALITGLCQFYGVPVTPNKVIKPPTNQAFIKKYCAPREAQGETPQQPGDGQQHTVATSRAPQLIHKKVRVLPTTHGRPIGDQVQIQR

SEQ ID NO: 145675 - protein, 111 aa, Glycine max
  Coding DNA Sequence Number=SeqID_53990
MGYAPSSFANLVFAGERIEAGLKRGKFDHPALMNEKNGANEEDENEGETLVVTTIPTRPNFPSAQQCQYSASINPSHYPPPNHPQMSHKAYLPHDQCQTPPLAQTETPTKK

SEQ ID NO: 145676 - protein, 331 aa, Glycine max
  Coding DNA Sequence Number=SeqID_53991
  Homolog annotation: Hit_ID=Q6WAY6; Match level="QueryCoverage=76%, HitCoverage=47%, E-value=2e-13, Identity=25%"; Hit description =Putative uncharacterized protein
MTKDNNWYLKALPWVWLVSYLFQQDTRHPCPLLSHRSCTEKRRIDWDQLLAGIGGRTINWFPRWKEGKEGVLFSWGGYPNIPLIGTRGCINYNPALAIRQLGYPMRGAPMEESMSPFLVREFGAQNFKAIQRIHKAWESPLRKDQELRGIRNGIIGGYHEWLKVHIRGLDWLAKLKVVSEESFEAPEEDEEVQALKSELGKANLAKEKFKLAATHIRKECVGLREENATTARALEQESKRARKEEYGCNKFRGALWGSNSELKLRREERDQSRAHSMVLKEELVACSRSKRSLSQRLCETETNMLAIIAKYQEELGLATAHEHRVADEYTQ

SEQ ID NO: 145677 - protein, 238 aa, Glycine max
  Coding DNA Sequence Number=SeqID_53992
  Gene Ontology: Mol. function=exodeoxyribonuclease VII activity; Cellular component=exodeoxyribonuclease VII complex; Biological process=DNA catabolic process
  Homolog annotation: Hit_ID=A8GHV3; Match level="QueryCoverage=94%, HitCoverage=49%, E-value=5e-99, Identity=79%"; Hit description =Exodeoxyribonuclease 7 large subunit
  Pfam annotation: Domain name=tRNA_anti; Domain location=30-105; Score= 48.6; E_value=2.1e-11; Accession=PF01336.16; Description=OB-fold nucleic acid binding domain
MSLPPTANIFTVSRLNTTVRQLLENEMGLVWLSAEISNFTQPASGHWYFTLKDDGAQVRCAMFRNSNRRVSFRPQHGQQVLVRASITLYEPRGDYQLIIESMYPAGEGLLQQQFEQLKARLAAEGLFDQQFKQPLPEPARQVGVITSATGAALHDVLRVLHRRDPSLPVVIYPTAVQGVDAPATIVRAIELANQRDECDVLIVGRGGGSLEDLWSFNDERVARAIFCQPPADRQRRWA

SEQ ID NO: 145678 - protein, 182 aa, Glycine max
  Coding DNA Sequence Number=SeqID_53993
MEKSMTDATSGGALGDMTPAEAKNLIEKMASNSQQFSARNDAIVLRGVHEVAMDSSSSTENKKLEGKLDALVNLQQNQQQQNNYDLSSNKYNPGWRNHPNLRWISPPQQQQSVPPFKNVAGPSKPYVPPPMQKQQQQQQQQQRQQATEAPPQPSLEELVRQMTIQNMQFHQETRASIQSLTN

SEQ ID NO: 145679 - protein, 476 aa, Glycine max
  Coding DNA Sequence Number=SeqID_53994
  Gene Ontology: Mol. function=hydrolase activity, hydrolyzing O -glycosyl compounds; Biological process=carbohydrate metabolic process
  Homolog annotation: Hit_ID=A8GKP4; Match level="QueryCoverage=73%, HitCoverage=80%, E-value=1e-168, Identity=85%"; Hit description =Glycoside hydrolase family 4
  Pfam annotation: Domain name=Glyco_hydro_4; Domain location=132-476; Score=283.8; E_value=3.5e-82; Accession=PF02056.7; Description =Family 4 glycosyl hydrolase
  Pfam annotation: Domain name=Ldh_1_N; Domain location=131-297; Score=- 35.5; E_value=0.0021; Accession=PF00056.14; Description=lactatemalate dehydrogenase, NAD bind
  Pfam module annotation: Pfam domain module=Glyco_hydro_4::Ldh_1_N; Domain location=132-476::131-297
MGAEGFLPTASRIFCPTPPWRILKHPTAASPRNPWRNDVSELMTEVSPEFESTIMELLAHGRVQRVGEESTPDPDRADRPGRRLRQTGDQPDHRACAGSSDERHGDPGSGRRHDRALSPSVADGGPPMSALKIAVIGGGSSYTPELVDGLIQRIEELPVTELALVDVEPGRQKVETIAALTRRMLARHGLEQVKVSVHFALDDAIRGAAFVLTQFRVGQLPARAADERLGLKYQLLGQETTGVGGFAKALRTIPVMLDIARRVEKLAPDAWIINFTNPAGIVTEAVSRFTKAKIIGLCNVPISMHHMIANMLQAPYADVQLRFAGLNHMVWVHQVTQQGRDVTAKVIDMLCDGAALTMNNIKEEPWQPDFLRALGAIPCPYHRYFYQTREMLAEEMAAAGERGTRAEQVMQVEKELFELYADPQLNTKPEQLSFRGGSFYSEVALELIRAIHNNLGTQLVVNTANRGAIHGLPDDA

SEQ ID NO: 145680 - protein, 103 aa, Glycine max
  Coding DNA Sequence Number=SeqID_53995
MELRRMQFKETRSSATRETRHNIDHPTNCQNKLNRLHQDIDCRDQNVHELYHILQKDMVNKAKSVGDDSWKLGRIICQAAKTFGSFAILCFWDCGRCSNRIRI

SEQ ID NO: 145681 - protein, 410 aa, Glycine max
  Coding DNA Sequence Number=SeqID_53996
  Homolog annotation: Hit_ID=Q84VH5; Match level="QueryCoverage=93%, HitCoverage=64%, E-value=1e-160, Identity=71%"; Hit description =Envelope-like protein
KEKSTEEEDQATEETPAPRAPEPAPGDLIDLEEVESDEEPIVKKLALGIAERLQSRKGKTPITRSGRIKTIAQKKSTPITPTTSRWSKVAIPSKKRKEISSSDSDDDVELDVPDIKRAKKSGKKVPGNVPDAPLDNISFHSIGNVERWKFVYQRRLAVERELGRDALDCKEIMDLIKAAGLLKTVTKKCLSEENVLDSPTAIINKYLGRPTEGVVDIAVSEHQIAKEITAKQVQHWPKKGKLSAGKLSVKYAILHRIGTANWVPTNHTSTVATESFAVKLPIAFPTVLCGIMLSQHPNILNNIDSVKKRESPLSLHYKLFEGTHVPDIVSTSGKAAASGAVSKDDLIAELKDTCKVLEATIKANTEKKMELERLIKRLSDNGVDDGEAAEEEEDAAEDTESDDDDSDATP

SEQ ID NO: 145682 - protein, 307 aa, Glycine max
  Coding DNA Sequence Number=SeqID_53997
MSSRGKKTIPFLRVSPLFEQNCNCGQGFSKRFGPHKRDLKRHSGPTTEVPRRQGKGYGQSRRLGPVYGCVSFANFWGRPLSKRRWFGGPSSNRRFPCIPHSKESSVVAVLADLFDTFNRRVPHEGIHNGIIGGYHEWLKVHIRGLDWLAKLKVVSEESFEAPEEDEEVQALKSELGKAKLAKEKFKLAATHIRKECAGLREENRTTTRALEQETKRARKEEYGRNKFRGALWGSNSELKLRREERDQSRAHSMVLKEELVACSRSKRSLSQCLCETETNMLAIIAKYQEELGLATAHEHRVADEYAQ

SEQ ID NO: 145683 - protein, 128 aa, Glycine max
  Coding DNA Sequence Number=SeqID_53998
MSNFGYNISRRSKLNIESSREIQMMSDLGIKYIEMLEIEQRKPSTNSKRHNFSLGCPIQAHNISRRSKLNIGSSREIQMVITFHSDVRFRRITYRDAENWNNSSSREIQMVITFNSDVRFGNIIYRDE

SEQ ID NO: 145684 - protein, 195 aa, Glycine max
  Coding DNA Sequence Number=SeqID_53999
MSVIELCVEVDVAGASAINLTNSLLSCGNNMSHNESGSATVGTNSEEDFDDDDYLISNSYVKDSSDEDEDIDEMSDTDDEAARLIEPLTIVQSGEGGSQTPFWDSASHYSNINWSHPDQEEICGLDMGSNFNMGQELYVGMEFDTKSAVKNALQQYVMKVHQSFKVVESKSQKYVVCCGNRSDDIPCPFYMREIL

SEQ ID NO: 145685 - protein, 136 aa, Glycine max
  Coding DNA Sequence Number=SeqID_54000
  Subcellular localization annotation: CTP_CleavageSite=42; ConfidenceScore=5.17e-01
MSVSSRGITRHGNLPRSGRATSTAHGLGAARSVREGNMISPRSEYPSTVPKPTPFSYQSNKVVPWKYTPPAFGERAATEVDSLSAKVTNITGLSGVTRSGRVFTPPHSAELPSKGKAPMTQESVGVAPPQKKWIPR

SEQ ID NO: 145686 - protein, 141 aa, Glycine max
  Coding DNA Sequence Number=SeqID_54001
MTTLTQTWMTLLLSNILPSDHNSDLPLPKCQLVYAILTRMNIHVAQLIADAIYLFVGMPPTRYLLDPDKSNRALGFSTLITGLCQSFRVPVTPSKVIRLPITRAFIEKYYTPRQAQGGDPQAPDAPPPPPQANPAGSFDTE

SEQ ID NO: 145687 - protein, 97 aa, Glycine max
  Coding DNA Sequence Number=SeqID_54002
HGAVSTALGSPTGGQPPGQVQIHECLYQLSLSQQGQGFAPFACPTPDQFRAEVAWPGDWPEDQTEEAPAGAPDDVEDARRDEEMTDLLGFLGGSGAT

SEQ ID NO: 145688 - protein, 223 aa, Glycine max
  Coding DNA Sequence Number=SeqID_54003
  Subcellular localization annotation: CTP_CleavageSite=60; ConfidenceScore=5.82e-01
MASGQAGWRLCASQARPAVSSSNRSSRTIPTSRWFSQAYPTNSAAGPTAFSQGVRGEGVSVSRSWRLNGSSSACSGLCNSQFSSAGRLGVTAGDGLLITASSIRSLLRRPEVFCTLGAVILDSMWFFRYLSESGRIRNNFQNNEPAGRSGGKRDGLKNGAVAARFPVYGGRFRAAVMMVVTAYSSPSPVDDGRVGTGDPGVAAAGFHHGAVRAVAVVFMANAA

SEQ ID NO: 145689 - protein, 400 aa, Glycine max
  Coding DNA Sequence Number=SeqID_54004
IVPGGEGVAGVDANADAAFVFHAVDDRRQVLEFEAQVAALAGGVFDHGRHAGGFIQRDVDRFGDARQALVFIDLQQVAAGVEVQQRQPQLFAALQLVDERLARFFQRVGHRVAQVDQVAVVRQDLPRPEAVLGAGALELIDHVGGQRRGLPLTLIFGEQGEREPVLHQLVYRAAADQQPDEQQRGQQNRFHPGLAHGADVGGQSQRRHRHRQHPGVGGDQVLHQHGRQQVEGVQPGDGDKQHGEPRNGNRGFFRLACAAAADVARQQQQERRQHHHADHLGDHRRIFGVRPDGVPGRNHLSHFVDGGAGIDAEGFLAERQPLEVFVQLIQPRVGEDRQGAEHHHGRDRHRYFTGVGLQHRLGGHHRRRAANAAAGADQHRGLAVDAEHFLAEPAASRKVV

SEQ ID NO: 145690 - protein, 234 aa, Glycine max
  Coding DNA Sequence Number=SeqID_54005
  Homolog annotation: Hit_ID=Q2HW90; Match level="QueryCoverage=93%, HitCoverage=61%, E-value=4e-11, Identity=37%"; Hit description =Putative uncharacterized protein
MGTNQTSKRFYQVKVKGLDTTSIKELGRLMEPLQMQAFRKTYGKILDLTIAEVSIEAIASLTQYYDQPLRCFTFGDFQLVPTIEEFEEILGCPLGGRKPYLSSGVSPLFEQNCNCGQGFSKRFGPHKTDSERHSGPTTEQDTRHPCPLLSHRSCTEKRRIDWDQLLAGIGGGTINWFPRWKEGKEGVLFSCGGYPNIPLIGERGCINYNPALAIRQLGYPMRGAPAEEGMSPFL

SEQ ID NO: 145691 - protein, 72 aa, Glycine max
  Coding DNA Sequence Number=SeqID_54006
  Gene Ontology: Mol. function=transporter activity; Cellular component= intracellular; Biological process=transport
  Homolog annotation: Hit_ID=A7Q7Z5; Match level="QueryCoverage=75%, HitCoverage=11%, E-value=1e-20, Identity=87%"; Hit description =Chromosome chr18 scaffold_61, whole genome shotgun sequence
MFKEKFPACSIAAKRHIDKTTTILDVHGVNWVSFSKVAHDLVMRMQKIDGDNYPEEKGGKLFMTGEGEFSTK

SEQ ID NO: 145692 - protein, 295 aa, Glycine max
  Coding DNA Sequence Number=SeqID_54007
  Homolog annotation: Hit_ID=Q2HW90; Match level="QueryCoverage=74%, HitCoverage=44%, E-value=4e-26, Identity=34%"; Hit description =Putative uncharacterized protein
MGTNQNGKRFYQVKVKSLDVTSLKELGRLMGPLQRQAFRKVYGKILDLAAAEVFTEAVVSLAQYYDHPLRCFTFGDFQMVPTIEEFEEILGCPLGGRKPYLFSGFLPSLSKIAAVIGDSAKELDCMKQTRNGVVGLPQGYLEGKARDMASQEKWGPFADILALLIFGVVLFPNVDGLVDLAAIDAFLAYHHSKESPVVAILADLFDTFDRRCEKNSARIVCCLPALCVWLISHLFRQDTRHPCPLQSYRSCAEKGRVDWDQHLAGIGGSAINCFLVGRKARNELSSRVGTTLMFH

SEQ ID NO: 145693 - protein, 102 aa, Glycine max
  Coding DNA Sequence Number=SeqID_54008
  Homolog annotation: Hit_ID=A5AL21; Match level="QueryCoverage=63%, HitCoverage=5%, E-value=6e-10, Identity=45%"; Hit description =Putative uncharacterized protein
SRSLDTEIKMTSSNGNFPASIHVLIGKNYDDWCAQMKEAWDIQDKSYAGDSKLKKVKLQTLRRQYELLQMSDQESIDLGIIDKVLRTLTPRFDHIVVAIEQG

SEQ ID NO: 145694 - protein, 127 aa, Glycine max
  Coding DNA Sequence Number=SeqID_54009
EVLQKKDKELRGNKNGPIGGYRKWLKAHVQGFDWLPSLRTAKREEVEAPEEDEEVQALRAKLEQAQTVKERFKSVALKIRKENTELRDVNVAITKALERETKRACREEHDRNKFRGALWGSNSELKL

SEQ ID NO: 145695 - protein, 241 aa, Glycine max
  Coding DNA Sequence Number=SeqID_54010
  Gene Ontology: Mol. function=motor activity; Cellular component=cell projection
  Homolog annotation: Hit_ID=UPI00016621D1; Match level="QueryCoverage =95%, HitCoverage=41%, E-value=8e-18, Identity=31%"; Hit description =UPI00016621D1 related cluster
MTLLGGTGTLHILVFRGLHVLTFRGQHIVAIRGLHALTFREQHVLAIRGIHALTFRGLHIVTIRGLHALTFRGLHVLAIRGLHILAFRGLHVLAIRGLHALTFRGLHVLVIRGLHILAFRGLDVLTFRGQDVFTIRGLDVLAFRGLHVLTIPGLHLLTFRGLHVLARGVHALTFRGLHALAFTGLHVLTFRVLHVPTFRGLHALAFKGRHVLNFRGMHAFAFRGLRVLIFSVLHIRTLGEI

SEQ ID NO: 145696 - protein, 108 aa, Glycine max
  Coding DNA Sequence Number=SeqID_54011
FTCDSPQISANPHQLDLAPYASGPYNAQWNAPGLLHDKHTLRSSRILGEMEVDEPQLALWLPLNYQVDMRAIYAKGGMAFVDNWAVGKEKVGYWLSNDIVGLVGNLAV

SEQ ID NO: 145697 - protein, 44 aa, Glycine max
  Coding DNA Sequence Number=SeqID_54012
MVVILPKEHLVVWFCSLHNRPDNYLKGIVNSAIKGLDDAPLWRP

SEQ ID NO: 145698 - protein, 192 aa, Glycine max
  Coding DNA Sequence Number=SeqID_54013
MAASDHTILRDRAYIPTKRRLLEHSSQDELLAQNKLLSKQLEALTETLSCLICGGAHESGYYISQEEATREVNYMGNQPRPNFNAGGHSGFQYGQQYHSQQGQWRNHPRNQFNKDQGGPSNRPQQQGPSLYDRTTKLEETFTQFMQVSKSNQKGTESAIKNLEVQVGQLAKQLADRPSSSFGANTEKNPNGE

SEQ ID NO: 145699 - protein, 94 aa, Glycine max
  Coding DNA Sequence Number=SeqID_54014
MSLHVLYLYAFSGFPPGISRLLYLSLQSFTEMNVIRGFSPHGQDHLELPSGVETKHEQQKPIKGRMQMGMGSRPTDRRPFSALNEQRTSLQGGP

SEQ ID NO: 145700 - protein, 89 aa, Glycine max
  Coding DNA Sequence Number=SeqID_54015
FRPARPIRLNGINRSPSMIGERIFPGVITTIWLAIRDGKRSSYVIGSGVNSGIGFGGKFLIVLELPAGRVVVGAGTWGASLWMGALGCT

SEQ ID NO: 145701 - protein, 165 aa, Glycine max
  Coding DNA Sequence Number=SeqID_54016
  Gene Ontology: Mol. function=transferase activity, transferring pentosyl groups; Cellular component=peptidoglycan-based cell wall; Biological process=peptidoglycan-based cell wall biogenesis
  Homolog annotation: Hit_ID=A7MGB9; Match level="QueryCoverage=100%, HitCoverage=19%, E-value=1e-90, Identity=94%"; Hit description =Putative uncharacterized protein
ALNTNIFGEPGWQGTGWRAGRDLQRHDIGGKTGTTNSSKDAWFSGYGPGVVTSVWIGFDDHRRDLGRTTASGAIKDQISGYEGGAKSAQPAWDAYMKSVLEGVPEQPLTPPPGVVTVNIDRSTGQLANGGNSREEYFIEGTQPTTQAVHEVGTEIIDNGETHELF

SEQ ID NO: 145702 - protein, 115 aa, Glycine max
  Coding DNA Sequence Number=SeqID_54017
  Gene Ontology: Mol. function=cysteine-type endopeptidase activity; Cellular component=endoplasmic reticulum; Biological process =proteolysis
  Homolog annotation: Hit_ID=Q6Y1E4; Match level="QueryCoverage=97%, HitCoverage=31%, E-value=4e-40, Identity=72%"; Hit description =Cysteine protease 12
  Pfam annotation: Domain name=Peptidase_C1; Domain location=2-114; Score=-26.1; E_value=9.1e-10; Accession=PF00112.14; Description =Papain family cysteine protease
MDSNTEANYPYIWVLMESAMQMKQPRMLLLLITGYEDVPANNEKAHTQKAVANNPVSEAIDASGSDFQFYKSGVFTGSCGTELDHGVTAVGYGVSDDGTEYWLVKNSWGTEWGEE

SEQ ID NO: 145703 - protein, 181 aa, Glycine max
  Coding DNA Sequence Number=SeqID_54018
EITPKKLSSKTSRRDVTAEGTNAAPEFDSHHFRSTEHQQCFEAIKGWSFHRERRVQLRDDEYTDFQEEIARRHWTSLVTPMAKFDLDIVLEFYANAWPTEEGVQDMRSWVRGEWIPFDANALSQFLDDPLVLEEGQECEFSQRRNRTDGFDEEAIAQHYAYRVRISPGPLTGGGCGSCALA

SEQ ID NO: 145704 - protein, 311 aa, Glycine max
  Coding DNA Sequence Number=SeqID_54019
  Subcellular localization annotation: CTP_CleavageSite=55; ConfidenceScore=5.59e-01
PITKKATTSSSGSPTQTGSSTQKGKREGSLTQITTVKPESSTQESPKPTTTKQTVADYVWSIQTLLALEDIGLTRVPKLAKKTWAEMASESDDDSETNLQKQIQKAKQTKTVCNQKPSQQLTQQESTPQPSNSYISKNKFFNVLQMEPEYWDKNPFKATAKGFQQFSKLFNSKESRIPADLKYGKTENSKQYPPLQRHAFVKWWSQFDTPKAAPEQVKNWFQSNSEFLKPADPETSLFLNQKSQLAAFLASSKSKESLAQNLKEVLQLLQQEEEEELPKKEAESSENNDDQEDDPFYQNEDDCFGISLDDD

SEQ ID NO: 145705 - protein, 47 aa, Glycine max
  Coding DNA Sequence Number=SeqID_54020
ELERRIMGPPRVLNDLKSALRKRHIPSYYERELMDKLQRHRHREYEC

SEQ ID NO: 145706 - protein, 131 aa, Glycine max
  Coding DNA Sequence Number=SeqID_54021
MGAKYLEVVKRWSHPNNGWSPDKIRVYTRTFRQPGANEPVDAQRLTSSPAPFVVLTREVICGITSWLPAPFIKPGANEPVDAKRLTSSSTLFAIQGHQVRWQAEIPYGHRRLSSIEGNDFDGIRMMLAVRC

SEQ ID NO: 145707 - protein, 243 aa, Glycine max
  Coding DNA Sequence Number=SeqID_54022
AEKDVSSPLKTVEEEKAAEVIDPLGELVKNLFDIYQRPVEVSWDGAKFGINNVKDGFFITHADVSEIILGDKFIHDWSASIGYGALYGFLEPQCIHNASSRHQECENYIGRWLKEAGKQIYIAPYLNQRQSSGLVLFFAKEVGCCHQGCSKQCNEISHQTAEGKPPQHGPQWIEAKSHVQTGNYECGYYVMQWIWCIVSGGLKDDWIHWFSDRSALTEETMTTLRHKWAAYFIQMKKCEPRKN

SEQ ID NO: 145708 - protein, 91 aa, Glycine max
  Coding DNA Sequence Number=SeqID_54023
MRFFQPVVKHCSMEAYLVCFFHWKSEEETIYMNQPEGFENGSKDNSSIVRVPEILMSILDQIWQFIKKISLIKEKLEIMKSWLLNMTVYIS

SEQ ID NO: 145709 - protein, 100 aa, Glycine max
  Coding DNA Sequence Number=SeqID_54024
  Homolog annotation: Hit_ID=B0HC01; Match level="QueryCoverage=32%, HitCoverage=68%, E-value=2e-09, Identity=96%"; Hit description =Putative uncharacterized protein
MSFLRYPRILWITVLPPLSELIPLAAAERPSAAKDERRVLCYFQTQQRLLLPFLCVDVTNDDICCNEAQKAQVGGATGADPQLTFTRSSYHVNNLEKGMP

SEQ ID NO: 145710 - protein, 232 aa, Glycine max
  Coding DNA Sequence Number=SeqID_54025
  Gene Ontology: Mol. function=motor activity; Cellular component=cell projection
  Homolog annotation: Hit_ID=UPI00016621D1; Match level="QueryCoverage =82%, HitCoverage=40%, E-value=1e-17, Identity=34%"; Hit description =UPI00016621D1 related cluster
  Subcellular localization annotation: CTP_CleavageSite=46; ConfidenceScore=5.25e-01
MLSHKGGPLGTSTLSFRGLHVVTFRGLHILTFRGSCTFTFRGLHVLASRGLHVLAFKGLHVLAIRGLHVLIFRGLHVLNFKGLHVLAFRGLHVLAFRGLHVLPFRGLHALAFRGLHVLAFRGLHTLTFRGLHALAFVGLHALTFRGLHVLTVGGLHALAFSGLHALAFRGLHVLAIRGLHVLAFRGLHVLTFRGLHTLTLERTTRPHLRRATRPRLRRTTCPPFQRATRPRL

SEQ ID NO: 145711 - protein, 207 aa, Glycine max
  Coding DNA Sequence Number=SeqID_54026
LGRIDGDPALRGTRIRATWEYVSSVGGGQQGMETLGTSGGVLLPKTKLDQSRPNPGIVIVKLEMKLGGLLVIDYQGIVMAAQLIHDRVEMECLEGAWETLEGNARCRFWGTIRFTATSLVHPDEPVHTFLRTVEWILPTPTPYRLVEPVQVIEVTSSEEDSEEDPEELPPEPAVDALDFLEGDEDPLPEVDSPEDVMSASEADSTED

SEQ ID NO: 145712 - protein, 287 aa, Glycine max
  Coding DNA Sequence Number=SeqID_54027
  Gene Ontology: Mol. function=RNA-directed DNA polymerase activity; Biological process=RNA-dependent DNA replication
  Homolog annotation: Hit_ID=A5AZG1; Match level="QueryCoverage=33%, HitCoverage=30%, E-value=4e-09, Identity=36%"; Hit description =Putative uncharacterized protein
  Pfam annotation: Domain name=zf-CCHC; Domain location=121-138; Score =22.6; E_value=0.00058; Accession=PF00098.14; Description=Zinc knuckle
HDPCKSLSEELRDYYEGRHRSDLRPHSHRREKERKPQEANIYLPYFHGKDNVETYLDWEIRVEQQLKRKSILKSYCPHSYPKKDQGQGILGAAPSKPKDDKGETIEKQPPKASMQEKTSSIKCFKCLGRGHITSQCPTKKTMIMRGQDIYSSQDEATTSPSSSERQPLMVKEECKEVSVSFKKLAKKESHFAIKTNIKETSLCKKTLVSTATTLGLEIIPQLKELLDEGLVHKSLNPCALLVPKIGVMRHQIPMIGGIVNVFSGAILFCKIAHASNIFMIHIHRDSL

SEQ ID NO: 145713 - protein, 132 aa, Glycine max
  Coding DNA Sequence Number=SeqID_54028
MVAWPGTQPSFHMEDEGPIAQVPQHVEDESSEATIPDPFVIREETDETLVRQVVAATPERSLEATSEPPAPVVDLPSPQHTVDPSTPILEIPEDPTTPVLAMDTSLPATLVLHLTDEEDVQTQDTQDQSQEF

SEQ ID NO: 145714 - protein, 100 aa, Glycine max
  Coding DNA Sequence Number=SeqID_54029
  Gene Ontology: Mol. function=aspartic-type endopeptidase activity; Biological process=RNA-dependent DNA replication
  Homolog annotation: Hit_ID=A5BY78; Match level="QueryCoverage=93%, HitCoverage=5%, E-value=3e-15, Identity=46%"; Hit description =Putative uncharacterized protein
MEEVDKEILETFRKVEVNIALLDAIKQIPRFAKFLKEPCTHKRRLKGNERISMGRNVSTLIGVVIQLANRSVAHPTGFIEDVLVRVGELIFPTDFYVLDM

SEQ ID NO: 145715 - protein, 87 aa, Glycine max
  Coding DNA Sequence Number=SeqID_54030
MARAGDNGGIYHQLDESQCLFLDAWTTQMQRLLNRETKKNESYARRIANKKRKEVVLPPFETLKCFPLEKGMMQIRMREKREQEKEN

SEQ ID NO: 145716 - protein, 144 aa, Glycine max
  Coding DNA Sequence Number=SeqID_54031
MAKIMLKFAVPLDTILNTVNIYGEVSRSFVVRWKDVLDRLWHFIDKDGNFHTVVYNQDLDKSAIIARWTTLRDFYHLTGDHQVSLTHYGVSHSAQSYLQQPDKGWTYLHLEDVAECRLVFNHWRKIVKIGAGWKYFCETLSFKA

SEQ ID NO: 145717 - protein, 76 aa, Glycine max
  Coding DNA Sequence Number=SeqID_54032
MWRKPKGGVVAQSMMTKVMNKKLKRIKEHPSQENLEQVKEFKNQEEFKTQEESLQTRIKIQDLKNQDQDSRLKIQE

SEQ ID NO: 145718 - protein, 26 aa, Glycine max
  Coding DNA Sequence Number=SeqID_54033
MESSEDYENEEINLCLMAKSYESDEE

SEQ ID NO: 145719 - protein, 45 aa, Glycine max
  Coding DNA Sequence Number=SeqID_54034
MALRKLSTKRSRRDTAAEGPVPLPSLTVIVSGVLSTNSVSRPSKD

SEQ ID NO: 145720 - protein, 134 aa, Glycine max
  Coding DNA Sequence Number=SeqID_54035
MARAGDNGGVYHQLDESQRLFLDAWTTQMQRLLNRNKEEPYRRIVKSSLFTLKPLSPREVQIAKKNESYTKQANKKRKEVVLEPGDDPGHLRANVFQEGGNDENPEIGQIQAKSPSGEGRRLKWRRTKPPSGEG

SEQ ID NO: 145721 - protein, 87 aa, Glycine max
  Coding DNA Sequence Number=SeqID_54036
  Homolog annotation: Hit_ID=A6FJQ2; Match level="QueryCoverage=43%, HitCoverage=84%, E-value=3e-11, Identity=92%"; Hit description=50S ribosomal protein L5
MRKEKIPHQAPFAIQAAQLLGRAIGAGLFAITPAGERGMCCKAIKLGNARVFPVTTLIPEHKGWIVPVWFRSCKGFYKDSGNLKWVA

SEQ ID NO: 145722 - protein, 189 aa, Glycine max
  Coding DNA Sequence Number=SeqID_54037
  Gene Ontology: Cellular component=chloroplast
  Homolog annotation: Hit_ID=A7QL08; Match level="QueryCoverage=22%, HitCoverage=57%, E-value=1e-12, Identity=90%"; Hit description =Chromosome undetermined scaffold_116, whole genome shotgun sequence
MVGAGLKKDLRVSRVVPGGSLNAFLFLLIGVISQRLAMVKKKGEQAHLESAVNVVVCCEFGDGSLLSFLPMVKGPKHATERLYLFETKTGVNQNVSPQEVGWAVQVRSNVGSYMDGSGVGGSHSWDPHWDPGKRTTSSSLLENSYIPYQYMDSYLSSTGLGLASMEKNGAPNNVSSQTKNYEIAPFILG

SEQ ID NO: 145723 - protein, 78 aa, Glycine max
  Coding DNA Sequence Number=SeqID_54038
MELIENMTASDHAILHDRAYTPTKRSLLELTAQDATLAQNKLLAQQIKAMTETLSKLPQHLQAGDAISVMEHMKQGNQ

SEQ ID NO: 145724 - protein, 76 aa, Glycine max
  Coding DNA Sequence Number=SeqID_54039
  Subcellular localization annotation: CTP_CleavageSite=39; ConfidenceScore=5.27e-01
MTATALGALNTSSASRPSRDGHFSGSDASSSGTTKEGVRDMRSWVRGQWIPFDADAIVQLLGYPLVLEEGQECEYG

SEQ ID NO: 145725 - protein, 264 aa, Glycine max
  Coding DNA Sequence Number=SeqID_54040
  Homolog annotation: Hit_ID=Q6WAY6; Match level="QueryCoverage=31%, HitCoverage=14%, E-value=5e-07, Identity=36%"; Hit description =Putative uncharacterized protein
MRTSGCISYNPVLAIRQLGYPMRGAPLEEELAPIIARGFNNTNVEALQKVCKAWKMLQKKDKELRGSNNGPIDSYRRWLKAHMQGLDWLPSLRTTKWVEVEAPKEDEEVRALRAELEQAPTVKESELKLRREERDQSRVDSLILKDELKVCLRSKRSLSQHLCETQTNMLAIISKYQEELNLATAHEHKVADEYARVYVEKQAIGRVFDSLHQEAIMSMDRFALTLNGSQELPRLLAKAKAMAETYSAPEEIHGLLSYCQHMID

SEQ ID NO: 145726 - protein, 57 aa, Glycine max
  Coding DNA Sequence Number=SeqID_54041
MESQNFLEKRVLRCGKHHPPCGMIESTPLWVLGSLRTKSILMSTQGAEGMGKGVYSP

SEQ ID NO: 145727 - protein, 133 aa, Glycine max
  Coding DNA Sequence Number=SeqID_54042
MRRSTRDVPSTSDLRSLRFLFNHVKAFTRKDPQGMYPPFFSLNNLVDVPSTRTDPHEMYPLLVPRRMERGESKELSDCVVLNSLTTEKGDTKEFRRLVLHSFGKGRRETQKEFRWLVLGEFFLAKGEENEKDE

SEQ ID NO: 145728 - protein, 110 aa, Glycine max
  Coding DNA Sequence Number=SeqID_54043
MYQYPFEGHHTDMSASEHSFGGVAETHPHFLWPTMIPSQQHDAPMATPNAPLASQWNVPRAIHDMGDLLGVDLHHEFSAEVEQVEAGRHHAEAILIVKREDRLDHVAHPH

SEQ ID NO: 145729 - protein, 120 aa, Glycine max
  Coding DNA Sequence Number=SeqID_54044
MARTRGLVVLFLGVAGDVLERRRPTASARRLRVHQMTTEDEGLGGPRDPSGHIIARVLDMLGAGQCWIYEHFPVSVHQCVTEYIPEETSPRASRWLTSKAHMGHHRSTLQGTCRWFDWRS

SEQ ID NO: 145730 - protein, 133 aa, Glycine max
  Coding DNA Sequence Number=SeqID_54045
  Gene Ontology: Mol. function=calcium ion binding; Cellular component =cell projection; Biological process=chitin metabolic process
  Homolog annotation: Hit_ID=Q86AI8; Match level="QueryCoverage=97%, HitCoverage=34%, E-value=5e-15, Identity=31%"; Hit description =Similar to Homo sapiens (Human). Mucin 2
MDLWVLVPSPLDDYTSSPLENYTSLPSEGCTPSPSEDYMSSPSKGCMPSPSEDYLSSPSKGYTPSSSKGYMPSPLEDYTLSPSKGYTPSPSKGYTPSPSEDYTPSPSKGYTPSPSKGYTPLSSKGHTPSPSED

SEQ ID NO: 145731 - protein, 357 aa, Glycine max
  Coding DNA Sequence Number=SeqID_54046
  Homolog annotation: Hit_ID=Q84VI1; Match level="QueryCoverage=99%, HitCoverage=53%, E-value=1e-128, Identity=69%"; Hit description =Envelope-like protein
MAHGSPSVPSSPHQGQPEFNIQPIQIIPGQAPVPEKLVPRRQQGVKIAENPSLAASPREVDTEMDKKIRSIVSSILNDASVPDAEKDVPTSSNPDVAVPEADEDVQHLPRPKESSEEEDQATEETPAPRAPEPAPGDLIDLEEVESDEEPIANRLAPGIAERLQNRKGKTPIKRSGRIKTMAQKKSTPITPTTSRRSKVAIPSKKRKEISSSDSDDDVELDVSTSKKAKKSGKKVPGNVPDAPLDNISFHSIGNVEKWKYVYQRRLAVERELGRDALDCKETMDLIKAAGLLKTVTKLGDCYEGLVREFIVNIPSDITNRKSDDYQKVFVRGKCVRFSPAVINKYLDRPTHGVMDIA

SEQ ID NO: 145732 - protein, 203 aa, Glycine max
  Coding DNA Sequence Number=SeqID_54047
  Homolog annotation: Hit_ID=A6FJQ2; Match level="QueryCoverage=18%, HitCoverage=84%, E-value=5e-11, Identity=92%"; Hit description=50S ribosomal protein L5
MTVKTSDTCSSRRRSQLVCKRMPGADKPVRARQRMRKEKIPHQAPFAIQAAQLLGRAIGAGLFAITPAGERGMCCKAIKLGNARVFPVDSRGSPYQCIRVANPPAEHPESRETCRASCINESANARGEAVCVLGALPLPRSLTRCARSFGCGERYQLTQRRSFAPSWAVCTNPPFSPTLRLIGNYRLESNPVRHDLSPLAAAT

SEQ ID NO: 145733 - protein, 155 aa, Glycine max
  Coding DNA Sequence Number=SeqID_54048
MEELFKRWNEYLNSTRSRVSQPPLINCDFCGGEHYNDNFHLYSMNDSRWEQELSPYNQYEEEKTPNLESVFEEFMAYHASSKANQNSMKNHEIHFGKSYSIENFQGGPKLQPYYQNEAERGSNLDNLLMQFKETTKSTQQALQSVKSKLVSWQKK

SEQ ID NO: 145734 - protein, 315 aa, Glycine max
  Coding DNA Sequence Number=SeqID_54049
MAKFDPEIVLEFYANAWPTEEGVRDMRSWVRGQWIPFDADAIGQLLGYPLVLEEGQECEYGQRRNRSDGFDEEAIAQLLCIPGQDFARTAAWRWVWIMRTNMTTLTQIWMTLLLSNILPKCQLVYAILTRMSIHVAQLIADAIYVFAGMAPTRHPLDPDKSNRALGFPALITRLCQSFGVPVTPSKVIRPPITRAFIEKYCTQRQVQGDSPQAADAPPRHQAGPAGSFDTEQYLQHLVPQQAANHRAHSQGFTSFPRPTLDQFRAEVAWPGDWPEARAGEAPAEAPAEAPDEADEAREDEEMTDLLDFLGGGGAT

SEQ ID NO: 145735 - protein, 139 aa, Glycine max
  Coding DNA Sequence Number=SeqID_54050
TMGDQEEIQEQMKADMSAMKEQMASMMDAILGMIQLMENNVATAAAVSSAAEADPTLPATAHHPFPNVVGRERSTLGHISNPHLGYNRVAYPYGLPPNYTPPVMRDDTEYAQGDIDFYPPVPVEGPAPNTLPQPNLTGV

SEQ ID NO: 145736 - protein, 150 aa, Glycine max
  Coding DNA Sequence Number=SeqID_54051
YMINSVITILYSNGRVYEEIDGKYVALQICDDEDVETMIESFQQQDQMSILELYIEKDVVGGYMFHCVNSLTSCENNLSNNEAEPPRIISNLHGDEDDDYLVSNSYVEESLDEDDGVDGISNIDDEVTNMIQPVRIVHPTEGVEGIQNPF

SEQ ID NO: 145737 - protein, 269 aa, Glycine max
  Coding DNA Sequence Number=SeqID_54052
  Pfam annotation: Domain name=DUF827; Domain location=81-238; Score= -114.4; E_value=0.067; Accession=PF05701.2; Description=Plant protein of unknown function (DUF827)
MEGLVDLAAIDTFLAFHHGKESPVVAILAMPVYPLQGHRSCIKKGKANWDELLASMEGRLLIGSLARRKEGSGLYLHAKDVQMFPGWEHGSRTQGLDWLPNLKTVRDNEVKASEESDEVQALKAKLERARESSRVKGMILKDELKAYLRSKRNLSQQLSETEGNMWAVIDECKEKLNLAATHEQRLEDEYAKISAESEARERVIDSWHQEATMWMDRFALTLNRSQELPRLLAKAKAMADTYSAPKKIHGLLSYCQHMIDLMDHMIRNR

SEQ ID NO: 145738 - protein, 131 aa, Glycine max
  Coding DNA Sequence Number=SeqID_54053
  Homolog annotation: Hit_ID=UPI00016621D1; Match level="QueryCoverage =87%, HitCoverage=37%, E-value=2e-07, Identity=34%"; Hit description =UPI00016621D1 related cluster
MSWPSEGLHALAFKGLHVLTFRGLDILAFKGLDVLAFKGLHVLTFRGLHVLTFRGLHTLTVRGLHALAFIGLHALAFIGLHVLAFRGLHNLTFRGLHVLAFKGLHICAFRELKGSCPLRGVPWTRRSPTGP

SEQ ID NO: 145739 - protein, 56 aa, Glycine max
  Coding DNA Sequence Number=SeqID_54054
MEVDLSQQPHRWGTVLGLKDNDEKKNKQGVEKENKKHDEVVTSEKVVSEEEKKKSN

SEQ ID NO: 145740 - protein, 102 aa, Glycine max
  Coding DNA Sequence Number=SeqID_54055
  Subcellular localization annotation: CTP_CleavageSite=72; ConfidenceScore=5.10e-01
MAQCRLKNISRGFSTADVVYYLSSFTGSGVYPDLSSFTGSGVYPDLSSFTGSGVYPDLSSFTGSGVIQIFVACNKRSAPTQVHINFFRLVLVNPTCVFSEVG

SEQ ID NO: 145741 - protein, 535 aa, Glycine max
  Coding DNA Sequence Number=SeqID_54056
  Gene Ontology: Mol. function=P-P-bond-hydrolysis-driven protein transmembrane transporter activity; Cellular component=type II protein secretion system complex; Biological process=intracellular protein transport across a membrane
  Homolog annotation: Hit_ID=A8GAM7; Match level="QueryCoverage=47%, HitCoverage=41%, E-value=1e-128, Identity=95%"; Hit description =Protein-export membrane protein SecD precursor
  Pfam annotation: Domain name=SecD_SecF; Domain location=352-495; Score=122.5; E_value=1.2e-33; Accession=PF02355.7; Description =Protein export membrane protein
  Pfam annotation: Domain name=Sec_GG; Domain location=279-307; Score =29.9; E_value=9.6e-06; Accession=PF07549.5; Description=SecDSecF GG Motif
  Pfam module annotation: Pfam domain module=SecD_SecF::Sec_GG; Domain location=352-495::279-307
MSNFTKDNIGKPMATLFVEYKDSGKKDANGRAVLVKQEEVINVANIQSRLGNSFRITGIGNPNEARQLSLLLRAGALIAPIQIVEERTIGPTLGQQNITQGLEACLWGLVASIVFMVVWYRKFGVIATTALVANLVLIVGVMSLLPGATLTMPGIAGIVLTLAVAVDANVLINERIKEELKNGRSVQQAIHEGYKGAFSSIVDANITTLITAVILYAVGTGSIKGFAITTAIGVATSMFTAIDYTVEQLNYGRKVYDFMRWDYLAFGISLLLLVASIATMSVRGFNWGLDFTGGTVIEINLEKPANLDLMRDTLEKAGFQDPIIQNFGSSRDVMVRMPPATGTAGQELGNKVIGVINDSVDKNATVKRIEFVGPSVGSELAQTGGMALLVALICILIYVGFRFEWRLALGAVIALAHDVIITLGVLSLFHIEIDLTIVASLMSVIGYSLNDSIVVSDRIRENFRKIRRDAEPYADDFRDHPDGGADAVHLRWRDAARLLAGDADRRVDRYRLLDLRRVRAGVEAGDETRTHVAAK

SEQ ID NO: 145742 - protein, 96 aa, Glycine max
  Coding DNA Sequence Number=SeqID_54057
MWSLKLPHMTLDLLFVMDRPVTCNILDQGVEPQYNLLHVDGWAVGQEGEAPLPRSLLTLGLHESDAEVEVTTLILGPPGSEKEAIEEAKLDLHLKI

SEQ ID NO: 145743 - protein, 163 aa, Glycine max
  Coding DNA Sequence Number=SeqID_54058
ETTLISACYQAFRMTDSKKVYTDNHSGISARQCDSKVSMTDIVSTEDDAFRVTDSKKVFIRRTTRVFPSVSVTQKAHETSLVSACYQAFRLTDSKKVYTDNHSGISARQCDSKVSMTDLVSTEDDAFRLTDSKKVYTDNHSGISARQRDSKVSMTELVSAGRL

SEQ ID NO: 145744 - protein, 124 aa, Glycine max
  Coding DNA Sequence Number=SeqID_54059
MVGYTPSSLTDLVFVSERIKVGPKRGKFDHPTRTTEKTGANKEGEDEGETHAVTAIPVRPNFPPTQQYLYSANNKLSPYPPPTITPTKVHQPPFFRGYDSNATCAYQWSPGASIEHCMTPKHKV

SEQ ID NO: 145745 - protein, 94 aa, Glycine max
  Coding DNA Sequence Number=SeqID_54060
MEVDEPWLGLWLPLNYQVDMGSSLAYDNGIWGFVVDLGMAFVDNWVVGKEKVCYWLSKDIVGLVGNLAVQEWQSQHGFLPHPHPLYLPQFSQSS

SEQ ID NO: 145746 - protein, 77 aa, Glycine max
  Coding DNA Sequence Number=SeqID_54061
MAGEPPATTNMNHMEEEAEAKAQQEPAHQSSPFKSLIIQKMDVMLHLHQEHSANVHNTLENITTHLENIETRLTLSN

SEQ ID NO: 145747 - protein, 223 aa, Glycine max
  Coding DNA Sequence Number=SeqID_54062
  Homolog annotation: Hit_ID=Q2HW90; Match level="QueryCoverage=88%, HitCoverage=39%, E-value=2e-18, Identity=30%"; Hit description =Putative uncharacterized protein
MEPLQTQAFRKTYGKILELAIAEVSIEAIASLTQYYDQPLRCFTCGDFQLVPTIEEFEEILGCPLGRRKPYLSSGCLPSLSRVATVIKDSARGLDRIKQTRNGIAGLPQKYLEDKARGMANKGNWVPFMDVLALLIFGVVLFPNVDGLIDLAAIDAFLAYHHSKESPVVAVLADLFDTFDRRCKKSSARIICCLPALCVWLVSHLFQQDTRHPCPLLKPSLVY

SEQ ID NO: 145748 - protein, 87 aa, Glycine max
  Coding DNA Sequence Number=SeqID_54063
MGVQIAPRPTWALQKAVASGGSNLARLGELGGKHLPYFAINRGGSEEEKAEALPKRFRNVFHEEFRKGFNRSSTYFIRSSSFFDLQR

SEQ ID NO: 145749 - protein, 85 aa, Glycine max
  Coding DNA Sequence Number=SeqID_54064
MRRYMKKNEETHGREASMRFFNGEFPPWRCSGRQRRRGEGRHHPLGNKPWKKELHHQECALGKKLEDDALMEEKKERRGSTKLKE

SEQ ID NO: 145750 - protein, 23 aa, Glycine max
  Coding DNA Sequence Number=SeqID_54065
MVFAEEMVESGSGWRRGKRMHSL

SEQ ID NO: 145751 - protein, 46 aa, Glycine max
  Coding DNA Sequence Number=SeqID_54066
SLGVMDEDVWEVLRAGPKYCLIVTLTPAAHTQPGCSGRPMAAVSTP

SEQ ID NO: 145752 - protein, 27 aa, Glycine max
  Coding DNA Sequence Number=SeqID_54067
MGATDIIIDKQRLIQKSLLYASRSLNN

SEQ ID NO: 145753 - protein, 52 aa, Glycine max
  Coding DNA Sequence Number=SeqID_54068
GRSRSVESVRSAAGLVPHSDCRGAHLERESMFSSTPGEPGSTTSGPNLWYVP

SEQ ID NO: 145754 - protein, 239 aa, Glycine max
  Coding DNA Sequence Number=SeqID_54069
  Pfam annotation: Domain name=Transposase_23; Domain location=139-209; Score=-3.6; E_value=0.0029; Accession=PF03017.5; Description =TNP1ENSPM transposase
DSFEEQATQGSSVPHGRQDVLAAAIGRPEHPGRVRAVGAGVTIKQYFGSTPRTSRSTSSLPPDELQQLTQQIRDHLEESITEKVTRQVMASFSHMQSQLQLQMQSQGLAVPPEPLVGPSGPRVSTKGSCVDPSENDPETGDSDRWSLYIEANPARLVAMGRVYEGSTVVHNTPLLPGQVKVSMEEVRDADAPVPVPTDEVSLVGQALHTCLADTSGQVFITAGSCVSGKTTSKARSEGR

SEQ ID NO: 145755 - protein, 169 aa, Glycine max
  Coding DNA Sequence Number=SeqID_54070
MTQELVARGDTLRLSAPRHSVTPSVIDEQRPIWSSAPFLEMSAFSDGDFSSLTNYLELQAAGPMIRGDTLRLSAPLCHPEAAGPMIRGDTLRLSAPFCHPEAAGPMTSRDKIWSFCTLVSSRGGGPDDTRRYLTVIRTLLSSRGGGPDDKQRQNLVILHPCVIQRRRAR

SEQ ID NO: 145756 - protein, 70 aa, Glycine max
  Coding DNA Sequence Number=SeqID_54071
MIKASRVRPIPENAMRYDLCTSWYTHGLASSYLEAALLTAAVSTPAYSLAHSLLLLWGLKHREILPVGVN

SEQ ID NO: 145757 - protein, 63 aa, Glycine max
  Coding DNA Sequence Number=SeqID_54072
MGVQIAPRPTWALQKIPPEGGEESKKEMVQPLRHFILICPNGERGMVVRFNLESNLVLQQLQQ

SEQ ID NO: 145758 - protein, 140 aa, Glycine max
  Coding DNA Sequence Number=SeqID_54073
MGMEDAMEEKLMLRLMLSRFAQPVWTPLFGRLILVEPIPQNCLLLENFQKQLPTKANLRKRHITLPSYRCPLCDSEEEDIGHIMFSCRMTRNLWWEALRWVNRVGPFPIEHKNHFMQFSHWNRKSFIDNRWVIKMLLSVN

SEQ ID NO: 145759 - protein, 112 aa, Glycine max
  Coding DNA Sequence Number=SeqID_54074
KATISSFYQFPDESLSEALERFRAGGKIKMKTPDEAMDLIESLAASDVAILRDRAHIPTMKRCTICGGAHESGEQPTVSTAETVANHPGNQFNRDQGGSSTRPQLQMPSLYD

SEQ ID NO: 145760 - protein, 78 aa, Glycine max
  Coding DNA Sequence Number=SeqID_54075
MELIENMAANDHAILCDRAYMPTKRYLLELIAQEATLAQNKLLSQQIEALTETLCKLSQQLQVGDATSTEEHMSQGNA

SEQ ID NO: 145761 - protein, 197 aa, Glycine max
  Coding DNA Sequence Number=SeqID_54076
  Homolog annotation: Hit_ID=A7P0P0; Match level="QueryCoverage=35%, HitCoverage=8%, E-value=5e-16, Identity=64%"; Hit description =Chromosome chr19 scaffold_4, whole genome shotgun sequence
MTVKTSDTCSSRRRSQLVCKRMPGADKPVRARQRMRKEKIPHQAPFAIQAAQLLGRAIGAGLFAITPAGERGMCCKAIKLGNARVFPVTTLIPGFEHSQIELKSEQKAGSNYLVKKQPKKPLARASQEPVGSDFSSGATLATIADVQPTSHLMQGGRCERSGNLDVGKPVVPAALMNRPTRGERRFAYWALFRFLAH

SEQ ID NO: 145762 - protein, 114 aa, Glycine max
  Coding DNA Sequence Number=SeqID_54077
MMNVLSGATLFYKITHVSNIFKIHVDRDLLAFNIVATYPSAGGQRVTRGMRVPRKEYARSRHQRLFEENVGKTGKDAIYKLFSERFGSCIYARGRVFPFAPTYSSIWDEEIRPT

SEQ ID NO: 145763 - protein, 143 aa, Glycine max
  Coding DNA Sequence Number=SeqID_54078
MAFRKRKAPSTPTQVRFDRSRFTSQEAWERYTNIIVPRKLLPERNVVVYYTEFDEFKEELKRRHWDKELTDFGDGNIDVSIVKEFNANLYDPEDKSPKQVRVRGHLIKFDEDTLNTFLKTPVIVEEGESLCAYSRFALLRPDP

SEQ ID NO: 145764 - protein, 77 aa, Glycine max
  Coding DNA Sequence Number=SeqID_54079
MKHKDKVMIFFINGFLCVLEDEWQRSGERKRERRRHFKEKMSLEEAHHHRRPWIRAWRKNEMNEERGREEHEILCSK

SEQ ID NO: 145765 - protein, 75 aa, Glycine max
  Coding DNA Sequence Number=SeqID_54080
VQPLKLHGLGPSLDKSESHKILKKPLELVHKLPFIVGGNVPLSKGTLRIILILYWRIPMNPSFPNKGSPQIEGIP

SEQ ID NO: 145766 - protein, 149 aa, Glycine max
  Coding DNA Sequence Number=SeqID_54081
  Gene Ontology: Mol. function=phosphoprotein phosphatase activity; Biological process=intracellular signaling cascade
  Homolog annotation: Hit_ID=A7PHV0; Match level="QueryCoverage=89%, HitCoverage=42%, E-value=2e-22, Identity=39%"; Hit description =Chromosome chr13 scaffold_17, whole genome shotgun sequence
MEARNTYLSHEMWRVYDYSSRCLSIIREMCSATDYKIKSIGGMCILIQMWAWKRCTTLAPKRTPPVIQNKPLGHRWLRRGNQHIGNDDLIVFRRKLDIMKRHEFLWESYTATVMSSLPLICLVGSVAWCAVVPLICFHVVEWHQPDRVL

SEQ ID NO: 145767 - protein, 84 aa, Glycine max
  Coding DNA Sequence Number=SeqID_54082
MRGIVHEPQGEPLGTSTLTFRGLNVLAFTGLHVLAIRGLHVLTFRGLHVLTFVGLHVLTLEDYTSSPSEGFMPSPSEDCMSSPS

SEQ ID NO: 145768 - protein, 109 aa, Glycine max
  Coding DNA Sequence Number=SeqID_54083
MWMDRFALTLNGSQELPRLLAKAKAMTDTYSAPEEIHGLLSYWKNTITKRAARDPYRTRSKSRTMGDQEETQEQMKADMSALKEQMASMMEAMLGMKQLMEKNAATAAA

SEQ ID NO: 145769 - protein, 62 aa, Glycine max
  Coding DNA Sequence Number=SeqID_54084
MTTFVSACQRAHLPLVEKGVDNHKVRITIRYPRMSSDSPSLNDKGADNHKVTPHVIELAVSR

SEQ ID NO: 145770 - protein, 188 aa, Glycine max
  Coding DNA Sequence Number=SeqID_54085
VDCDEEDREEHSHAVVQGSAWTDSGFRMSIGSRMGSIGRSGTSTSDHAIPFGYTQTIPAPPVDSWVSYDDIHDRWMHYEDHIVPAGEVCVVPGACSRDYIDWFFRISHPFMTPGHALDPLPHGHAPQPRVVPQAPQTDISRVPEPGASSTSAEEPRHAVEECLRLVRSVTQDHLVYVRCRRRRHTDQA

SEQ ID NO: 145771 - protein, 305 aa, Glycine max
  Coding DNA Sequence Number=SeqID_54086
  Gene Ontology: Mol. function=nucleotide binding; Cellular component =integral to membrane; Biological process=chromosome segregation
  Homolog annotation: Hit_ID=A8GCE7; Match level="QueryCoverage=100%, HitCoverage=25%, E-value=1e-154, Identity=92%"; Hit description=Cell division protein FtsK/SpoIIIE
  Pfam annotation: Domain name=FtsK_SpoIIIE; Domain location=1-178; Score=243.8; E_value=3.9e-70; Accession=PF01580.9; Description =FtsKSpoIIIE family
  Pfam annotation: Domain name=Ftsk_gamma; Domain location=281-305; Score=-23.5; E_value=0.03; Accession=PF09397.1; Description=Ftsk gamma domain
  Pfam module annotation: Pfam domain module=FtsK_SpoIIIE::Ftsk_gamma; Domain location=1-178::281-305
MPHLLVAGTTGSGKSVGVNAMILSILYKATPKEVRFIIIDPKMLELSVYEGIPHLLTDVVTDMKDAANALRWCVGEMERRYKLMSALGVRNLAGYNERVDQAEAMGRPIPDPFWKPTDSMDITPPVLEKEPYIVVMVDEFADLIMTVGKKVEELIARLAQKARAAGIHLVLATQRPSVDVITGLIKANIPTRIAFTVSSKIDSRTILDQGGAESLLGMGDMLYLAPNSSIPVRVHGAFVRDQEVHAVVKDWKARERPQYKEGILSGGEDGEGGAGGGMDGDEELDPLFDQAVDFVVDKRRASISG

SEQ ID NO: 145772 - protein, 154 aa, Glycine max
  Coding DNA Sequence Number=SeqID_54087
MTLLLSNIPPDDHNADLPPVEVSVGLCHRDIGKDCTHKAPSGPGEVQQDPGVSSFGFGPLSFLQGARPPNKGSCPQDTQRTRRSPTGPRGFQLWLQASVSPTGCPFPPTRDRARKTPSGPEEIQQGLRVANSNYGPLSVLRSAYRPQQGHQAPY

SEQ ID NO: 145773 - protein, 76 aa, Glycine max
  Coding DNA Sequence Number=SeqID_54088
MAAKYLEVVKRGRIPTMDGPQMKLGAQNLSLRVYHSSSVRMTACHRARRLWMTKGAETTSVSACYHALSLRDSKES

SEQ ID NO: 145774 - protein, 145 aa, Glycine max
  Coding DNA Sequence Number=SeqID_54089
MSASDHAILRDRTHQPTKKSLIELSSHDALLAQNKLLSKQLEILTETLDKLPTKLSLGQPTHSSILQKTLKKFIIWEINNDKGILKEDFQASSRLPIINEDSGGHTLVTSSTKTKVGLKTGQSNKDLTYSKGLLSWRRPRLSLCR

SEQ ID NO: 145775 - protein, 133 aa, Glycine max
  Coding DNA Sequence Number=SeqID_54090
MEAPTNALNLSNRRPQLHPICFRAIEGQIAFTGGVPRLGRTPSIVLPGMSPFILEASHKDMSLWTITSSRPCFSMLGGEGLQHLGVSFLFPNVRQAVAGALPLVVPGFNPFSGEDEIRKVSWHVAYQLFIVEH

SEQ ID NO: 145776 - protein, 123 aa, Glycine max
  Coding DNA Sequence Number=SeqID_54091
RWPRESFHQRGPGRTPQEKAPALPHRLTQTSTGIDSGALNISSASEPSRDSHSLERGRRCWAPLVPPMAKFDPEIVDEKMSLDEAHHHKRPWIRAWRKKEMNEGRGREEDEILCSKRALKSEV

SEQ ID NO: 145777 - protein, 163 aa, Glycine max
  Coding DNA Sequence Number=SeqID_54092
MVKEECKEVSVSSKRLAKKERHFEIKINIKEISPLRQPPHFLLCKKTIVSIATPLGLEFIPQVKELLDKGLLRKSINPCALLVLKIGIIRHQIPKIGGMMNVLSGATLFCKITCAPNIFHDCVYIGTISDKGVPMNRKRIKVILSGPLPQVFREGAQSMKGIL

SEQ ID NO: 145778 - protein, 138 aa, Glycine max
  Coding DNA Sequence Number=SeqID_54093
  Gene Ontology: Mol. function=N-acetylmuramoyl-L-alanine amidase activity; Cellular component=extracellular region; Biological process=peptidoglycan catabolic process
  Homolog annotation: Hit_ID=A4WD40; Match level="QueryCoverage=99%, HitCoverage=47%, E-value=2e-62, Identity=86%"; Hit description=N -acetylmuramoyl-L-alanine amidase precursor
  Pfam annotation: Domain name=Amidase_3; Domain location=37-138; Score= 76.2; E_value=1.1e-19; Accession=PF01520.9; Description=N -acetylmuramoyl-L-alanine amidase
MTLTGVASQATAKEQPLKTSNGHSKPVAKKAGSRRLVMLDPGHGGIDTGAIGHNGSKEKHVVLAIAKNVRSILRSNGIDARLTRSGDTFIPLYDRVEIAHQHGADLFMSIHADGFTNPSAAGASVFALSNRGASSAMG

SEQ ID NO: 145779 - protein, 95 aa, Glycine max
  Coding DNA Sequence Number=SeqID_54094
  Homolog annotation: Hit_ID=B0HC01; Match level="QueryCoverage=34%, HitCoverage=70%, E-value=3e-11, Identity=100%"; Hit description =Putative uncharacterized protein
GGGAYGKTPATRPLYGSWPFAGLLLTCSFLRYPLILWITVLPPLSELIPLAAAERPSAARNSYDHDYEFELGTQLEEDVGYIRQSFDLPPPRPSS

SEQ ID NO: 145780 - protein, 93 aa, Glycine max
  Coding DNA Sequence Number=SeqID_54095
  Subcellular localization annotation: CTP_CleavageSite=34; ConfidenceScore=5.11e-01
DRTHKTPSGPGKVQQGPRVSSSGYGPLSVLQGARAQLVIELSQRSSWATPDIGRQGRTVRAHQQHWDGRYAGTLDYYAIHLGQDFTRASSSIK

SEQ ID NO: 145781 - protein, 86 aa, Glycine max
  Coding DNA Sequence Number=SeqID_54096
MAPKKLSAKKSRRDTAAEGTSAAPKFDSHRFRSTEHQQRFEAIKGWSFHRERRVQLRDNEYTDFQEEIARRRWTSLVTLMVKLTQI

SEQ ID NO: 145782 - protein, 46 aa, Glycine max
  Coding DNA Sequence Number=SeqID_54097
MGVSLAIIGGVYLSSSFSSQGGLLKEVFSKKLLKEVFSRKLLKEAT

SEQ ID NO: 145783 - protein, 32 aa, Glycine max
  Coding DNA Sequence Number=SeqID_54098
MGPKYLEAVKQRLHVIKQWSRTKLGGKCKDHT

SEQ ID NO: 145784 - protein, 78 aa, Glycine max
  Coding DNA Sequence Number=SeqID_54099
  Gene Ontology: Mol. function=transferase activity, transferring glycosyl groups; Biological process=metabolic process
  Homolog annotation: Hit_ID=A7R171; Match level="QueryCoverage=97%, HitCoverage=16%, E-value=1e-14, Identity=50%"; Hit description =Chromosome undetermined scaffold_340, whole genome shotgun sequence
LMEEKMVGIEVQKNEHDGKFTRDSVATALRPVMLEEEGKTSKSQAKEMSKIFGDKDLHQNYVDEFVDNLEIHRPTIKD

SEQ ID NO: 145785 - protein, 144 aa, Glycine max
  Coding DNA Sequence Number=SeqID_54100
  Subcellular localization annotation: CTP_CleavageSite=66; ConfidenceScore=5.25e-01
MCPPPSSLERCVVIALCYSPFSIFFRSPMNCVFVHVSSTFEFGAMLSDCLVQFSILTLFRSPINCVFVHVSSTFEFGAMRSDCLVQLSILALFRSPMNCVFDHVSSTFEFGAMRSDCLVQFSILTLFGSPMNCVFIHVSSTHEF

SEQ ID NO: 145786 - protein, 149 aa, Glycine max
  Coding DNA Sequence Number=SeqID_54101
  Gene Ontology: Mol. function=nucleoside-triphosphatase activity; Cellular component=plasma membrane; Biological process=peptide transport
  Homolog annotation: Hit_ID=B0J1E1; Match level="QueryCoverage=91%, HitCoverage=65%, E-value=8e-69, Identity=93%"; Hit description=ABC transporter related
  Pfam annotation: Domain name=ABC_tran; Domain location=55-149; Score=- 54.0; E_value=0.02; Accession=PF00005.18; Description=ABC transporter
MFRRPENAGGRVMGAQPLLKVENLVKHFHVKLGAFGERSATVYALDNVNLDIMEGETLSLVGESGCGKSTTGFTILNLYKATSGRVVYKGQDIATLDEKQMRPFRRDLQIVFQDPYSTLNPRMTIGEAIGEPILFHKLATKAELKGKVD

SEQ ID NO: 145787 - protein, 134 aa, Glycine max
  Coding DNA Sequence Number=SeqID_54102
MVKDECKEIRVSSKRLAKKESHFAIKTNIKETFLLRQPPHLFLCKTILVSTATPLEIEVIPHVKELLDEGLVHKSLNPCALLVSKIGIIRHQIPKIRGMMNVFSGATLFCKITQAPNIFMIRVHRDSLAIKGFP

SEQ ID NO: 145788 - protein, 92 aa, Glycine max
  Coding DNA Sequence Number=SeqID_54103
  Pfam annotation: Domain name=zf-CCHC; Domain location=20-37; Score =31.4; E_value=3.3e-06; Accession=PF00098.14; Description=Zinc knuckle
MERSHNFNNGKRSQEVSPTLKCYKCNQPGHIKENCPSNESWPKKNEKKSYKERGSKKAYIAWDNNDSSDGSEKEINLLSKDYESDKNISQED

SEQ ID NO: 145789 - protein, 52 aa, Glycine max
  Coding DNA Sequence Number=SeqID_54104
MTLRQHGLSLGSSSSMESFASWKMNDSRMEKGREREETPLQGEDESRRSSPP

SEQ ID NO: 145790 - protein, 128 aa, Glycine max
  Coding DNA Sequence Number=SeqID_54105
MTNLSLLATDTTVSEWQRGADNRKNDQTWSLRCQRTRLCLNGKGVRITVRMTKLGLCVPTDTTVSEWQRGADNRKVSPRIIMTKLGLCVPSDTTVSEWQRGADNRKVSPRIMCADDQLVSACHGHDCV

SEQ ID NO: 145791 - protein, 183 aa, Glycine max
  Coding DNA Sequence Number=SeqID_54106
MTRTRGLGRAIGRLVDRDRHDDHDAADVPERRRPTASARRQQVHQMTADARDMAEDVVDMTDDVPDLVEEAPEMCADVQGADGAEGSDADDDTKGFPGGPRDPSVLASFVDHVAHAIWSGQERPDLKLVSHGRKVTLIGRIKSTDRLFSCYWRSWTNIRICGEVARRDQHLPPFGRRVDDHIG

SEQ ID NO: 145792 - protein, 36 aa, Glycine max
  Coding DNA Sequence Number=SeqID_54107
DALPKRFCNVFREEFRKGFNRSSTFFIRLSSFSIFN

SEQ ID NO: 145793 - protein, 49 aa, Glycine max
  Coding DNA Sequence Number=SeqID_54108
MATNHQCFGTGRSQTGMCIIDIGDLNSRRSIDLDEEKERKICLGSKKFP

SEQ ID NO: 145794 - protein, 45 aa, Glycine max
  Coding DNA Sequence Number=SeqID_54109
ASGCPALAVAPAAGAPVEPDPWALPKASVSGALPIVPRVRGASGA

SEQ ID NO: 145795 - protein, 70 aa, Glycine max
  Coding DNA Sequence Number=SeqID_54110
  Subcellular localization annotation: CTP_CleavageSite=51; ConfidenceScore=5.38e-01
MDVWGANTFPVRKYNSRTFHLKVRRSRLFRFFRRFPQINVGGDSARIPFVEHASRESRVALPPKVSWYFV

SEQ ID NO: 145796 - protein, 201 aa, Glycine max
  Coding DNA Sequence Number=SeqID_54111
MKVIIAFSVILSNLLYSQIKVPDDYKKIPDILDTVEYLYPFIVPDKDYAYWRVLSNDMDYEKSVLYESQAPDFMTINEPVPEKGFFQKCIGNNCFSYILACKNERSVYFSNEQQLRDFLGTVDNLPEAILLAKTYGYSVDTSNRFTGSYKIEDRHISMYLMQSKGCPAVKESFWVKINRKTGKLEAKSNGVYTKDENCTSL

SEQ ID NO: 145797 - protein, 87 aa, Glycine max
  Coding DNA Sequence Number=SeqID_54112
MENCTKQSLRMAPNLKVEDYRTKTQFMGLRKSSKLGGGGHMNENAIHGAPKKVENGELHLAITTHSSKLEGGGHMQRKRNSWGSEKG

SEQ ID NO: 145798 - protein, 75 aa, Glycine max
  Coding DNA Sequence Number=SeqID_54113
ACSELQNKERETPPPLKRAIKGINSRTHQQESSQGYCASNQWGKTHQMIMMMDGSNSHKGKLITFKLSFQNYHDM

SEQ ID NO: 145799 - protein, 239 aa, Glycine max
  Coding DNA Sequence Number=SeqID_54114
  Homolog annotation: Hit_ID=Q2HW90; Match level="QueryCoverage=82%, HitCoverage=39%, E-value=4e-16, Identity=31%"; Hit description =Putative uncharacterized protein
MGPLQMQAFRKAYGKILDLTIAEIFTEAIASLAQYYDQPLRCFTFGDFQLVPTVEEFEEILGCPLGGRKLYLFFGFLPSLSKIAIVIRDSARGLDRVKQTRNGIVGLARKYLEGKARDMANQDEWVPFMDVLALLVFGVVLFPTVDGLVDLAAIDVFLAYHHSKESSVVAVLADLFDTFDRRCEKSSAQIICCLPALCVWLVSHLFQQDIRHPCSLRSHRSCVEKEKSRLGPTLGWDRR

SEQ ID NO: 145800 - protein, 116 aa, Glycine max
  Coding DNA Sequence Number=SeqID_54115
MAKVIACMKEEIEGIKGKEEKEKIEGESNEENAALGSPEDDDTARELRASPFRRRSWRDSGEAIREKVETALLRERSFVLVLEKEEHEEGIARHMGKAIGELSEIKWGVRNPTIKE

SEQ ID NO: 145801 - protein, 335 aa, Glycine max
  Coding DNA Sequence Number=SeqID_54116
MDPGHHEVRYDHEDNHRVFLVDGVDALEVLVREVNVDVPDDVVAHAVVAVVFVCLDLPLFFYLLPGSCAAPLDVLLYLVMSDPDLGSFVLGSRMGTSRLNTSSRIVAGACLAYASYPTYVSRPWCLLCAYRASVWLDRLHFGIWIFLLSRCNPWLARATRPYYQVEHGMQHYLGVKILDLDSYAPKSVHELSKGIIVCLLQTDKGGRGHAVRLAGGILRTKLFNEGVEVVYGPWFAYVRKASRCSFGSVVPLYPSRLSGFHPKGMPASIMHVACVSEVLFPLGAFKQGVGKLLVSLGMSNMSLQLSVCVCHNYQMRMGVFEKGLVFEARSTANHG

SEQ ID NO: 145802 - protein, 97 aa, Glycine max
  Coding DNA Sequence Number=SeqID_54117
  Subcellular localization annotation: CTP_CleavageSite=30; ConfidenceScore=5.04e-01
MYPLLFLVTTTQVDVPSTCTTKDVPSNVLRQTSQAGKGRIKRILRLCLIEFFEKGEGRHKRIQAVSPLFFWKREKRDTKRIQAISPCRILFGKGRRE

SEQ ID NO: 145803 - protein, 185 aa, Glycine max
  Coding DNA Sequence Number=SeqID_54118
MTLLLSNILPNDHNSDLRLSKWIMPPRHPVDPEKSNRALGFPTLITGLCQFYGVSVTPTKLIQPPINRAFIEKYCMPKQVQGQQPAADAPLPPLEEVPSLRSISDHLRRIELQMHNGVRTPVLSLGLPPNSSGPRWPSLGTRPILRREKDPWGPLGVRKELRRITTWLTCWTSSLDEAELHDRDR

SEQ ID NO: 145804 - protein, 232 aa, Glycine max
  Coding DNA Sequence Number=SeqID_54119
  Homolog annotation: Hit_ID=A5B5G7; Match level="QueryCoverage=87%, HitCoverage=15%, E-value=2e-07, Identity=24%"; Hit description =Putative uncharacterized protein
MLSLAQFIAASTRLSEPCLLSTYGIQEEKEHDFKTHNSYDTRHFQSLEAWNRYMDNILGRNIISERNVKIYHIEFDKFKVELERRNLHKCLTNLQDGSIDMAVVKEFYANLYSPEEPAPKQARVRGHLIKIDADNLNEFLQTLVVLEELRINHQEIEARLCIPCKRFVLNVEGQPWKLLRKDLTTLAQTWSVFSYSNLAPTSHTSDLNMDKATLVYGLVCNMDMNIGALISG

SEQ ID NO: 145805 - protein, 93 aa, Glycine max
  Coding DNA Sequence Number=SeqID_54120
MGIGSTFGRPLVLGYLEASILDEKEFLLLKVISTFPELSCLICSMVGAGRGIDGVALSITHLSGRVTSSHFIFLGRETLAFVISVINKVVSPF

SEQ ID NO: 145806 - protein, 444 aa, Glycine max
  Coding DNA Sequence Number=SeqID_54121
MGSKSTLRLMRTLGPSLGSLAQSTWSLLSNALAGWLPRRESLLLLPLPNQDLTDLGFILKKLGRERNVVVYYTEFDEFKEELERRKWDEELTNFAEGGIDVAILKEFYANLYDLEDKSPKLDPQELATKLCIPRRRFELNADGQPLKILRKNMTTLAQTWSVLSYSNLVPTSHTSDITLDRAKLIYEMIMKMDRNLGYLISHQISIIAQNDSSRLGFLALITTLCKARGVTSDSRTLKSLSPTIYLAYIKKNCWNLDDPIVTFRGPKKTRGKRLEAPTTSAAPETAAPSSSTPPAPSSSTPSTQIPLPAHSSFGPSNFLFTSEMLHSMLQSLHRGHVIIMQSLQSSGLPFIMSTDEFLTQIPAKEDEPTPPEPFEFVSDSVVAQEEVPSPEPIPEPSPTPVPEDTMLAEDTQPSEPVLEHEQLTIQDSSATPILDLNEDQPQED

SEQ ID NO: 145807 - protein, 48 aa, Glycine max
  Coding DNA Sequence Number=SeqID_54122
  Gene Ontology: Mol. function=aspartic-type endopeptidase activity; Biological process=RNA-dependent DNA replication
  Homolog annotation: Hit_ID=Q6WAY3; Match level="QueryCoverage=100%, HitCoverage=2%, E-value=4e-09, Identity=58%"; Hit description =Gag/pol polyprotein
MDINPAYSYLLGQPRIHSVGVVPSMLHQRLKFMVEGQLIIISGEEDIL

SEQ ID NO: 145808 - protein, 112 aa, Glycine max
  Coding DNA Sequence Number=SeqID_54123
MARIAKKWDSRNTKEAFGGKDEGVGRSRCKKSGARIVCCTLALYVWLVSHLFRHENRPVYPLQGHRLCAEKGKENWEQLFASMVGASINWFPRWKEGRAGVLSHVRDSRMYP

SEQ ID NO: 145809 - protein, 28 aa, Glycine max
  Coding DNA Sequence Number=SeqID_54124
MKILALLAEVTVLEEQIVRLEEQGVHFR

SEQ ID NO: 145810 - protein, 168 aa, Glycine max
  Coding DNA Sequence Number=SeqID_54125
  Gene Ontology: Mol. function=metal ion binding
  Homolog annotation: Hit_ID=Q941Y7; Match level="QueryCoverage=84%, HitCoverage=53%, E-value=2e-19, Identity=41%"; Hit description=RING finger-like protein
MSVWQSLQVVSEIMFLLLDLQLYCGSIQDYMFEESVCLLLRASWFTPLSVEEHVAHEDVYEDLEDYYQYEDDDDMDEAYYGGSSNLRVIGNRRWGDNGYVRAGRQEARPVHRLNFQDSGASSSSREPKKKEVGKIITGRRAKRAQKREAADKAAEAKHLQHLIRLGRK

SEQ ID NO: 145811 - protein, 116 aa, Glycine max
  Coding DNA Sequence Number=SeqID_54126
MGHVCEILSPEKGPVWDCYGAVFNVELDTHVNYVTVIRKPNKCKSSQTKQKQVHRRRRSVEAKLSKFILMMPKTQVKNQESNKFQESKSRSIKNQDSSEDSREDSRYARTSRKTSR

SEQ ID NO: 145812 - protein, 157 aa, Glycine max
  Coding DNA Sequence Number=SeqID_54127
ELHYDDAILPRKGLVTRAMSKRLQEDWARAIEEGPKPRAKRKISVLSATSAFSQAKLETGAKPNFTYSWSLTRGICGRSLDIQPDEGSRDLEATTIPEEEPQSSEACSSFAIAEHSHLDPTEDYIMAEEPRRVTLEYYSSSNVPQFFTSIAQPEVQA

SEQ ID NO: 145813 - protein, 107 aa, Glycine max
  Coding DNA Sequence Number=SeqID_54128
  Subcellular localization annotation: CTP_CleavageSite=99; ConfidenceScore=5.09e-01
MCFTSKIRVIQDCQWFYKVMGTPPRSPSSSDGHSKATSRKSRQSTRLRRCIKIYKDLVWDDIWAKFDIPEALTGKKKVTSTVATRWRQFQSSLTTKFVYADTKGEDK

SEQ ID NO: 145814 - protein, 58 aa, Glycine max
  Coding DNA Sequence Number=SeqID_54129
MSRNFTNCLMMGAKYLEVVKRGSHPNNGWSPDEIRWRESLRCWTLKRSQVMFDKKKRL

SEQ ID NO: 145815 - protein, 68 aa, Glycine max
  Coding DNA Sequence Number=SeqID_54130
MHDAIKEHARRYHPLRIYIVAIGTISDNESLKEENLDEASMLSSESETQHDHRSTCTPYGSHRPGYMA

SEQ ID NO: 145816 - protein, 216 aa, Glycine max
  Coding DNA Sequence Number=SeqID_54131
MVEPSKKRKGSSSRSQRHSEAQDTPIPSSISSSSLFSSEEQHIRYTKLFSSHSIIDPKFIDMDFFSDESFECIQAFQNSNLIPFMSLKLPVYSKLVYGIKMVIDQSLFYDLTQLSSEGVPFEVTLFLQHFNIPLDSEPYVPIKRSFLIGAAMVVSFGYHKECDGSWVKKGAQPNDDEEHLPVERDSSLLQNILDRFDGLQTYVGERFDSLERQVDT

SEQ ID NO: 145817 - protein, 102 aa, Glycine max
  Coding DNA Sequence Number=SeqID_54132
  Subcellular localization annotation: CTP_CleavageSite=64; ConfidenceScore=5.02e-01
MHIVTVVPTWPNFPLAPLNPMYQYPPQQYQYSANISPSHYSPPFQPRMPNYPQRSPLNRPQNPPAAHPRPNTAPNTSQNTNQGRNFPEKEACRIHPNSNAIC

SEQ ID NO: 145818 - protein, 65 aa, Glycine max
  Coding DNA Sequence Number=SeqID_54133
MTANIEAPYYCIFNTRSKMSIPSIVSYDNITTTTTTPYPTRWGWLHGSTSAIMFYQVPIVSYDNN

SEQ ID NO: 145819 - protein, 201 aa, Glycine max
  Coding DNA Sequence Number=SeqID_54134
  Gene Ontology: Mol. function=oxidoreductase activity; Cellular component=chloroplast; Biological process=metabolic process
  Homolog annotation: Hit_ID=A7R093; Match level="QueryCoverage=39%, HitCoverage=37%, E-value=6e-22, Identity=50%"; Hit description =Chromosome undetermined scaffold_300, whole genome shotgun sequence
  Pfam annotation: Domain name=ADH_N; Domain location=81-151; Score= -4.1; E_value=0.0028; Accession=PF08240.3; Description=Alcohol dehydrogenase GroES-like domai
  Pfam annotation: Domain name=Chromo; Domain location=9-63; Score =53.3; E_value=8.1e-13; Accession=PF00385.15; Description='chromo' (CHRromatin Organisation MOdi
  Pfam module annotation: Pfam domain module=ADH_N::Chromo; Domain location=81-151::9-63
MAGEQKEEFEPEAVLAVRRVQKQGEEVKQLLIHWKGKTVEEATWEDYVMFKSQFPQFNLEDKVAAEEGSIDRNNDNNSSLPGQLIHHTSSGPRVWKVYSRRGSDVTGEVVEVGQGVRKFKPGDKVVALVNPFSGGGLAKFVVAKKNILINAALGGVGHYALQLAKLGNTHVTATCGAHNIVLVKSLGADEVIDNKTQMVQL

SEQ ID NO: 145820 - protein, 47 aa, Glycine max
  Coding DNA Sequence Number=SeqID_54135
MATTTSMFTFTLPTISTKLGSLLESQFYDFQTSIAPTALSKVICSGL

SEQ ID NO: 145821 - protein, 75 aa, Glycine max
  Coding DNA Sequence Number=SeqID_54136
MMTKEMTKSSKINQRTTQNNSRVQDKNQEEFKTQEESLESRIKIQGSRFKVQDQDSRIKGRLNQDKYKKFFPKTE

SEQ ID NO: 145822 - protein, 108 aa, Glycine max
  Coding DNA Sequence Number=SeqID_54137
MPSKVILMMPKNQELSKVSSKDSRIKFQVSRFKIQESSFKNQESRIKSNQDQDSRIKRRLNQDKGYIYLGLTENNRGYISCGSVLVEGTSTRVSKRTREGTSLVDLCL

SEQ ID NO: 145823 - protein, 77 aa, Glycine max
  Coding DNA Sequence Number=SeqID_54138
MDGKQCTPSGNVEDGLLGVVKAIDDGREEGIEVELEVFTGEDDDGGNNLDCALGDAEVVVLEEIHTRVNKRGDLGRG

SEQ ID NO: 145824 - protein, 42 aa, Glycine max
  Coding DNA Sequence Number=SeqID_54139
MSKIGRFGGLGMEERRKGEEVEQGFLKNVIFIDQDALPSVLV

SEQ ID NO: 145825 - protein, 341 aa, Glycine max
  Coding DNA Sequence Number=SeqID_54140
  Homolog annotation: Hit_ID=A5AIE9; Match level="QueryCoverage=76%, HitCoverage=55%, E-value=6e-13, Identity=26%"; Hit description =Putative uncharacterized protein
  Subcellular localization annotation: CTP_CleavageSite=27; ConfidenceScore=5.65e-01
MAESSKKRKGSSASASASRAHRSGATSASTTPIPPSLSSSTLFFFEEQQKWYSNLFSSRSIIDPKFIDMEFFSAETFDCIQAFQNLGLIPFMSLQLPVYPELVKDFYCNLEIQDNTLISEVFGIKMVIDQSLFHDLNQLSSDGVPFEGTLNDDWKFDFSAHDARQLVCTNHADMTGRLLAGSLAFESRILHYLIVRILLPRSSNLAQVSKEDLVIMWAFHTGCQLDWAHLVRYRMHKALRLNAPLPYPHLVTLFFRHFQIPLDSEPYVPIKRSFLIGAAVIASLGYRKKHDGSWVKKAAQPADDEGNLPTEDSSSLQKIFSIVTSFHLVLEWLSKAYIYVT

SEQ ID NO: 145826 - protein, 255 aa, Glycine max
  Coding DNA Sequence Number=SeqID_54141
  Homolog annotation: Hit_ID=A5C1L4; Match level="QueryCoverage=47%, HitCoverage=52%, E-value=2e-07, Identity=30%"; Hit description =Putative uncharacterized protein
YILCGTSRAYIYLGCNTENKRGHISCGSVQVEGTSTWLFKENKGGYIPYGSRLLERILQGYWKSQEPVVAWGLNYFMAPISKKLCGRPNGSKNKPKSTSRSICQPIESSVKLVTINVVSGKGVMETILDVACCDHVSLTVLNAFGMIKNVIICNPPQGATHPPPFSFAFKLCTSHGQVFDGLIGGSIIVGDNVSLMAKKGTMMTTTYNYNDNPSDLSRRGDLLLFNMVGSNVRGGQNKRRVLYNALYAGGVFCVG

SEQ ID NO: 145827 - protein, 119 aa, Glycine max
  Coding DNA Sequence Number=SeqID_54142
  Subcellular localization annotation: CTP_CleavageSite=57; ConfidenceScore=5.01e-01
MSPKIVGEEETDDVHANRNDHDASQMTAPPNSPPPPTGATSQSPSTLKQTRKATQLRSLATRPVGAAKLLVYVDPTTRKVDGPHRKKQFKSDLTTKWALVADKESIDDTVCEKYDISKE

SEQ ID NO: 145828 - protein, 375 aa, Glycine max
  Coding DNA Sequence Number=SeqID_54143
IRQSLSPYPPLLLQNLLHRGRNPVVHNYKNRAYPLAPNLQHQPTSSNSVAHDADIAPTRAPHKALYIIRVASIEAYHVVILNNFSKNLPPVALHAGQQSLHDELLRDHDRGHGVLHGINDGRDKHDIDLVLEALTESVHHRVLEGANCLAGIIAGNDSTANGTTKDLPLTAIEGEQCEGPAKCEGINTMQRVEGCFSDHSKDIGDSEANVASMSNIKNGLYDVAAWGHIDNDDLHAGFHGARFSRGWFVAGDGGQRERWKEELVLLSQEDVKSKSKERELWKMEITMELLVIMTKRGAQPNDDEGQLPVQEDSSLLQSILDRFDGLQTYVGERFDSVERQVDTRFEEMNSRIAKVEEDVTIIRDCLDLPPPPPSV

SEQ ID NO: 145829 - protein, 41 aa, Glycine max
  Coding DNA Sequence Number=SeqID_54144
MVEVVDKADSYCKEEDGNGTAAPQPCMDSDMEDGTCAVCIK

SEQ ID NO: 145830 - protein, 314 aa, Glycine max
  Coding DNA Sequence Number=SeqID_54145
  Gene Ontology: Mol. function=small conjugating protein ligase activity; Cellular component=cytosol; Biological process=regulation of protein metabolic process
  Homolog annotation: Hit_ID=Q06H24; Match level="QueryCoverage=28%, HitCoverage=60%, E-value=4e-44, Identity=92%"; Hit description =Ubiquitin carrier protein
  Pfam annotation: Domain name=UQ_con; Domain location=188-307; Score =144.1; E_value=4e-40; Accession=PF00179.17; Description=Ubiquitin -conjugating enzyme
MLQCEGFSSKLRYDFEIPNGENVRNWVANVVLKFHDDPIVNESEIVIFLRQVWWAARKRKNYKNWDVTPLALHPTVTSASLPWTFPLLLSTASGHCASILTNRKSRVTATRNSTLQSCLMVMASFRNAAINIVERGRKEGKEGEWIDSSTAPDIYKSSFPSPKSLILFQSFFFFTFLSRSIIQNKKKKKELKDLQKDPPTSCSAGPVAEDMFHWPTTIMGPPDSPYARGVFLVTIHFPPDYPFKPTKVAFRTNVFHPNINSNGSICLDILKEQWSPALTISKLLLSVLGGVATSDFYRYVSIANFLELPQNPIS

SEQ ID NO: 145831 - protein, 287 aa, Glycine max
  Coding DNA Sequence Number=SeqID_54146
MDWEVISIGGSSYEDTCRGASNSESYSTEREPFPITVILPLSASGGVRRSSGDRDVRRLPVFDVKLANPKDSCKLGVQACGSDDFPFLRAAIGRLECHSALDRFSVCSTRALECGLFPTSPKQLSDSSDKIGWVSLNNVEFDSNIFRHLKDHFFKSDPTLVERVNKAILEQLVTSLDTWLILSLSSASDPLVALDGKVPNLVLRPLMKQVGPTSGTVPLFAATPPVGEGGQLAGEVCPIVVGAEAAGLMATTGRLSIVQDVHPAPPIVKAPATVATPASSPPPTIVV

SEQ ID NO: 145832 - protein, 56 aa, Glycine max
  Coding DNA Sequence Number=SeqID_54147
MTGVRAKSQRSVFQKGKRVGVTTNIYSRKTLEKPKMRFILTAKKKSFKALDLETMF

SEQ ID NO: 145833 - protein, 87 aa, Glycine max
  Coding DNA Sequence Number=SeqID_54148
MAKNHIFQWAFHLRLVMSFKTKKGENRLKGAIKGINSRKHQQESSQGYCASNQWGKTHQKIMMMDGSNSHKGKLITFKLSFQNYHDM

SEQ ID NO: 145834 - protein, 320 aa, Glycine max
  Coding DNA Sequence Number=SeqID_54149
MAHTKKTGQMTSEAAKKIIDKIMQSHELTFPPKPEVGPPASRVGTKESCVDPSGHDPDTGDLEKYGLYVDENPPRLVALGRLYKGSTTIHNIPLGNDQVKDKQGAEGPAKTTDRLDADVNPLYLMTLTIPQLFLKPLHVLCDATVFGVYNDNFSLYMKHEDLSEITHDGQCMSIFVIPLWIFALKGFVDSQQSKSKPAARWIVVKCNKKKGSTECKYYVMYWMSMLILGSFKNNWEMVIFYFKRPAVHVVVENEHTQPLLINSKAKEQDEDREEENDNAEETKKHVTSIVVAYKLFTPSVKVRNPSIWRKIEIKQFNNLK

SEQ ID NO: 145835 - protein, 162 aa, Glycine max
  Coding DNA Sequence Number=SeqID_54150
MNQTTHKWLDMGGKRWWQDNPHQFCLNSPPCFETSQRRQTIEQWIFIISIQQRHTFDGFSGSLKAKHNGLPKSSPTLSGTRFFPSFLRPTKVSKCSNEERLMLKPKDVPQKISARHEFHKHELDNVVAVTEAQPSLRQTPTQAEGETTRMPWEYPFRDSFLS

SEQ ID NO: 145836 - protein, 243 aa, Glycine max
  Coding DNA Sequence Number=SeqID_54151
MVDIMLYERPRPKSVNKKTMGLVFDKDWEDITEETVDIMLYERPSPKSVDKKTMGYVVVIAIPKEEYREGLEDCKSYLHSRILLAKGVPPPRVSDLQAKALASFGTLAYGPNWKRLLQFFFLLSLRFTCWDPLCIDDAMNSRAFGRYAWIFVDVDLDRKLRTSLSGMERICLLCGYRQGRKRFMSSKQKNKEIILQDNALAREGPSYTLNNQAANPEPWCYNGDFNRIVGAHEKNDGCYPFLA

SEQ ID NO: 145837 - protein, 87 aa, Glycine max
  Coding DNA Sequence Number=SeqID_54152
  Pfam annotation: Domain name=zf-CCHC; Domain location=1-18; Score =16.0; E_value=0.0058; Accession=PF00098.14; Description=Zinc knuckle
MKCFKCLGGEHFTSQCPTKKIMIMRGQDIYSSQDEATTSPFASSLSLDEVVVLSCWGFEKKVKDRVPKELKISVISKKKVLCNNKIS

SEQ ID NO: 145838 - protein, 37 aa, Glycine max
  Coding DNA Sequence Number=SeqID_54153
MTITNGNCASIFTTSSVAARKFQTENEGRQSLLWYSE

SEQ ID NO: 145839 - protein, 69 aa, Glycine max
  Coding DNA Sequence Number=SeqID_54154
MLILKKHRTPLPRGSSLCESMGEGCCTQPYPCICKEAVSGFEPMTNKSPRHNFTAAPGFALTMLILIII

SEQ ID NO: 145840 - protein, 198 aa, Glycine max
  Coding DNA Sequence Number=SeqID_54155
SGALSGWLAKPDGLNVKTNPLASHGGPVVNAVEECGPQRPKQMKDVVTSRRFILKALRQAGIICFDGGEGDTCLIHPGVAHDVEVCPVAEDLLQGIMDQGRFEVGGASKGEQHVCMQLADKSSSKPKPLVIQFTRDATTQKPRGFQPVSGKKPIPFPYKNDKAWVNLHGTRPVGAVQGHEGKGKGGHGRKRQGKPDSG

SEQ ID NO: 145841 - protein, 352 aa, Glycine max
  Coding DNA Sequence Number=SeqID_54156
  Homolog annotation: Hit_ID=A5B5V0; Match level="QueryCoverage=69%, HitCoverage=57%, E-value=4e-10, Identity=24%"; Hit description =Putative uncharacterized protein
  Subcellular localization annotation: CTP_CleavageSite=74; ConfidenceScore=5.34e-01
MAEPSKKRKGTSSRSQRHSGSQEAPIPSSIPSGSLFSSKEQRIRYTNLFSSRSIIDPKFIDMEFFSNENFECFQAFENSNLIPFMSLKLPVYSELVKAFYSNLEIHEGILMSEIYGIKMVIDQSLFYDLTKLPSEGVPFEGALIDDWKFDFSVHDARRLVCTNQADMTGRLLAGSLAFESRILHYLIVRILLPRSSNLAQVSEEDIIVIYRMHKALRLNAPLPYPHLVTLFLQPFNIPLDFEPYVPIKRSFLIGALVIASFGYIKEHDGSRVKKGARNVGEERHEGEDSSLLLKILERFDGLQTFVGERFDTLELQVDMRFNGMKSRMTKVEEDVSYIRSSFDLPPPPPPSS

SEQ ID NO: 145842 - protein, 87 aa, Glycine max
  Coding DNA Sequence Number=SeqID_54157
  Subcellular localization annotation: CTP_CleavageSite=19; ConfidenceScore=5.04e-01
MMTKVMTTSPKVNQRMSSRCSRRNQEQFKTQEEKLKNTSRFKKNDEFKNQDSSFKNQDQDSRFKTQESREDLIKISMKRIFQKLSST

SEQ ID NO: 145843 - protein, 53 aa, Glycine max
  Coding DNA Sequence Number=SeqID_54158
MAMQMASLCMVGVRIDLWTNSSSHGVVFYLSLFGNADSLEEAINIINENKYIG

SEQ ID NO: 145844 - protein, 103 aa, Glycine max
  Coding DNA Sequence Number=SeqID_54159
  Pfam annotation: Domain name=Extensin_1; Domain location=32-41; Score= 6.5; E_value=2.2; Accession=PF02095.6; Description=Extensin-like protein repeat
  Pfam annotation: Domain name=Extensin_1; Domain location=44-53; Score= 8.2; E_value=0.64; Accession=PF02095.6; Description=Extensin-like protein repeat
  Pfam module annotation: Pfam domain module=Extensin_1::Extensin_1; Domain location=32-41::44-53
MASLVSFLVLLLATLILMPQGLATYYKPIKKSPVYKPLVYKPKPPVYKPPYMKPPYGKYPPVAMNVLGSCMHFNPLYNAVANSSSSYLCLCECKSDYKRENGA

SEQ ID NO: 145845 - protein, 79 aa, Glycine max
  Coding DNA Sequence Number=SeqID_54160
MARHKIFFAHFPCNCCSMHHRLFILHTRGTYEYYLWGEALGPPDFQGPPGAHRTPRDVRRSSSRWTLPPAEPFPGWAGC

SEQ ID NO: 145846 - protein, 42 aa, Glycine max
  Coding DNA Sequence Number=SeqID_54161
DKDSVDDTICEKYDISKEKWAQFCQTRRDPSWEDVQKKAQAI

SEQ ID NO: 145847 - protein, 106 aa, Glycine max
  Coding DNA Sequence Number=SeqID_54162
MMAHQNPPYLAFCTPGQNETKNKIQGYERETNKNIHIFLNEHQGMKGMAFEKQHFHSACPTFNQYTMYIKYGPKYIMKHSQQNKLSNETKTPHTYSQNNFQSSRIP

SEQ ID NO: 145848 - protein, 412 aa, Glycine max
  Coding DNA Sequence Number=SeqID_54163
  Homolog annotation: Hit_ID=Q6WAY6; Match level="QueryCoverage=50%, HitCoverage=38%, E-value=3e-21, Identity=32%"; Hit description =Putative uncharacterized protein
  Pfam annotation: Domain name=G-patch; Domain location=246-290; Score =10.2; E_value=0.011; Accession=PF01585.14; Description=G-patch domain
ELDRGKQVENGVVGVPRKCLEAKARVLASQDEWAPFMDILALLIFGLVLFPNVDGLVDRTAINAFLAFYDRRKSPVVAILADLYGTFDRRCEKNNARIATAHAPRKKKANWDRLLASKEGASVNWFPRWKEGRAGILISCGEIPNVPLMGTRGCINYNPVLAIKQLGYPMRGAPSEEGLTPFIARGFNSTNAGVIHRVRKACHSVGVVPSTLHQKLKFVVEGHLVIISVSIASVDSLPRQPRLSDAAIMVARMMLGHSYEPRMGLGKNNNSRTGLVSTRGNRGKFGLGYKPTQADIWKNISERKNKGQGPRSGQQAKEAPPCHISRSFVSAGLRCEGQVAAICDEDSLRRSNLVQPCPPGFQLGNWRVEERLGLYTTSIISDDESRKGTNTGDLAVNFEQEASRTEDEEDED

SEQ ID NO: 145849 - protein, 47 aa, Glycine max
  Coding DNA Sequence Number=SeqID_54164
GRGRMAEDWPEAQAGEAPAEAPDDMEEARMDEEMTNLLDFLGGSGAT

SEQ ID NO: 145850 - protein, 110 aa, Glycine max
  Coding DNA Sequence Number=SeqID_54165
MDSFGGFFGFCVFLAFDFFCFGFVRGEQVIDAQDFGWEGLTFSPWVKVYGELGFWLKACRMARHDTCQGLVWFKDKRDAPYYFHDTNAKMMIWKLYAKLVMHAPMWTLKC

SEQ ID NO: 145851 - protein, 169 aa, Glycine max
  Coding DNA Sequence Number=SeqID_54166
GLYIVAIRGLHVLAFRGLHVLPFRGQHDLPFRGLHALALTGLHVLIFRGLHNLAFRGLDALAFRGVHILPLRGLHALAFGYTSSTSEDYMPIPSKDTFIGLHALGFGYTPSPSEDYTSSFSERYMPSPSEDYMPNLSGDYMSSISEDYMFSTLEDYMSLPYEDYTASPF

SEQ ID NO: 145852 - protein, 162 aa, Glycine max
  Coding DNA Sequence Number=SeqID_54167
MITFLVKRITRFTLKKELRRSDFVFDGGLLSFGTNVRGANTFLKQINVGGDSAHLSSFEKRTREPRPRSPAKGHETNKILLQGVVGVDGLYYFHNLKLQGNPSLLMSTSASVTNAEFPTSAATANNTSNIVSNSDVTSSSSANLWHARLGHPNEHVMKIVLK

SEQ ID NO: 145853 - protein, 102 aa, Glycine max
  Coding DNA Sequence Number=SeqID_54168
MGQDSWSVFRNHLLKELANFSEDYIKLFGGTERFEELRMSLLVDGLTKVTTDKWMNITDMRHVIASSNCHPQAKSWPNPYISRMQHYKSFVMFKRDYVDINR

SEQ ID NO: 145854 - protein, 226 aa, Glycine max
  Coding DNA Sequence Number=SeqID_54169
MGDIEEVQEQMKADMEALKDQMTSMIEAMLSMKRIIESNMAATATEADPTHPSAINQANQPIPDVLGQGGEVLGSTSGPHVGHNNNAYPYGLPPNYTPPTMHMPNENANHVVLVTFEGQQPQPIGGVREEPQEHAQGDFDPYPTFTTEGPTFNVMPRPNTAGAPQPRPLQSLHFSVEGSPPTMEGRKRLDLIKERLRAVERFGDYPFVDMEKLCLVLDVVIPPKFK

SEQ ID NO: 145855 - protein, 83 aa, Glycine max
  Coding DNA Sequence Number=SeqID_54170
MLLSSNIIPICVRVVMLVHMIRTRLFAATRVKSCPNMHSSCTIASLSGCARTIGHLPISGGGPGTDKSKLLALHPRAQASIKH

SEQ ID NO: 145856 - protein, 86 aa, Glycine max
  Coding DNA Sequence Number=SeqID_54171
MQHKYLHYLRSLRLVLQLLLSAQRRVVLIPQGMIQTRVTQTNAGCTSKKILPTWELWDQQNLQIVMQLHVELVCLGSSSSMESFAS

SEQ ID NO: 145857 - protein, 117 aa, Glycine max
  Coding DNA Sequence Number=SeqID_54172
MGLRKRGRDWRIALSNQYAWLQTCGWRMHERKRNSWGSKKRVENGELQQAITAHDSKLMGGGRMNENAIHGAPKKGREWRIALRNHYAWLQTHRWRMHERKPISWGSEKGVEIGELH

SEQ ID NO: 145858 - protein, 113 aa, Glycine max
  Coding DNA Sequence Number=SeqID_54173
  Subcellular localization annotation: CTP_CleavageSite=66; ConfidenceScore=5.08e-01
MHKALRSNAPLPYPHLITLFLQHFNVSLDSDPFVKVKRSFSIGANVVSSFGYRKERDGSWVKKDAPAQAVEDRSPSPPPQRDDSSSLMHNILDRLDGLHTFVVCGNGYSHHSA

SEQ ID NO: 145859 - protein, 39 aa, Glycine max
  Coding DNA Sequence Number=SeqID_54174
MTSPGKKERVVYYLIWASHHLRQYMLSHTTLFDIQDGPG

SEQ ID NO: 145860 - protein, 140 aa, Glycine max
  Coding DNA Sequence Number=SeqID_54175
  Subcellular localization annotation: CTP_CleavageSite=70; ConfidenceScore=5.13e-01
MTLPLSNILPSDHNVDLPLRKYQLGSRPQDTQWTRRSPTGPGGFQLGLRASVSPTGCPSPPARSYHRDICKDHARKTPSGPGEVQQALGFLALIMCLCQFYEASVTPNKVIRPPINRAFIKKYCALRQAQGETPQQPGDG

SEQ ID NO: 145861 - protein, 182 aa, Glycine max
  Coding DNA Sequence Number=SeqID_54176
  Gene Ontology: Mol. function=phosphoinositide phospholipase C activity; Biological process=intracellular signaling cascade
  Homolog annotation: Hit_ID=Q2HTA0; Match level="QueryCoverage=79%, HitCoverage=22%, E-value=2e-18, Identity=38%"; Hit description=IMP dehydrogenase/GMP reductase, related
  Pfam annotation: Domain name=DUF1723; Domain location=94-143; Score =58.6; E_value=2.2e-14; Accession=PF08330.1; Description=Protein of unknown function (DUF1723)
MEVPAAVEDIPADTSAEAAEDQPQGFPGGPSGPSVLTAYADHVACSVWTGEERLELKLSSHGRKVHSLGRPVPAIEGLIAGTGLSPLIACSIDTGDRGLLSAFVERWHRETSSFHLPVGELTITLDDISSLLHLPVIGDLHAFEPLHLDDAVQMLVDLLMVSPESARAETVQCRRLYVRLQW

SEQ ID NO: 145862 - protein, 325 aa, Glycine max
  Coding DNA Sequence Number=SeqID_54177
  Homolog annotation: Hit_ID=Q2HW90; Match level="QueryCoverage=84%, HitCoverage=55%, E-value=2e-33, Identity=32%"; Hit description =Putative uncharacterized protein
MGSSQTPSLKKRFYQVKVKSLGIASLEELGQLMGQLQRQAFRKAYGKIWDLTMAEVSMEAIASLAPYYDQPLRCFTFGDFQLTPTVEEFEEILECPLGGRKPYLFSGFYPPLARISKIVKISTQELDREKQEMLEAKARVLASQGEWAPFMDILALLIFGVVLFPNVDGLVDWASIDAFLAFYNRKESPVVAILADLYDTFDRRCEKNNARIICCTLALYVWLVLHFFRQEMRHVCPLEGHRSCTEKREANWDWLLANKEGASVNWFPRWKEGRIGILISCGKFPNVPLMGTRGCINYNPVLAIRQLGYPMRGAPSEEGLIPFVT

SEQ ID NO: 145863 - protein, 108 aa, Glycine max
  Coding DNA Sequence Number=SeqID_54178
MMVARVMLGHDYEPGMGLGKNNGGRASLPCPPDFQLGNWRVEERPEVYTTSIISDDESREGTNTGDPAIDFEQEASRTEDEEDEDVGLPLELERIIARQNREMRPHPE

SEQ ID NO: 145864 - protein, 74 aa, Glycine max
  Coding DNA Sequence Number=SeqID_54179
MESALSDHYAWLQTRRWRTHETKTQFMGLRKKIENEELHLSNHYAWLQTRRWRTHERKRNSWGSEKRLRMENCT

SEQ ID NO: 145865 - protein, 25 aa, Glycine max
  Coding DNA Sequence Number=SeqID_54180
KSENITQKPILRASNTSELPSKREN

SEQ ID NO: 145866 - protein, 355 aa, Glycine max
  Coding DNA Sequence Number=SeqID_54181
HLLRMNTHALAKLPMAKRVKRALLAKLPTVSRIFEELVPLSASFKELSANPCGTCKLSGPCLAKRPMASRKRKSIGTRPTSQYDTRRFSSLDAWTRYTDNVLGRKILPERKVELYHTELDDFKAELERRNFHKCLTNLADGSIDLALVKEFYANLYRSEDHPLKQSRVRGHLVKIDADNLNAVQTLPVYSRYCRLPTDFREIEAALCILGRWFILNSEGQSGKILRKDMTTLAYMWSFLPYSNLAPTSHTYDLTVDRARLIFDLSNTSKLGFLALITALYRARGVVSDSLTFECLSSVINLAYIRKNCWNHEDLTVSIRGARRARARPAELPSTSTAPTPTSTSATPSVPAQTNS

SEQ ID NO: 145867 - protein, 227 aa, Glycine max
  Coding DNA Sequence Number=SeqID_54182
  Gene Ontology: Mol. function=1-acylglycerol-3-phosphate O -acyltransferase activity; Cellular component=integral to membrane; Biological process=phospholipid biosynthetic process
  Homolog annotation: Hit_ID=A9PGT0; Match level="QueryCoverage=83%, HitCoverage=47%, E-value=7e-79, Identity=68%"; Hit description =Putative uncharacterized protein
GRFVQRPTSLAALLTFLWLPIGIILSILWVYLNIPLPERIAWYNYKLLGIRVIVKGTPPPPPKKVVALSREREKDAANIKRLLEEGDLVICPEGTTRREPFLLRFSVLFAELTDRIVPVAINTKQSVFYETTVCGHKLLEPYFVFMYPMTTYEITFLNQLPKELTCSGGKSAIEVANYIQRVLAGTLGFESEVVCIAVFEFGGVVPWPYVILHRTYAFMTFIMSRKN

SEQ ID NO: 145868 - protein, 251 aa, Glycine max
  Coding DNA Sequence Number=SeqID_54183
  Gene Ontology: Mol. function=helicase activity; Biological process =viral genome replication
  Homolog annotation: Hit_ID=Q2A9E0; Match level="QueryCoverage=93%, HitCoverage=16%, E-value=1e-52, Identity=45%"; Hit description =Putative uncharacterized protein
MWYDERISKDKNCQNPSQYSGIQSHIVSGLSHMLNQHNSHAKSFRMARDRLAGDQANNIKLQLIAARGKDGRVYNMPNVPEIVALIVGDFHLGSKRDIIVETQNGELQRIHELHASYLPLQYPILFPYGEDGYRADILHRSTSSSKKRKRNRLTMREWLSYRLQSRSNEAQTLFHSRKLFQQFIVEGYTMVKSERLSYIRNNQKKLRVDKYSSLQSSLDTGTAKSLTKGKRVILPSTFVGSPRYMNQLYFD

SEQ ID NO: 145869 - protein, 202 aa, Glycine max
  Coding DNA Sequence Number=SeqID_54184
  Gene Ontology: Cellular component=integral to membrane
  Homolog annotation: Hit_ID=Q1H4U5; Match level="QueryCoverage=82%, HitCoverage=45%, E-value=7e-48, Identity=57%"; Hit description =Permease YjgP/YjgQ
  Subcellular localization annotation: CTP_CleavageSite=34; ConfidenceScore=5.12e-01
MANASTSSKASTSWETRSKHICPIQANGKTGIITANSGSRFKASNGDNFLRMEHGRRYEITPNTREVLTTEFERYDIRVEIKETAPSSDTAQTRSTRSLIAGATNADHAELHWRLAIPISTIVMVLLAIPLSFVDPRAGRSLNIMFAILIFIIYNNMLSIFQAWVTQGKISVMVGLWPVHFSFILLGWYLYYRRKTSQTTDP

SEQ ID NO: 145870 - protein, 193 aa, Glycine max
  Coding DNA Sequence Number=SeqID_54185
GLHILAFRGLHVLAFRGLHAVTIKGLHILAFRGLHVLVFRGLHVLTIRGLHALTFRGIHVVAFKGRHILNFRGLHVMSSPSEGCTPSPSEECTPSPLKDCSAARPRLQRVACPRLQRATRPQLQRTARYVLAFKGLHALTFKGMHALTLRGMLVLVFRGLHALVFRALDALALRGLRVLTFSGLHIHPLREFK

SEQ ID NO: 145871 - protein, 148 aa, Glycine max
  Coding DNA Sequence Number=SeqID_54186
MKANMEAMKDQMTSMMEAMLSMRRMEDNVAAVAATSATTEVDLTHPSDINQTSHPVPDMVGQGGEVLGSTGGPHVVQNKNSCPPYGLPPNYTPPNAMHVPNENATHSVLVPLEGQQPQLGHTPFAQPVGEACEEPRDHALGEFEPYPT

SEQ ID NO: 145872 - protein, 100 aa, Glycine max
  Coding DNA Sequence Number=SeqID_54187
MGDQEETHEQMKADMSALKEQMASMMEAMLGMRQLMENNVATAAAVSSAAEADPTLLATAHHPLPNAVGRERSTLGHISNPHLGYNRVAYPHGYHLITRH

SEQ ID NO: 145873 - protein, 142 aa, Glycine max
  Coding DNA Sequence Number=SeqID_54188
MIESDGTHRQIMVILRLLSSRGGEPDDMRRQIMVIPHLFAIWRRSSLMARKDKLWPFYAFCHPEAASPMTRGDKLWSFRTFCQLEASEPVDTQRQIMVFFTLVVRKHSSPAMRGILLCWAEMIGCNGKGKCRGCPTLSFSKH

SEQ ID NO: 145874 - protein, 49 aa, Glycine max
  Coding DNA Sequence Number=SeqID_54189
EFVSDCEILEEVFGLWKAKSSVGSSLGNWSDSKVLDSTGLSYCAIMRNR

SEQ ID NO: 145875 - protein, 398 aa, Glycine max
  Coding DNA Sequence Number=SeqID_54190
  Gene Ontology: Mol. function=two-component response regulator activity; Cellular component=intracellular; Biological process=two -component signal transduction system (phosphorelay)
  Homolog annotation: Hit_ID=P0AA18; Match level="QueryCoverage=56%, HitCoverage=94%, E-value=1e-121, Identity=99%"; Hit description =Transcriptional regulatory protein ompR
  Pfam annotation: Domain name=Response_reg; Domain location=5-117; Score=146.0; E_value=1e-40; Accession=PF00072.15; Description =Response regulator receiver domain
  Pfam annotation: Domain name=Trans_reg_C; Domain location=156-223; Score=44.4; E_value=3.9e-10; Accession=PF00486.19; Description =Transcriptional regulatory protein, C t
  Pfam module annotation: Pfam domain module=Response_reg::Trans_reg_C; Domain location=5-117::156-223
MQENHKILVVDDDMRLRALLERYLTEQGFQVRSVANAEQMDRLLTRESFHLMVLDLMLPGEDGLSICRRLRSQSNPMPIIMVTAKGEEVDRIVGLEIGADDYIPKPFNPRELLARIRAVLRRQANELPGAPSQEEAVIAFGKFKLNLGTREMFREDEPMPLTSGEFAVLKALVSHPREPLSRDKLMNLARGREYSAMERSIDVQISRLRRMVEEDPAHPRYIQTLVCPNPVVDRHPAVRQPGDDLSGGAELRHPAQPAAVQQGIGLRSAYADDRSAAAGGRHAAGSAAGVPPRDLPRTGHLSLHQLGGGGERPALGAALPVPQPADGAAARRADRCAGGGRLLSAVPLYAGDHVAGDRRRLAVYPHSKPPAGGAGTCGAACGQGIIPPPLREYGASEV

SEQ ID NO: 145876 - protein, 85 aa, Glycine max
  Coding DNA Sequence Number=SeqID_54191
MESPTVATCPFAGERGEAHGCAFQRRKDARSRHQRLFVENVEKTEGNRSKMKILSSGVVFTFEEGRQKWGFCSYVPFIEEEIRPT

SEQ ID NO: 145877 - protein, 53 aa, Glycine max
  Coding DNA Sequence Number=SeqID_54192
  Homolog annotation: Hit_ID=A5B0P7; Match level="QueryCoverage=73%, HitCoverage=12%, E-value=7e-09, Identity=64%"; Hit description =Putative uncharacterized protein
MSPYWVVFGKACHLLVEIEHKAYWAVKTCNFSIDQLRSKVNPQIRASRSMDTD

SEQ ID NO: 145878 - protein, 96 aa, Glycine max
  Coding DNA Sequence Number=SeqID_54193
  Homolog annotation: Hit_ID=A5B3F8; Match level="QueryCoverage=77%, HitCoverage=12%, E-value=3e-09, Identity=41%"; Hit description =Putative uncharacterized protein
MADNNRTLKELATPNIVYQLWCEDPHKHLKEFHVMRSTMRPHDIHEDYVKLKAFPFSMDGVAKDWLYLQLDTINTLTDMKRRFLEKFFPASKTTSI

SEQ ID NO: 145879 - protein, 153 aa, Glycine max
  Coding DNA Sequence Number=SeqID_54194
  Pfam annotation: Domain name=Transposase_23; Domain location=37-107; Score=-10.6; E_value=0.017; Accession=PF03017.5; Description =TNP1ENSPM transposase
MQSQGLAPPPDPLVGPFGPRVSTKGSCVDPSGNDPETGDSDRCGLYIEADLARLVALRRVYEGSTIIHNTHLLPGQVKVSAEEVTDADAPVPVPTDEVSIVGQALHTFLAWSTHLVKFLSQLVVVSPAKPPPRPDPEIDDSLYLMTLTIPELF

SEQ ID NO: 145880 - protein, 64 aa, Glycine max
  Coding DNA Sequence Number=SeqID_54195
MGPKLRRSFVVKRAFSGGALGQDHLELPSGVGTKHEKQKPIKVLRNGCKWGWSHDRLIVAPSLR

SEQ ID NO: 145881 - protein, 124 aa, Glycine max
  Coding DNA Sequence Number=SeqID_54196
YEGRFFENPNDEGLTIDFDQDVSQMMNEEEEEDVLSPELERLIAQEEREMKPHQEETDLVNLGTEEEKREDMPGLDSDIVQHKLSLNPGCGAIPRVGGQHCPGPKKGRQGANVCRLSGLKPSQS

SEQ ID NO: 145882 - protein, 219 aa, Glycine max
  Coding DNA Sequence Number=SeqID_54197
  Gene Ontology: Mol. function=transferase activity; Biological process= metabolic process
  Homolog annotation: Hit_ID=Q3SHR3; Match level="QueryCoverage=64%, HitCoverage=40%, E-value=3e-20, Identity=40%"; Hit description =Heptosyltransferase family protein
  Pfam annotation: Domain name=Glyco_transf_9; Domain location=2-214; Score=-75.7; E_value=0.022; Accession=PF01075.8; Description =Glycosyltransferase family 9 (heptosyltransferase)
MQYDLIIDLQTNDKSRSLLTMLRLMGKAPALLLGNHPQFPYTVRQPQHLPQAHSFQIMQQTLLSAGIPVSTNGPKLHIASSSVESAELLLAQYGLAPKSFAVFLCGSHAGGLTKRWGVAHYSELAEKCIQQGERVVLLGGRDEAEECHCAAAGCAVQELLCQAMQPSFLHAPVISIAIVVTFARFRGVGCLKCFGGGGLTSTIPEIVFAGGYYSRWAMS

SEQ ID NO: 145883 - protein, 95 aa, Glycine max
  Coding DNA Sequence Number=SeqID_54198
RGGARVDEGRHGGHERANGHNDGGHDEHEEDNEANGLQLPLPALLLSTGSPYYAQIQNKHAFPPYGLPSNYTPPNVAYTPGEDVNNSTPILIESQ

SEQ ID NO: 145884 - protein, 37 aa, Glycine max
  Coding DNA Sequence Number=SeqID_54199
MELLDEGLVRKSLNPCALLVPKIGVEEKTQSFNNLGI

SEQ ID NO: 145885 - protein, 67 aa, Glycine max
  Coding DNA Sequence Number=SeqID_54200
  Homolog annotation: Hit_ID=A0ST23; Match level="QueryCoverage=40%, HitCoverage=55%, E-value=2e-08, Identity=100%"; Hit description =Putative reverse transcriptase
MPMKRVFRPYPTLTYIKLIDTVDLEGGPVGKPVVPAALMNRPTRGERRFAYWALAECILAYYVGTDE

SEQ ID NO: 145886 - protein, 76 aa, Glycine max
  Coding DNA Sequence Number=SeqID_54201
MAFKDLEQLTQKIKDQLEESIIEKGVALPSEVGPSTARVNTKENCVDPSGHDPYMVKVDVEEVRDVDARIHVPTQE

SEQ ID NO: 145887 - protein, 31 aa, Glycine max
  Coding DNA Sequence Number=SeqID_54202
MDFEGDNNEASEERVVLANDGLDDSLVEGGD

SEQ ID NO: 145888 - protein, 128 aa, Glycine max
  Coding DNA Sequence Number=SeqID_54203
  Subcellular localization annotation: CTP_CleavageSite=71; ConfidenceScore=5.26e-01
MTYMQFVMIIMKVYGRTFLRNCVVSKIMGTSPRSPPHLDGHSEATSKKTRQSTRLRRLTLRTLDQPRPTVNADPTTGRGSSPQKQKFHNYLGVVARKKIPIVHSNWKDVPESLKDLVWDYILEIRKKA

SEQ ID NO: 145889 - protein, 63 aa, Glycine max
  Coding DNA Sequence Number=SeqID_54204
MTFFPLRSQPPGDSSVYRIICIGYVYDNHFVQLCTIELIFFFARTKDLFKRSLSFTAVSIVMV

SEQ ID NO: 145890 - protein, 77 aa, Glycine max
  Coding DNA Sequence Number=SeqID_54205
MYGITSAVFFNTHRCACETSCRGGGDNVESSCTLTPQCPTMATFGNLDGLSTLNVLGAKLNTLFSNIPFDNRSFGSG

SEQ ID NO: 145891 - protein, 83 aa, Glycine max
  Coding DNA Sequence Number=SeqID_54206
MDFLTRHGESIKGTSTWVLYWRTREGTSLGGSVQVEGTSTLGGQREQGEGTSLVDLLACKGFYKVERNLKNCRLLARFVAEPV

SEQ ID NO: 145892 - protein, 114 aa, Glycine max
  Coding DNA Sequence Number=SeqID_54207
MTGKTLIDDLQRLQTLAHHATLGIGIIGRISPSAPLELFSTSALSLSPLSSASISAWERMLSPIKSPQNEGGKQHVTDYLRRLTFYQRWRQHLFDLFNQGLFPLLGCQRAGALT

SEQ ID NO: 145893 - protein, 99 aa, Glycine max
  Coding DNA Sequence Number=SeqID_54208
ELVPLDLEIEATFKRNNVERKRKLLHDRTVASILEEAHFSESSSSNSPTSRESQIAEFEAEVMAKEQPRRVTLVFLPLGILLVCVGAKSTGKCTGSSSK

SEQ ID NO: 145894 - protein, 153 aa, Glycine max
  Coding DNA Sequence Number=SeqID_54209
  Homolog annotation: Hit_ID=A3A7P3; Match level="QueryCoverage=96%, HitCoverage=46%, E-value=2e-08, Identity=27%"; Hit description =Putative uncharacterized protein
MSEVWETWSFKEGLPGVQRKEHDFSWSKWVNDSEKQQDDKQEMTLLGGLIREQQAMCAKIVVVSSIIDKLPSSWKDFKHTLKHMKEELTLVQLGSHFMIEESLRAQEIDKVNNKTVAGSSSVTMVQESGTVKQNYNAKGNQRKFHGTKNKGPN

SEQ ID NO: 145895 - protein, 102 aa, Glycine max
  Coding DNA Sequence Number=SeqID_54210
  Subcellular localization annotation: CTP_CleavageSite=25; ConfidenceScore=5.22e-01
MVPSGVANCHNVPFAGERRRGSRVRFSKGGKMRGVATNVYFGKRQENRRKPVKMKILSSGVVFYALRKVDKSGAFAPTYPPSKRKSDLRSSSLCVNQVILFT

SEQ ID NO: 145896 - protein, 180 aa, Glycine max
  Coding DNA Sequence Number=SeqID_54211
  Gene Ontology: Mol. function=metallopeptidase activity; Cellular component=extracellular region; Biological process=cell wall organization and biogenesis
  Homolog annotation: Hit_ID=A8AGP4; Match level="QueryCoverage=95%, HitCoverage=89%, E-value=1e-54, Identity=61%"; Hit description =Putative uncharacterized protein
  Pfam annotation: Domain name=Peptidase_M15; Domain location=1-170; Score=208.6; E_value=1.5e-59; Accession=PF01427.8; Description=D-ala- D-ala dipeptidase
  Pfam annotation: Domain name=VanY; Domain location=22-154; Score=3.5; E_value=1.1e-05; Accession=PF02557.8; Description=D-alanyl-D-alanine carboxypeptidase
  Pfam module annotation: Pfam domain module=Peptidase_M15::VanY; Domain location=1-170::22-154
MFDLKYATADNIAGYAIYRDAQALLHPDAAAALRRSSDIARLAGFRLLVLDAYRPQQAQWHLWDACPDADYVVPPARGSNHSRGVAIDVTLVDEAGNILEMGTGFDDMSAESHPFHPNVPQQAQRHRLLLNAIMLGGGFVGMPTEWWHFELPDAQNYPLLSDRFACVSRTDRAPVSDIAR

SEQ ID NO: 145897 - protein, 134 aa, Glycine max
  Coding DNA Sequence Number=SeqID_54212
MEAMKEQMAAMMEAMMSTKKIMEANAVAIAATSVVAKVNPTSPSGINQMNHPTSDMVGRDLGSTDGPQDVQIQNEHTFPPYGLPLNYTPPNVAYTPSENVNNSTPIPIESQQPRMIMHMSLKPWGRHMKFPTTI

SEQ ID NO: 145898 - protein, 41 aa, Glycine max
  Coding DNA Sequence Number=SeqID_54213
MVHDIIVKVKLERKMQGSCMSEHENKRYAVCRTKSMLNAYA

SEQ ID NO: 145899 - protein, 75 aa, Glycine max
  Coding DNA Sequence Number=SeqID_54214
  Subcellular localization annotation: CTP_CleavageSite=34; ConfidenceScore=5.32e-01
MASFSHMQSQLQLQMQSQGLVVPPDPLVGPSGPRVSTKGSCVDPSGNDPETGDSNRCGLYIEVGSCPPSCHGESL

SEQ ID NO: 145900 - protein, 436 aa, Glycine max
  Coding DNA Sequence Number=SeqID_54215
  Gene Ontology: Mol. function=siderophore-iron transmembrane transporter activity; Cellular component=cell outer membrane; Biological process=siderophore transport
  Homolog annotation: Hit_ID=A5FHK7; Match level="QueryCoverage=99%, HitCoverage=56%, E-value=4e-93, Identity=42%"; Hit description=TonB -dependent siderophore receptor precursor
VDSRGSHRTNNGGSIEASTLESVEILKGSSALLYGGVSGGAVVNLVTKKPKFYYGGEASMRVGSYDFYKPTVDVYGPISNKVAFRVIGTYEKAGSFRDQVKSKRTYVNPSVLYKISDKTELNFTFDYLKSDFTPDFGMGTVDGKLNNEVGRNTFMNVPFAFNRTNTSNGQINLNHKFNESWNLNAIASYQTYDRDYYGSDRIQANKNGIASRSLTRSKSNEFTANQQLNLTGTVKTGSIKHKILVGADADQSHANAYAYKIDASKNVGGAYDSIYVFNPSQTAQHLASGKGLRTDMPQADLLTKTTTDIYRYGVFFQDLIEVTEKFKVLAGIRYSYQRTPNSEKYTYATNLSEEIINLDGQKNPIGAKVDKAWSPKFGLIYQPIPSSSVYVTYANNFTSNSGYDVNYQPLAPSIIDQYEAGVKNDFFNGRLSANVA

SEQ ID NO: 145901 - protein, 71 aa, Glycine max
  Coding DNA Sequence Number=SeqID_54216
MAHGCVFQERKMRRVATNVYLRKKSEKSERCGVRILIVKGSGVVFTHGEGCFPRSYVSSIAMRKLDLRSSF

SEQ ID NO: 145902 - protein, 62 aa, Glycine max
  Coding DNA Sequence Number=SeqID_54217
  Subcellular localization annotation: CTP_CleavageSite=11; ConfidenceScore=5.16e-01
PMTVSTSSASVCRARVSLLFRALLQIGSGQRSHGPKIGLRPRPGRRPQWLPAMQMRPAWTRR

SEQ ID NO: 145903 - protein, 210 aa, Glycine max
  Coding DNA Sequence Number=SeqID_54218
  Homolog annotation: Hit_ID=A5BSR3; Match level="QueryCoverage=39%, HitCoverage=25%, E-value=2e-09, Identity=46%"; Hit description =Putative uncharacterized protein
DVRKKAQAIQKQNIASHVLSRGGYEYLEQKLLAEKTKKKLEEAAQSGSIDGVIDPPSPVRRHVKWTMACTKKIGEMTTEAAKEIAEKIDYSFEEQATQGSFVPHGRQDVLTAAIGRPEHPGRVRAAGAGVTIKQYFGSAPRMSHSSSSLPPEELQQLTQQIRDQLEESIKEKVTRQLMASFSQMQSQFQSQMQSQGLALPPKHLVGPSGP

SEQ ID NO: 145904 - protein, 27 aa, Glycine max
  Coding DNA Sequence Number=SeqID_54219
MILKGELKASLRSKRSLSQQLSETEVL

SEQ ID NO: 145905 - protein, 15 aa, Glycine max
  Coding DNA Sequence Number=SeqID_54220
GKRCEISPDAQNGLG

SEQ ID NO: 145906 - protein, 122 aa, Glycine max
  Coding DNA Sequence Number=SeqID_54221
  Subcellular localization annotation: CTP_CleavageSite=35; ConfidenceScore=5.40e-01
FPENTSGSTSSGMGLSNFRKTFFRKLLRPLPEEVFAEVDSGNTSSRLSARLALSSNPLTRTKHEGGAKCNVADGLRQQSKKLLDASAGGKIKMKIPDEAMDLIESMAASDIAILRDRAHIPT

SEQ ID NO: 145907 - protein, 89 aa, Glycine max
  Coding DNA Sequence Number=SeqID_54222
  Subcellular localization annotation: CTP_CleavageSite=31; ConfidenceScore=5.43e-01
MLSTPSPRSARHLSLPTLSAPSSLSGFSLTRAKYENGTKRAFEDRKPFLRLKLEKSRERLEERLIQSVKSRIEAQNRARKPKPQLSKGS

SEQ ID NO: 145908 - protein, 230 aa, Glycine max
  Coding DNA Sequence Number=SeqID_54223
KPARAFITRCIVGTKQAVVQAIGSIDRNTKLQVMSYVEEHMSPATVFPKKKHHMKSTTWGTSQDKISMQGHWRNHPGNQFNIDQGGPSKRPQQQGPSLYDRTTKLEETLTQFIFGANTEKNPKEECNAIMTRIKLVTMNESENGIGAEKQQLVSNPSLDTMVESLSESEEELEVEDEKKETTIKKSKSEISREKKRETTPAEGKELPYPLVPSRKDKERHLAIFLASSKS

SEQ ID NO: 145909 - protein, 128 aa, Glycine max
  Coding DNA Sequence Number=SeqID_54224
MATYQTYANSEYRRVQLGRQSTGCLVTGAGGIRSANADMSSVKGGEKPPRRKRKVSYATFIGVGAMWGRRRLAQPTVGYVDEVSDTLLPGKATKLQLHTTVPQTDTGARDEYSKALERTLEKELGKLI

SEQ ID NO: 145910 - protein, 51 aa, Glycine max
  Coding DNA Sequence Number=SeqID_54225
MAVDVGCINESANARGEAVCVLGALPLPRSLNFAALGRSACGERYQLTQRR

SEQ ID NO: 145911 - protein, 67 aa, Glycine max
  Coding DNA Sequence Number=SeqID_54226
  Subcellular localization annotation: CTP_CleavageSite=19; ConfidenceScore=5.03e-01
MKGNHDLKWSSPFDCQPKTCASVTCSPHAKQKQKRKRPKTLKAKFPTKKTNHSQEKVLLIHDHACNL

SEQ ID NO: 145912 - protein, 235 aa, Glycine max
  Coding DNA Sequence Number=SeqID_54227
  Gene Ontology: Mol. function=motor activity; Cellular component=cell projection
  Homolog annotation: Hit_ID=UPI00016621D1; Match level="QueryCoverage =93%, HitCoverage=40%, E-value=6e-21, Identity=33%"; Hit description =UPI00016621D1 related cluster
VDSRGSHQRAAHLAFRGLQALAFRGLHVLAFRGLHALAFRGLHVLTFRGLHVLAFRGLHSLTFKGLHVLTFRQLHILAFRGVHILACRGLHAFTFKGLHTLAFRGLHALAFIGLHALIIKGLHALTFKRLHILTIRGLHVLAFEELHALVFRGLHTLTFRGLHVLTFRGLHVLAIRGLHFLAFKRLHVLVFRGLHVLAFRGLHTLTFRGLEVLTFRGLHALAFRGLHVLAFRILH

SEQ ID NO: 145913 - protein, 45 aa, Glycine max
  Coding DNA Sequence Number=SeqID_54228
MYDMPFRGLKTLSEELAKRTYCAKRVHPLRINIHPLAELPMAKQG

SEQ ID NO: 145914 - protein, 92 aa, Glycine max
  Coding DNA Sequence Number=SeqID_54229
MHMTQMQFMNTRAREIVSFVEAKLHDESTMIQSSKDQRATQVNQEQVKSSRIKKNSRLKKKVYNQDSRFKISRIKIKIQDSRFKNEEKTQSR

SEQ ID NO: 145915 - protein, 99 aa, Glycine max
  Coding DNA Sequence Number=SeqID_54230
MATPPRALFSLSFLIKLYPFTGGAVEFGLSHVSWMSIRILLEPRVLCRRTCSAVCFTKAVGNRVFLAAHWTTWFFCCAVIYTMFFSASPAACIVVTVFF

SEQ ID NO: 145916 - protein, 121 aa, Glycine max
  Coding DNA Sequence Number=SeqID_54231
KLGRIDGDPVLRETKIWATWEYVSSVGGGQQGMVGLCALCGCGKTCCAPSPDRHLVPHVMVVPGDMPLGSGDLGDVRRAPDSQQIKGTKTTKQGGLCGGWLAEAKMVSGNRLPRGVIDYQA

SEQ ID NO: 145917 - protein, 18 aa, Glycine max
  Coding DNA Sequence Number=SeqID_54232
VITHPGIHSNSSKKEWIP

SEQ ID NO: 145918 - protein, 63 aa, Glycine max
  Coding DNA Sequence Number=SeqID_54233
MSLAKDLGIHVCLSPYTGSVQNLGANFNTGARQPYLGLWDGGSTLASFSENNERSGKSQVVNM

SEQ ID NO: 145919 - protein, 219 aa, Glycine max
  Coding DNA Sequence Number=SeqID_54234
MTSIAQPNTSRLGFLALITALCRERGVVSNSLTFERLSPVINLAYIRKNCWNPEDLTVSIRGARRARARPAELPSTSTAPTPASTSTAPSSLQVVAPPGSIPSIEQFKEMVAWPGTQPYLHREDEGPTSQVPQHVEDESSKATIPEPFDLGEEAGETQVRHVVAATPERSLEATSEPPAPVVDLPSPQHTTVPSTPILEVPKEPTTPVLAMDTSPPTTP

SEQ ID NO: 145920 - protein, 73 aa, Glycine max
  Coding DNA Sequence Number=SeqID_54235
TISDNASPKEENSMRIHCYQASQRPSMTTDKPPLPMAHIDPGIGPNISTCVQRCRCHVCIGKKIFLTTKVIER

SEQ ID NO: 145921 - protein, 221 aa, Glycine max
  Coding DNA Sequence Number=SeqID_54236
  Homolog annotation: Hit_ID=A3J3Y6; Match level="QueryCoverage=36%, HitCoverage=64%, E-value=1e-08, Identity=33%"; Hit description =Putative uncharacterized protein
  Pfam annotation: Domain name=DUF456; Domain location=1-85; Score= -62.4; E_value=0.064; Accession=PF04306.4; Description=Protein of unknown function (DUF456)
MLYIWFFGILTAASAVLNYVIPARTNKKYGGTKWGSIGSVVGTIAGVFIGELLHDSKDMDKALKSTKGAFIGFIYGTGFSFVGSKPSAATNTKEKTMNKEGDIIYFNEGENRFLKEYQMNVTFTNISEDSRCPEGVNCIWAGVAVANVLVMGTTTRPVTLTLATMDNPGRNYVQSAEFNGYTISLKDVTPYPTAQEGTKGLPGKYKIGITIKKTGEKTTTK

SEQ ID NO: 145922 - protein, 174 aa, Glycine max
  Coding DNA Sequence Number=SeqID_54237
  Homolog annotation: Hit_ID=A6H5B3; Match level="QueryCoverage=38%, HitCoverage=84%, E-value=9e-28, Identity=88%"; Hit description =Putative ribosomal protein S3
RGKESKSDSRSSGERNGSSLNRENGVVGELYKCRAARRSSRECCTLDGESPVAESITSLRSDPSSMGHVESRVNQQGPPCKAKYSWVTDSEVVPETTGAVAKASLHRAIVTAYGPEPGGEMPLEPRASWFSPKCVEAQQLTRHLGGQGRPVRRWGISFIVERENSPGSPAKAPK

SEQ ID NO: 145923 - protein, 88 aa, Glycine max
  Coding DNA Sequence Number=SeqID_54238
MSTSLWWGHHKFVCRILGSSIFVRAGSNYFLVYCAMHNVNNFNIKEMKRCPLRNKEDRLTGISVPHLRSASQANALPVIGVNLVGGIL

SEQ ID NO: 145924 - protein, 164 aa, Glycine max
  Coding DNA Sequence Number=SeqID_54239
MVPTRHPLDPDKSNRALGFPTLITGLCQSFGVPVAPTKVIRPPITRAFIEKFGTQRQAQGGCSTGCGHATTTSSGWPGWAANHRAHVQTHDCLYQMSLSMQSQGFASFSCPTPDQFRAEVAWPGDWPEAQAGEAPPEVPDDGEEAHEDEEMADLLDFLGGSGAT

SEQ ID NO: 145925 - protein, 167 aa, Glycine max
  Coding DNA Sequence Number=SeqID_54240
LKSWDEVVEKFLKKYFPESKTAEGKAVISSFHQFLDESLSEALERFRGKIKLKTPEEAMELIENMTASDHAILRDRAHIPTKRSLLELSSQDALLVQNKLEVVLYVVEHMILAAAFPEKIQHMKPQQQGPSLYDRMKKLEETFAQFMQVSMSNQKSTELAIKNLEVQ

SEQ ID NO: 145926 - protein, 85 aa, Glycine max
  Coding DNA Sequence Number=SeqID_54241
PLIELVRNHVPSWEDAQEMGFQTLPYFNFPNTTNMSFDDNKDDDKKPKRMSSRLSQEHFKNQEKFDFKIQESSFKIQVSRIKNQE

SEQ ID NO: 145927 - protein, 167 aa, Glycine max
  Coding DNA Sequence Number=SeqID_54242
MGLQKGREWRIAAKQSLRMAPTSGWRMHERKRSFHGAPKRGREWRIALSNHYAWLKLVGGGCMNENAIHGAPKKGREWRIALSNHYAWLQTRGRRMHERKGNSWGSEKGGREWRIALSNHTQAPNSWVGGCMNKKLIHGAPKRGRELAELRLSNHLRMAPNSWVEDA

SEQ ID NO: 145928 - protein, 137 aa, Glycine max
  Coding DNA Sequence Number=SeqID_54243
MACRKRKSIGARPTAQYDTRRFHSLDAWNRYTDNVLGRSNFPERKVEIYHTEFDDFKTELERRNLHKHLTNLADGTIGVALVKEFYANLYSSEDPSPKQARVRGHLVRIDTDSLNTFLETPVVLEEGETLPTYSRYC

SEQ ID NO: 145929 - protein, 230 aa, Glycine max
  Coding DNA Sequence Number=SeqID_54244
  Subcellular localization annotation: CTP_CleavageSite=60; ConfidenceScore=5.18e-01
MSPPPLEHYNHSQSHLMLSGWLPLQAQFSTSGLIGACALSATLACLAHISHPSSKFFLVLSRMSGALSRKSGALSGWLAKSLGRWVDIELMVEEIGIEASILARVLGLSSLIAINIAPWIMIIYKSSLKNFFVRWGIDMNASNAFRVGQWVMSESNQEFNVSKRGDIMFKEPYEVFLKSLHFLVGHECGHEERVIMVKDYVDIITIIKAYWRMIEAVPESNKHENAVTRK

SEQ ID NO: 145930 - protein, 121 aa, Glycine max
  Coding DNA Sequence Number=SeqID_54245
MVKEECKEVSVSSKRLAKKESHFGIKTNIEEASSLRQSPHLLIFKKTLVSTVTPLGLVIIPQLKELLDDGLVRIMRHQIPMKGGMMNVLSGATLFCKITHASNIFMIHIHRDSLGRGSHEP

SEQ ID NO: 145931 - protein, 96 aa, Glycine max
  Coding DNA Sequence Number=SeqID_54246
MMKDYENGEEQKRYIDNNFSKHMAYIKVYSTNKGHLINKPNNYVEKPENYPVIGTKWVFRNKLDEHGIVRNKTVLLYPLLKQNISLPAVVVHKFYG

SEQ ID NO: 145932 - protein, 42 aa, Glycine max
  Coding DNA Sequence Number=SeqID_54247
MVMTCPLDVLFGGNVRWASSGDSSLFDLDRSSLLADVDCHFF

SEQ ID NO: 145933 - protein, 209 aa, Glycine max
  Coding DNA Sequence Number=SeqID_54248
ERRVQLREDEYSKFQEEIAHRHWTPLVTPMPKFDPEIVLEFYANAWPTEEGVWDMRSWVRGQWIPFDADALSQFLGDPLILEEVQQCEFSQRRSQADGFDEEAIAQLLCIPGEAGVDHAHQHDYFDPDMDDTAAQQCMAPTRHPLDPEKSNRALGFQSLIIGLCQSYGVRVTPNKGDTHQAIDAPPPPRQANPAGPLGVERYLQHLVHQ

SEQ ID NO: 145934 - protein, 28 aa, Glycine max
  Coding DNA Sequence Number=SeqID_54249
MSKKGANRSSNMDARDQKYFITYIDDYS

SEQ ID NO: 145935 - protein, 138 aa, Glycine max
  Coding DNA Sequence Number=SeqID_54250
MSHSSRVNGEGTSHKDPLSRILDELSSLKLWKEKLERKEQGKERSLSEELRDYYEGRHRSHLRPHSHWIEKERKPQEANINLPYFHGNDNVEASLDWEIRVEQQLKRNSTKFFGSHSYPKKDQGQSIFWVTPSMPKDD

SEQ ID NO: 145936 - protein, 295 aa, Glycine max
  Coding DNA Sequence Number=SeqID_54251
  Homolog annotation: Hit_ID=Q6WAY6; Match level="QueryCoverage=87%, HitCoverage=48%, E-value=6e-17, Identity=27%"; Hit description =Putative uncharacterized protein
MGWLEYRGNVWKQKQESWQAAIDTFLAFHDRKESPVVAILADLYDTFDRRCEKNSTRIVCCTPALYKKEASWDRLLASKEGASANWFPRWKEGRTGILISCGGFPNVPLLGTRGCINYNPVLAIRQLGYPMRGAPLEEELAPIIARGFNKTNVEALQKVRKACEMVQKKDKELRGSNNGPIGGYRKWLKAHMQGLDWLLSLRTTKRKEVKAPEEDEEVQTLRAELEQAQTIKERFQSAALKIRKENAELRDVNIATTKALEQETKRACREEHGQNKFRGALWGINNELKLPRHPS

SEQ ID NO: 145937 - protein, 18 aa, Glycine max
  Coding DNA Sequence Number=SeqID_54252
MAGTFFLLKQQISFRDYE

SEQ ID NO: 145938 - protein, 119 aa, Glycine max
  Coding DNA Sequence Number=SeqID_54253
MGLLFYVKYMQTANVTSEKPLCATRGENATATGRIANGLAVCAGDIAMQGSARLTGDTASIRGSRHTIFRHCEWRNIFDYLPNFAQSYGLTQFPKGSMLNNTQAQCSYDPIANNKLHLG

SEQ ID NO: 145939 - protein, 152 aa, Glycine max
  Coding DNA Sequence Number=SeqID_54254
STICGGAHEFGRCIPIEEQPTHEVNYMGNQPINNFDAGGFSGFQHGQQYNQQQGQWRNHPGGPSTRPQQQGPSLYDRTTKLEETLAQFMQVSMSNQKGTESAIKNLEVQVGQLAKQLADRSSSSFTANTEKNPKEECKDVMTRSIMAIHVDE

SEQ ID NO: 145940 - protein, 69 aa, Glycine max
  Coding DNA Sequence Number=SeqID_54255
MECLEGAWETLEGNMRCRFRGTIRFTATSLVLPDEPARTLQRTQNSLEIMSGKKEMTPNRVVNWPFRTL

SEQ ID NO: 145941 - protein, 95 aa, Glycine max
  Coding DNA Sequence Number=SeqID_54256
GGGAYGKTALPRPSHFPVKYLPGIFQEISAPFPFFSCHMKHFTDTLISANIVSQYTSASAQYANRLSPRVGRFINAVGTTGFPTGKRAVSATQLM

SEQ ID NO: 145942 - protein, 170 aa, Glycine max
  Coding DNA Sequence Number=SeqID_54257
  Homolog annotation: Hit_ID=Q6WAY6; Match level="QueryCoverage=85%, HitCoverage=32%, E-value=5e-07, Identity=26%"; Hit description =Putative uncharacterized protein
MGKNQNGKRFYQVKVKSLDVTCLKELGRLMGPLQRQAFRKVYGKILDLTAAEVFTEAVVSLAQYYDQPLSKIAAVVGDSAKEMDRMKQTRNGVVGLPQKYLEGKVRDMASQEKWGPFADILALLIFGVVLFPNVDGLVDLAAIDTFLAYHHSKESPVVAILADLFDTFDR

SEQ ID NO: 145943 - protein, 186 aa, Glycine max
  Coding DNA Sequence Number=SeqID_54258
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=46%, HitCoverage=72%, E-value=4e-24, Identity=67%"; Hit description=LacZ protein
MDKAPPIKTTHGMHERKTRVRHHSLTKPITKPPIKVEASCKTSQPVIIYKFLNHKVQARSVRSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 145944 - protein, 301 aa, Glycine max
  Coding DNA Sequence Number=SeqID_54259
VDPWVLVPITFRGLHVLANRGLHALTFRGLHVLALTGLHALILGLHVLTIRGLHALTSRGLHVLALRGLHALTLEGYTSSPWVLVTLTVRGLHALTLKGLHVLASRGLHALTSRGLHLLALRGLHALTFRGLRVLIFRASSFLLTVPGPPPDIGGGPTVRAQPEREAITQLLCIPGQDFTRACKETRIAPTRHPVDPEKSNRALGFPALVTGLYQSYRVPVPPRQGHVIIGIAPARHPVDPKKSNRVLELSSSKYGSLSVQGSACCPQQGHQAPYQSSFHLEVLRPQAGAGRDTTAALGWT

SEQ ID NO: 145945 - protein, 354 aa, Glycine max
  Coding DNA Sequence Number=SeqID_54260
  Homolog annotation: Hit_ID=A8DDB6; Match level="QueryCoverage=54%, HitCoverage=19%, E-value=3e-23, Identity=40%"; Hit description =Putative uncharacterized protein precursor
RGAGEVSGHDVPADAALREVVERAESSREGVGVLERGAGRDAEAQVLGHGGHRADQQDRVVHGHLGAVADRGLVGAAVHVVGTKDVRDEDTVERRAFQQLRQVRPVRDGVVLARAVVGVPPQAGRLVGDAVHVERVEADLTGGLVLAPRARVGREDLDVVVGRALCPPPDHEADRGEDAVEQVHQPGGVIAGAEQQGDSDRVDGDPDQPELRPPPGHPVRGEERADERPRVSPHRLPRAERAEHGRQRDGADDQHEDHADACARRRPPRHHASALRVPPADPSVDRHGDEHDLPAGLAQQMRQRRVGAQGGAEEHGEQQQVADDADRPRPHLAPHTAERTRQPECVADDFADEE

SEQ ID NO: 145946 - protein, 19 aa, Glycine max
  Coding DNA Sequence Number=SeqID_54261
MVQGKFFPNLGEVLSRYES

SEQ ID NO: 145947 - protein, 446 aa, Glycine max
  Coding DNA Sequence Number=SeqID_54262
  Gene Ontology: Mol. function=motor activity; Cellular component=cell projection
  Homolog annotation: Hit_ID=UPI00016621D1; Match level="QueryCoverage =66%, HitCoverage=40%, E-value=5e-14, Identity=30%"; Hit description =UPI00016621D1 related cluster
MIGPLNDSISCFLIRVDPWVLVPIAFRGLHVLAFRGLHALALPLEDYMAACPRLQRVARPRLQRATRLRLRGPHVLAFRGLHALFFRGLHVVAFRGLHVVAFRGLHVLAFRGLHALAFRGLHVLTFRGQHALAFRGPNALTFRGPNALAFRGLHVLAFRRLHVIAFRWLPSHAFRGLRVLALRGLHALAFKGLHVLAFRGLHVFAFRGQHVLPFRGLHALTFKGLHILTFRGLHVLTFEGLYALAFRGLHDLAFRELHIPALRGLHVLVFRGLLALALRGLHVFAIRGLHVLTFRGQHHLALRELHILTFRGALAFRGLHALAFRGLHALAFRGLRVLAFRGLHGLAFRGLHVLAFRSLHVLTFRGLHALTFRGHTPSPSENYTSSPSEDYMSSPSEGYTPSPSEGYTPSLSEGYMPSPSVDCTSSPSEGYTSLPSKDSTSSLSEG

SEQ ID NO: 145948 - protein, 51 aa, Glycine max
  Coding DNA Sequence Number=SeqID_54263
  Homolog annotation: Hit_ID=Q1J7G7; Match level="QueryCoverage=54%, HitCoverage=42%, E-value=3e-07, Identity=90%"; Hit description =Transposase
MGSDSPSQWLLFVSAPVQLLTGWCVTAKAPPDISAGKCSGHAARNHHTRRA

SEQ ID NO: 145949 - protein, 122 aa, Glycine max
  Coding DNA Sequence Number=SeqID_54264
  Gene Ontology: Cellular component=chloroplast
  Homolog annotation: Hit_ID=Q49KT9; Match level="QueryCoverage=69%, HitCoverage=92%, E-value=1e-25, Identity=63%"; Hit description =Putative uncharacterized protein ORF113
ALSHMDSLMCSSAPDPEMWIIQGTLAWRTSPVRSNVDPTFSSLVGSGRSGGDHHGSSLLENSYIPYQYMDSYLSSTGLGLASMEKNGAPNNVSSQTKNYEIAPFILGDQEIGSSHKKNRMLG

SEQ ID NO: 145950 - protein, 138 aa, Glycine max
  Coding DNA Sequence Number=SeqID_54265
MSKSCGFGMTGPLDESISCFLIRVDPWVLVPITFRGLHVLANRGLHALTFRGLHVLALRGLHVLTIRGPHALTSRGLHVLALRGLHALTLGTSYPHQRTTRPRLERTTRPHHQRAARPHLQRTTCPRLERATRPHLGY

SEQ ID NO: 145951 - protein, 111 aa, Glycine max
  Coding DNA Sequence Number=SeqID_54266
  Homolog annotation: Hit_ID=A5BIS3; Match level="QueryCoverage=98%, HitCoverage=12%, E-value=1e-10, Identity=31%"; Hit description =Putative uncharacterized protein
MNALEIYSNRVKRQLDRKVKVVRFDRGGEYYGRYDENGQHPEKSKGYMFYYSNHNMRSVETGNARFIENSEISGTTIPRDVKTIFLNGDLEESAYMDQPIGFSVEGKEHMV

SEQ ID NO: 145952 - protein, 108 aa, Glycine max
  Coding DNA Sequence Number=SeqID_54267
MNNKASINNRWKFVWLALSFFVWHHRNAMIFKNHPFDPEKRRTTPGTTPSICSSCMWRSTPGCLMNDNSISHLPAVNDMVCMQRDSRNLNTLQYMFWGWSGKDIKRRR

SEQ ID NO: 145953 - protein, 102 aa, Glycine max
  Coding DNA Sequence Number=SeqID_54268
  Homolog annotation: Hit_ID=A0PAV3; Match level="QueryCoverage=37%, HitCoverage=17%, E-value=5e-07, Identity=76%"; Hit description =Restriction endonuclease
MVKVGTSYVPINVSFSPKVGPGLPGINRDTRIYLFCEVIFRHSGFLFLSAVPPCSATDGGGRVPFAIQAAQLLGRAIGAGLFAITPAGERGMCCKAIKLGNA

SEQ ID NO: 145954 - protein, 70 aa, Glycine max
  Coding DNA Sequence Number=SeqID_54269
MGAKHLTRTKAGRMSSSKGCRMTKFGLCLSSGPLPLDDKKGADNRKGADNRKGADNRKVSPRIIGPAASG

SEQ ID NO: 145955 - protein, 153 aa, Glycine max
  Coding DNA Sequence Number=SeqID_54270
  Pfam annotation: Domain name=zf-CCHC; Domain location=8-25; Score =21.5; E_value=0.00084; Accession=PF00098.14; Description=Zinc knuckle
MQEKTSSMKCFKCLGRGHITSQCPTKKTMIMRGQDIYSSQDEATTSPSSSKSEEAKGEESSEEMYPQEEGQPLMVKEECKEAPIPKIGGVMNALGGATLFCKITRAPNIFMICVHRDSLGVPMNPKRIKVIPEWPAPPSVLREKAQSFKNLGI

SEQ ID NO: 145956 - protein, 95 aa, Glycine max
  Coding DNA Sequence Number=SeqID_54271
MDDMGLNQFRFCNMVHDILVKVKLEVTRTSTVLNVLGSRQSSDVTRFIFCPNFCKMVTSILHLDLVNFFRKSMSLVQPHNPGNGNFDRQYFNNLS

SEQ ID NO: 145957 - protein, 59 aa, Glycine max
  Coding DNA Sequence Number=SeqID_54272
MTISSSLVSTDKFKELRKSLLVDELSMICYYGKWMDITRMGISLHQGIKSLYRCPYNKA

SEQ ID NO: 145958 - protein, 39 aa, Glycine max
  Coding DNA Sequence Number=SeqID_54273
MHSSKLEGGGHMTKRNSWGSEKVENGDCLSITTHSSKLE

SEQ ID NO: 145959 - protein, 406 aa, Glycine max
  Coding DNA Sequence Number=SeqID_54274
  Gene Ontology: Mol. function=DNA binding; Biological process=DNA modification
  Homolog annotation: Hit_ID=A8ZS41; Match level="QueryCoverage=90%, HitCoverage=94%, E-value=8e-75, Identity=44%"; Hit description =Restriction modification system DNA specificity domain
  Pfam annotation: Domain name=Methylase_S; Domain location=212-350; Score=42.8; E_value=1.2e-09; Accession=PF01420.10; Description=Type I restriction modification DNA specificity domain
  Pfam annotation: Domain name=Methylase_S; Domain location=23-175; Score=62.4; E_value=1.5e-15; Accession=PF01420.10; Description=Type I restriction modification DNA specificity domain
  Pfam module annotation: Pfam domain module=Methylase_S::Methylase_S; Domain location=212-350::23-175
MELRKPGVEKSHQTDIGVLPVSWEVRTLGSISTLLNGRAYGLAEWEQSGTPVIRLQNLTGGEDYYYSNLRLAAEKYCFRGDLLYMWSATFGPHIWQGGRAIYHYHIWKVVPKPNCSDRIFVYDKLSEITALKKATSTNGGTMLHLTKREMESTLVAVPPLPEQEAIAEALSDADTLIESLSFLLAKKRKIKQGAMQELLTGKTRLPGFQAPWARTQLGKLLSVRHGRNQRLVQYDDGPYPILATGGQIGWANRFLHDKPSVLIGRKGTIDEPQFMDTPFWTVDTLFYTDIHPPNVAKFLFYRLCLVHWMRHNEASGVPSLSAKVIESIEIEHPDADEQQAIADVLSTMDAEIESAEARLQKARRLKQGMMQALLTGRIRLAQPAFDAVPLLTDLAVHSPSIHSDPN

SEQ ID NO: 145960 - protein, 227 aa, Glycine max
  Coding DNA Sequence Number=SeqID_54275
MAPRKLSAKRSRKDVTTEGTSAAPEFDSHRFRSAEHQQRFEAIKGWSFHRERHVQLRDDEYTDFQEEIAHRRWTSLVTPMAKFDPDIVLEFYANAWPTEEGVRDMRSWECESSQRRNRADGFDEEAIAQLLCIPDHAHQHDHLDSDVDDVAAQQRMPPTRHPLDPDKSNRALGFPALITGLCQSFGVPVTPSKVIRPPITRAFIDKYCTPRQAQGDAPQAADTPPPP

SEQ ID NO: 145961 - protein, 162 aa, Glycine max
  Coding DNA Sequence Number=SeqID_54276
  Gene Ontology: Mol. function=ribosome binding; Cellular component =cytoplasm; Biological process=ribosome biogenesis and assembly
  Homolog annotation: Hit_ID=Q1I5Y9; Match level="QueryCoverage=100%, HitCoverage=91%, E-value=1e-84, Identity=93%"; Hit description=16S rRNA-processing protein rimM
  Pfam annotation: Domain name=PRC; Domain location=85-162; Score=55.2; E_value=2.2e-13; Accession=PF05239.7; Description=PRC-barrel domain
  Pfam annotation: Domain name=RimM; Domain location=1-79; Score=88.6; E_value=2e-23; Accession=PF01782.9; Description=RimM N-terminal domain
  Pfam module annotation: Pfam domain module=PRC::RimM; Domain location= 85-162::1-79
IFSVHGVRGEVKVYSFTDPIENLLDYPRWTLRHEGKVKQVELVNGRGSQKGLVVKLKGLDDRDEARLLSGYEICIPRSLLPSLAADEYYWYQLVGLKVINQDEQLFGKVDHLLETGANDVMVVKPCAGSLDDRERLLPYTAQCVLDIDLEAGVMRVEWDADF

SEQ ID NO: 145962 - protein, 212 aa, Glycine max
  Coding DNA Sequence Number=SeqID_54277
AWNETNAAHNSGMTPVNRKAGTGERTREPPGGNAGIFIVLSGFATTDLSVRFRDACQGGGAYGKTALPRPSHFPVKYLPGIFQEISAPFVSHALAAVERPSVASQCSPGGISTSSELAATAQRAATLASADASGGGTADRNMKPGALEINPHTLGIIKLVGHPRAHGIDSLPEYKIKYNAYKLTSQKNKSGAMLIPGSPGPTFGEIHETLIG

SEQ ID NO: 145963 - protein, 80 aa, Glycine max
  Coding DNA Sequence Number=SeqID_54278
MFLDFRVVIIKKGEIVEAMSSKVILMMPKNQELRKVSSKDSRIKFQVSSFKIQDSRIKFQDSRIKFQRSRFKNQDKPQSR

SEQ ID NO: 145964 - protein, 198 aa, Glycine max
  Coding DNA Sequence Number=SeqID_54279
MGSSQKPSLKKRFYQVKIKSLEVTSLRKLGQLMGQLQWQAFRKAYDHQKQVENGVVGIPRKCLEAKARILAGRNEWAPFIDVLALLIFGGVLFSNMDGLVDLAAIDAFLAYHNHKESPVVAMLADLYDTFDRGCPSIRYKVTARASKKEGRIRIVSSCEGCPMRGVPSDESITPFIARGFSDHNARVLQGVRKAWDAA

SEQ ID NO: 145965 - protein, 32 aa, Glycine max
  Coding DNA Sequence Number=SeqID_54280
MDPKRIKVIPEWPTPPSVEETILEFQEPLDLR

SEQ ID NO: 145966 - protein, 84 aa, Glycine max
  Coding DNA Sequence Number=SeqID_54281
  Subcellular localization annotation: CTP_CleavageSite=35; ConfidenceScore=5.03e-01
MAMSHGCLYQQRKKNAFDKKGFMSVVIVSSQFFKRREHGSEASILTLVLMNGRKERLGSRPIGRHPLPSSGQTESAAAKQPSIL

SEQ ID NO: 145967 - protein, 101 aa, Glycine max
  Coding DNA Sequence Number=SeqID_54282
  Homolog annotation: Hit_ID=A5BT67; Match level="QueryCoverage=48%, HitCoverage=4%, E-value=4e-07, Identity=51%"; Hit description =Putative uncharacterized protein
MSDLKSIGEFFSRILAITNQMSAYGDKQLDLGIIDKLLRTLTPRFDHIVYVKVCAYVQYSSNPLEIFHSLCKNPFTKSEPYRDNSIPCVQESLQLKRSSVP

SEQ ID NO: 145968 - protein, 253 aa, Glycine max
  Coding DNA Sequence Number=SeqID_54283
  Gene Ontology: Mol. function=aspartic-type endopeptidase activity; Cellular component=small subunit processome; Biological process=DNA integration
  Homolog annotation: Hit_ID=A5B323; Match level="QueryCoverage=100%, HitCoverage=23%, E-value=1e-42, Identity=33%"; Hit description =Putative uncharacterized protein
  Pfam annotation: Domain name=zf-CCHC; Domain location=161-178; Score =13.8; E_value=0.012; Accession=PF00098.14; Description=Zinc knuckle
MSWSASVELWFLGQGYHDHLEKGVDAVPNDKRAEWEKLDFQLCAVLWQSVEPDVLEILRSFKTCCFFWKKAQEIFANDIQSLFDTTQKVAALKQTNHDMIAHVGDQVPSMDSLITRLLHVPQALKEENLAKVVETSATAASCGRGGGRNNRGGRGGRSGRPQCTYCKRMGHTQENCYSLHGFPDKVAHVSKIEKSESKFSDEKYQEYLRLKSTKADNQAQSSSVPYVSSACISQSVKDSSPWILDSGASDHIS

SEQ ID NO: 145969 - protein, 46 aa, Glycine max
  Coding DNA Sequence Number=SeqID_54284
MASGNRLPIGCNRLHRIAMAVQLIHDRVVMECLEGVWETLEGNERC

SEQ ID NO: 145970 - protein, 149 aa, Glycine max
  Coding DNA Sequence Number=SeqID_54285
MTTLTWIWMTLLFSNILPCNHNANLPLQMYQLESHPQRHPVDPEKSNRALGFPALVTGLCSPTGCPFPRQGIAPAGHLVDPKKSNRFYGVSVAPSKIIRPPTNRAFIKKYYVPRQAQGKTPQQPGDGRQRSTEAPQSPLEFTSAHRQKG

SEQ ID NO: 145971 - protein, 93 aa, Glycine max
  Coding DNA Sequence Number=SeqID_54286
  Homolog annotation: Hit_ID=A5BTC5; Match level="QueryCoverage=60%, HitCoverage=12%, E-value=4e-09, Identity=49%"; Hit description =Putative uncharacterized protein
MEKFDKKNFNDKNKKKAYITWEDNERDSSSDSENEILNLSLMAKDYEIEEEESLKQSWYVDSSCSKHMTGDASKFIHISSKNSGHVTYENNNK

SEQ ID NO: 145972 - protein, 76 aa, Glycine max
  Coding DNA Sequence Number=SeqID_54287
MGSFAPGCTKGAGRQKVQKMMLVFKRHGLICSFALWLTNGAGNHKVRTTKGAETMLVFKRQRAHLPYLTKFAGNHK

SEQ ID NO: 145973 - protein, 87 aa, Glycine max
  Coding DNA Sequence Number=SeqID_54288
YILCGTSRGYIYLGLTENKRGYISYGSVLVEGTSTRFKENKGGNRLFQDHDEDQFNLCLMTKSDENNKEDSVRKKWYIDSGCSKHMT

SEQ ID NO: 145974 - protein, 75 aa, Glycine max
  Coding DNA Sequence Number=SeqID_54289
MVGSWYLTHRKTQGSCMKIKVKKVIWTFRLPVTKDETNIQCMRDDMMQTRKSATWGCTQYGNIPKESYNKGIHDI

SEQ ID NO: 145975 - protein, 250 aa, Glycine max
  Coding DNA Sequence Number=SeqID_54290
  Gene Ontology: Cellular component=mitochondrion
  Homolog annotation: Hit_ID=Q652R5; Match level="QueryCoverage=76%, HitCoverage=85%, E-value=6e-20, Identity=38%"; Hit description =Putative uncharacterized protein P0603C10.50
MARLNRAAAPSYLFKSFAPIPKSDERFARQYRCGPPPEFPLASPRSGIVHHLSGPDRYALTRTLHRRSGSVGGANPQGDPTNQLPCALRVYSPVDSHTCQTPWSVFPRRAEWGAHRPTPGARRCRGTPRARAAIHNRDDDVSTSISTARAWATIAIRVGQCPESIGGPALTSFSSFPRGTCSLSVSRQYLALDGIYRPIGAAFPNNPTRRQRLVGTWARSATEDASPDYNSDAEGDRFSWWAFPGSLAVT

SEQ ID NO: 145976 - protein, 248 aa, Glycine max
  Coding DNA Sequence Number=SeqID_54291
  Gene Ontology: Biological process=transposition, DNA-mediated
  Homolog annotation: Hit_ID=Q6UUU1; Match level="QueryCoverage=24%, HitCoverage=40%, E-value=3e-18, Identity=78%"; Hit description =Putative uncharacterized protein
GHQDLFILRSDLPSQWLLFLSAVPPVQLLTGWCVTAKAPPDISAGKCSGHAARRVPFAIQAAQLLGRAIGAGLFAITPAGERGMCCKAIKLGTYKLVKGTSKLLKALHQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 145977 - protein, 176 aa, Glycine max
  Coding DNA Sequence Number=SeqID_54292
MENYWWEQELHPYNQYEEKRLSNLENVLMQFMKTSEANFKVNQNAIQNLEIEVVTREENFEEVKAHEESLVEEHDSREKDEEKGEERTQQQWEKNSQVKIQQENILQVNIPPHQLIGKEERHVECDKSLSVILSLNTNTSPAMVWKAFLRYMSFMESLANKQKCKENVFYVTFMSP

SEQ ID NO: 145978 - protein, 40 aa, Glycine max
  Coding DNA Sequence Number=SeqID_54293
AGMEKPHHHAYLNSSGSAIQETQGYHCSRLVRTICTVGIL

SEQ ID NO: 145979 - protein, 91 aa, Glycine max
  Coding DNA Sequence Number=SeqID_54294
  Gene Ontology: Biological process=transposition, DNA-mediated
  Homolog annotation: Hit_ID=Q1J7G7; Match level="QueryCoverage=36%, HitCoverage=47%, E-value=2e-10, Identity=93%"; Hit description =Transposase
MVKVGTSYVPIKRLIFAKSWPRASRYQQGHQDLFILRSDLPSQVLQWLLFLSAVPPVQLLTGWCVTAKAPPVISAGKCSGHAARSHHTRRA

SEQ ID NO: 145980 - protein, 105 aa, Glycine max
  Coding DNA Sequence Number=SeqID_54295
IPEHKGWVVPVWFRLCNGFYKDSGNLNHFQIPLNDEPFVQVKCSFAIGAGAVTSFGYRKDRNGQWLKKDALPPQDERTPSPPLQREDSALLNEVLTELRGLRSYV

SEQ ID NO: 145981 - protein, 84 aa, Glycine max
  Coding DNA Sequence Number=SeqID_54296
MARRDKLWIFCDICDLEATSPMTPCPFAGKQSEAHGCVFQRRKDAQSRHQRLFVENIRKTEGNRSAKAGSCSYVPSIEEEIRPT

SEQ ID NO: 145982 - protein, 192 aa, Glycine max
  Coding DNA Sequence Number=SeqID_54297
MAASDIAILRDRAHAPNKEKSSGTYIARYAVAGCAICGGAHNLAVVSPMKNQLMNMPSHIIHNRDSGGITLETSSTKTRVVSMFNHKSTESAIKNLEVQVGQLAKQLADKLSSSFSANIEKNPKEECKDVMTRSRMAIQLDEGRAEEKAEGHKQQSAAKPALEPVFDFVELEEVVEDEDDQQERERDTNKRK

SEQ ID NO: 145983 - protein, 207 aa, Glycine max
  Coding DNA Sequence Number=SeqID_54298
MIMRGQDIYSSQDEATTSPSSSKSEEAKGEESSEEIYPQEEGQPLMVKEECKEVSVSSKRLAKKERHFEIKTNIKEISLLRQPPHFLLCKKTLLSIATSLRLEFNPQVKELLDEGLVRKRLNPCALLVPKIGIIRHQIPKIGGVMNALGGATLFCKITRAPNIFMICVHRDSLGVPMNPKRIKVIPEWPAPPSVLRKKAQSFKNLRI

SEQ ID NO: 145984 - protein, 34 aa, Glycine max
  Coding DNA Sequence Number=SeqID_54299
VIKKDLELNDLDRSMVEGLRILKMRVWELFTHRK

SEQ ID NO: 145985 - protein, 70 aa, Glycine max
  Coding DNA Sequence Number=SeqID_54300
  Subcellular localization annotation: CTP_CleavageSite=36; ConfidenceScore=5.23e-01
MPISPCGSISWSVSFRHRDRAHKTPSGPREVQQGPRVSNSGYAPLSVLQGARSPQQSHAIMTKVSMHIAQ

SEQ ID NO: 145986 - protein, 65 aa, Glycine max
  Coding DNA Sequence Number=SeqID_54301
  Gene Ontology: Mol. function=phosphoprotein phosphatase activity
  Homolog annotation: Hit_ID=A7PHV0; Match level="QueryCoverage=89%, HitCoverage=17%, E-value=1e-14, Identity=56%"; Hit description =Chromosome chr13 scaffold_17, whole genome shotgun sequence
MKRHEFLWEPYIATVLSMLPPICLVGSVAWCAVVPLICFHVVEWHQPDRVLRQFEMQQPIPESPS

SEQ ID NO: 145987 - protein, 76 aa, Glycine max
  Coding DNA Sequence Number=SeqID_54302
MRENYTVLLGITMTQETQEKEAYEDSQDQWQVRLQGIMNFKRFGMESCKNTSHRSSTSCYLDKDESSQYIDMKQYR

SEQ ID NO: 145988 - protein, 111 aa, Glycine max
  Coding DNA Sequence Number=SeqID_54303
MWRYLMVIHTFCQPEASEPIDTQRLTSCHQSLHPFVNQRDGESDDMQEIPYRLSALFVNQRQGSPLTRETNVVICTFVIQRRRSPVTYEDTLWLSTPFFRPEASEPLTRRY

SEQ ID NO: 145989 - protein, 179 aa, Glycine max
  Coding DNA Sequence Number=SeqID_54304
MGEVEEVQEQMKADMEAMKEQMATMMEAMISIKKIMEANAIAVIVALLLSQQPQFDHAHVSRPMGETHEIPHQNLADFNPCLGYATKGQAVGSIPLQNTLEGPQFRPQPQPSCIPQQERLRTIEGGEDCAFSNLEELFLVPNIITRPKFKVSAFDKYKGTTCLKIIVERWRHMQKMRNY

SEQ ID NO: 145990 - protein, 22 aa, Glycine max
  Coding DNA Sequence Number=SeqID_54305
MATPRIFPPLKSAPAKFNKRDL

SEQ ID NO: 145991 - protein, 153 aa, Glycine max
  Coding DNA Sequence Number=SeqID_54306
MDNEEGVQEQMKADLSALKDQMASITEAMLKLQKTIEDNATAAASNTAREAEPVLQPAINLGRDRNTTVFGRRYSPQAYPYGLPPDFTPRTAPDDLSQAPTFEGQLPPHADIPLQEDDEGDAHLGPLLPLKDPTPHELPQPNIVRHVPSPPAP

SEQ ID NO: 145992 - protein, 69 aa, Glycine max
  Coding DNA Sequence Number=SeqID_54307
MRLPSPGLRHIRTSLLGELYGLAGKRQFHRPPQRYSPKPFGHAFISSRAVTRPTRTGRRCSYSNISLYR

SEQ ID NO: 145993 - protein, 160 aa, Glycine max
  Coding DNA Sequence Number=SeqID_54308
LALVKDFYANLYSSKGPSPKHYRVRGHLVKIDADSLNTFLETPVVLAEGRGFILNTEGYLGKILRKDLTTLAQSNTSRLGFPALITALFRARGVVFDSLTFECLSPVINLANIKKNCCNPEDLTVSIQGAKRARERPAELPSTSAAPTPASTSAAPFVPA

SEQ ID NO: 145994 - protein, 93 aa, Glycine max
  Coding DNA Sequence Number=SeqID_54309
MVSISCPSCSVLKVVIRSQFGTQAYRAGSISAGKCKAGTHYRRELLELATARCMRHALELVAYPPGCGIRWRFQRKILNREVVAAASKVSVFA

SEQ ID NO: 145995 - protein, 218 aa, Glycine max
  Coding DNA Sequence Number=SeqID_54310
  Homolog annotation: Hit_ID=Q2QVY0; Match level="QueryCoverage=84%, HitCoverage=23%, E-value=5e-07, Identity=25%"; Hit description =Transposon protein, putative, CACTA, En/Spm sub-class
  Pfam annotation: Domain name=Transposase_23; Domain location=131-201; Score=-2.7; E_value=0.0023; Accession=PF03017.5; Description =TNP1ENSPM transposase
MTSEAAKEIPDKIGSFVTHGRHDILIAVIGRPEHPSHVRAIGAGITIKQYFGSTSRTSSIAPEYLQQLTQQIKDQLEDPITEKVTRRLMLSLSQMQSQGLALPPEPGVDPSAAHVSTKESCVDPSGNDPDTSDSYKCGLYIEEYPPRLVALGRVYAGSTTIHNIPLLHDQVKVGVEEIRDADAPILVPTKEVKVMGQALNTFLAWPTHLVKRLSEHVF

SEQ ID NO: 145996 - protein, 348 aa, Glycine max
  Coding DNA Sequence Number=SeqID_54311
QLGYPMRGAPLEEELAPVISRGFNETYGETLQKVVESPRARFGLAPLPSLRTAKREEVEALEEDEEVQALRAELEQAQIVKERFKSTALKIRKENAELRDTNIATTKALEQETKRARREEHGWNKFQGALWGSNSELKLRREERDQSRVHGMVLKEELAACSRSKKRQYKEELNQSLTHEQKLVEDFAQAYAEKETRGRVIDALHQEATMWMDRFALTLSGSQDLPRLLAKARAMAEVCSAPKEIHGLINYYQHMIDLMAQVLKLITLSKKALRSVTGFNRRYSPQAYPYGLPPNFIRRTALDDLSQAPTFKGQLPPHADYPLQEDDEGYAHLGPLLPPKEPAPHELP

SEQ ID NO: 145997 - protein, 171 aa, Glycine max
  Coding DNA Sequence Number=SeqID_54312
MQLPQGPLNERPRGLARKSMAGTNFAELYGVAIVNSSCEGKKGTSREHIAWSKRSLSQRLCETETNMLAIIAKYEEELGLATAHEHRIADEYAQVYAEKEARGRVIDSLHQEATMWMDRFALTLNGSQELPRLLAKAKAMADTYSTPEEIHGLLGYCQHMIDLMAHIIRNR

SEQ ID NO: 145998 - protein, 65 aa, Glycine max
  Coding DNA Sequence Number=SeqID_54313
MSSPELHCLTGQVTKAIPKRLNEGMMRIMKLAKYRLKAQVEKDEGPSGEGQSPRVEKDEGPSGEG

SEQ ID NO: 145999 - protein, 70 aa, Glycine max
  Coding DNA Sequence Number=SeqID_54314
MPSAREMAPRKLSMKRSRKDAAAEGTSAAPEFDSHHFRSAEHQQRFEAIKGWSFHRERRVQLRDDEYIDF

SEQ ID NO: 146000 - protein, 95 aa, Glycine max
  Coding DNA Sequence Number=SeqID_54315
MVINFHTDVRFMGHNIDLKNEPRKLSEIQNGHKFSNGSPIKVHQYIETLKMNNIGSSREIQMVINFHTEVRNSGINIVEMLEIEQRKLFEIFKWT

SEQ ID NO: 146001 - protein, 232 aa, Glycine max
  Coding DNA Sequence Number=SeqID_54316
  Homolog annotation: Hit_ID=UPI00006A2D9E; Match level="QueryCoverage =91%, HitCoverage=86%, E-value=2e-12, Identity=19%"; Hit description =UPI00006A2D9E related cluster
VDPWVLVPSPSEDYTSSPSEDYTSSPLEDYTSSPSEGFTPSPSEGYASSPSEGYMHALRELCVLTFRGLHALAFRGLHALTFRGLHVLTFRGLHVLAFRGLHTLSFRGLHALAFRGLHVVAIRGLHVLAFRGLHAITFRGLHVLTFRGLHVLTFRGLHTFSFSGLHTLAFRRLDALAFKGMANCASTTRGGGYRTSTMHTGARFHPCRYKETSADHVHQHDHSYTDIDDVAT

SEQ ID NO: 146002 - protein, 67 aa, Glycine max
  Coding DNA Sequence Number=SeqID_54317
MSQQSWEIHTKECDIAVLLMLIKEFQGTSSTPKRSPPLHPKKGISTDEEDQATEETTCTKGTRTCSR

SEQ ID NO: 146003 - protein, 85 aa, Glycine max
  Coding DNA Sequence Number=SeqID_54318
IFLSNALAGYDCITDAPVPIPTDEVSLVGQALHTFLAWPTHLVKSLSHQVAVSPPKPPPKPDPEVDDPLYLMTLTILELFLRPYQ

SEQ ID NO: 146004 - protein, 175 aa, Glycine max
  Coding DNA Sequence Number=SeqID_54319
  Gene Ontology: Mol. function=helicase activity; Biological process =viral genome replication
  Homolog annotation: Hit_ID=Q2A9E0; Match level="QueryCoverage=93%, HitCoverage=13%, E-value=3e-22, Identity=36%"; Hit description =Putative uncharacterized protein
MARDRLTADQANNIKLQLIAARGKDGRVYNMPNVPEIAALIVGNFHPDSKRDIIVETQNGELQRIHELHPSYLPLQYPLLFPYGEDGYRADILHCCTSSSKKRKQNCLTMREWFAYRLQSSYIRNNQKKLRVDKYSSLQTSLDTGTAKGLTKGKRVILPSTFVGSHVIWINFTLM

SEQ ID NO: 146005 - protein, 81 aa, Glycine max
  Coding DNA Sequence Number=SeqID_54320
MMITKDDDKGDDKKLKDQSKNSSSESKTSQEFKDKNKEEIKTQEECLESRIKIQGSRSQESRSRFKTQGSIIKRRLNQDKY

SEQ ID NO: 146006 - protein, 205 aa, Glycine max
  Coding DNA Sequence Number=SeqID_54321
  Homolog annotation: Hit_ID=UPI00006A2D9E; Match level="QueryCoverage =84%, HitCoverage=86%, E-value=1e-08, Identity=13%"; Hit description =UPI00006A2D9E related cluster
MNDPLNESISCFLIRVDPWVLEPVAFRGLHALASRGLHVLAFRGLHVLAIRGLHALAFRGLHVLTFRGLHVLAFKGSCTFAFVGLHALALKGRHALALKGRHALAFRGLHVLAIRGLHVPTFRGLHAFAFRGLHVPLFKGLHALALRGRHALTFRGLHVLAIIGLYSFAFKRRHVLNFRGLHALAFRGLRVLTFSGLHIHTFKII

SEQ ID NO: 146007 - protein, 159 aa, Glycine max
  Coding DNA Sequence Number=SeqID_54322
  Homolog annotation: Hit_ID=A0ST23; Match level="QueryCoverage=28%, HitCoverage=91%, E-value=1e-11, Identity=73%"; Hit description =Putative reverse transcriptase
MTVKTSDTCSSRRRSQLVCKRMPGADKPVRARQRMRKEKIPHQAPFAIQAAQLLGRAIGAGLFAITPAGERGMCCKAIKLGNARVFPVDSRGSPDDDDDVKETQDIKRLRYEWGTELEFVIMVIAVSFGKPVVPAALMNRPTRGERRFAYWALFRFLAH

SEQ ID NO: 146008 - protein, 89 aa, Glycine max
  Coding DNA Sequence Number=SeqID_54323
  Homolog annotation: Hit_ID=Q2HX35; Match level="QueryCoverage=58%, HitCoverage=2%, E-value=3e-07, Identity=44%"; Hit description=LINE -type retrotransposon LIb DNA, complete sequence, Insertion at the S11 site
MLEKHTLGASAIWIKKGKSYMWYQQYGVWSPPKAIFAKVNCDGACSYQQNIASAGVIIRDSNGQFIASFSTQLGEWSVVITQQNSGQSI

SEQ ID NO: 146009 - protein, 24 aa, Glycine max
  Coding DNA Sequence Number=SeqID_54324
SGNHEVTGRGRLVNSMPGKGKHAA

SEQ ID NO: 146010 - protein, 163 aa, Glycine max
  Coding DNA Sequence Number=SeqID_54325
  Homolog annotation: Hit_ID=UPI0000ECBAF8; Match level="QueryCoverage =25%, HitCoverage=48%, E-value=1e-16, Identity=100%"; Hit description= UPI0000ECBAF8 related cluster
SEQESARGSFQGETPGIFIVLSGFATSDLSVDFCDARQGGGAYGKTPATRPFYADTARRSRTTERSESVSEEAEERPIRKPPLPAPDNNFTQETAMTMITNSSSVPDYLYGMQAWHWPSFYNVVTGKTLALPNLIALQHIPLSPAGVIAKRPAPIALPNSCAA

SEQ ID NO: 146011 - protein, 168 aa, Glycine max
  Coding DNA Sequence Number=SeqID_54326
MASISQLQSQMQSQGLAVPLEPLVVPSDPRVSTKGSCVDPSGNDPETGDSDRCGLYIEADLARLVAMGRVYEGSTVVHNTPLLPGQVNVVVSPTKPPPKPDLEVDDPLYLMTLTIPELFLRPYQVRWDATVFGVFNPDFPLYIKHEDLSKIARGGQCLNISVLQLWIM

SEQ ID NO: 146012 - protein, 79 aa, Glycine max
  Coding DNA Sequence Number=SeqID_54327
MYKFIVCSIGFLTYQGNPCGVYPDLSSFTGSGVYPDLSSFTGSGVYPDLSSFTGSGVYPDFLPSPEVAHKKRLVLIIAL

SEQ ID NO: 146013 - protein, 143 aa, Glycine max
  Coding DNA Sequence Number=SeqID_54328
MAAQLIHDRVEMECLEGAWETLEGNTRCRFWGTIRFTTTSLVHPDEPVRTLQRTVEWILPTPTPYRLVEPVQVIEVTSSEEDPEEDPEELPPEPAVDALDFLEGDEDPLPEVDPPEEVMSASEADSTEDSGPREMATSGGSSS

SEQ ID NO: 146014 - protein, 470 aa, Glycine max
  Coding DNA Sequence Number=SeqID_54329
  Gene Ontology: Mol. function=hydrolase activity, hydrolyzing O -glycosyl compounds; Cellular component=cellulose and pectin -containing cell wall; Biological process=carbohydrate metabolic process
  Homolog annotation: Hit_ID=A7P2I3; Match level="QueryCoverage=91%, HitCoverage=85%, E-value=0.0, Identity=79%"; Hit description =Chromosome chr1 scaffold_5, whole genome shotgun sequence
  Pfam annotation: Domain name=Glyco_hydro_1; Domain location=21-470; Score=569.8; E_value=2.8e-168; Accession=PF00232.9; Description =Glycosyl hydrolase family 1
MRIRNLLMGIELLIKVKSNFAIKWYMFYQGDIRYGKIIDFSNADVAVDQYHRYEEDIQLMKDMGMDAYRFSISWSRIFPNGYGQINQAGVDHYNKLINALLAKGIEPYVTLYHWDLPQALENKYSGWLNASIIMDFATYAETCFQKFGDRVKHWITFNEPHTFATQGYDVGLQAPGRCSILLHLFCRAGNSATEPYIVAHNVLLSHATVADIYRKKYKKIQGGSLGVAFDVIWYEPLTNTKEDIDAAQRAQDFQLGWFLDPLMFGDYPSSMRTRVGSRLPKFSQSEAALVKGSLDFVGINHYTTFYAKDNSTNLIGTLLHDSIADSGAVTLPFNGTKAISERASSIWLYIVPQSMKSLMIYIKQKYGNPPVYITENGMDDPNSIFISIKDALKDEKRIRYHTGYLSYLLASIKDGCNVKGYFVWSLLDNWEWSAGYTSRFGLYFVDYKDNLKRYPKQSVEWFKNFLKPTK

SEQ ID NO: 146015 - protein, 492 aa, Glycine max
  Coding DNA Sequence Number=SeqID_54330
  Gene Ontology: Mol. function=thiamin-phosphate diphosphorylase activity; Cellular component=intracellular; Biological process =thiamin biosynthetic process
  Homolog annotation: Hit_ID=A7PU60; Match level="QueryCoverage=39%, HitCoverage=20%, E-value=2e-71, Identity=73%"; Hit description =Chromosome chr7 scaffold_31, whole genome shotgun sequence
  Pfam annotation: Domain name=Dynamin_N; Domain location=311-445; Score=73.3; E_value=7.7e-19; Accession=PF00350.14; Description =Dynamin family
  Pfam annotation: Domain name=MMR_HSR1; Domain location=309-445; Score= 46.0; E_value=1.4e-10; Accession=PF01926.14; Description=GTPase of unknown function
  Pfam module annotation: Pfam domain module=Dynamin_N::MMR_HSR1; Domain location=311-445::309-445
MAIGRPEHPSRVCMAGTGVTISQYFGPTSRQSMTSSNLITPEQLADIIVGTQCDSFGTIHNVPYADDVVRVPIPTSEIKFVKETLGSFVPWSTHLVKPILPEDLEKAVSLPLKIVEEEKASVVVDPLGDLVKNLFDIYQRPVELSWDGTKFGINNVKDGFFITHADVIKIILGDNLAVWFCSLWKKPDATIKGTINRYNAYGHCSEGANTHSGMSNEEANAKFMTATYMTKYKKAKKGIQFLINGSKVGNSPEEIAAFLKDASGKILCSLSPFPPMLNEVIEVMKRVAPLILEEVSLLNDAVSQIDEPCLLVIAGKFNSGKSTVINALLGERYLNEGVAPTTNEITFLRYTDLDIEQQQCERHLDGQYICYIPAPILKEMTIVDTPGTNVILQRQQHLTEEFVPCVDLLLFVIFADHPLTGSEIAFLRYSQQWKKKAVFVLNKADIYQNNHEDETVVNFILVNDDRLDDTVIEERLVYDGRGEQTVVEFTNV

SEQ ID NO: 146016 - protein, 541 aa, Glycine max
  Coding DNA Sequence Number=SeqID_54331
  Gene Ontology: Mol. function=DNA binding; Cellular component=nucleus
  Homolog annotation: Hit_ID=A5AF94; Match level="QueryCoverage=99%, HitCoverage=89%, E-value=8e-87, Identity=39%"; Hit description =Putative uncharacterized protein
  Pfam annotation: Domain name=Myb_DNA-binding; Domain location=256 -306; Score=21.5; E_value=0.003; Accession=PF00249.22; Description =Myb-like DNA-binding domain
MGYKRCREANEFEDLSLNKAKRFECNNELVSLADIVTPNKAFAKTVIKGDEDGFYNIQWYDPLETDAAKESPYSGDKNGKTSGHFRSCSSEDDTGSGATSLSSASSDCLEFDTPQKVFVPLDDDYLDFDCSPRKSVPIGPNHQATIPVWRGKVNKMLELGIYNHDSPSSGLVSAHTVDEDEERLMGTSVLSMDEFSFHYFSSNEIGQGRTECNCMDRCSIRCVRQHVREARENLMETLGEEKFVNLGFCDMGEDVSRQWTEEEEDMFHEVVYSNPASLGRNFWKHLSVTFSSRTSKEIVSYYFNVFILRRRAAQNRSRFLDIDSDDDECQTRNSRIFGFENSDDSAIESLGDEDVRVENHDNYSDEDDDDDNTDDGTEDNVHGVTGCDIGNTTEIEGEIDQNPSNSKVNSQIEPWSNPDEHVNGTPGILNYNIAVGDDSCMSFECDANMHVSCHSHGLGGASSALQARGYNCNQSPHTQGKLDLSSNEMDHVYLMEPCVSKDWYPGYSTCPTPSTDLDFLPTSNLIEEFFGYGTLDKKDLK

SEQ ID NO: 146017 - protein, 90 aa, Glycine max
  Coding DNA Sequence Number=SeqID_54332
MQDSIAAGNEEKQRGMRKNRHKKEKDITGKMRRKKKCCTQRLPLDYSKILTSNYLDQQIIIKEIMSFKKILKKYKDMKSRLRELMPMPPV

SEQ ID NO: 146018 - protein, 455 aa, Glycine max
  Coding DNA Sequence Number=SeqID_54333
  Gene Ontology: Mol. function=sequence-specific DNA binding; Cellular component=nucleus; Biological process=regulation of transcription, DNA-dependent
  Homolog annotation: Hit_ID=Q5IY47; Match level="QueryCoverage=83%, HitCoverage=90%, E-value=1e-90, Identity=47%"; Hit description=DNA binding protein WRKY2
  Pfam annotation: Domain name=WRKY; Domain location=224-282; Score =129.5; E_value=9.6e-36; Accession=PF03106.6; Description=WRKY DNA -binding domain
  Pfam annotation: Domain name=WRKY; Domain location=375-425; Score =16.6; E_value=6.8e-06; Accession=PF03106.6; Description=WRKY DNA -binding domain
  Pfam module annotation: Pfam domain module=WRKY::WRKY; Domain location=224-282::375-425
MVDGGKGEGGGEQASPPSTAARHGTTLRPRASVESVFSGGYSPGPMALLSNFYGDGDECKSFSELLAGAMVDPTAPSPMPTTTFALPPGFIDSPSQVITHNLICYILYQQQHITKRDHGIPLGKIFIMLEISTIRKTRLNSVFAIEEGQFGITHQQMLAQISSQAVQTHSEHPFSISAVSATSSCAAQQLIPPSMPDSKVKESLDYSHSEQKLQSSVNVDNKPNNDGYNWRKYGQKHVKGSDFSRSYYKCTRPNCPVKKKLERSLEGHVTAIIYKGEHNHQRPHRSKIVKETQTSNENSVSKMDLGSSQATGEHGSGTSDSEEVDDHETEADEKNDEPDAKRRNTEARIQDPATLHRSVAEPRIIVQTTSEVNLLDDGYRWRKYGQKVVKGNPYPRHGTRAGRGRGRGRGVFPCSPSPNLTLLPVSVPASRGGGIFCPVPILRLPVGTCADPVLH

SEQ ID NO: 146019 - protein, 599 aa, Glycine max
  Coding DNA Sequence Number=SeqID_54334
  Gene Ontology: Mol. function=translation repressor activity; Cellular component=nucleus; Biological process=negative regulation of transcription
  Homolog annotation: Hit_ID=A7P330; Match level="QueryCoverage=63%, HitCoverage=39%, E-value=1e-57, Identity=41%"; Hit description =Chromosome chr1 scaffold_5, whole genome shotgun sequence
MVSVCKGGLVLGKAADGLFQAVGSLGTCMVFGHGVAGRQIGLQTLYRPKIGKKKKRGEMVGATTLLKIAFSSSIKWDVQNPIITKTLHSNHHIRSPEPSLMSTAKSRNFRRRGGDDTESNDDNDGDTTSTTLPSKPPSSAKPKKKPQAPKLLSFADDEDETDENPRPRASKPHRTAATAKKPSSSHKITTLKDRIAHTSSPSVPTNVQPQAGTYTKEALRELQKNTRTLVSSSSSRSDPKPSSEPVIVLKGHVKPLGPETQGRDSDSDSEGEHREVEAKLATVGIQNKEDSFYPDEETIRAIRAKRERLRLARPAAPDYISLDGGSNHGAAEGLSDEEPEFRGRIAMFGEKVDGGKKGVFEEVEERRVDLRFKGGEEEVLDDDDDEEEKMWEEEQFRKGLGKRMDEGSARVDVAAAAVQGAQLQHNFVVPSAAKVYGAVPSAAASVSPSIGGAIESLPVLDVVPISQQAEAARKALLENVRRLKAVSLPVKFVILPIFCTESHGRTMSSLSKTDENLSASLLNITALENSLVVADEKYRFMQKLRNYVTNICDFLQMAVISHESDHDLSCNNCNIKLFHSRPHKQEGGTMQHTYSSSIA

SEQ ID NO: 146020 - protein, 134 aa, Glycine max
  Coding DNA Sequence Number=SeqID_54335
MTDPGSLLLRPGKGSIDVAIVKEFYANLYDPKDKSPKQVRVRVHLVKFDEDTLNTFLKTPVIIEEGETLSAYSRFALLRPNPQELAAKFYILGRGFELNADGQPLEDFKEEHDHTHSDLECSFLLELGPYLPYF

SEQ ID NO: 146021 - protein, 625 aa, Glycine max
  Coding DNA Sequence Number=SeqID_54336
  Homolog annotation: Hit_ID=A5BSR3; Match level="QueryCoverage=43%, HitCoverage=74%, E-value=2e-12, Identity=27%"; Hit description =Putative uncharacterized protein
MTSRGSGPNKENFHSYLGVVARDKIPIVHSTWKVVPETLKNIIGDDILVKFDIPEGTVAKKKMVKRTMIHLLSMLWIKKHGNNLQRVDKPQVGNTKKAQEIQKFNDSPHVLSRGGYDLVEKKWMAEKMKRRQNEAELTENSPMFVDPPSPMARHVKWKKARIKAYGEMTSTIAKEISDKIGTFAPHGRHDILNTALGRVEHPGRVRVAGHGVTIGQFFGQHASGSHNSAASITPNQLVEIIGILKQEWRREVEDENKKTLDIMKKELDAIKSELSQMQTQQLAPVRPPNADALIERVSTKESCAEAAANVAVGDPFAADVTNMGLYIVCSNNIQLVASGKVYGQGGTIHNVPYVDDVVRVYVETIYDGDVKILVGCATESNAVAVKDPLGEMMKIMYDVYLNPVELLWEATQFGLPSIGAKFYITHGDVAEKLGHKCLNISILQLWMMSHWQLFVLCPTENMVVWFCSLLKKLDVHIKAAINSAMKTITTSFEGMAEQGSPRWVEPKSHVQTGGYECAYYVMHWMWCIVTGSLKDEWNKLKKAVRCGEGQRLLLGNTKRIMCVAQIVIFTFVGRLLCCCQPEVEGMLLAYFNCYIIMCSSRLSNPPNNNHGLTTYDYFVAMKEVG

SEQ ID NO: 146022 - protein, 234 aa, Glycine max
  Coding DNA Sequence Number=SeqID_54337
DPPLPPPLQAIAATEHPVTHQHQFLLLFHLPDHQPCFLSMTNVSGITHNSAIASFLTLIKVFLLRELLLMTVNMLIQVMMLEKWSGMTMLTSINLAHASEEDLILLWAFQIGRQIDMAHLVQYRIHKASRANAPLPYPHLVTFFLQYFNVPLDDEPFVKVKHSFAIGAGDVTSFGYRKDMDSQWVRKQDLPPPILDDIGKTWIVSGCASKTYHLPFPMSVHRLHHCNEMPLLLS

SEQ ID NO: 146023 - protein, 62 aa, Glycine max
  Coding DNA Sequence Number=SeqID_54338
MRGTMHEPQANLGEDQKFSPGRLLGIPFRHDNEAGRVRVLSPQSLIPTPQHIPIPVPDTRRV

SEQ ID NO: 146024 - protein, 170 aa, Glycine max
  Coding DNA Sequence Number=SeqID_54339
  Subcellular localization annotation: CTP_CleavageSite=23; ConfidenceScore=5.63e-01
MAIPPSSPPHPPPPTDSTSHSPSTMKRTRKATQLRSLATRLVGAKIPLVHVDLVTWKADSPYKRKLRTYLGIVARDKVDVTYKNWKQVPANQKDLIWKDIQKILQTIGERWRQFKSNLTSKWALAADKDGVDDIVCEKNKFMDEKKKKQLEEAAKSRSTNTMIDPSSPIK

SEQ ID NO: 146025 - protein, 124 aa, Glycine max
  Coding DNA Sequence Number=SeqID_54340
  Pfam annotation: Domain name=zf-GRF; Domain location=28-70; Score =6.5; E_value=0.0051; Accession=PF06839.3; Description=GRF zinc finger
MRFRPRGHRSSNLVLFVARWSASLRRRPSEEAPLVTSWIEDNPRKHFYGCGLYKVTGRKWCNYFEWHDPVANICQKKIIVTLMKKVDELKLREKDLQTKMSDMKMKGKFLGIVLVFSWQRNVIS

SEQ ID NO: 146026 - protein, 409 aa, Glycine max
  Coding DNA Sequence Number=SeqID_54341
  Homolog annotation: Hit_ID=A7PN08; Match level="QueryCoverage=100%, HitCoverage=99%, E-value=3e-94, Identity=48%"; Hit description =Chromosome chr14 scaffold_21, whole genome shotgun sequence
  Pfam annotation: Domain name=DUF1336; Domain location=171-393; Score =366.0; E_value=6.3e-107; Accession=PF07059.3; Description=Protein of unknown function (DUF1336)
MGGCASKPNRKSNVHKREHKKFRKHASLGDITKKRHSNASATRRKSDVSNMKLHLAQLQYQSHSKKDASGKTHEDAWFDSVSIIESESDDDFISVLGDGFPFVTNNALGSVPNTQLLQHENASCLVDSGCKYDRLCDSYFKAGVPERFLCRPRAGLQILNTTQEKPCPSSWSAVSPSVFNLRGEKYFRHVYQFFPLRDKQKCPAPDFSPYIPIGVDLFACPRKLPTYAASMFPGDADGEGMSLVLYFKLSENFDKDTSPHFQESIKRLVDDEMEIVKGLTRESLVPFSERLKFLVGVVNPEDLQLKSAERKLISAYNGKPVLSRPQHKFFKGPNYFEIDLDIHRFSYISRKALDSLRDRTKNVVLNMGITIQAQKQEELPEHVLCCLRLNKIDFANNGQIPTIVALDDN

SEQ ID NO: 146027 - protein, 65 aa, Glycine max
  Coding DNA Sequence Number=SeqID_54342
DSFEEQATQGSFLPHGCQDVLTVAIGCPEHPGRVCAAGAGVTIRHYFGSSPRMSHTSSSLPPEEL

SEQ ID NO: 146028 - protein, 94 aa, Glycine max
  Coding DNA Sequence Number=SeqID_54343
MEKKTTRRRRQREGDETYLGMVAKEKKQRLVMMLECDKHDAQMQNRDLQVVPISFKGKFTKESSQSFASGYEEVVLKMVKAPKTLAFCIICLAN

SEQ ID NO: 146029 - protein, 150 aa, Glycine max
  Coding DNA Sequence Number=SeqID_54344
  Gene Ontology: Mol. function=hydrolase activity, hydrolyzing O -glycosyl compounds; Cellular component=extracellular region; Biological process=carbohydrate metabolic process
  Homolog annotation: Hit_ID=Q2HTE2; Match level="QueryCoverage=93%, HitCoverage=25%, E-value=2e-46, Identity=57%"; Hit description =Sialidase
  Pfam annotation: Domain name=Glyco_hydro_32N; Domain location=3-150; Score=-72.1; E_value=9.1e-09; Accession=PF00251.11; Description =Glycosyl hydrolases family 32 N termi
MTHFWVKPDKLNPVVVDKDVNNTEFRDPTAAWWGKDGHWRMLVGSVRKRRGIAYLYGSKDFMTWVRAKHPIHSKGGTGMWECPNFYPVSVIGNVVVNIVKYVLKNNLDDTKFDYYNVGTYMEDKDRYVPDNTSVDGWGGLRYDYCWIEWP

SEQ ID NO: 146030 - protein, 161 aa, Glycine max
  Coding DNA Sequence Number=SeqID_54345
  Gene Ontology: Mol. function=hydrolase activity, hydrolyzing O -glycosyl compounds; Cellular component=extracellular region; Biological process=carbohydrate metabolic process
  Homolog annotation: Hit_ID=Q2HTE2; Match level="QueryCoverage=85%, HitCoverage=23%, E-value=2e-56, Identity=80%"; Hit description =Sialidase
  Pfam annotation: Domain name=Glyco_hydro_32C; Domain location=15-115; Score=127.7; E_value=3.4e-35; Accession=PF08244.3; Description =Glycosyl hydrolases family 32 C termi
  Subcellular localization annotation: CTP_CleavageSite=53; ConfidenceScore=5.01e-01
MRVCVWQMLKLRSPFQAWTRQRWGSKLQGGVGPFGLLTLATQNLEEFTPVFFRVFKSPNKHIVLLCSDARSSSLKSDLYKPQFAVFVDVDLTVDKKISLRSLIDHSVVESFGAGGKTNILSRVYPELAVMNQAHLFVFNNGTEPIVVQNLKAWSMISTDIK

SEQ ID NO: 146031 - protein, 537 aa, Glycine max
  Coding DNA Sequence Number=SeqID_54346
  Gene Ontology: Mol. function=hydrolase activity, hydrolyzing O -glycosyl compounds; Cellular component=extracellular region; Biological process=carbohydrate metabolic process
  Homolog annotation: Hit_ID=Q2HTE2; Match level="QueryCoverage=99%, HitCoverage=88%, E-value=0.0, Identity=74%"; Hit description =Sialidase
  Pfam annotation: Domain name=Glyco_hydro_32C; Domain location=374 -491; Score=167.6; E_value=3.2e-47; Accession=PF08244.3; Description =Glycosyl hydrolases family 32 C termi
  Pfam annotation: Domain name=Glyco_hydro_32N; Domain location=1-333; Score=473.5; E_value=2.7e-139; Accession=PF00251.11; Description =Glycosyl hydrolases family 32 N termi
  Pfam module annotation: Pfam domain module=Glyco_hydro_32C::Glyco _hydro_32N; Domain location=374-491::1-333
MYYNGVYHLFYQYNPNGTVWGNIVWAHSVSKDLINWNGIEHAIYPSKPFDKFGCWSGSATIIPGKGPVILYTGVIDENNTQVQCYAEPEDPNDPLLRRWVKPDKLNPAVVDKDVNHTEFRDPTTAWWGKDGHWRMLVGSVRKRRGIAYLYRSKDFKTWVRAKHPIHSKGGTGMWECPDFYPVSVIGNVVGNPVKHVLKNSLDDTKFDYYTVGTYLEDKDRYVPDNTSVDGWGGLRYDYGNFYASKSFFDPSKNRRILWGWANECDKPIDNFRKGWAGIQGYLKSQLSSSFDKKFTLPITEFLSVSIDAATGQGTAIPRTVWLDFTGRQLVQWPVEELNSLRGKEVNIDNQRLEKGDYSEVKGITAAQADVEVTFSFSSLDKAEAYDPKWVKAQDLCAQKGSKLQGGVGPFGLLTLASQNLEEFTPVFFRVFKSPNKHIVLLCSDARSSSLKSDLYKPQFAGFVDVDLAADKKISLRSLIDHSVVESFGAGGKTNILSRVYPELAVMNQAHLFVFNNGTEPIVVQNLKAWSMISADIK

SEQ ID NO: 146032 - protein, 66 aa, Glycine max
  Coding DNA Sequence Number=SeqID_54347
MKHGHTAEELCPTSEAHRTCKRVRLRCDAVSVASAVTRHGIALERDSNEGAATAESYAKRGGGGGL

SEQ ID NO: 146033 - protein, 408 aa, Glycine max
  Coding DNA Sequence Number=SeqID_54348
  Homolog annotation: Hit_ID=A5BSR3; Match level="QueryCoverage=18%, HitCoverage=24%, E-value=2e-09, Identity=42%"; Hit description =Putative uncharacterized protein
MEVVKSDLTRKWALAPDTDSVDDTIYEKCGISKEKWAPFCQTHRDTSWEDVHKKAHAIQKQNTAPHVLSRGGYEYLEQKLLAEKTKKKLEEAARSESVDGVIDPPSPIRHHVKWKMASTKKTGEMTTEAAKEITEKIDSFEEQATQGSFIPYGRQDVLTAAIGRPEHPGRVRAAGAAADPTNQGPARGVHHRESDAAVPPDPLVGPSGPRVSTKGSCVDPLGNDPETGDFDRCGLYIEADPACLVAMGRVYEGSTVVHNTPLLPDPVKVSVEEVTDANALVPVPTDEVAVSPAKPPPKPDPEVDDPLYLMTLIIPELFLRPYQVTWDATVFGVFNPDFPLYIKNEDLSKIVHGGQCLSISVLQLHLTDTSMRAGNYDIYGFLEPHALKGLDDAPQPKSKAPARWIVVK

SEQ ID NO: 146034 - protein, 129 aa, Glycine max
  Coding DNA Sequence Number=SeqID_54349
KGEMKDIELVEEEEARISAYSSSATSNKSENYKEEARNAAQKHKAKRVESVNADAEAFGDHWKNKIGDSTVLKIGDSAKVVIKQDMKGGEHKYGFNNNKREKAEKVRVVDDETGEHELYEVLRMPSRCV

SEQ ID NO: 146035 - protein, 61 aa, Glycine max
  Coding DNA Sequence Number=SeqID_54350
  Homolog annotation: Hit_ID=A7PY44; Match level="QueryCoverage=91%, HitCoverage=10%, E-value=1e-16, Identity=80%"; Hit description =Chromosome chr15 scaffold_37, whole genome shotgun sequence
MEDSPEVSDKDIEQDKRLGIVKLPLNDLEPETEKEFELGLLTSLDTLKVKDKKDRGTITIK

SEQ ID NO: 146036 - protein, 244 aa, Glycine max
  Coding DNA Sequence Number=SeqID_54351
  Gene Ontology: Cellular component=chloroplast
  Homolog annotation: Hit_ID=A7PCI4; Match level="QueryCoverage=45%, HitCoverage=16%, E-value=4e-33, Identity=68%"; Hit description =Chromosome chr2 scaffold_11, whole genome shotgun sequence
DDVVGGNEEGEDVGDEVALAIAEDGPVAKVRREVHLLCVEASFMMMNQAMLMMPKAQMIDSRLIQDFKIKHQESNPRFKIQEKKSRSNNSSGAYIHLVVQREQGRVDPLWIFACKGFYKVIGNLNNHWLLGDWTLFNRHITEDVGADLNEGYDTYIPKKDLGSEGFGDLRACVRDKNIPLQNIHFVTFCNNLNKVIIHFGLFDFGILEISKSSGDNLILATAYIRHAPWEMGVHKRNGVVYLDV

SEQ ID NO: 146037 - protein, 105 aa, Glycine max
  Coding DNA Sequence Number=SeqID_54352
MDALLLFYYEKIVGYMPSNFADLVFAGERIEAGLRKGKFNYVASVNPSNGGPKRSGERKKEGEPHVVAAVPAWPNFPLTPYNPMLAKILGGQSLVNSDVVKPYYA

SEQ ID NO: 146038 - protein, 75 aa, Glycine max
  Coding DNA Sequence Number=SeqID_54353
MGHLRSIIFLGRNNQYENTEKGVPMNPKRIKFIPEWPTPPSVEGRSPEYEEPWDLRLNPFQGGGDDAILPPKGIG

SEQ ID NO: 146039 - protein, 118 aa, Glycine max
  Coding DNA Sequence Number=SeqID_54354
MAKCNIHGRGEACYSKMLEKAKEKITKLKVSMLQKCNQELRLITNQNESKLQQLSNHIHSKQKASKRKTYQDTTDTRRGAKSALVPTAARKATSQQTRQTRSKKTYQSVMMAVKRVAL

SEQ ID NO: 146040 - protein, 164 aa, Glycine max
  Coding DNA Sequence Number=SeqID_54355
MAEEQPRRVTLKDYSSTCVPQFFTSIVRPEVQAQNITYPHSLVQLIQGNLFHGLPNEYPYVNLATYIEICNTARIVEKPRGGCIHSKNKLLSKQLKALTKTLNCTICGAAHESSLCISTDENVHEVNYMGNPPRQGYNVGGYSGFQHGLNFNQQQGQWRAHPGN

SEQ ID NO: 146041 - protein, 672 aa, Glycine max
  Coding DNA Sequence Number=SeqID_54356
  Gene Ontology: Mol. function=metal ion binding; Cellular component =integral to membrane; Biological process=protein palmitoylation
  Homolog annotation: Hit_ID=A7QSP4; Match level="QueryCoverage=99%, HitCoverage=98%, E-value=0.0, Identity=53%"; Hit description =Chromosome undetermined scaffold_161, whole genome shotgun sequence
  Pfam annotation: Domain name=zf-DHHC; Domain location=212-283; Score =64.3; E_value=4e-16; Accession=PF01529.11; Description=DHHC zinc finger domain
MRKHGWQLPYHPLQVVAAAVFLALGFAFYVFFAPFVGEKMYQYIVIGLYSPLFNEGFYEAVSVSDKIISVFGLYIWCAAADPGDPGVFKSKKYLKIPDSKKLAELKNSKLGEESSSSMHEVNASIVGAKSVDKEALGTKGTSKDASNSVEKSTLSSCSSCVLLVSSPCAYICSCSSSTEKSSDKQTIEDGMFYCSLCEVETCGGGKIILPQHQCLQNFTITYCYKLMFTLQCLYGKVFKYSKHCRVCDKCVDHFDHHCRWLNNCIGKKNYRQFFTLMVAAMLLFILQWLTGILVLICCFVKRKQFSVDISSKLGTSFSMVPFVIVVSICTILAMIATLPVVQLFFFHILLIKKGLSTYDYIIAMREQEQEQLGNGGQQSPQMSTVSSFTGLSSASSFTTLHRGAWCTPPRLLLEDQFDVVPPETGSVSSLGKKTTREDPLKKKNPGTVKISPWTLARLNAEEISKAASEARKKSKVLQPVTRHGEAISLELENSFGSSGRRMVPRIEGNKKRASKRVHHPADLSMESLTKVSSSNTDKALSGMSRLAPLPIEACSTFQTSQAMSSSAGIVPSSPESSLDSPDIHPFGVSSSSAEKARQLAGPSAAGAATLKEIPLSSSTSDGYEASGGEDSDRVDPSRIVQRSTNWTNLLFRADQDDKAFKMSLSSTSVGYR

SEQ ID NO: 146042 - protein, 165 aa, Glycine max
  Coding DNA Sequence Number=SeqID_54357
  Gene Ontology: Cellular component=mitochondrion
  Homolog annotation: Hit_ID=A7P7D0; Match level="QueryCoverage=91%, HitCoverage=33%, E-value=3e-37, Identity=49%"; Hit description =Chromosome chr9 scaffold_7, whole genome shotgun sequence
  Pfam annotation: Domain name=DUF292; Domain location=2-117; Score =54.3; E_value=4.1e-13; Accession=PF03398.5; Description=Eukaryotic protein of unknown function, DUF292
MRLEMIRNRRNAVQKFLKKDIADLLRSALDYNAYERETNVLGSHSNFSYPITRIVGSSARKDCPVECKEAIQSLIHAAARFSDLPELRELRTLFTGKFGNSLELYISKEFVEKLRQDLPSKEMKIQLLHDVAQEFSIEWNSKALEQRLQSPPQLHEQKYESELDN

SEQ ID NO: 146043 - protein, 89 aa, Glycine max
  Coding DNA Sequence Number=SeqID_54358
MQIVRFGTGFENDGEENVVVGSGVEGEVHEVVERNDDGGGAVGEVVDEEGGVEFFEGGEVYAEPGEVECAGEWRRWRWWCTGGSGGTMG

SEQ ID NO: 146044 - protein, 165 aa, Glycine max
  Coding DNA Sequence Number=SeqID_54359
MCRITCGTFLGDSGSLSRPLGNAVLDGIDFVIENDDPSFYGDLARNLKSHSGKVSTLGIKVYEDDNNGTQIFAIIGHISLDSSEAFSFRCLHTMKIKHTSGIFPLTLMAPSDFFSDLFKVVNYLPMSYSKQVVDMAHCWGGSNPCNACDLLFMSCLVQKTRSKRS

SEQ ID NO: 146045 - protein, 171 aa, Glycine max
  Coding DNA Sequence Number=SeqID_54360
MGSSQKPSLKKRFYQVKIKSLEVTSLRKLGQLMGQLQRQAFAKPMGSTPHWPEFLKSPNLSAGIRPPKASRKWGGRNTEKIFGGSPLSKCGWVGGPGSDRRFLAYHNHKESPVVAMLADLYDTFDRRCEESNARIVCCTPALYVGLVSHLFFQEGRLVYPLQGYRSCVEKG

SEQ ID NO: 146046 - protein, 249 aa, Glycine max
  Coding DNA Sequence Number=SeqID_54361
MTPAEARNLIEKMASNSQQFSARNDAIVVRGVHEVATNPSASSETKKLEGKLDALVNLVTQLALNQKSVPVARGCGLCSSADHHTDLCPSMQQPGAIEQPEAYAANIYNRPPQPQQQNQPQQNNYDLSSNRYNPGWRNHPNLRWSSPQQQQQPAPSFQNAAGPSRPYIPPPIQQQQQPQKQPTVEAPPQPSLEELVRQMTMQNMQFQQETRASIQSLTNQMGQLATQLNQQQSQNSDKLPSQAVQNPKN

SEQ ID NO: 146047 - protein, 64 aa, Glycine max
  Coding DNA Sequence Number=SeqID_54362
  Subcellular localization annotation: CTP_CleavageSite=48; ConfidenceScore=5.24e-01
MRVHCNQASQRPSMITDSPPLLKFPWTRWSRQLSQPTLRREGNAGLAGASSKKGICAESPPTFI

SEQ ID NO: 146048 - protein, 86 aa, Glycine max
  Coding DNA Sequence Number=SeqID_54363
MAQCHILSEHCVPTSFSTRFLKAINLVICSPEHKVPDHHRIQTQTTHGEETSQGHAILQRMLQPCGIDTSLKEHSNRVYLPPWPTL

SEQ ID NO: 146049 - protein, 239 aa, Glycine max
  Coding DNA Sequence Number=SeqID_54364
  Homolog annotation: Hit_ID=Q2HW90; Match level="QueryCoverage=69%, HitCoverage=33%, E-value=5e-09, Identity=28%"; Hit description =Putative uncharacterized protein
MGSNQAPLFKKRFYHVKIKSLEVASLQELGQLMDQLQRQAFRKTYGKIWQRCFMFGDFQLVLTVEEFEEILGCPLGGRKPYLFSGVYPSMERIAKVVKISAQELDRVKQNRNGVVGIPRKHLEEKAKALVDQDEWALFIDVLALLVFRVVLFPNMDGLVYLAAINAFLAYHHSKESLVVAVLVDAYNTFDRRCEKSGARIVYYTPALYVWLVSHLFRHEGRPVCPLYGHRMCPEKGKAN

SEQ ID NO: 146050 - protein, 309 aa, Glycine max
  Coding DNA Sequence Number=SeqID_54365
  Gene Ontology: Mol. function=ATPase activity, coupled to transmembrane movement of substances; Cellular component=integral to membrane; Biological process=peptide transport
  Homolog annotation: Hit_ID=A2YH29; Match level="QueryCoverage=100%, HitCoverage=58%, E-value=1e-158, Identity=91%"; Hit description =Putative uncharacterized protein
  Pfam annotation: Domain name=ABC_tran; Domain location=111-287; Score= 122.1; E_value=1.7e-33; Accession=PF00005.18; Description=ABC transporter
  Subcellular localization annotation: CTP_CleavageSite=50; ConfidenceScore=5.22e-01
MMLGAIGLVFFMANSLGWADSAVAATYSLTLLFLRTPLLQAVGAFPTLVSAEVAFNKLKTLRLAEYQPAFPAAVGRSWQTLELRDVVFHYADTEQQPGFAVGPLNLTLRRGELVFLIGGNGSGKSTLAMLLTGLYRPVSGHIVLDGVAQSAADMPDYRRLFSAIFTDFHQFDRLQGPEGGEPDADLVAIWLERLNMKSKLQFDGTRVTNPQLSQGQRKRLALLLAVAEQRDILLLDEWAADQDPQFRRTFYRELLPELRAMGKTVFAISHDDHYFEHADRLLEMRSGHLRELTGSEREHASRDSVSRIG

SEQ ID NO: 146051 - protein, 43 aa, Glycine max
  Coding DNA Sequence Number=SeqID_54366
MSALKEQMASMMDAMLGMRPLMENHAATAVAVSSAAEALSQLP

SEQ ID NO: 146052 - protein, 31 aa, Glycine max
  Coding DNA Sequence Number=SeqID_54367
MGAKYLLAVKKRLYAIKQWSPEEIRIYNLNR

SEQ ID NO: 146053 - protein, 55 aa, Glycine max
  Coding DNA Sequence Number=SeqID_54368
MTKFCLCVSSGPPPLDDTRVRITGQYDKDYGAADKSKALAPTYPPMRNSDLRSSR

SEQ ID NO: 146054 - protein, 100 aa, Glycine max
  Coding DNA Sequence Number=SeqID_54369
MGQHRYTHHINEIQLTLTQLMSFHHLSRNITSQHYMSHTFSQHSRTQGSKHNITQPINIDQYANVMQQYTKTQSYMQCGIMSMKNLIGRLGIHDNTNHTL

SEQ ID NO: 146055 - protein, 193 aa, Glycine max
  Coding DNA Sequence Number=SeqID_54370
MDERPCGPGMPPTRHPLDPDKFNRALGFPALITGLCQSFGVLVTPRKVIQSPITRAFIEKYCTPSLLVIADAIYLFVGMPPTRHPLDPNKSNRALGFPTLITGLCQSFGVPVTPSKVIRPPITRTFIEKYCTPRQAQGDTPQAIDTLPPPHQTDPAGSLGMERYLQHLVRQQAANHQVQVQIHECLYRFSLSQ

SEQ ID NO: 146056 - protein, 122 aa, Glycine max
  Coding DNA Sequence Number=SeqID_54371
GTSFVVQVEGTSTWVVVTENKRGYTSCGSFQVEDTSTWLFRVNKGGYIPCGSLLVKTKDQAECFDDAKGLHVSQSLPKGYMFLKALCKTKKSKIFKMDDQDSFKSLRKSILNRKGIPIEVAK

SEQ ID NO: 146057 - protein, 135 aa, Glycine max
  Coding DNA Sequence Number=SeqID_54372
MGEVEEVQEKMKADMEATKEQMAMMMEAMMIMKKIMEASAVAVTATSTVAKVNLMPPSGLNQMNHPTSAMVGKDLGSMGSPHDVQIQNEHAFPPCGFPLNYTPPNVAYTPNKNVNNSTPIPIESQQPQADHAHVS

SEQ ID NO: 146058 - protein, 290 aa, Glycine max
  Coding DNA Sequence Number=SeqID_54373
  Subcellular localization annotation: CTP_CleavageSite=31; ConfidenceScore=5.43e-01
MAEPSKKRKGSLSRSQRHSKAQDTPIPSSISSSSLFSSEEQRTRYTNLFSSRSIIDPKFIDMDFFSDESFECIQTFHNSNLIPFMSLKLTVYSELVKAFYSNLEIQESNLISEVYGIKMVIDQSLLYDLTQLSSDGVPFEGALDDDWKFDFSVHDARRLVCTNQADMIGRLLSGIACIEALRLNAPLPYPHLVTLFLLHFNTPLDSEPYVPIKRSFLIGAAVVSSFGYRKEHRWLFGKKMSILDRFDGLQTYVGERFDSLERQVGARFEEMNSRIAKVEEDVTIIHDCLG

SEQ ID NO: 146059 - protein, 95 aa, Glycine max
  Coding DNA Sequence Number=SeqID_54374
VVGASDGSWRRWAATAAVEDDPFLFFDGVKKRKIGLYGMCFGEDLSRIRRFEDLGMEEARGEALAAQQDWFRRSDKPYGNRLQDVVIDYRLPVLV

SEQ ID NO: 146060 - protein, 126 aa, Glycine max
  Coding DNA Sequence Number=SeqID_54375
MHKALWANAPLPYPQLVTLFLRHFLIPLDDEPFFQVKRSFPIGAGAVTSFGYRKDRDGQWLKKDALPPQDEHTPSPPPQRDDSSALMTEVLSELRDGRFEGMDTRITQLEEDVTYLRRSFDLPPPS

SEQ ID NO: 146061 - protein, 58 aa, Glycine max
  Coding DNA Sequence Number=SeqID_54376
GSSRCRVSTENNGGLWWLMVAMGDEESAWDVRNGFGRKKGEGMAFFLSYTKAKAETLK

SEQ ID NO: 146062 - protein, 175 aa, Glycine max
  Coding DNA Sequence Number=SeqID_54377
  Gene Ontology: Biological process=transposition, DNA-mediated
  Homolog annotation: Hit_ID=Q1J7G7; Match level="QueryCoverage=23%, HitCoverage=71%, E-value=3e-12, Identity=74%"; Hit description =Transposase
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPVTTLANWSSTAVAAALELVDPPGCRNSINTKRGVKDKAPNTLPMKGLFVTKLESDE

SEQ ID NO: 146063 - protein, 151 aa, Glycine max
  Coding DNA Sequence Number=SeqID_54378
ATLPEGRKADRYPVSGRVGTGERTRELPGGNACLWKNASNAAFLRFLAFCWPFAHMFFPALSPDSVDNRITAFEKRKSAQYANRLSPRVGRFINAAGTTGFPTGKRAVSATQLIYDHDYEFELGTLGNLLIRTQDNYQQESAEDNMYLGIL

SEQ ID NO: 146064 - protein, 160 aa, Glycine max
  Coding DNA Sequence Number=SeqID_54379
MWAFHKGLQIDWAHLVRYRMHNALRLNAPFPYPHLVTLFLQHFNIPLDSEPYVPIKRSFLISASVIASFGYIKEHDGSWVKKGARNIGEEGHEGEDSSLLLKILERFDGLQAFVGEKFDNLELQVDMRFNEMESRMTKVEEDVSYIRSSFDLPPPPPPSS

SEQ ID NO: 146065 - protein, 99 aa, Glycine max
  Coding DNA Sequence Number=SeqID_54380
MTRPLLRSRFRCPLVVEAAMPATTLSSVAVHARPSISAHRIVTLDGSYCPFSGYFGCPDIIIRDENEPVTVVAVLYQNIDAVPGKRVSDFAQLSGTFLR

SEQ ID NO: 146066 - protein, 328 aa, Glycine max
  Coding DNA Sequence Number=SeqID_54381
  Homolog annotation: Hit_ID=A8XZZ5; Match level="QueryCoverage=41%, HitCoverage=57%, E-value=3e-10, Identity=25%"; Hit description =Putative uncharacterized protein
PHLQRDYSSPPSEEYTCSPLEKLRVLNFIALQALAFRGLHALAFRGLHVLQVRGLHVLPFTERTTREPRLQRTLQHACRGLPVLALRGTPSRRLQIAICPSSLQRATHPHLQRTTRPRLQRATRPRLQSSTHPPLERAKRPCHRRTSRPYLQRSTRPHLQRTTHRCHQRATSHRLQWVTRPTLQRTTGPHLQRTTHPRIQRATRPRLQRTTRPRLQRAAHHRLKRTARLHALTFRGLLVPSEEYTCSPLENYASSTSLHYKPSPSEDYTALALEDYMSSKSEDYTSSPLEDHTSPPSESYTPSPSEDYTPSPSENYTSSPSDHYMSSP

SEQ ID NO: 146067 - protein, 154 aa, Glycine max
  Coding DNA Sequence Number=SeqID_54382
MSKSFEFGMTGSLDEDLLLSHKDGPSGTSTLVFRGLHVLANRGLHALTLRGLCVLTLRGLHVLTFRGLHVLALRGLHVLTFRGLHALTSRGLHVLALRGLHALTSGTSYPHRQRTTRPRLERTTRPHHQRAARPHLQRTTSPRLERATRPHLGY

SEQ ID NO: 146068 - protein, 94 aa, Glycine max
  Coding DNA Sequence Number=SeqID_54383
MAKECGMTKFCLRMSSGPPPLDDKGCRMTKFCLGATSDTAVSEWAKGLHRKMLTSPERAQMTTQAFAHQSHLGSLNDEVRITVRCLRGLPALGS

SEQ ID NO: 146069 - protein, 79 aa, Glycine max
  Coding DNA Sequence Number=SeqID_54384
MSTRSPLKERACNPLQARMCSPLVARTYSPLKIDCPFEKGDNSCNPILSFANLSGNSLRVYVVFYLVTCPFWSDDNGAV

SEQ ID NO: 146070 - protein, 56 aa, Glycine max
  Coding DNA Sequence Number=SeqID_54385
LGSSSSMDSFASWKMNGSGTEKEQREEMPLQGEDESRRSSSPQEAMDKSLKGEGDE

SEQ ID NO: 146071 - protein, 142 aa, Glycine max
  Coding DNA Sequence Number=SeqID_54386
YEGIDSLRSPNNLTINVTEMFKQMMNASFWKMDHARGVSLSPEKFAVGGFGDHYRGRTEMWRAIEPGNETRRMSFVRSKKKYRKQFDAGFLAVAQFHPEWVANIAWSRKRTARWPNVCRLSGLNRASPKDPPNFTTHATMIP

SEQ ID NO: 146072 - protein, 72 aa, Glycine max
  Coding DNA Sequence Number=SeqID_54387
MVAVATYPSAGGRCVTRGMRVPRKEYARSRHQRLFEENVGKTGKDAIYELLSERFGSCIYARGRFFYGYAFT

SEQ ID NO: 146073 - protein, 181 aa, Glycine max
  Coding DNA Sequence Number=SeqID_54388
MKEQMTTMMEVMMSMRKMMEVNMATIITASTATEVDPTHPPGFNQEGKAFGSTLLMHFFQESLTRAVVTWWKDLVAQVVPPSFADLVFIGERIKVGLRRGKFDYLALMNRKPGENGKNKKDGGTHVVIVVPTWPNFPPTQQYQPFSLPTTLSARNTQSSTKATPKLAIKPACRTSDTKNHP

SEQ ID NO: 146074 - protein, 213 aa, Glycine max
  Coding DNA Sequence Number=SeqID_54389
MAPRKLPAKRSRKDKAAEGTSAAPEYDSHRFRSAKHQQRFEAIKGWSFHRERRVQLRDDEYTDFQEKIVRRRWASLVTPMAKFDPDIVLEFYANAWPTQEGVRDMRSWVRGQWIPFDADALSQFPGYPLVLEEGQECEYGQRRNRVNGFDEEAIAQLLCIPGQDFAQTAVGRRVRIMHTNMTTLTQIWMTLLLSNIQPNDHNSDLPSVEVSAG

SEQ ID NO: 146075 - protein, 130 aa, Glycine max
  Coding DNA Sequence Number=SeqID_54390
MGLGKNNGGITSLINTQGNRGKYGLGYKPTSGGHEKKHRGEGKEPVVKALVGDKKSQVVAIYEDDVPSTLDSDLSSSVPTSLPILIHLHVYFFFWNGGSDDESPEGTNTWDPPIDFEQEMNQTEDEGNED

SEQ ID NO: 146076 - protein, 148 aa, Glycine max
  Coding DNA Sequence Number=SeqID_54391
  Gene Ontology: Mol. function=chlorophyll binding; Cellular component =integral to membrane; Biological process=photosynthetic electron transport
  Homolog annotation: Hit_ID=Q2MI75; Match level="QueryCoverage=100%, HitCoverage=48%, E-value=3e-48, Identity=75%"; Hit description =Photosystem II P680 chlorophyll A apoprotein
  Pfam annotation: Domain name=PSII; Domain location=1-148; Score= -155.9; E_value=0.00027; Accession=PF00421.10; Description =Photosystem II protein
LYGPGIWVSDPYGLTGRIQSVNPAWGVEGFDPFVPGGVASHHIAAGTLGILAAFVVAGTMWYGSATTPIELFGPTRYQWDQGYFQQEIYRRVGAGLAENQSSMDNGDGIAVDGDGIVRADVPFRRAESKYSVEQVGVIVEFYGGELNG

SEQ ID NO: 146077 - protein, 106 aa, Glycine max
  Coding DNA Sequence Number=SeqID_54392
  Gene Ontology: Mol. function=DNA binding; Cellular component=nucleus
  Homolog annotation: Hit_ID=B0HC01; Match level="QueryCoverage=31%, HitCoverage=70%, E-value=3e-11, Identity=100%"; Hit description =Putative uncharacterized protein
GGGAYGKTPATRPFYGSWPFAGLLLTCSFLRYPLILWITVLPPLSELIPLAAAERPSAARNSYDHDYEFELGTLEALKLYGRAWRRIEEHVGTKTAVQIRSHAGIL

SEQ ID NO: 146078 - protein, 88 aa, Glycine max
  Coding DNA Sequence Number=SeqID_54393
  Gene Ontology: Mol. function=aspartic-type endopeptidase activity; Biological process=proteolysis
  Homolog annotation: Hit_ID=Q9SJS1; Match level="QueryCoverage=80%, HitCoverage=9%, E-value=2e-10, Identity=47%"; Hit description =Putative Athila retroelement ORF1 protein
MKREKVLCSIARSKVQAQNITYPHSLIQLILGNQFHGFPNEDPYAHLATYIEICNTTRIAGVPEDVVRLNLFSFSLSGEAKRRLHSFK

SEQ ID NO: 146079 - protein, 72 aa, Glycine max
  Coding DNA Sequence Number=SeqID_54394
MDILRDIIGHLSKKLLSFEFGVYEVFNYESLDILRDTIGHRSKKLLSFEFAHSLCFQCQASRYTTGHNRTSE

SEQ ID NO: 146080 - protein, 81 aa, Glycine max
  Coding DNA Sequence Number=SeqID_54395
MATQMSTACYLDKDEIGQSIDVKQYRGTMNIGLWYSRNSRTCTLIGYPIQTLPVLKTDRKSTSGLFQFIGNCLVSDRRRSK

SEQ ID NO: 146081 - protein, 35 aa, Glycine max
  Coding DNA Sequence Number=SeqID_54396
STLEDPRADTDTERRKLGERMGLDTPVVLAVNDGY

SEQ ID NO: 146082 - protein, 111 aa, Glycine max
  Coding DNA Sequence Number=SeqID_54397
  Homolog annotation: Hit_ID=A5BXI2; Match level="QueryCoverage=84%, HitCoverage=6%, E-value=1e-08, Identity=34%"; Hit description =Putative uncharacterized protein
LQFGLQQDIPVDPMNLDLLHQIDMRGNHYTDWMEYLADWINIWKNKHNDVLVGQWVEGIVTHTPAYMEWYRKNTTLFLFVAQQLQDPRTTITQNITGSGVEQTHFEFPHPQ

SEQ ID NO: 146083 - protein, 307 aa, Glycine max
  Coding DNA Sequence Number=SeqID_54398
MGLIIPQDYAEEVANRSIEGQRALRLMPKTLDPSSQKLFLKYMRIFLSFDKFLPQHAPFISREVGPAWFTDYFPTVDPDNEEEVNEIWSFYLNPQILSCRTGVQSNYLGLVGYQPNLVSRQFGLSQIRPKSLFEDPQDVIRGANLSEKTFKKFLKISLDENYDLHPFEFNHSHFCTMGFITWWEKYYSTRSVGDTTTMISRLESGFAQPTVENIRSSLQARSKAPMTKRSAETSRADVRPKKPTGVKIQEGKQEEKSQKKDDSIETTMTSKRSKHAGVELDEEKDARRRGEKSYKKKKVTYDFDQIC

SEQ ID NO: 146084 - protein, 58 aa, Glycine max
  Coding DNA Sequence Number=SeqID_54399
MKHSSKLEGGGHMNSARQLHSWGSEKGGEWRIALREAGCFGLFLFVQVRWDIASRERP

SEQ ID NO: 146085 - protein, 34 aa, Glycine max
  Coding DNA Sequence Number=SeqID_54400
RTREPRLARPQKGRLRQYPRVHPYEKPRDRLIER

SEQ ID NO: 146086 - protein, 69 aa, Glycine max
  Coding DNA Sequence Number=SeqID_54401
MEEDLKKILKFLDSTNATQLGHIKANCPSNEEWPEKSDKKRYDERRTKKRALHGMTMTHSTVPRRRSTF

SEQ ID NO: 146087 - protein, 124 aa, Glycine max
  Coding DNA Sequence Number=SeqID_54402
MSVRSPTLNGFDYIYSPHREGPGCCQYIQRHGRSIDIVCECLTLVAFSHMDATVIFHGEPVVACPSNLPSHGMPISMRPKGPFMHLHEHSLGFLSVCRNLPFGRRATRDSRVRVPRKEYARSRH

SEQ ID NO: 146088 - protein, 161 aa, Glycine max
  Coding DNA Sequence Number=SeqID_54403
MSFWVILVLKRVTSVTLQPEDDTICLRMTRQVGSIVPEFSPRDSHPPPTNPQTMDPSSHHSDSDWPIDIRKAIIDEIQALENNGTWELIPLPPGKTTLKSLPFVCFLLWLPCVTGPSISLILKMPSFMVTLRRRFIWSNLLGLLLRRSMVLCVSYIDLSMG

SEQ ID NO: 146089 - protein, 212 aa, Glycine max
  Coding DNA Sequence Number=SeqID_54404
  Homolog annotation: Hit_ID=A8C977; Match level="QueryCoverage=47%, HitCoverage=14%, E-value=2e-22, Identity=44%"; Hit description =Forisome
MEKRQQRGLFTVPGLLLAFAHMFFLRYPLILWITVLPPLSELIPLAAAERPSAASHWHDRFPDWKAGSERNAINETAMTMITNSSSVPSWVQNFKIAIGKIEKHVINNVDINIEPYQLGESNPDNVPSFWIGLDGKKKNKGCKDKVDCEIQEVVRTLLCLKQDPSGWVVLGRGRNLKILGHAEPMYQTVLGGSSRVDLQACKLGTGRRFTTS

SEQ ID NO: 146090 - protein, 32 aa, Glycine max
  Coding DNA Sequence Number=SeqID_54405
CFRNAFISDYVEILHPSSSFFHVLRSFFVLQW

SEQ ID NO: 146091 - protein, 140 aa, Glycine max
  Coding DNA Sequence Number=SeqID_54406
MNDKEEVQEQMKVDMSALKEQMASMMDAMLGMRQLMENNVATAAAVSLAAEAYPTLPATTHHPIPNVVGRKGAHWGTSATPIRDTTEWLTPMDYHLITRHQSYVMTRVMSLPPSLKGSLLDSRTRLTRIVESMPKETSIP

SEQ ID NO: 146092 - protein, 196 aa, Glycine max
  Coding DNA Sequence Number=SeqID_54407
FVLNAEGLAWKLLRKDLTTLAQTWSILSYFNLAPTLYTSNLNLDRTRLVYGLVMKMDMNVGALISEQITLMAQSNSMRLGFPALITALCMARVVTSDSLTLSPLAVRGSEGPSSVAPQTSTALAPIPSTPVSTISASANYEHGGVFFVGGLARSSAFFSWRSAPPAQEDDSKVTPPESFVPETDPEADPMIAEASP

SEQ ID NO: 146093 - protein, 166 aa, Glycine max
  Coding DNA Sequence Number=SeqID_54408
  Subcellular localization annotation: CTP_CleavageSite=33; ConfidenceScore=5.11e-01
MNIGALISGQMTSIAQSNTSRLGFPSLITELCKARGVVSDSLSFERLSPVINLAYIRKNYWNPEDLIVSIRGARRARARPAKLSSTSTAPTPAPTSAAPSVPAQIDSQHFEAMLQNIHQEQIILLQSLQVVAPPGSIPSVEQFTKMVAWPGTQPSLHREDGGPTAQ

SEQ ID NO: 146094 - protein, 101 aa, Glycine max
  Coding DNA Sequence Number=SeqID_54409
MAPKKLSTKRSRRDATGEGSSAASEFDSHRFQSAKHQQRFEVIKGWSFHRERRVQLREDEHTDFQEEIARRHCTPLVTPMAKFDPEIVLEFYVNAWPTEER

SEQ ID NO: 146095 - protein, 97 aa, Glycine max
  Coding DNA Sequence Number=SeqID_54410
SYNEEKKEMKDCGNTSSRDVSSISRPHNHSQTHLKLSGWLPLPTLVKLPRSGQKVHHQTSPRRNLGIPLVGLTCARTTIRQTDGQRSGRLPGDPDSS

SEQ ID NO: 146096 - protein, 190 aa, Glycine max
  Coding DNA Sequence Number=SeqID_54411
MVSRGGDERDECLFHLGESHDMETCPAVEELLQRLMDWEQLEVSKGGREEPQICMQSEEKKVPPTPKALVICFTRKGTGSTPIYPQTAPKLTSFAYQTNKAIPWKYTPPTFGERVATEVDSLSAKVTNITGLSGVTRSGRVFAPPHSAELPSKGKAPMVQEPTDVATPSKEVDPPMLKGAEKKEGLQGKT

SEQ ID NO: 146097 - protein, 201 aa, Glycine max
  Coding DNA Sequence Number=SeqID_54412
  Gene Ontology: Mol. function=transporter activity; Cellular component= integral to membrane; Biological process=transport
  Homolog annotation: Hit_ID=A6T9G1; Match level="QueryCoverage=100%, HitCoverage=81%, E-value=9e-74, Identity=73%"; Hit description =Binding-protein-dependent transport systems inner membrane component
  Pfam annotation: Domain name=BPD_transp_1; Domain location=49-201; Score=49.0; E_value=1.6e-11; Accession=PF00528.13; Description =Binding-protein-dependent transport s
  Pfam annotation: Domain name=DUF81; Domain location=11-179; Score= -62.4; E_value=0.019; Accession=PF01925.10; Description=Domain of unknown function DUF81
  Pfam module annotation: Pfam domain module=BPD_transp_1::DUF81; Domain location=49-201::11-179
MRGKLLRGCSVFCGLLLLWQLASYSGIPTFLLPSPAAVAEALWNNRSYLASHTLVTLSEILSGMALGVALGMVLALCMTMSPRLQRWVMPLVLTSQAIPVFALAPLLVLWFGFGMSAKVMMAVLVIFFPVTSAFFDGLQRVNRDYLDLARTMGSSFGAQLRHVRLMAALPALGSGLRMAAAVAPIGAIIGEWVGSAEGLGY

SEQ ID NO: 146098 - protein, 172 aa, Glycine max
  Coding DNA Sequence Number=SeqID_54413
LIKVILVASTLTYLPSPEVASSKNSTACIKRSAPTQVHIKKQYQWALQLDVECWVMGTPEKESPKTQEVQASPLEERTFQCCRRSTTMSLQNDCLVSIIKSTFNVGTDLSLFDADGGALDLRTNPFQEGGSDEDITKDHEALEGPMTRGRLKQAQHVIETRLVICIAAIDDD

SEQ ID NO: 146099 - protein, 173 aa, Glycine max
  Coding DNA Sequence Number=SeqID_54414
  Homolog annotation: Hit_ID=A6FJQ2; Match level="QueryCoverage=21%, HitCoverage=84%, E-value=3e-11, Identity=92%"; Hit description=50S ribosomal protein L5
MTVKTSDTCSSRRRSQLVCKRMPGADKPVRARQRMRKEKIPHQAPFAIQAAQLLGRAIGAGLFAITPAGERGMCCKAIKLGNARVFPVTTLTNKRGIEIEIQVMGKSKVLVVGGTGYIGRRIGRETCRASCINESANARGEAVCVLGALPLPRSLTRCARSFGCGERYQLTQR

SEQ ID NO: 146100 - protein, 60 aa, Glycine max
  Coding DNA Sequence Number=SeqID_54415
MVVDVGPKDDQSRKDDRSRSKNEESPEDADRTFPNRHRLNIIGGLNRRNNSGHWSLNSPD

SEQ ID NO: 146101 - protein, 25 aa, Glycine max
  Coding DNA Sequence Number=SeqID_54416
SSDKNQEEFKTQDKVKSQESRFKVQ

SEQ ID NO: 146102 - protein, 110 aa, Glycine max
  Coding DNA Sequence Number=SeqID_54417
  Subcellular localization annotation: CTP_CleavageSite=74; ConfidenceScore=5.14e-01
MLVRMIRTRLFAAARVKSCPGMHSSCVIASLSGCACTVGPPPISGGGLGTVWMWSTLKMRTRSPLKVRACSPLKARMCSPLEVRACSPLLARMCSPLQGEGMQPFVGEDV

SEQ ID NO: 146103 - protein, 81 aa, Glycine max
  Coding DNA Sequence Number=SeqID_54418
MAPNKVFPLVMPFGQNNALKCENMDESILWHLRCTGYHFQKHLGELKLHFNWCMLISGDHQVPPALVEEDIFSSSLMTTLE

SEQ ID NO: 146104 - protein, 41 aa, Glycine max
  Coding DNA Sequence Number=SeqID_54419
MAPKTWSNQASASDRASSIKRCLMLKGYSLLNNAHVCYGVS

SEQ ID NO: 146105 - protein, 153 aa, Glycine max
  Coding DNA Sequence Number=SeqID_54420
MTRGNPSNLQPFDPEIDRTFHRLVRHSVHPTFPKHFVPFEHPEHFVTGESVHFVVGDFEHPDFEHSNFEHFDFEHSENMAQPPPRERTLREMAAPDFTYESLCIQYPDEDVPYVLKTGLIHMLPKFHGLESEEPHKLLKEFHIVCSTMKSPNV

SEQ ID NO: 146106 - protein, 62 aa, Glycine max
  Coding DNA Sequence Number=SeqID_54421
MTIIYLCMSSGSPPLDDKKAQNDHNLSLRAIGHDCVWMAKRRKGVWNDHNLSPDVIGLAASG

SEQ ID NO: 146107 - protein, 151 aa, Glycine max
  Coding DNA Sequence Number=SeqID_54422
MSRNLTDDAIVPSLASGMLRNFTDCALTLPFNSRHVAELHGLPNDGCQVPQSGQVKVASHQIDGPRTKLGTERPTSSKYCRIRSSRLTKGMNDHKTQLSLDGKKVCGMTIICLCMSSGSPPLDDKRAQNDHNLSLRAIGHDRLWMAKRYAE

SEQ ID NO: 146108 - protein, 137 aa, Glycine max
  Coding DNA Sequence Number=SeqID_54423
MKQKEETTKSTQRALQSVEIQVGKLAKEVTQFMFRREKYVVKVEAQKESPAKEHESREKDEEQAQQQWEKYSTVENQQENILQINNLPHQLIVKKGRQGEHEETLSAILSLITNTFLEMIWNVLPNYMKFMEFLAKR

SEQ ID NO: 146109 - protein, 133 aa, Glycine max
  Coding DNA Sequence Number=SeqID_54424
MTVKTCLTHCSLIRRSAQRLSVGEAVMPYWSRQVFRFRARAVEIPVIHRIRVTQERTCDRKQAPFAIQRLQQPVGKRRDRCWAFFAISPPAAATKRDRAARDSSPMSPLHSQELTEPVFSLREAWRFLIAHAV

SEQ ID NO: 146110 - protein, 250 aa, Glycine max
  Coding DNA Sequence Number=SeqID_54425
  Gene Ontology: Cellular component=integral to membrane
  Homolog annotation: Hit_ID=A7PCE2; Match level="QueryCoverage=28%, HitCoverage=17%, E-value=6e-20, Identity=69%"; Hit description =Chromosome chr2 scaffold_11, whole genome shotgun sequence
MTVKTSDTCSSRRRSQLVCKRMPGADKPVRARQRMRKEKIPHQAPFAIQAAQLLGRAIGAGLFAITPAGERGMCCKAIKLGNARVFPVTTLSTLEDPQMACRGCWECLLKLFNFILTLTGLAIVGYGIYLFVEFSKASDDDNTPAISPVSDDSALIQLGRPVLMAVSLSNGRETCRASCINESANARGEAVCVLGALPLPRSLTRCARSFGCGERYQLTQRRNRKKAALLAFFHRLRPPDEHHKIDAQVR

SEQ ID NO: 146111 - protein, 195 aa, Glycine max
  Coding DNA Sequence Number=SeqID_54426
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=26%, HitCoverage=50%, E-value=8e-24, Identity=100%"; Hit description=LacZ protein
MTVKTSDTCSSRRRSQLVCKRMPGADKPVRARQRMRKEKIPHQAPFAIQAAQLLGRAIGAGLFAITPAGERGMCCKAIKLGNARRPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 146112 - protein, 163 aa, Glycine max
  Coding DNA Sequence Number=SeqID_54427
  Homolog annotation: Hit_ID=UPI0000ECBAF8; Match level="QueryCoverage =25%, HitCoverage=48%, E-value=1e-15, Identity=97%"; Hit description =UPI0000ECBAF8 related cluster
VGTGERTRELPGGNACLWKNASNAAFLRFLAFCWPFAHMFFPALSPDSVDNRITAFEKRKSAQYANRLSPRVGRFINAAGTTGFPTGKRAVSATQLIYDHDYEFELGTHMGMLAWHWTSFYNVVTGKTLALPNLIALQHIPLSPAGVIAKRPAPIALPNSCAA

SEQ ID NO: 146113 - protein, 70 aa, Glycine max
  Coding DNA Sequence Number=SeqID_54428
GVANCRNVPFCGRAKARLTGALSKGGKMHGVATNEGISTSHVDKSGALAPTYPPSKRKSDLRSSSLCVNQ

SEQ ID NO: 146114 - protein, 91 aa, Glycine max
  Coding DNA Sequence Number=SeqID_54429
MYNSIITYIGLLYSAHWQMVIILPKENVIIWFCLLHNRSDNYLKGIISSALKELDDTPQSKSKVATRWIVVKCNKKEALSVSITSCTGCQL

SEQ ID NO: 146115 - protein, 140 aa, Glycine max
  Coding DNA Sequence Number=SeqID_54430
MAPRKLASKRSRKDKAAEGTSSAPEYDSHRFRSAEHQQRFEAIKGWSFLWERRVQLRDDEYTDFQEEIVRRRWASLVTPMAKFDPDIVLEFYANAWPTEEGVRDMRSWVRGQWIPFDADAIGQLLGYPLVLEEGQECEYG

SEQ ID NO: 146116 - protein, 80 aa, Glycine max
  Coding DNA Sequence Number=SeqID_54431
IALARHPVDPEKSNRVLGFLALITGLCQFYEAPIAPNKVIRPPINQAFIKKYCAPGRRRARHHSSLGMADSRQQAHRHHL

SEQ ID NO: 146117 - protein, 75 aa, Glycine max
  Coding DNA Sequence Number=SeqID_54432
MSSSPDTMTKCPSTTNFSFWWSVEGMTPTEWIHGRPKRQLYGGLSIQGGRSLPSPLGGCRRRHGPPWNLALDGKR

SEQ ID NO: 146118 - protein, 142 aa, Glycine max
  Coding DNA Sequence Number=SeqID_54433
IAPARHPVDPEKSNRVLGFSALITGLCQFYRVLIAPNKVLRPLLTGLSSRSTVPPGRCRARHHGSGQQTHRHHLWSSPQLIHKKVARYLRYAYVISGVATCPSRASEGEAHGCAFQRRKDARSRHQCLFLENVGKTEGNRSR

SEQ ID NO: 146119 - protein, 165 aa, Glycine max
  Coding DNA Sequence Number=SeqID_54434
MAPTRHPLDPDKSNRALGFPALITGLCQSFGVPITPSKVIWPPITRAFIEKYCTQRQVPGDAPQAADAPPPHQAGPAGLFDTEQYLRHLVRQQAANHRAHPAEPGLYFFSVPYSGPVQGRGRMPGDWPEAQAGEAPAEAPDEADEAREDEEMTDLLDFLGGSRAT

SEQ ID NO: 146120 - protein, 95 aa, Glycine max
  Coding DNA Sequence Number=SeqID_54435
LSKKFTETHGLRKNTSFRFPPHYGISRIAQACFLLISETSRDFIYCMSSIEIKSESTDKSFKVNGHRLKPFLTNPSLVDVVVEETSILYPTSLPP

SEQ ID NO: 146121 - protein, 167 aa, Glycine max
  Coding DNA Sequence Number=SeqID_54436
  Homolog annotation: Hit_ID=A6FJQ2; Match level="QueryCoverage=22%, HitCoverage=84%, E-value=3e-11, Identity=92%"; Hit description=50S ribosomal protein L5
MTVKTSDTCSSRRRSQLVCKRMPGADKPVRARQRMRKEKIPHQAPFAIQAAQLLGRAIGAGLFAITPAGERGMCCKAIKLGGVVLAEVLLADSRFTRPDMGFHPTKLNFVPSDADEAPLDVSICLHAFGIVGCGSFSGVKSCEREDPFHPGLFVGDAGGFQSPTREP

SEQ ID NO: 146122 - protein, 157 aa, Glycine max
  Coding DNA Sequence Number=SeqID_54437
  Subcellular localization annotation: CTP_CleavageSite=85; ConfidenceScore=5.04e-01
MTDPLNESISCFLIKRTTRPHLQRATRPHLQRATRPHLQRATHPRLQRDTRPHLQRTTRPPLQRTTCPHLQRTTRPHLQRITCPRLQRAAYPHDEDMTKSKGKDQLEGVGGPMTRARARKAKEALQQVLSILFEYKPKFQGEKSKVVSCIMAQMEED

SEQ ID NO: 146123 - protein, 39 aa, Glycine max
  Coding DNA Sequence Number=SeqID_54438
MAITQATWLQMRLFQNENKVEDERKERITLSGEGNTQML

SEQ ID NO: 146124 - protein, 219 aa, Glycine max
  Coding DNA Sequence Number=SeqID_54439
MKTKPLANHGGAAVNVVESDRPRRSKPLKDVTTPMRFIYKALQKGGVIPHGGHEEDSCLLHPDKLHNMETCLAVEDLLQQMIDQGRLEVGDKGREEQHISPQKPRYPSVVKPVPFPYRNSHAVPWRYAPPSERKEEATDISSLSAKVTNITGLSGVTRSGHVFAPPDLSTQPTNVKGKAKMVEEQNDKTTLTPNEDTPVKGLPEKRDGCGKKEVSLGIL

SEQ ID NO: 146125 - protein, 79 aa, Glycine max
  Coding DNA Sequence Number=SeqID_54440
MAQPPPRERTLREMAAPDFTYESLCIQYPDRGVAKNWLYYLAPRSIFSWDDLKRVFLEKFFPASRTTAIRKRHFRHQAT

SEQ ID NO: 146126 - protein, 150 aa, Glycine max
  Coding DNA Sequence Number=SeqID_54441
VTPTRHPVDPEKSNRALGFPALVTGLYQSYRVPIPLARSRHHDIGKFAGIAPARHPVDPEKSNRVLGFPALITSLCQFYGVPVTPSKVIRPPTNRVFIKKYCAPMQAEGETPQQPGDGQQQAANAPPPPPEPLSSSTKRLEYCLRHMADQ

SEQ ID NO: 146127 - protein, 87 aa, Glycine max
  Coding DNA Sequence Number=SeqID_54442
  Homolog annotation: Hit_ID=A6FJQ2; Match level="QueryCoverage=43%, HitCoverage=84%, E-value=3e-11, Identity=92%"; Hit description=50S ribosomal protein L5
AYHEALRLARFGDDGENSDTCSSRRRSQLSMRKEKIPHQAPFAIQAAQLLGRAIGAGLFAITPAGERGMCCKAIKLGNARVFPVTTL

SEQ ID NO: 146128 - protein, 340 aa, Glycine max
  Coding DNA Sequence Number=SeqID_54443
  Homolog annotation: Hit_ID=Q84VI1; Match level="QueryCoverage=99%, HitCoverage=49%, E-value=1e-141, Identity=78%"; Hit description =Envelope-like protein
MATSPKETSASGSPAVPSSPHQEQPEFNIQPIQIIPGQASVPEKLIPRRQQGVKIAENPSPATSPREVDTEMDKKIRGIVSSILKDASVPDAEKDVPTSSTPNVSVPDVNKDVPTSGARNAEALPSPSEEESTEEEDQASEETPAPRAPEPAPGNLIDLEEVESDEEPIANRLAPGIAERLQKRKGKTPLKRSGRIKTMAQKKSTPITPATSRRSKVAIPSKKRKEISSSDSDDDVELDVATSKKAKTSGRKVPGNVPDAPLDNISFHSIGNVEKWKYVYQRRLAVERELGRNALDCNEIMDLIKAAGLLKTVSKLGDCYEGLVREFIVNIPSDISNQKK

SEQ ID NO: 146129 - protein, 88 aa, Glycine max
  Coding DNA Sequence Number=SeqID_54444
MTDRGRRGFFVRAQSTFCCGRNWHIRIYAARKALAHLGKKIFFTDNDRKKCQSTSARKDRPIEVKKETSPMTPIEHFLSDIMHISLRD

SEQ ID NO: 146130 - protein, 169 aa, Glycine max
  Coding DNA Sequence Number=SeqID_54445
MEAMKEQMAAMMEAMMSVKKIMEANAVAIAATSVVAKVNLMSPSGINQMNHPTSYMVGKDLGSDFEPCLGYATEGQAVGGIPLQNTLKGPQYHPQLHLLPSTTSKNPHPMAKVEKLDHLEERLRAIEEGEDYAFANLEELFLVPNIITPPKFNEPEFDEYKGLLAPRTI

SEQ ID NO: 146131 - protein, 68 aa, Glycine max
  Coding DNA Sequence Number=SeqID_54446
DLEATTIPEEEPQSSEACSSFAIAEHSHLDPTEDYIMAEEPRRVTLEYYSSSNVPQFFTSIAQPEVQA

SEQ ID NO: 146132 - protein, 275 aa, Glycine max
  Coding DNA Sequence Number=SeqID_54447
  Gene Ontology: Mol. function=chlorophyll binding; Cellular component =integral to membrane; Biological process=photosynthetic electron transport
  Homolog annotation: Hit_ID=Q2MI75; Match level="QueryCoverage=100%, HitCoverage=68%, E-value=1e-139, Identity=73%"; Hit description =Photosystem II P680 chlorophyll A apoprotein
  Pfam annotation: Domain name=PSII; Domain location=1-269; Score =285.2; E_value=1.3e-82; Accession=PF00421.10; Description =Photosystem II protein
LYGPGIWVSDPYGLTGRIQSVNPAWGVEGLFHLSVRPPQRLYKGLRMGNIETVLSSSIAAVFFAAFVVAGTMWYGSATTPIELFGPTRYQWDQGYFQQEIYRRVGAGLAENQSSMDNGDGIAVGWLGHPVFRDKEGHELFVRRMPTFFETFPVVLVDGDGIVRADVPFRRAESKYSVEQVGVIVEFYGGELNGVSYSDPATDRATLKSDGVFRSSPRGWFTFGHASFALLFFFGHIWHGARTLFRDVFAGIDPDLDAQVEFGAFQKLGDPTTKKQ

SEQ ID NO: 146133 - protein, 349 aa, Glycine max
  Coding DNA Sequence Number=SeqID_54448
  Gene Ontology: Mol. function=receptor activity
  Homolog annotation: Hit_ID=Q26BL8; Match level="QueryCoverage=100%, HitCoverage=69%, E-value=1e-50, Identity=38%"; Hit description =Putative uncharacterized protein
  Pfam annotation: Domain name=SusD_RagB; Domain location=105-349; Score=51.4; E_value=3.1e-12; Accession=PF07980.2; Description=RagB, SusD and hypothetical proteins
MKDPNALGVMLIEDVPELTETKPRVANSQIFALIDADVAFAESNLTTSGDYYRITKNFLNAFKARYYLYRGMYPQAKAAAQAVLNTSGLSLTVASPPNPDTGNPRELIFSLNRPQLQSWGNIVTLFATNASQANGSILYDMGRKTFNLYASTPGDIRRFAYIDPTAVINSNYAAIDNYRALDVLVIDKYPGRATLAPDPIPTDPTREKVLSQNVLRNDIPIFRLSEMYFILAECAVEEGSFTTAATLIKNVRDARNYLGPVDLPVYSSKQQAYVDILLERRKELYLEGHRYLDLKRLGAIAGVAIDRDPTDDVKTIPVTIPINDYRMRSLPIPRAELQGNPTIQQNPGY

SEQ ID NO: 146134 - protein, 193 aa, Glycine max
  Coding DNA Sequence Number=SeqID_54449
  Homolog annotation: Hit_ID=Q84VH5; Match level="QueryCoverage=94%, HitCoverage=28%, E-value=5e-77, Identity=79%"; Hit description =Envelope-like protein
MIPGSAPVPEKLIPKRQQGVKIAENPSLATSPREVDTEMDKKIRSIVSNILKNASVPDADEDVPTSSTPNVSVPDVEKDVPTSSGPNAEVLSSPSKERSTEEDDQATEETLAPRAPEPAPGDLIDLEEVESDEEPIANRQKGKTPIKRSGRIKTMAQKKSTPITPTTSRRSKVAIPSKKRKEFPHLILMMMSN

SEQ ID NO: 146135 - protein, 96 aa, Glycine max
  Coding DNA Sequence Number=SeqID_54450
MSYRMSRHHASEHADCMCPYEQIKQVNNTRELLTQFGAPHLHLGATKPGRKSTLNSVSSSLHDYIAVYDSGLQVLDAGGDLSSSEKSAVKELKDNF

SEQ ID NO: 146136 - protein, 185 aa, Glycine max
  Coding DNA Sequence Number=SeqID_54451
  Homolog annotation: Hit_ID=Q2HTA0; Match level="QueryCoverage=88%, HitCoverage=25%, E-value=3e-21, Identity=36%"; Hit description=IMP dehydrogenase/GMP reductase, related
  Pfam annotation: Domain name=DUF1723; Domain location=96-145; Score =56.0; E_value=1.3e-13; Accession=PF08330.1; Description=Protein of unknown function (DUF1723)
MTGAVDAIQTEGVATDGSLGSPAADEGFPGGPRDPSILTDFAVHVAHSIWSGQEQPDLKLVSHGRKVDKIGRPAPEIEGLIAGTELSPLIRCSIITTDSGLISAFIERWHRKTSTFHLPVGELTIMLDDVASLLHLPITGALHTFEPLVTSDAIGLLTELLEVSHEEVTFETRQAGGPHVRLGWL

SEQ ID NO: 146137 - protein, 81 aa, Glycine max
  Coding DNA Sequence Number=SeqID_54452
  Subcellular localization annotation: CTP_CleavageSite=75; ConfidenceScore=5.52e-01
MRGYPMVTRTIGPPGANESVGARRLTSSSAPFVVLTRESSDMRGYLMVTRTFRQPGAKNPVDVRKLTSSSAPFVVLTREVK

SEQ ID NO: 146138 - protein, 185 aa, Glycine max
  Coding DNA Sequence Number=SeqID_54453
MKDKRDEEEKLEKQKKKKDSKALSSKAKGKEKEEKDSSKKIVKKENHFATKGDIKRALLLKQSFYLLLSRETSLSTVIPLELEVITQVKELLDEGLVHKSLNPCALLVPKIGIMRHQIPMIGAPLIELVRNHVPSWKMPRKWGDGMMQSYPSRALNRRLQEDWARDAREGAMVLMSLRVDFGPVG

SEQ ID NO: 146139 - protein, 174 aa, Glycine max
  Coding DNA Sequence Number=SeqID_54454
GELGLSGAKPEETLVEARSDTDVQIVRLTWVGRCGCSVEPRHGIESSKWAIFGKQNWRCGMNRKLGYGAQLRANLDPTKGVGRLRQQDGGHGSRNPLRRRGGRCKTQGASPGGAVVGADLGGSSKYSTENFEGRRGERDGGSPSDSALCAYSERESGKIPEPDVAADGNVRSPE

SEQ ID NO: 146140 - protein, 207 aa, Glycine max
  Coding DNA Sequence Number=SeqID_54455
  Homolog annotation: Hit_ID=Q2HW90; Match level="QueryCoverage=33%, HitCoverage=14%, E-value=2e-09, Identity=40%"; Hit description =Putative uncharacterized protein
MGQLQQQAFRKAYGKIWDLATIEVSVEVIASLTQYYDQPLRCFTFEDFQLVPTMEEFEEILGCPLGGRKPYLFSGFYPSIARATKAKALENQGEWTSFIDILALLIFGFILFPNVEGLVDLALLTLSSPFTIARKARSSPFWPTWMTRLTGGPFVRYKVIARAPRKERRIGTNSYLAWRGRPLIGSLAGRKEEPGLCPRAKDFQMFP

SEQ ID NO: 146141 - protein, 153 aa, Glycine max
  Coding DNA Sequence Number=SeqID_54456
MAPTRHPLDPDKSNRALGFPTLITGLCQSFGVPVAPTKAAGAPPPPHQAGPARSFDMEQYLRHLVRQQAANHRAHVQTHDCLYQMSLDMQSQGFASFSCPTPDQFRAEVAWPGDWPEAQAGEAPPEAPGDGEEAHEDEETADLLDFLGGSGAT

SEQ ID NO: 146142 - protein, 192 aa, Glycine max
  Coding DNA Sequence Number=SeqID_54457
MTQELVARGDTLRLSAPRHSVTPSVIDEQRPIWSSAPFSEMSAFSDGDFSSLTNYLELQAAGPMIHGDTLRLSAPLCHPEAAGPMIRGDTLRLSAPFCHPEAAGPMIRGDTLRLSAPFCHPEAAGPMTSRDTIWSFCTLVSSRGGGPDDTRRYLTVIRTLVSSRGGGPDDTRKYPSGYPYKHSFAICQTERL

SEQ ID NO: 146143 - protein, 91 aa, Glycine max
  Coding DNA Sequence Number=SeqID_54458
  Subcellular localization annotation: CTP_CleavageSite=39; ConfidenceScore=5.20e-01
MRLLAQRMDSSGALSGMNPRSANMHISSFFQALPCAPPRSVALSGWLAKLADWLSEWMKISTSQTCLINLKLRGIDIKTHKMKVSKQRLCP

SEQ ID NO: 146144 - protein, 128 aa, Glycine max
  Coding DNA Sequence Number=SeqID_54459
  Homolog annotation: Hit_ID=A6FJQ2; Match level="QueryCoverage=29%, HitCoverage=84%, E-value=3e-11, Identity=92%"; Hit description=50S ribosomal protein L5
MTVKTSDTCSSRRRSQLVCKRMPGADKPVRARQRMRKEKIPHQAPFAIQAAQLLGRAIGAGLFAITPAGERGMCCKAIKLGNARDRAHKTPSGPGEVQQGPGVSNSGYGPLSVLQGARSPQQGHAIMT

SEQ ID NO: 146145 - protein, 61 aa, Glycine max
  Coding DNA Sequence Number=SeqID_54460
  Pfam annotation: Domain name=G-patch; Domain location=2-43; Score =22.8; E_value=0.00034; Accession=PF01585.14; Description=G-patch domain
MMVARVMLGNGYEPGMGLGKNNGGRTSLVSTRGNHGKFGLGYKPTQADLRNSVAGRKSRSQ

SEQ ID NO: 146146 - protein, 795 aa, Glycine max
  Coding DNA Sequence Number=SeqID_54461
  Gene Ontology: Mol. function=two-component sensor activity; Cellular component=membrane; Biological process=signal transduction
  Homolog annotation: Hit_ID=Q31IU7; Match level="QueryCoverage=47%, HitCoverage=59%, E-value=1e-104, Identity=49%"; Hit description =Putative integrase
  Pfam annotation: Domain name=Phage_integrase; Domain location=172 -306; Score=-23.6; E_value=0.058; Accession=PF00589.13; Description =Phage integrase family
MIRATKATRIDDLMLIGYRSSLDEAHEHHLGHVSVLLRKWHKLGYPGVSKNVVCLLEGWRLKGGRKGDAVKRLDPLKGPLTDNELQAFNESVVRAYENSLITIAELAMALSVSHTGRRSIQISHLRVVDILCGENEKGEPFYVLNVPRAKQRNSFFRESFKPYAMTLELWAVLSAQAKNAITLVENRLGIELQEADRQQIPLFPDLDVLATIKSPYELRQLLATDKLNIAASVITKTLHLIVEETDIRSERTGELLHINASRFRYTTGTRAAREGFGELVIAELLDHTDTQNAGVYIKNIPEHVKKLDEAVGFQLAPYAQAFVGVLVDSERDAHRGNDPTSRIRTEMGQGVGTCGEHGFCGANVPIPCYTCMHFQPWLDGPHEDVYQGLLNERERVKEITGDIQIAAVLDRSIIAVADFKPKATLTAAENLKAFISKCRDQLTVFGSDIDWEEPVWPNITVFAKLGVITRKPVQGEVQDPEFIDFAKAYFRYQQGHHPTGTKNESKALRAVEASLLQLNWQGSHYSDGAAYSCGREIERLAKFVVENQLVPNAIQDWVNPIQRAEDKNKTGKEAKKNREEKLPSDTALNALAEIFANDPIHERDIFTTSVFAMLMSAPSRISEVLALPVDCEVFETDREGIERYGWRFFAGKGYEGDIKWIPTVMVGIAKTAVTRVRLLSENARQLAKWIEKHPDKFYRHANCPDVADDVPLTMVQTCMALGFAHDSQKTCRSCLGSRGLAKGDGVHTLNSLWQHTMERLPEGFPWFDKNKGIKYSNALFALNVNQFHGNRGCLP

SEQ ID NO: 146147 - protein, 115 aa, Glycine max
  Coding DNA Sequence Number=SeqID_54462
  Homolog annotation: Hit_ID=A6FJQ2; Match level="QueryCoverage=33%, HitCoverage=84%, E-value=2e-11, Identity=92%"; Hit description=50S ribosomal protein L5
MTVKTSDTCSSRRRSQLVCKRMPGADKPVRARQRMRKEKIPHQAPFAIQAAQLLGRAIGAGLFAITPAGERGMCCKAIKLGNARVFPVEKLREMSPLYEFIKEGINIKDIQWAQD

SEQ ID NO: 146148 - protein, 76 aa, Glycine max
  Coding DNA Sequence Number=SeqID_54463
  Homolog annotation: Hit_ID=Q2HTR6; Match level="QueryCoverage=89%, HitCoverage=16%, E-value=8e-08, Identity=33%"; Hit description=RNA -directed DNA polymerase , putative
EWTDEPNKVKEEIKTFFSNTFQDVDVQRPKIDGISFKTIDQPQNSMLVTPFQEIEIQNVVWECGNDKSPGPHGINF

SEQ ID NO: 146149 - protein, 115 aa, Glycine max
  Coding DNA Sequence Number=SeqID_54464
  Homolog annotation: Hit_ID=A6FJQ2; Match level="QueryCoverage=33%, HitCoverage=84%, E-value=2e-11, Identity=92%"; Hit description=50S ribosomal protein L5
MTVKTSDTCSSRRRSQLVCKRMPGADKPVRARQRMRKEKIPHQAPFAIQAAQLLGRAIGAGLFAITPAGERGMCCKAIKLGNARAVFNEKLYKYAQVDQMEPGCDDDGVEVQHLT

SEQ ID NO: 146150 - protein, 245 aa, Glycine max
  Coding DNA Sequence Number=SeqID_54465
APVPVPTDEVSLVGQALHTFLAWPTHLVKSLSQQVAVSPAKPPPKPDPEVDDPLYLMTLTIPELFLRPYQVRWDATVFGVFNPNFPLYIKHEDLSKIAHGGQCLSISVLQLWILHLTETCMRAGIMISMDSSSHSPFKEFKMGCLSWSLPKWRTLADGGHCAQGTPSCLLLLAWNNALKYLDDVPQPKSKAPARWIVVKSNRQKGSTECDYYVMHWMSTIILGSFSNNLEAYFNDPKPLEPKRLK

SEQ ID NO: 146151 - protein, 240 aa, Glycine max
  Coding DNA Sequence Number=SeqID_54466
  Homolog annotation: Hit_ID=A5BP60; Match level="QueryCoverage=85%, HitCoverage=90%, E-value=8e-18, Identity=27%"; Hit description =Putative uncharacterized protein
  Pfam annotation: Domain name=zf-CCHC; Domain location=197-214; Score =27.7; E_value=4.3e-05; Accession=PF00098.14; Description=Zinc knuckle
MASTNFLFPEGNSINRLPIFNGEGYHYWKTRMQIFIEAINLNIWGAIEIGPYIPTTVERITIDGSTTSESITLEKPRDRWMNANESIQDMQKRFTHIVNHLAALRKEFQNEDLINKEHEMELLRLNQHEENDKKKKGISLKASSSIQEESDKEIDLDEDDDLSLFVKRFNKFLKVRGNQRRPNFKSKRRTETSSSTPKCFECNQPGHLRVDCPIFKKKMEKPEKKNFSEKKLKKAYITLG

SEQ ID NO: 146152 - protein, 72 aa, Glycine max
  Coding DNA Sequence Number=SeqID_54467
AAEGKKDTFCLSRRMELAYGLRFEINYPIPSDKSNYTLSLWPEKGSEIAEPEPKLLRWNGMANILPTDMGNL

SEQ ID NO: 146153 - protein, 137 aa, Glycine max
  Coding DNA Sequence Number=SeqID_54468
MERSMIDAASGGALGDMIPVEDRNLIEKMATNSQQFSAKNDAIVIRGVHEVATNSSASSETKNLEGKLDALVSLVTQLALNQKSTPVTKLCGLCSSADHHTNLCPSVQQSEAIEQPKAYAANIYNRPPQPQQQNQPQ

SEQ ID NO: 146154 - protein, 154 aa, Glycine max
  Coding DNA Sequence Number=SeqID_54469
MTSRDQVWSFCTLVSSRGGGPDDTRRYLTVIRTLLSSRGGGPDDKQRPKAAGPMTSRDQVWSFCTLVSSRGGGPDDTRRYLTVIRTLLSSRGGGPDDKQRPKAAGPMTSRDQVWSFCTLVSSRGGGPYDTRRYLTVIRTLLSSRGGGLDDKQRP

SEQ ID NO: 146155 - protein, 201 aa, Glycine max
  Coding DNA Sequence Number=SeqID_54470
MFKSSTIRIRKENAKLRDVNIATTKALEQETKRARREKHGRNKFRGALWGTNSELKLRREERDQSRVDSLILKDELRICLRSKRNLSQRLCETETNMLAIISKYQEELNLATAHEHKVVDEYARVYAEKEARGRVIDLLHQEATMWMDRFALTLNGSQELPRLLAKAKAMADAYSAPEEIHGLLSYFSHMIDLMAHIIRNL

SEQ ID NO: 146156 - protein, 145 aa, Glycine max
  Coding DNA Sequence Number=SeqID_54471
MQRIDVLNVSITYKHGLRNRNERGHWQLVVLCPATNVVAWFCSLHVDHAIIISSAMKSTNTTADGTNNPATPKWIEVKSHVQSRGYECGYYVMHWMWNIISGGLKNDWSMWFLDGTVLDNETITTIRQKWAEYFLKVQSNQCTKS

SEQ ID NO: 146157 - protein, 96 aa, Glycine max
  Coding DNA Sequence Number=SeqID_54472
MNKIRNGQDKGKWITTKVRAALDEHWGSTYFLNKSSTAKANRSIDRGASTYCGGSISTATHFEKLSKEFQRLPTAWEVMEKTKKLKSREWVNDRSR

SEQ ID NO: 146158 - protein, 93 aa, Glycine max
  Coding DNA Sequence Number=SeqID_54473
MYPPLELIHKRCTLSCSQSTTQVDVPSTCTTKDGCKRILRRLVFGEFFLAKGEEMKRKNSTSFQGLEKPENFGKLLAQRRRRSSKRFKACKGL

SEQ ID NO: 146159 - protein, 106 aa, Glycine max
  Coding DNA Sequence Number=SeqID_54474
  Subcellular localization annotation: CTP_CleavageSite=14; ConfidenceScore=5.07e-01
KTPSGPGEVQQGPRVSSSGYGPLSVLQGARPPRITPARHPVDPEKPNRVLGFLALITGLCQFYEAPVTPTRSLGPPLTRAFIKKYCAPDGRRARHHSSIGMAGSGQ

SEQ ID NO: 146160 - protein, 144 aa, Glycine max
  Coding DNA Sequence Number=SeqID_54475
MRLGRAIGRVVGRDRPADEDAADVPERRRPTASACRQRVHQMTTEGRDMAEDVADMIDDVPEQAAEAPEMRADAEGADSGEGSDGDDAAEGFPGGPRDPSVLTSFAEHVAYAVWSGQERPDLKLVSHGRKVTLIGRPVPEIKGL

SEQ ID NO: 146161 - protein, 52 aa, Glycine max
  Coding DNA Sequence Number=SeqID_54476
MEVFITFSTNKRWWRLRAFSSFGRRTREPCLARPQKGRLRQLATPLGTIFVS

SEQ ID NO: 146162 - protein, 69 aa, Glycine max
  Coding DNA Sequence Number=SeqID_54477
MCFGQSFSTSALFSWFRLGGVDHPVMRGTRIRATWGYVSLVESGQLVMVGSCLICGCGRVDLHHRPIAT

SEQ ID NO: 146163 - protein, 203 aa, Glycine max
  Coding DNA Sequence Number=SeqID_54478
  Homolog annotation: Hit_ID=Q2HW90; Match level="QueryCoverage=52%, HitCoverage=20%, E-value=4e-12, Identity=40%"; Hit description =Putative uncharacterized protein
MGTNQTGKRFYQVKVKSLDTTSIKELGRLMEPLQMQAFRKTYEKILELTIAETRNSIAGLPRKYLEDKARGMANQGDWVPFMDVLALLIFGVVLFPNIDGLVDLAAIDAFLAYHHSKESPVAAVLADLFDTFNRRCEKSSARIICCLPTLCVWLVSHLFQQDTRHPCPLQSHRSCTEKRRIDWDQLLAGIGGRTINWFPRWKE

SEQ ID NO: 146164 - protein, 253 aa, Glycine max
  Coding DNA Sequence Number=SeqID_54479
MWQLKEFYANLYVPDDKFPKQVRVRGHLIKFDVDSLNTFLETPVVVEQGESLPCYSRFARLRPDPQELAARLCIPGRGFVLNAEGLLWKLLRKDLTTLAQTWSVLSYSNLAPTSHTSDLNLDRAKLVYRLVMKMNMNLGSLISGQISLIAQSNSSRLGFLALITALCKGQGVTSNSLSFESLNPTINLAYIKKNCWNLDDPSVTFPGIQKSKARRYEAPSTSAAPAPTPSTSAPSTSALPSPVAASILPGPSA

SEQ ID NO: 146165 - protein, 91 aa, Glycine max
  Coding DNA Sequence Number=SeqID_54480
MGKAHTTKSPSDPEEVHRALRFPVLVTGLYQSYGVPVPPRQGHVIIGIATARPLVDPKKSTRVLELSSSNYGFLSVLRCTCHLHQGHQAPY

SEQ ID NO: 146166 - protein, 139 aa, Glycine max
  Coding DNA Sequence Number=SeqID_54481
  Homolog annotation: Hit_ID=A0ST23; Match level="QueryCoverage=32%, HitCoverage=91%, E-value=1e-11, Identity=73%"; Hit description =Putative reverse transcriptase
MTVKTSDTCSSRRRSQLVCKRMPGADKPVRARQRMRKEKIPHQAPFAIQAAQLLGRAIGAGLFAITPAGERGMCCKAIKLGNARVFPCGPSRQGTELEFVIMVIAVSFGKPVVPAALMNRPTRGERRFAYWALFRFLAH

SEQ ID NO: 146167 - protein, 56 aa, Glycine max
  Coding DNA Sequence Number=SeqID_54482
GKRAMKERVRGAQRVFEGYDAIKEQARVSLLCAPNSGTKLKVSKSPLLVIIPKGTF

SEQ ID NO: 146168 - protein, 182 aa, Glycine max
  Coding DNA Sequence Number=SeqID_54483
MASRKRKSTASRPQAQIVSEWNAKIYYTKFDKFKAKLERRNLQKRLANLQDGSIDVAVVKEFYANLYSPEDQSPKKVRVRGHLIKIDADSLNTFLETPVVLEEGETLPTYSRFTRMRIDPQEFAARLCIPGRGFVLNAEGHPWKLLRKDLTTHAPTWSVFSYSNLKTTSHTSDLNMDKARLV

SEQ ID NO: 146169 - protein, 62 aa, Glycine max
  Coding DNA Sequence Number=SeqID_54484
MGLVVCLSQTSQGSQGHAIRPTSGVLRTESFNKGVEAFYGHRWKSIVPGQCCPLEGHREDTT

SEQ ID NO: 146170 - protein, 92 aa, Glycine max
  Coding DNA Sequence Number=SeqID_54485
GSRLQDTQWTRRSPTGSWSYQALITGLSQFYRVPVAPDKVIRPPTNRVFIKKYCVPWQAQGEIPQQPGDGRQRATDAPPSPLEFTSAHPQKG

SEQ ID NO: 146171 - protein, 186 aa, Glycine max
  Coding DNA Sequence Number=SeqID_54486
MASGNRLPREAREVSGNRLPRGVIDYQASKRVQSGRLWRPLIVMAAQLIHDRVEMECLEGAWETLEGNTRCRFRGMIRFTATSLVHPDEPVRTLQRTVKWILPTPTPYRLVEPVQVIEVTSSEEDPEEDPEELPPEPAVDALDFLEGDEDPLPKVDSPDEVMSASEADSTEDSGPREMATSGGSSP

SEQ ID NO: 146172 - protein, 60 aa, Glycine max
  Coding DNA Sequence Number=SeqID_54487
PFTKRKPRAKHIFGHVLSRESQVLSAQPLHPRLIWSAKLAKAELSQCQFDLNSAKRWPDR

SEQ ID NO: 146173 - protein, 167 aa, Glycine max
  Coding DNA Sequence Number=SeqID_54488
  Homolog annotation: Hit_ID=A6FJQ2; Match level="QueryCoverage=22%, HitCoverage=84%, E-value=3e-11, Identity=92%"; Hit description=50S ribosomal protein L5
MTVKTSDTCSSRRRSQLVCKRMPGADKPVRARQRMRKEKIPHQAPFAIQAAQLLGRAIGAGLFAITPAGERGMCCKAIKLGNARKKAQASQKQNTAPHVLSCGGYEYLEEKLMAEKTKKRLEETAQSGSTEGIIDPPSPIRRHVKWKMARTKKTGQMTSEAAKEIAD

SEQ ID NO: 146174 - protein, 31 aa, Glycine max
  Coding DNA Sequence Number=SeqID_54489
MALRRDVVDVENVIVMMCYFLDEWYHIAFES

SEQ ID NO: 146175 - protein, 59 aa, Glycine max
  Coding DNA Sequence Number=SeqID_54490
MAAMSCRCLPLDPHTKRNTLIRAESSESSSKIRWRKSFNPPFHSFSEGVFTLSLKNPGE

SEQ ID NO: 146176 - protein, 110 aa, Glycine max
  Coding DNA Sequence Number=SeqID_54491
IALKASSSRQEENEKEESEDEEDFSLFVKKFQKFVKKRRIERRQNFNNGRRSEEDSQEWPEKSDKKRYDERRTKKAYIAWDDNESSDGLEKEINLLTKDYESDENISQED

SEQ ID NO: 146177 - protein, 76 aa, Glycine max
  Coding DNA Sequence Number=SeqID_54492
  Gene Ontology: Cellular component=photosystem II reaction center; Biological process=photosynthesis
  Homolog annotation: Hit_ID=Q7J1A0; Match level="QueryCoverage=44%, HitCoverage=97%, E-value=6e-11, Identity=97%"; Hit description =Photosystem II reaction center protein T
  Pfam annotation: Domain name=PsbT; Domain location=1-29; Score=65.6; E_value=1.7e-16; Accession=PF01405.8; Description=Photosystem II reaction centre T protein
MEALVYTFLLVSTLGIIFFAIFFREPPKVPTKKVMSPQYGGLITSTSPHVLQMDLLVVARVAQRQYIKAYPVKTYK

SEQ ID NO: 146178 - protein, 98 aa, Glycine max
  Coding DNA Sequence Number=SeqID_54493
IPRKKALASIATPLGLEFIPQVRKLLDEGLVRKSLNPCALLVPKIGVPMNPKRIKVIPEWPTPPSVEGRSPEYEEPRDLRSNPFQGGGNDAILSRKGI

SEQ ID NO: 146179 - protein, 33 aa, Glycine max
  Coding DNA Sequence Number=SeqID_54494
MAEPSKKHKGSTSRSQRYSEAHDTPVPSSISSS

SEQ ID NO: 146180 - protein, 179 aa, Glycine max
  Coding DNA Sequence Number=SeqID_54495
MQRSIIDATSGEALGDMTPAEARNLIEKMASNSQQFSARNDAIVLRGVHEVATNSSSSTENKKLEGKLDALVNLITIQIFVLLCSNLESMSNLKLMLQTFIIDLLSSKTNNNRIIMTFQAIDTIQVGGIIQTEDEQVLHNNNNLSLLSRMLLVQASHMFLLQCSNNKDNKQLRLLLNLP

SEQ ID NO: 146181 - protein, 67 aa, Glycine max
  Coding DNA Sequence Number=SeqID_54496
MGDQEETQEQMKADMSTLKEQMASMMEAMLGMRQLMEKNVATTAIVSSAAKADPTLLATAHHPPLNA

SEQ ID NO: 146182 - protein, 314 aa, Glycine max
  Coding DNA Sequence Number=SeqID_54497
  Gene Ontology: Mol. function=nucleotide binding; Cellular component =membrane; Biological process=defense response
  Homolog annotation: Hit_ID=A7QA99; Match level="QueryCoverage=98%, HitCoverage=33%, E-value=2e-43, Identity=36%"; Hit description =Chromosome undetermined scaffold_70, whole genome shotgun sequence
  Pfam annotation: Domain name=NB-ARC; Domain location=136-314; Score= -49.8; E_value=4.3e-07; Accession=PF00931.13; Description=NB-ARC domain
MLRDLPKEVRDITDELESFQDFINDADKVAEAEEDDGRRHRIKERVMRLRETAFHMEDAIDEYHISCEDKQPDDPRCAALLCEAVAFTKTQILLLQSAYKIQDVKSLVRAERDGFQSHFPLEQRPTSSRGNQDVTWQKLRMDPLFIEEDDVVGLDGPRDTLKNWLTKGRKKRTVIFVVGIPGVGKTTLAKQVYDQVRNNFECHALITVSQSYSVEGLLRHMLNEICKEKKEDPPKDVSTIESLTEEVRNCLRNKRYVVLFDDVWNGKFWDHIESAVIDNKNGSRVLITTRDEKVAAYCRKSSFVKVHKLEKTFN

SEQ ID NO: 146183 - protein, 130 aa, Glycine max
  Coding DNA Sequence Number=SeqID_54498
  Homolog annotation: Hit_ID=B0HC01; Match level="QueryCoverage=25%, HitCoverage=70%, E-value=3e-11, Identity=100%"; Hit description =Putative uncharacterized protein
MRKRHASRREKGGQVSGKRQGRNRRAHEGASRGKRLGGGAYGKTPATRPFYGSWPFAGLLLTCSFLRYPLILWITVLPPLSELIPLAAAERPSAARNSYDHDYEFELGTLRRGPGAYQHGWRRATFTREL

SEQ ID NO: 146184 - protein, 129 aa, Glycine max
  Coding DNA Sequence Number=SeqID_54499
MAEKTKKRLEEAAQSGSTEGIIDPPSPIRRHVKWKMARTKKTGQMTSETAKEITDRIGSFVPHGRQDILTAAIGRPEHPGRVCAVGAGVTIKQYFGSASRTSRSSSSMPLEDLEQLTQQIRDQLEESIT

SEQ ID NO: 146185 - protein, 224 aa, Glycine max
  Coding DNA Sequence Number=SeqID_54500
  Gene Ontology: Mol. function=nucleotide binding; Cellular component =intrinsic to membrane; Biological process=defense response
  Homolog annotation: Hit_ID=Q2YE88; Match level="QueryCoverage=100%, HitCoverage=18%, E-value=1e-116, Identity=90%"; Hit description=NBS -LRR type disease resistance protein Rps1-k-1
  Pfam annotation: Domain name=LRR_1; Domain location=121-143; Score =6.8; E_value=17; Accession=PF00560.24; Description=Leucine Rich Repeat
  Pfam annotation: Domain name=LRR_1; Domain location=179-202; Score =13.2; E_value=0.98; Accession=PF00560.24; Description=Leucine Rich Repeat
  Pfam annotation: Domain name=LRR_1; Domain location=98-119; Score =5.6; E_value=28; Accession=PF00560.24; Description=Leucine Rich Repeat
  Pfam module annotation: Pfam domain module=LRR_1::LRR_1::LRR_1; Domain location=121-143::179-202::98-119
NGIKELGGLSNLRGQLEIRNLENVSQSDEAWEARIMDKKHINSLWLEWSGCNNNISNFQLEIDVLCKLQPHFNIESLEIKGYKGTRFPDWIGNSSYCNMISLKLRDCDNCSMLPSLGQLPSLKVLEISRLNRLKTIDAGFYKNEDCRSGTSFPSLESLAIYDMPCWEVWSSFDSEAFPVLKSLYIRDCPKLEGSLPNQLPALKTLEIRNCELLVSSLPTSPAIQ

SEQ ID NO: 146186 - protein, 211 aa, Glycine max
  Coding DNA Sequence Number=SeqID_54501
  Homolog annotation: Hit_ID=A5BSR3; Match level="QueryCoverage=76%, HitCoverage=46%, E-value=4e-11, Identity=29%"; Hit description =Putative uncharacterized protein
NKDSVDDTVCEKYGISKEDVWKKAQAIQKQNTVPHVLSRRGYEYLKQKLMAKKTKKKLEEVAQSRSTEAMIDPPSPIRRHVKWKMVCTKKTGQMTSKAAKEIVEKIDSLEEQAPQGSFVPHGRQDVLTVAIGRPEHPGRVRAAGAGVTIKQHYGSAPRTARTSSSMTPKELEQLTQQIRDQLEESIIEKVTRQLMLSFSQMQSQFQSQMQS

SEQ ID NO: 146187 - protein, 149 aa, Glycine max
  Coding DNA Sequence Number=SeqID_54502
MGSSQKPSLKKRFYQVKIKSLEVTSLRELGQLMGQLQQQAFRKAYGLPASADLKEFEEILGCPLGGRKPYLFFGFYPSMTRVAKEVFGGKGQRPWQNQGEWASFIDILALLIFGVVLFPNMEGLVDLAVIDAFLAYHNHKESPVVAILA

SEQ ID NO: 146188 - protein, 226 aa, Glycine max
  Coding DNA Sequence Number=SeqID_54503
MRGAVNAVESDRPHRSKPLRDVATPRRFIFEALQKRGVIPHSGCKEDSCLLHSGEMHDMETCLEVEELLQRMIDQGRLEVGIEGKEEQHICMQSTEGSGVVKPKPLVIYFTKSAASQKPGHPLIAKPVPFPYQNSHAVPWRYTPPGKKEEEATDVSSLSAKVTNITGLSGVTRSGRVFAPPDLPVQPADVKGKGKVVEEQDGEAPHASNKDIPAKGPPEKKDGRKE

SEQ ID NO: 146189 - protein, 103 aa, Glycine max
  Coding DNA Sequence Number=SeqID_54504
KRSFAIGVGAVTSFGYRKDRDGQWLKKDALPPQDERTPSPPPQRDDSSALMNEVLSELRGLRTYVGERFDSLDGRFEGMDTCITQLEEDVTYLRQCFDLPPPS

SEQ ID NO: 146190 - protein, 20 aa, Glycine max
  Coding DNA Sequence Number=SeqID_54505
MEMQRKTKEKRLGSFLEKLS

SEQ ID NO: 146191 - protein, 56 aa, Glycine max
  Coding DNA Sequence Number=SeqID_54506
MSSLSTCEDGVLSELAFAQRLYTTQPPSRIVHALSHQIGCLANDALSQKISGLASS

SEQ ID NO: 146192 - protein, 74 aa, Glycine max
  Coding DNA Sequence Number=SeqID_54507
MSSKVILIMPKNQELSEFQRFKNQVLKNQDSRIKIQESSFKNQDSRIIKIKIKIQESREDLIKICTKKVFQNIE

SEQ ID NO: 146193 - protein, 52 aa, Glycine max
  Coding DNA Sequence Number=SeqID_54508
MGVQIAPRPTWALRNIPPEGGEEVKKEGECRKGFNRSSTFFIRSSSFFDLQR

SEQ ID NO: 146194 - protein, 163 aa, Glycine max
  Coding DNA Sequence Number=SeqID_54509
MSASDHAILCDRVHQPTKKSLLQVVPSVVRLMKEANVFLVKNTLKKFTIWEINKDKDILKEDFQASSKEETLTQFMQLTMSNHKSTKSALKNLEVQVGQLAKQIADNSSNSFMANTKKNPKEEYKVVMTRSKRFVEAEDEDSVMIKKKVAEKKGIDDKKDDVR

SEQ ID NO: 146195 - protein, 179 aa, Glycine max
  Coding DNA Sequence Number=SeqID_54510
  Gene Ontology: Mol. function=beta-lactamase activity; Biological process=beta-lactam antibiotic catabolic process
  Homolog annotation: Hit_ID=P62593; Match level="QueryCoverage=18%, HitCoverage=11%, E-value=8e-11, Identity=100%"; Hit description=Beta- lactamase TEM precursor
LGPDGKPSRIVVIYTTGSQATMDERNRQIAEIGHHFKNSVAPPTYLALLILLPVAAASGDKSCLTGATLPEGRKADRYPVSGRVGTGERTRELPGGNACLWKNASNAAFLRFLAFCWPFAHMFFPALSPDSVDNRITAFEKRKSAQYANRLSPRVGRFINAAGTTGFPTGKRAVSATQL

SEQ ID NO: 146196 - protein, 75 aa, Glycine max
  Coding DNA Sequence Number=SeqID_54511
MGYHIEEMIHDLGQDGFQQAHAPLYDKIENDSKMPFVEAMTSKIILMMPKNQELSKFQRIRLQESSLKESRFKNN

SEQ ID NO: 146197 - protein, 90 aa, Glycine max
  Coding DNA Sequence Number=SeqID_54512
MRKCRRVKLPAFIVDHRVVPGDMSRGSGDLGDVRRAPGSQQIKGTKTTKQGGLWWLASCEFLCDIWVVASGNRLPRVGNRLQGLKMKTGG

SEQ ID NO: 146198 - protein, 87 aa, Glycine max
  Coding DNA Sequence Number=SeqID_54513
MWYQKHLHLGDTTSCGTTSCELQALIPNDVAPCGACKPWIFFINRVLCFLKIMAVEWRRKKDDWRCHFKEKMSQEEAHHHRKPWIRA

SEQ ID NO: 146199 - protein, 54 aa, Glycine max
  Coding DNA Sequence Number=SeqID_54514
MEVKDLIWARLDEGKCGFRNLHFMQNFAVKLCSRILHKCRKMLCFAGCGKSSAE

SEQ ID NO: 146200 - protein, 181 aa, Glycine max
  Coding DNA Sequence Number=SeqID_54515
  Homolog annotation: Hit_ID=UPI0000ECBAF8; Match level="QueryCoverage =22%, HitCoverage=48%, E-value=2e-16, Identity=100%"; Hit description= UPI0000ECBAF8 related cluster
ATLPEGRKADRYPVSGRVGTGERTRELPGGNACLWKNASNAAFLRFLAFCWPFAHMFFPALSPDSVDNRITAFEKRKSAQYANRLSPRVGRFINAAGTTGFPTGKRAVSATQLIYDHDYEFELGTPAAGMQAWHWPSFYNVVTGKTLALPNLIALQHIPLSPAGVIAKRPAPIALPNSCAA

SEQ ID NO: 146201 - protein, 70 aa, Glycine max
  Coding DNA Sequence Number=SeqID_54516
TDNHSGISVRQRDSNVSMTDLVSAEDDAFCPTDSKRMFMKVRTTTWVSPHVTEALAPMYPQMRNSDLRSP

SEQ ID NO: 146202 - protein, 216 aa, Glycine max
  Coding DNA Sequence Number=SeqID_54517
  Homolog annotation: Hit_ID=Q2HSI4; Match level="QueryCoverage=60%, HitCoverage=62%, E-value=1e-09, Identity=32%"; Hit description =Putative uncharacterized protein
MARTRGLGCAIGRVVGRDKAADEDADDVPERRRPTASARRLRIHQMTTEGRDMAEDVADMTDDVPEQPTKAPEMRVDAQGADSGERSDGDDAAEGFPGGPRDPSVLTSFAEHVAHAVWSGQERPDLKLVSHGRKVTLIGRPVPEIEGLLLLGDPGLISAFVERWHSETSTFHLPFPRSFYGGGQILAHGVAGSVCGGGQSRDSTHTWSICTIRMGS

SEQ ID NO: 146203 - protein, 171 aa, Glycine max
  Coding DNA Sequence Number=SeqID_54518
  Pfam annotation: Domain name=Transposase_23; Domain location=49-119; Score=11.0; E_value=7.5e-05; Accession=PF03017.5; Description =TNP1ENSPM transposase
  Subcellular localization annotation: CTP_CleavageSite=32; ConfidenceScore=5.44e-01
MASFSQLQSQMQSQGLAVPPKPLVGPGPSGPRVSTKGSCVDPSGNDPETGDSDRCGLYIEADPARLVAMGRVYDGSIVVHNTPLLPGQVKVSVEEVTDADAPVPIPTDEVSLVGQALHTFLAWPTHLVKSLSQQVAVSPPKPPLKPDPEVDDPLYLMTLTIPELFLRPYLG

SEQ ID NO: 146204 - protein, 28 aa, Glycine max
  Coding DNA Sequence Number=SeqID_54519
MSKRLQKDWARAAEEGPRVLMNLRGSIT

SEQ ID NO: 146205 - protein, 118 aa, Glycine max
  Coding DNA Sequence Number=SeqID_54520
  Subcellular localization annotation: CTP_CleavageSite=63; ConfidenceScore=5.39e-01
MLLPCAVHVSSTFQFGVVFHDCLSADPQGNPPFSPLFRSSMNYVYVHVSSTFQFGVVFHDCLSADPQGNPPFSPFFRSSMNYIYVHVSSTFEFGAVFHDFLSADPQGNPPFSPYFGAR

SEQ ID NO: 146206 - protein, 147 aa, Glycine max
  Coding DNA Sequence Number=SeqID_54521
  Homolog annotation: Hit_ID=A5ALA5; Match level="QueryCoverage=95%, HitCoverage=36%, E-value=2e-07, Identity=26%"; Hit description =Putative uncharacterized protein
MVHNSWKDVPDTLKELLWNEILAKFDIPEALHAKKKVMSTVATRWRQFKSSLTSKFVFSISEDQHKEDPSVKYGFDAQIWEEFAATRKVPNWQDSLEEQVTQGEFVPQGRQDILNMAIGRPDHGGCVRAAGSGVTISQYYGRTSRAS

SEQ ID NO: 146207 - protein, 106 aa, Glycine max
  Coding DNA Sequence Number=SeqID_54522
GISKKKSIASSSSQIRYDKYKYSSPEAWDHYTNNIFGIKIIPERNVQLSLNDFEEFQGELNRWNWHKKIANLEEGNIDVALVREFYANVYDPEDKSPKQVKKHQWL

SEQ ID NO: 146208 - protein, 137 aa, Glycine max
  Coding DNA Sequence Number=SeqID_54523
MKLAKYRLKAQVEKDGGLSGEGQSPQVEKDEGSSNPCGVYPDLSSFTGSGVYPDLSSFIGSGVYPDLSSFTGSGVIQTFVACIKRSAPLIKVILVASTLTYLLSLEVASTRTYLPSPEVASTLTYLPSPEVASSKYP

SEQ ID NO: 146209 - protein, 156 aa, Glycine max
  Coding DNA Sequence Number=SeqID_54524
  Gene Ontology: Mol. function=L-gamma-aminobutyric acid transmembrane transporter activity; Cellular component=integral to membrane; Biological process=gamma-aminobutyric acid transport
  Homolog annotation: Hit_ID=A1FQ04; Match level="QueryCoverage=92%, HitCoverage=31%, E-value=9e-35, Identity=53%"; Hit description=GABA permease precursor
  Subcellular localization annotation: CTP_CleavageSite=13; ConfidenceScore=5.30e-01
MLYSLSRRQDAPAAASRTTRSGTPWVAVLMSTAAAFLAVIANYLAPSAVFEFLLASSGAIALLVYLVIAASHLVLRKKREARGEQLSYRMWLFPGLTWATMVFIVGVLTSMLFNAQHRSEIIATGLLTLLVLVASQIVHRKRAARKNSEEMVALRS

SEQ ID NO: 146210 - protein, 72 aa, Glycine max
  Coding DNA Sequence Number=SeqID_54525
  Subcellular localization annotation: CTP_CleavageSite=54; ConfidenceScore=5.04e-01
MTGLTHRCGYLTGLASSSKSILCMQVDGLILGMFAKVHPMAFLCFLSTSNNFSSCSTAKEAEMITGKFPCPP

SEQ ID NO: 146211 - protein, 53 aa, Glycine max
  Coding DNA Sequence Number=SeqID_54526
MREKERGRRKMTERARKWREWALIMRFDSERIPHRMMEEERGRGRGVWIANES

SEQ ID NO: 146212 - protein, 66 aa, Glycine max
  Coding DNA Sequence Number=SeqID_54527
MAFGVGVLRGTEVEGGWTYQGNPCGVYPDLSSFTGSGVYPDLSSFTGSGVYPDLSSFTGSGVIQTL

SEQ ID NO: 146213 - protein, 38 aa, Glycine max
  Coding DNA Sequence Number=SeqID_54528
MSHILSEHCLLVSSSMRETSQDHVVLRECSNHVGSAQT

SEQ ID NO: 146214 - protein, 311 aa, Glycine max
  Coding DNA Sequence Number=SeqID_54529
  Gene Ontology: Mol. function=protein binding; Cellular component =nucleus; Biological process=ribosome biogenesis and assembly
  Homolog annotation: Hit_ID=A7QPB4; Match level="QueryCoverage=76%, HitCoverage=34%, E-value=3e-90, Identity=61%"; Hit description =Chromosome chr18 scaffold_137, whole genome shotgun sequence
  Pfam annotation: Domain name=DUF663; Domain location=75-309; Score =226.5; E_value=6e-65; Accession=PF04950.3; Description=Protein of unknown function (DUF663)
MVYFLAGFCKLLVVYLYSHGSNTNLINITWKKLIKQGGKDYHPVLLLPNQEVDNLTREKIEDELNELKEAHAAYEVDTPLDVPARKRFAKYRGLKSFRTSSWDPKDCIPVGSYARLHIMGVPSAIASKLSLLAKTIPITACGLLKHESKVSVLHFSVKKHEAYDAPIKSKEELIFHVGFQQFVGWPIFSSEFINTDKNKMERFLHAGRFSVASIYAPVSFPPLPMIILKRNGENATPVVAAVGSLKTVDADRIILKRVILTGYPQRVSKRKASVRHMFYNPEDVKWFEVKIHYPLSGFFKLYLLDGSEVYI

SEQ ID NO: 146215 - protein, 87 aa, Glycine max
  Coding DNA Sequence Number=SeqID_54530
MKSADFSLRGCVVCIWGTCGNEVAMKCVAVEWRVVMRILKLAKYRLNVQVEKDECPSGEGQSPRVEKDEGLETETLPRQLIVAEGPD

SEQ ID NO: 146216 - protein, 498 aa, Glycine max
  Coding DNA Sequence Number=SeqID_54531
  Gene Ontology: Mol. function=[ribulose-bisphosphate carboxylase] -lysine N-methyltransferase activity; Cellular component=chloroplast
  Homolog annotation: Hit_ID=Q43088; Match level="QueryCoverage=100%, HitCoverage=100%, E-value=0.0, Identity=73%"; Hit description =Ribulose-1,5 bisphosphate carboxylase/oxygenase large subunit N- methyltransferase, chloroplast precursor
  Pfam annotation: Domain name=Rubis-subs-bind; Domain location=327 -453; Score=183.6; E_value=4.9e-52; Accession=PF09273.2; Description =Rubisco LSMT substrate-binding
  Pfam annotation: Domain name=SET; Domain location=53-304; Score =196.3; E_value=7.4e-56; Accession=PF00856.19; Description=SET domain
  Pfam module annotation: Pfam domain module=Rubis-subs-bind::SET; Domain location=327-453::53-304
  Subcellular localization annotation: CTP_CleavageSite=39; ConfidenceScore=5.59e-01
MASVFSACSGSAVLFYSRNSFPSKGSFIHLKRPLSANCVASLGTEVSVSPAVDTFWQWLKEEGVVSAKTPVKPSVVPEGLGLVALKDISRNEVVLQVPKRLWINPDAVAASEIGKVCIGLKPWLAVALFLIRERSRSNSLWKHYFSVLPKETDSTIYWWVSFALLVRCRSEEELSELQGTQLLNTTRSVKQYVENEYRRLEEEIILPNKKLFPSPLTLDDFFWAFGILRSRAFSRLRNENLVVIPFADFINHSARVTTEDHAYEIKGAAGLFSWDYLFSLRSPLSLKAGDQVYIQYDLNKSNAELALDYGFIEPNADRNAYTLTLQISESDPFFGDKLDIAESNGFGETAYFDIFYSRPLPPGLLPYLRLVALGGTDAFLLESIFRNSIWGHLELPVSRDNEELICRVVRETCKTALAGYHTTIEEDQKLKEAKLDSRHAIAVGIREGEKQLLQQIDETFKEKELELDQLEYYQERRLKDLGLCGENGDILGDLGKFF

SEQ ID NO: 146217 - protein, 114 aa, Glycine max
  Coding DNA Sequence Number=SeqID_54532
MSGFFLLGIVETFDLDISITKNTTRNNACYIDGREDRLRMGTFLRRSPVRDRLRMTDVEWYAFYDGQWAEIDVELEAFYDDQTVKTDVEWYPILRRSSTRIHKLQTFKYPQYYT

SEQ ID NO: 146218 - protein, 56 aa, Glycine max
  Coding DNA Sequence Number=SeqID_54533
MINIFAHLEIILRGMLNLFRLRTAEWRRRKGDWRCHFKEKMSQEQAHHHRKPWIRA

SEQ ID NO: 146219 - protein, 62 aa, Glycine max
  Coding DNA Sequence Number=SeqID_54534
MGEGYHGDTSAIGLPYFYLSPASYTEWCTGKSKGYGFVTFREAEAAKKACEDSTTLIINGHC

SEQ ID NO: 146220 - protein, 180 aa, Glycine max
  Coding DNA Sequence Number=SeqID_54535
  Homolog annotation: Hit_ID=A3BXN8; Match level="QueryCoverage=56%, HitCoverage=36%, E-value=2e-15, Identity=40%"; Hit description =Putative uncharacterized protein
MIFNNTESNTVLEMVFPKPSLSKMRCNCKPRTNEPYVLASQAQQVYYVKDTKDPNWLVFVKTKPRDLYDVSEKATPEACQENDDIGSISFTSNALDNDQGLSLDRNDLARPIVDGKQVVPLEVVDREKEQSDEEIIDLAKDEESGKMKNKKVAAASISLSEAYAFSEQHPLSETSARLAS

SEQ ID NO: 146221 - protein, 339 aa, Glycine max
  Coding DNA Sequence Number=SeqID_54536
  Gene Ontology: Mol. function=ATPase activity, coupled to transmembrane movement of substances; Cellular component=integral to membrane; Biological process=transport
  Homolog annotation: Hit_ID=A5BVK9; Match level="QueryCoverage=93%, HitCoverage=91%, E-value=1e-121, Identity=49%"; Hit description =Putative uncharacterized protein
  Pfam annotation: Domain name=ABC_membrane; Domain location=1-222; Score=22.8; E_value=0.00021; Accession=PF00664.14; Description=ABC transporter transmembrane region
MVQAIAMFYEPPEKQQKDSSFWALLYVGLGIVTLVIIPVQNYFFGIVGGKLIERIRLPTFEKVVHQEISWFDDSANSRSHVNMTFTANWILALIIVAMSPLIFIQRFLQMKFLKGFNGDAKAKYEEASQVANDVVSSIRTIASFCAESKVMDRYKKKCDIEFILALGLVSGTGFDFSFLALYCTNAFYFYIGSVLVQHSATFPEVFKVLFCLTITAIGISQTSVLAPDTNKAKDSAASIFKILDSKPTIDSSSNGGRTLEAVFGDIELQHVSFNYPTRPHIQIFKDLCLSIPAGKTVALVGKSGSGKSTVISLLERSMDIASMISSQPFLYFKNQPRNR

SEQ ID NO: 146222 - protein, 32 aa, Glycine max
  Coding DNA Sequence Number=SeqID_54537
MEKGSKILLFLIIDSLGNPLKFYKFYTYGDGW

SEQ ID NO: 146223 - protein, 72 aa, Glycine max
  Coding DNA Sequence Number=SeqID_54538
MWRPSEIAFDDKTWWYIVVCDGASGGKYAQGDESSFIRMGRISTRFPNIISVDDGEGVGLFARLREKENDYA

SEQ ID NO: 146224 - protein, 370 aa, Glycine max
  Coding DNA Sequence Number=SeqID_54539
  Gene Ontology: Mol. function=subtilase activity; Biological process =proteolysis
  Homolog annotation: Hit_ID=A7QXF8; Match level="QueryCoverage=13%, HitCoverage=3%, E-value=8e-18, Identity=80%"; Hit description =Chromosome undetermined scaffold_222, whole genome shotgun sequence
  Subcellular localization annotation: CTP_CleavageSite=28; ConfidenceScore=5.63e-01
GSSASKRGLAGGSTASTSGTDPDRTSPCSSAPRPSPLTGVGVHNERVAGGVGLGEPGAKEGVMNGVVMVEVEEDVGGIGVIRIFNRGKRIESYDDKGPAIDAVVWYDGEVWRVALDTHSLDDDPDCGKLANFIPLTNYSALGPWHGVIANDACVRLCLHAWAMQCMEAPMFLENECALLRDAFGWYCFTLLCIIHEYKQVLYTEPPLSTTERSVVEAGPNASYLTKKEESAFKDGAYLNNVFESGHSKTVFTSATSLKVSILRRCLRQQRLRMPTFKDGAEAFPGYMSFMESLAKKRKCKEDVFYEVKKTVGMSCMSQVIRSEQIPIQVSCPGVQFPFVGGDTFGTDNDAAAESRVNDDYIVDITATQEA

SEQ ID NO: 146225 - protein, 166 aa, Glycine max
  Coding DNA Sequence Number=SeqID_54540
MPNIVNLMCFNFSFRHSACLATWENLEENLRSIYALNESSTCSMRRLSLPALSAPSLLSEYSLIRAKREIGAKRSFEDRKPFLRLKLEKSSIWRLAAGVSLSEACVLSENHALSEALSPRSELGESGGESEKHMRAQCVISLLSEAFVSSHAKHAQLAQWIFTNLR

SEQ ID NO: 146226 - protein, 71 aa, Glycine max
  Coding DNA Sequence Number=SeqID_54541
MVVARRGKKEVEMDLVIVDLRFKFNDWSLKKWKTLRIIIRIRDNVGIEMVEEVGEGGREDLKGSHKSLLGK

SEQ ID NO: 146227 - protein, 112 aa, Glycine max
  Coding DNA Sequence Number=SeqID_54542
MKTAWEMNVVVRKGKKEAGMDLMADRRFIMAGWSLMKKWKTLLVMLMTPQVEEGGREDEGGGYGEEEEEGEGVEVKKVCFHDVLRLRNETTEVLGGHVWEENNGKVKFCKDD

SEQ ID NO: 146228 - protein, 59 aa, Glycine max
  Coding DNA Sequence Number=SeqID_54543
MTFPPKGTGIANLECVVLPPGSSNEAIPLEETVKTMSPLDRIANDKVFQTKVLPVPPYP

SEQ ID NO: 146229 - protein, 116 aa, Glycine max
  Coding DNA Sequence Number=SeqID_54544
  Pfam annotation: Domain name=Retrotrans_gag; Domain location=10-96; Score=-2.5; E_value=0.094; Accession=PF03732.8; Description =Retrotransposon gag protein
MELKDGWLIRMITSLNSNIHCCKKSIDSWIDLRKKLRDTFVASQARPKTEIDLKKIRHGDQEPLREYINWFNQEARAAWNLQLGVVLMLAKDGAREGSPFFTLMAKTPNNKLMKNL

SEQ ID NO: 146230 - protein, 162 aa, Glycine max
  Coding DNA Sequence Number=SeqID_54545
MDLEVLRQRANSPATYTRGLILGDVVTISEASGNDRGRLGHDGTRTPQNNVDAAQATMAGQARARQMSASRFKCFASCRTPSRIHRKTALYPPCPKGLPLIGNMNIMKQLTHKGLANLVVVGDKNLKNAVKVFVDRLAIKVENGVEGFEGFVGQIGFNVGFD

SEQ ID NO: 146231 - protein, 183 aa, Glycine max
  Coding DNA Sequence Number=SeqID_54546
  Homolog annotation: Hit_ID=A2YBQ3; Match level="QueryCoverage=23%, HitCoverage=7%, E-value=9e-08, Identity=48%"; Hit description =Putative uncharacterized protein
MTEENGDWKPKIGLEFEDVEETWEFWSKYGEEVGFGVRKQFKNKEKEDGVIRKGLESRIKEIDKLPSIELRPELIVKRATNFMNSLSHSSSASVNSLSAPLLTLRLSKKTSDKPETERELSLKRKPSCRALKEILRVCEVSRGGGDIPTTCSYLSSSLFIVVNESSLLWRAKSSVGSSYGVLD

SEQ ID NO: 146232 - protein, 22 aa, Glycine max
  Coding DNA Sequence Number=SeqID_54547
MWKFFIVLHRSSFVLRRSSVFN

SEQ ID NO: 146233 - protein, 200 aa, Glycine max
  Coding DNA Sequence Number=SeqID_54548
MRGYRMVIRTFGHLEMASPMTCGGITASPMTCGGTVWLSAPFVIPSGKSDEMRGYRMVIRTFRQPGANKPVDAQKLVLSSVPFVNQGQASPDGKSDDMWGYHMVIRTFCHLETSSPMTCGDGKSDDMRGYRMVIRTFCHPETASPAEIPYGHPHLSSTEANEFDDIQAQRRTGFFSAGPGRSSAIARGNVVVPLVGILIG

SEQ ID NO: 146234 - protein, 57 aa, Glycine max
  Coding DNA Sequence Number=SeqID_54549
MVVTALWVEHNDDIGMPIDVALGSLVKSQNPATFPDSVSQASNSSEVGSQATLKDLN

SEQ ID NO: 146235 - protein, 269 aa, Glycine max
  Coding DNA Sequence Number=SeqID_54550
  Homolog annotation: Hit_ID=A5B5G7; Match level="QueryCoverage=81%, HitCoverage=14%, E-value=4e-08, Identity=23%"; Hit description =Putative uncharacterized protein
MASRKWKSTVSRPTTQYDTRRFQSLEASNRYTDNIVGWNILPERNVKLYHIEFDKFKVELERRNLHKCLANLRDGSIDVALVKEFYANLYTIEDQAPKQARVRRYLIKIDADRLNEFLQTPVVLEEGESLPTYSRFCRLKTNHQEIEARLCIPRKGFVLNAEDQPWKLLRKDLTTLAQTWSVFSYSNLAPTSHTLDLNMDRARLVYGLVTNMDMNIRAFISVNFRGARKARARPADVPFSSASPAPSSATPPALPSPSSQDSQCFEAMR

SEQ ID NO: 146236 - protein, 77 aa, Glycine max
  Coding DNA Sequence Number=SeqID_54551
MFIFPIPSSIDTHNIVVVGLNLGLTIIGDGWRFRLRWLISLMVDGGFDHGELWWVTKFRYGEGVGQISMGSDMVNNY

SEQ ID NO: 146237 - protein, 80 aa, Glycine max
  Coding DNA Sequence Number=SeqID_54552
MEDFMAQVAWPRVQPSPLGGGGGEAFAAQEPQPEPQPEVVPEATPEATPQASPVASPVLEVSEEEDGTVDADYAADMNAA

SEQ ID NO: 146238 - protein, 203 aa, Glycine max
  Coding DNA Sequence Number=SeqID_54553
MEEKQKKQLEQVAQSGSFETIIGPSSPIRRHMKLKMVRTKISGQMKYEVKHQIADRIDSLEEQSAQGSFVAYGRQDVLTAVIGRLEHPSCVCAVGAGGNVLPVEPKVAHSDARVSIKGSYVDPSGQDPDMDASNSSNVDVHIVVPTEEIQLVGHALNIFLNWTAHLDKQLPKGSVKPIDRSELDDDPIYQMTLMTLQLFLKPM

SEQ ID NO: 146239 - protein, 160 aa, Glycine max
  Coding DNA Sequence Number=SeqID_54554
  Homolog annotation: Hit_ID=A2Q1D6; Match level="QueryCoverage=72%, HitCoverage=18%, E-value=3e-13, Identity=36%"; Hit description =Ovarian tumour, otubain, related
  Pfam annotation: Domain name=FAR1; Domain location=50-134; Score= -28.2; E_value=0.061; Accession=PF03101.6; Description=FAR1 family
MNEDQWMYDGIMSEEVDMNDENEDEVGVNKEEHVDCSKAFNTSQWAQSVAYEIRFVAVIMRSSINNGMRERTSFVLIGCEMTSQYRSKKKDFVRRDTDSGKCECPFKFRGKPMVGGQGWMVKLMCGSHNHELVKSLVGHPYVSRLTKDEKTIIVDMIRSM

SEQ ID NO: 146240 - protein, 86 aa, Glycine max
  Coding DNA Sequence Number=SeqID_54555
MGQKEEEKCTDTARGWRVFLEDDDYGDVKTPPTRSLASLATVASPEHGCGTCVGCDNGWKKMFWCRELTEYYNNSGAGVGDVVDKG

SEQ ID NO: 146241 - protein, 20 aa, Glycine max
  Coding DNA Sequence Number=SeqID_54556
MPPWKTCNYSNCKNKEESKK

SEQ ID NO: 146242 - protein, 168 aa, Glycine max
  Coding DNA Sequence Number=SeqID_54557
  Gene Ontology: Mol. function=oxidoreductase activity, acting on the CH-CH group of donors; Biological process=electron transport
  Homolog annotation: Hit_ID=Q9M7Y7; Match level="QueryCoverage=26%, HitCoverage=10%, E-value=7e-14, Identity=80%"; Hit description =Acetyl-coA dehydrogenase, putative
MGALKSRYCSGEARLRHYRRWKEKTETKMVFLVEGDILNSRWTVHPAKEKLKEMAKKEGLWNLWNPGKTDFNAAKHKQQSMILVDVNTLGIHMKRPMTVFGFDDASHGHAKTAIALGFFTMVQERLFAFPPFSSRGLRRSHHQPFPPPVANVHRHSLVIATLHASLLT

SEQ ID NO: 146243 - protein, 53 aa, Glycine max
  Coding DNA Sequence Number=SeqID_54558
MELATGVLINKTQLFSKIIPTSSRRLGGSTKESHFTYYTAVILLPRTKVHDHH

SEQ ID NO: 146244 - protein, 124 aa, Glycine max
  Coding DNA Sequence Number=SeqID_54559
  Homolog annotation: Hit_ID=A5AV98; Match level="QueryCoverage=81%, HitCoverage=13%, E-value=1e-20, Identity=53%"; Hit description =Putative uncharacterized protein
MDAKLYDYCFMGDLCVSLILFIYSKQVQFHLSVLDLDLVILEKKSVTITDASSNKEKTHYKARERSNRFNLMFMRMIVVDGTKTTLPKIDRAKEFMGLVGERSQTADKSLAGTLMSILTTMKFV

SEQ ID NO: 146245 - protein, 66 aa, Glycine max
  Coding DNA Sequence Number=SeqID_54560
MEDLKEVKFWKEWEGALFQQRVIPVQLALAQANNRLCLQNNIAIAEANTREQCWKQLKMTLARAWE

SEQ ID NO: 146246 - protein, 78 aa, Glycine max
  Coding DNA Sequence Number=SeqID_54561
MLTDENPETGQIQAKGPSPNYQGNPCDVYPDLSSFTGSGVYPDLSSFTGSGVIQISVACIKRSAPSQDHIIWHQSFNS

SEQ ID NO: 146247 - protein, 68 aa, Glycine max
  Coding DNA Sequence Number=SeqID_54562
MLFLLSSSKTLSFSRRPPNLSQKNDDLGLVHRWIVMKFEHHVRNPNMRILTVGNFDIMSKLREIFLAL

SEQ ID NO: 146248 - protein, 40 aa, Glycine max
  Coding DNA Sequence Number=SeqID_54563
  Homolog annotation: Hit_ID=A7QGE6; Match level="QueryCoverage=92%, HitCoverage=5%, E-value=8e-13, Identity=91%"; Hit description =Chromosome undetermined scaffold_91, whole genome shotgun sequence
MSAGLQITGWPAHDSSISSILFGPDETSIFSLGSDGKANF

SEQ ID NO: 146249 - protein, 353 aa, Glycine max
  Coding DNA Sequence Number=SeqID_54564
FQETVYLVETLNTKDQRSLGSLQEVRFASWLITGHKRPTSFGFIARSGYNFLVVITGHMGTTSFGVHCKKILQGVETLKWDLLEDWTQNFFKLFLKLQALALGCSMLFFPLSLTQDPQLSYKNLGAKDHSDQRIQGLSIKVDGSFLRKFPAYEHELIQQSHAEETKKKRKGIALKVNSSMEDYKEISSDDEDAENFNLMDKKQKEKAYIAWDDNASTSSDSSSEEEVANVGLVTDLMEGSSTIEESKLRSDLKLHITKLASTQSVLDRLRQENEKLVSSYKATGCVCASISLNMEDYKYLQTEFEKFKEDYCAERMKLQTEFSYLKDLSRKMNKGKSDLSHLLSVQNHTSNKT

SEQ ID NO: 146250 - protein, 106 aa, Glycine max
  Coding DNA Sequence Number=SeqID_54565
MSSSALLLILTREVRRGYRMVICTFRQPGANQPVDAQRLTSSSAPFIIQGQRVRWQAEIPYGRLHLSSTKANQFDGIRMIHSSPTMHEILLCWAGTIKFDSVWKRH

SEQ ID NO: 146251 - protein, 69 aa, Glycine max
  Coding DNA Sequence Number=SeqID_54566
MKENDGSLLVGLLWRLDLSASMRSFNGDFSPWRCSGRQRRRGEGRHHPLGNKELHHQELPWIRSLKRML

SEQ ID NO: 146252 - protein, 254 aa, Glycine max
  Coding DNA Sequence Number=SeqID_54567
  Gene Ontology: Mol. function=binding
  Homolog annotation: Hit_ID=A1FW25; Match level="QueryCoverage=99%, HitCoverage=41%, E-value=1e-133, Identity=91%"; Hit description =Putative uncharacterized protein
MEYEALLAAQPDFLPARLELARVYAEDQRDRDAAALFTAIAAGINADDPATAGVRARVDGYLSALQARQRWKGALSAGPAWSDNINRSSASRTCLFGVGDACIIERKLPDAQRAAGLDYDASLERRWVLGGHHGLYVRGLAFGQAWRGHSAYNELNANVQAGYSWRNARQTVMLAPSYDYQALGNHALQGGSGVHAEWQYALDARSLLKLEADWKRQRYRQQGLASNYDGELASLYATWFRALNPRWTVFAGLD

SEQ ID NO: 146253 - protein, 78 aa, Glycine max
  Coding DNA Sequence Number=SeqID_54568
  Subcellular localization annotation: CTP_CleavageSite=66; ConfidenceScore=5.35e-01
MRGKRVFLLSFLDPSSPKLASGLSGPPNDFRVKESARLGDPVTSGVSLSSLGRAAFAPSAHFPINRCAREAEEGFQGS

SEQ ID NO: 146254 - protein, 124 aa, Glycine max
  Coding DNA Sequence Number=SeqID_54569
MTDPVSAEDDITKKNVYTDNHSGISARQRDSKVSMTDLVSAEDDVNLCVSTGLSAAIDEGAEDDRDSKVSMTDLVSAEDDVNLRVSTGLSAAMTKGAEDDVSLCVLSGFVLQIAKKNVYTDKHS

SEQ ID NO: 146255 - protein, 108 aa, Glycine max
  Coding DNA Sequence Number=SeqID_54570
MIMRGQEIYSSQEKNTFSPSSSGSEDEVRGEESSEEVYPDEEGDLLIVRRLLGANISKFILMMPKTQVKNQESNKFQESKSRSIKKQDSSEDSREDSRYARTSRKSSR

SEQ ID NO: 146256 - protein, 107 aa, Glycine max
  Coding DNA Sequence Number=SeqID_54571
MSFEWLRASTFNFEASRYIRDSIRHPKVQHSISSVSIYYVTQSDIRVKSYCRLNWLRASTFNFERLDILRDSIRHPSKKLLSFELAQRFNIQFRASRYITGLNQTSE

SEQ ID NO: 146257 - protein, 61 aa, Glycine max
  Coding DNA Sequence Number=SeqID_54572
MAGAGSLDIQTWNWKEDWCHHLKNLSQEKRANHLKSYWTKKNSKLSESPKREQPPKLRTVL

SEQ ID NO: 146258 - protein, 153 aa, Glycine max
  Coding DNA Sequence Number=SeqID_54573
  Subcellular localization annotation: CTP_CleavageSite=21; ConfidenceScore=5.06e-01
MSSPSEATRPHLKRATHPHLRRASRPHLQRTIRPHLQRTTQSSPLEDYTPRHQRVARPHLQRTTRLHALTFRGLHVLAFRGLHAFAIRGLHVLAIRGLHVLAFRGLHVLAFEGLHTLAIRGLHVLAFVGLHVLALTFRGLHVFAFMGLHALTF

SEQ ID NO: 146259 - protein, 246 aa, Glycine max
  Coding DNA Sequence Number=SeqID_54574
  Gene Ontology: Mol. function=transferase activity, transferring glycosyl groups
  Homolog annotation: Hit_ID=Q8ZPW3; Match level="QueryCoverage=99%, HitCoverage=57%, E-value=1e-126, Identity=90%"; Hit description =UPF0229 protein yeaH
  Pfam annotation: Domain name=DUF444; Domain location=1-244; Score =287.7; E_value=2.2e-83; Accession=PF04285.3; Description=Protein of unknown function (DUF444)
MTAGKRRMLHELEATLSEVENSEPAQLLEEERLRKEIAELRARIERVPFIDTFDLRYKNFEKRPEPSSQAVMFCLMDVSGSMDQATKDMAKRFYILLYLFLSRTYKNVDVVYIRHHTQAKEVDEQEFFYSQETGGTIVSSALKLMDEVVKERYDPSQWNIYAAQASDGDNWADDSPLCHEILAKHILPVVRYYSYIEITRRAHQTLWREYEHLQAMFDNFAIQHIREPEDIYPVFRELFHKQVAEA

SEQ ID NO: 146260 - protein, 283 aa, Glycine max
  Coding DNA Sequence Number=SeqID_54575
  Gene Ontology: Mol. function=beta-lactamase activity; Cellular component=plasma membrane; Biological process=beta-lactam antibiotic catabolic process
  Homolog annotation: Hit_ID=P62593; Match level="QueryCoverage=77%, HitCoverage=76%, E-value=1e-111, Identity=92%"; Hit description=Beta- lactamase TEM precursor
  Pfam annotation: Domain name=Beta-lactamase; Domain location=1-242; Score=143.0; E_value=8.5e-40; Accession=PF00144.15; Description=Beta- lactamase
  Pfam annotation: Domain name=Peptidase_S11; Domain location=1-218; Score=-128.3; E_value=0.081; Accession=PF00768.11; Description=D -alanyl-D-alanine carboxypeptidase
  Pfam module annotation: Pfam domain module=Beta-lactamase::Peptidase _S11; Domain location=1-242::1-218
AEDQLGARVGYIELDLNSGKILESFRPEERFPMMSTFKVLLCGAVLSRIDAGQEQLGRRIHYSQNDLVEYSPVTEKHLTDGMTVRELCSAAITMSDNTAANLLLTTIGGPKELTAFLHNMGDHVTRLDRWEPELNEAIPNDERDTTMPVAMATTLRKLLTGELLTLASRQQLIDWMEADKVAGPLLRSALPAGWFIADKSGAGERGSRGIIAALGPDGHHFKNSVAPPTYLALLILLPVAAASGDKSCLTGATLPEGRKADRYPVSGRVGTGERTRELPGGNA

SEQ ID NO: 146261 - protein, 157 aa, Glycine max
  Coding DNA Sequence Number=SeqID_54576
LCQSFGIPVTPSKVIRPPITRAFIEKYCTQRQVQGDTPQAADAPPPHQAGPAGLFDTEQYWRHLVRQQAANHRAHVQTHDCLYQMSLSLQSQGFTYFPCLTPDQFRAEVAWPGDWPEAQAGEAPARAPAEALDGAYEACEDEEMIDLLDFLGGSGAT

SEQ ID NO: 146262 - protein, 163 aa, Glycine max
  Coding DNA Sequence Number=SeqID_54577
MASQKIKSIAFSSSHIRYDRYKFSSPEAWDRYTNNIFGRKIILERNVQLLFNDFEEFQGELNRRNWHKKITNLEEGSIDVALVKEFYENVYDPKDKSPNTGQETPVAIEKGESLPAYARFVLLRPNQQELAACLCIPGKGFELNSDGLPLKILRKNLTTLAQT

SEQ ID NO: 146263 - protein, 95 aa, Glycine max
  Coding DNA Sequence Number=SeqID_54578
MAPRKLSAKRSRKDAAAEGTSADPDFDNHRFRSAEHQQRFEAIKEWSFHRERHVQLRDDEYTDFQEEIAHRCWTSLVTPMANFDPDIVLEFYANA

SEQ ID NO: 146264 - protein, 107 aa, Glycine max
  Coding DNA Sequence Number=SeqID_54579
  Subcellular localization annotation: CTP_CleavageSite=8; ConfidenceScore=5.01e-01
MLAAQLAQASQVASSRSNSLLEESSGGPKWAWVLFAPPFLLKCYGTSLNYATMLPFDFRCVTETYGLCINIFFFLVFRYVLEFHKLPNDGCQAPHKDQRKVACHQAK

SEQ ID NO: 146265 - protein, 66 aa, Glycine max
  Coding DNA Sequence Number=SeqID_54580
  Homolog annotation: Hit_ID=A5B6C9; Match level="QueryCoverage=98%, HitCoverage=19%, E-value=6e-08, Identity=39%"; Hit description =Putative uncharacterized protein
MGMEYQKIHACPNDCILYRHEFKKCTNALGEGFKHLFANGDDAKDVTWHADGRNCDGKIRQLADSS

SEQ ID NO: 146266 - protein, 25 aa, Glycine max
  Coding DNA Sequence Number=SeqID_54581
MKKIQGLQAPHGSELHHVVSRASSS

SEQ ID NO: 146267 - protein, 19 aa, Glycine max
  Coding DNA Sequence Number=SeqID_54582
MPENIKNIDAQSVSFRDTP

SEQ ID NO: 146268 - protein, 43 aa, Glycine max
  Coding DNA Sequence Number=SeqID_54583
MEHLLVGDEQKRKTESKKAKKGDPRAANSSIPWRWLAQLAQAS

SEQ ID NO: 146269 - protein, 103 aa, Glycine max
  Coding DNA Sequence Number=SeqID_54584
MGIAPTKTPSGPQEVQQGPGFPALITGLCQFYRVPVPPARASGPLLIELSSKKCAPRQAQGETPQQSGDGRQRAIDAPPPPPEPLSSSKKIGAWPTTPWPTNR

SEQ ID NO: 146270 - protein, 268 aa, Glycine max
  Coding DNA Sequence Number=SeqID_54585
  Pfam annotation: Domain name=Transposase_23; Domain location=128-198; Score=-8.2; E_value=0.0094; Accession=PF03017.5; Description =TNP1ENSPM transposase
DSLEEQASQGSFVAHGRQDVLTATIGRLEHPGRVRAVGVGVTIKQYFRPAPRTSRTSSSIAPKDLEQLTQQIRDQLEESITEKMQSQFQSQMQSQGLALPLELEVGPSAACVSTKESCVDPSGNDPDTGDSDKCRLYIEENPPCLVSLGRLYEESTTVHKIPLLHDQVKVGVEEVRDADASILVPTEEVQLVGQTLNTFLALLTHLLKHLSEQGAVGPAKPTDGLDYDVDDPLYLMTLTIAQLFLKSLPVMWDATVVGVFNENFPLYI

SEQ ID NO: 146271 - protein, 89 aa, Glycine max
  Coding DNA Sequence Number=SeqID_54586
ENILPCKFVMTKTLKRCWKVLNSQQEMSVLELYIEKDVTGGSMFHYANSLTSCENYLSNDETQPPTNMSNLHLDEDDDDDYLVSNSYVE

SEQ ID NO: 146272 - protein, 76 aa, Glycine max
  Coding DNA Sequence Number=SeqID_54587
MAFWKREGATFRPKGQVAKILILNQTWKLFFLRKKLGMPGLNGLAQSDLASVDLGILVLLLVDLKVSSLDGLLLLD

SEQ ID NO: 146273 - protein, 29 aa, Glycine max
  Coding DNA Sequence Number=SeqID_54588
ACNELQNKERGMIEAVPESNKHENAVTRK

SEQ ID NO: 146274 - protein, 465 aa, Glycine max
  Coding DNA Sequence Number=SeqID_54589
  Homolog annotation: Hit_ID=Q6WAY4; Match level="QueryCoverage=58%, HitCoverage=58%, E-value=2e-19, Identity=25%"; Hit description =Putative uncharacterized protein
LTIAEVSIEAIASLTQYYDQPLRCFTFGDFQLVPTIEEFEEILGCPLGGRKPYLSSGCLPSLSRIATVVKDSARGLDRIKQTRNGIAGLPQKYLEDKARGMAHQGDWIPFMDVLALLIFGVVLFPNVDGLVDLAAIDAFLAYHHSKESPVVAVLADLFDTFDRRIDWDQLLAGIGGRTISWFPRWKEGKEGVLFSCGRYPNIPLVPHEGAPTEESMSPFVVRDFGAQDFKAIQAIHKAWETPLRKDQELRGIRNGIIGGYHEWLKVHIRGLDWLAKLKVISEESFEAPEEDEEVQALKSKLGKAKLAKEKFKLAATHIRKECAGLREENATTARALEQETKRARKEEYGRNKFRGALWGSNNELKLRREERDQSRAHSMVLKEELVACSRSKRSLSQRLCETETNMLAIIAKYQEELGPATAHEHRIADEYAQVYAEKEARGRVIDSLHQEATMWMDRFALTLNG

SEQ ID NO: 146275 - protein, 80 aa, Glycine max
  Coding DNA Sequence Number=SeqID_54590
MSSLERLHVLTTRGLHALTIQRTISPRLERATRPHLGATCPHLQRTTRSSPLEDYTSSPSEDYMFPIFKGGHALTFRGLH

SEQ ID NO: 146276 - protein, 57 aa, Glycine max
  Coding DNA Sequence Number=SeqID_54591
MNTKRGVKDKCFTQFGVLLSPIALKVVGPLLLDSNSSRYGTNPPFQFPTWQLTSKET

SEQ ID NO: 146277 - protein, 93 aa, Glycine max
  Coding DNA Sequence Number=SeqID_54592
MRITQVGRKISVREKKVKGKCACCFGSKFVLYIIGAYFIPILVLKFQLKIIVKTSAKTRGNWKGGLVPSLEEFESRSKGPTTLRAIGLRSTPN

SEQ ID NO: 146278 - protein, 60 aa, Glycine max
  Coding DNA Sequence Number=SeqID_54593
MILRGRLLLLMMTDIFQENDRSHPAQVVAAQIRTLLYKHEGCTSFLPSPRLKSYFVSFGT

SEQ ID NO: 146279 - protein, 238 aa, Glycine max
  Coding DNA Sequence Number=SeqID_54594
MFVDPNNANTATLGEVAETLQYMVSPQGRNTWTVDDLVPYVEKLAILSQEQERITEPMTHGSASKRRFPPQQFHMLQSSVETRGFDRRREIVQVEDFSQQMEQRGHGMYYTPPTFAQYPSQMYQYPFEGHDTDMSASEHSFGGVAETQPHFSWPTMTPSQQHDAPMATPNAPLGQQWDVPGAIPPMGDLLGVDLRHEFSAEAEEQGRRQRARRNPDRQARRWDRPCGTSSRHHEHHDD

SEQ ID NO: 146280 - protein, 75 aa, Glycine max
  Coding DNA Sequence Number=SeqID_54595
MTETVCTDNRMGISARHLTSRVRMAETICTDNHLGISVRHLTSWVRMTKSTEDDVNLRVSTSSLAPIDKGCRRRR

SEQ ID NO: 146281 - protein, 77 aa, Glycine max
  Coding DNA Sequence Number=SeqID_54596
TYQGNPCGVYPDLSSFTGSGVYPDLSSFTGSGVYPDLSSFTGSGIIQKLYSLYQAIRPVRFTSSGIRARLCVKKKSV

SEQ ID NO: 146282 - protein, 140 aa, Glycine max
  Coding DNA Sequence Number=SeqID_54597
VWRPPGTLMDPDKSNGALGFPALITRLCQSFGVPVTPSKVIRPPITRAFIEKYCTQRQVQCDAPQVADAPPPHQAGPVGLFDTEQYLRHLVRQQAANHRAHVQTHDCLYQMSLSLQSQGFTSFPCPTPDQFRAEVVWPGD

SEQ ID NO: 146283 - protein, 18 aa, Glycine max
  Coding DNA Sequence Number=SeqID_54598
QGFPNGRGLNQPLLQTVQ

SEQ ID NO: 146284 - protein, 188 aa, Glycine max
  Coding DNA Sequence Number=SeqID_54599
  Pfam annotation: Domain name=Transposase_23; Domain location=23-93; Score=8.6; E_value=0.00013; Accession=PF03017.5; Description =TNP1ENSPM transposase
MSAQSCNSGWSWSLRSSRNDPETGDSDKCGLYIEADPARLVAVGRVYEGSTLVHNTPLLPGQVKVSVDEVKDADAPVPIPIDEVSLVGQTLHTFLAWPTHLVKSLSHQVDVSPPKPPPKPDPEVDDLLYLMTLTIPELFLRPYQVRWDATVFGVVNPDFPLYIKHEDLSEITHGGQCLNISVLQLWIL

SEQ ID NO: 146285 - protein, 119 aa, Glycine max
  Coding DNA Sequence Number=SeqID_54600
MPRQAQGGDPQAPDAPPLPHQVDPAGSFDTERYLQHLVRQQAANHRAHVQTHDCLYQLSLSLQSQGFAPFPCPTPDQFRAEVAWPGDWPEAQVGEAPAEAPDDADEACMDEEMIDLLDF

SEQ ID NO: 146286 - protein, 122 aa, Glycine max
  Coding DNA Sequence Number=SeqID_54601
MDISEDTDIPIILGRPFMLTASCIVDMGKRKLELGFEDQKIDFDLFVEDKLAPEHNVFLQVMGEGQEVLKVRTKTNLLYNLNIGAYQPPFECPFTKRLFLAKRIIIYALSHEFKHLVHNPGI

SEQ ID NO: 146287 - protein, 108 aa, Glycine max
  Coding DNA Sequence Number=SeqID_54602
MSELTRDSPQISASPHQLDLVPYASGPYNAQWNAPGLLHEKHTLRSSRILGEMEVDEPWLGLWLPLNYQVDFVVDSGMAFMDNWVVGKENGCYWLSNDIVGLVGSLAM

SEQ ID NO: 146288 - protein, 74 aa, Glycine max
  Coding DNA Sequence Number=SeqID_54603
  Homolog annotation: Hit_ID=A7R4K5; Match level="QueryCoverage=59%, HitCoverage=57%, E-value=2e-09, Identity=68%"; Hit description =Chromosome undetermined scaffold_728, whole genome shotgun sequence
MKFDGSHIMHEHVIEMTNTAARLKTLGMAVNENFLVQFILISLPSEKKQSLRIKEVTQSVMQATKGINELERNL

SEQ ID NO: 146289 - protein, 68 aa, Glycine max
  Coding DNA Sequence Number=SeqID_54604
MTRGNPSDLQPFDPEIDRTFHRLVRHHFIPFDHPEHSITGESVHSVIGDFEHPDFEHSDFEHCTTSTP

SEQ ID NO: 146290 - protein, 55 aa, Glycine max
  Coding DNA Sequence Number=SeqID_54605
MVGWNDRAIADALQALAQAIGNPNRGEAGGAVEYQGLDRFQRNNPPSFNGGYNPN

SEQ ID NO: 146291 - protein, 29 aa, Glycine max
  Coding DNA Sequence Number=SeqID_54606
GIAQAERHPPIGKSAEGAGSFADEEDVAG

SEQ ID NO: 146292 - protein, 104 aa, Glycine max
  Coding DNA Sequence Number=SeqID_54607
ESLSETLERFRGLLRKTPTLGFFEPIQLNIFIDGLRPQSKQLLDASTGVKIKLKTPKEAMELIKNMATSDDVILHDRTHVPTKRSLLELSSQDALLAQNKLLAK

SEQ ID NO: 146293 - protein, 26 aa, Glycine max
  Coding DNA Sequence Number=SeqID_54608
MPDVSYPNFVRGPLLDDMRPFFGPCE

SEQ ID NO: 146294 - protein, 321 aa, Glycine max
  Coding DNA Sequence Number=SeqID_54609
  Gene Ontology: Mol. function=beta-lactamase activity; Cellular component=plasma membrane; Biological process=beta-lactam antibiotic catabolic process
  Homolog annotation: Hit_ID=P62593; Match level="QueryCoverage=78%, HitCoverage=88%, E-value=1e-131, Identity=93%"; Hit description=Beta- lactamase TEM precursor
  Pfam annotation: Domain name=Beta-lactamase; Domain location=31-280; Score=159.5; E_value=8.7e-45; Accession=PF00144.15; Description=Beta- lactamase
  Pfam annotation: Domain name=Peptidase_S11; Domain location=29-251; Score=-124.1; E_value=0.043; Accession=PF00768.11; Description=D -alanyl-D-alanine carboxypeptidase
  Pfam module annotation: Pfam domain module=Beta-lactamase::Peptidase _S11; Domain location=31-280::29-251
MSIQHFRVALIPFFAAFCLPVFAHPETLVKVKDAEDQLGARVGYIELDLNSGKILESFRPEERFPMMSTFKVLLCGAVLSRIDAGQEQLGRRIHYSQNDLVEYSPVTEKHLTDGMTVRELCSAAITMSDNTAANLLLTTIGGPKELTAFLHNMGDHVTRLDRWEPELNEAIPNDERDTTMPVAMATTLRKLLTGELLTLASRQQLIDWMEADKVAGPLLRSALPAGWFIADKSGAGERGSRGIIAALGPDGSPPLGHHFKNSVAPPTYLALLILLPVAAASGDKSCLTGATLPEGRKADRYPVSGRVGTGERTSELPGGNA

SEQ ID NO: 146295 - protein, 202 aa, Glycine max
  Coding DNA Sequence Number=SeqID_54610
  Gene Ontology: Mol. function=3-dehydroquinate dehydratase activity; Biological process=aromatic amino acid family biosynthetic process
  Homolog annotation: Hit_ID=A8GK70; Match level="QueryCoverage=63%, HitCoverage=85%, E-value=2e-54, Identity=85%"; Hit description=3 -dehydroquinate dehydratase, type II
  Pfam annotation: Domain name=DHquinase_II; Domain location=5-151; Score=242.1; E_value=1.2e-69; Accession=PF01220.10; Description =Dehydroquinase class II
MADKFHILLLNGPNLNLLGTREPEKYGSTTLTEIVNGLENQASALDITLSHLQSNAEHQLIDRIHQARGNTDFILINPAAFTHTSVALRDALLAVQIPFIEIHLSNVHAREPFRHHSYLSDVARLTVCRKPTNAPQKEYGITLMDIRKIKKLIELVEESGISELEISEGEESVRISRAAPAQAYPVMQQAYAMPAQHSASPG

SEQ ID NO: 146296 - protein, 84 aa, Glycine max
  Coding DNA Sequence Number=SeqID_54611
  Subcellular localization annotation: CTP_CleavageSite=22; ConfidenceScore=5.25e-01
MEIKKRLSSLGTDVWGANTFPVCKYNSRTFHLKVRRSRLFWFFRRFPQINVGGDSARIPFVEHASRESRVALPPKGRLRQSYLS

SEQ ID NO: 146297 - protein, 157 aa, Glycine max
  Coding DNA Sequence Number=SeqID_54612
SPSTLKWKCKVTRLRSLATRLPGVERPVVHVDPAIGKANGPHKKKLRTYLGIIARDKVDVTYETWKEVPAAQKDLIWEDIQDSVDDTVSEKYDISKEKWAQFCQTHRDPSWEKKGTGHPEAKHCPPRVVSWGGVIDPPSPIRRHVKRKMAAPRKFGR

SEQ ID NO: 146298 - protein, 140 aa, Glycine max
  Coding DNA Sequence Number=SeqID_54613
MCYEKVLRRLVLRNFVKGENKRYLRQLVLRNLLFKGKGRIKRILRLCHFEFFDKGEGRHKRIQEVSPSFFWKREKRDTKKNSGENFRKLFAKEEEEEEEEEEEEEVQRDSKVVKEYVEKLFVKVVSITLQVWSRKPLEEL

SEQ ID NO: 146299 - protein, 116 aa, Glycine max
  Coding DNA Sequence Number=SeqID_54614
  Subcellular localization annotation: CTP_CleavageSite=34; ConfidenceScore=5.21e-01
MLVRMIRTRLFAAARVKSCPVMHSSCVIASLSCCARTVGPPPISGGGPGTIKRKLLVRMWSTLKMRTRSPLKVRACSPLKARMCSPLEVRACSPLLARTCSPLQGEGVQLSVGEGV

SEQ ID NO: 146300 - protein, 120 aa, Glycine max
  Coding DNA Sequence Number=SeqID_54615
  Gene Ontology: Mol. function=protein binding
  Homolog annotation: Hit_ID=A7QXE8; Match level="QueryCoverage=55%, HitCoverage=10%, E-value=8e-15, Identity=59%"; Hit description =Chromosome undetermined scaffold_222, whole genome shotgun sequence
  Pfam annotation: Domain name=LRR_1; Domain location=27-44; Score=6.1; E_value=23; Accession=PF00560.24; Description=Leucine Rich Repeat
  Pfam annotation: Domain name=LRR_1; Domain location=3-25; Score=5.9; E_value=24; Accession=PF00560.24; Description=Leucine Rich Repeat
  Pfam annotation: Domain name=LRR_1; Domain location=52-77; Score=7.4; E_value=13; Accession=PF00560.24; Description=Leucine Rich Repeat
  Pfam module annotation: Pfam domain module=LRR_1::LRR_1::LRR_1; Domain location=27-44::3-25::52-77
MESLRNFYLSLSGFMGLIPHQLGNLSNLQHLNLGYNYALQIDNLNWISRLSSLEYLDLSGSDLHKQACSNLEKIWKLWKEAEFLEASFRAKANSLQEVHLPTLTNLLDQFFGTMHNGYLP

SEQ ID NO: 146301 - protein, 83 aa, Glycine max
  Coding DNA Sequence Number=SeqID_54616
MEHASRESRFASRRRKKKEGVETRVVITERAGRTKSVSYLCFPLISDERVHLLGLLTENKRGYLSCGSVLVEGTSTRFNVNKG

SEQ ID NO: 146302 - protein, 162 aa, Glycine max
  Coding DNA Sequence Number=SeqID_54617
  Gene Ontology: Mol. function=motor activity; Cellular component=cell projection
  Homolog annotation: Hit_ID=UPI00016621D1; Match level="QueryCoverage =63%, HitCoverage=40%, E-value=5e-09, Identity=39%"; Hit description =UPI00016621D1 related cluster
MSSPSEDFTSSPLEDYTSSPSRGLDVLAFRGLHVLAFRGLHVLAFRGLHVLTFRGLHVLAIRGLDVLAFRGLYVLTFRGLHVLAFRGLHVLPFRGLHVLTFRGLHVLAFRGLHVLAFRGQHVLALTFRGLHRTARPHLQRTTRPRLQRAARPHIQRTSRPHL

SEQ ID NO: 146303 - protein, 158 aa, Glycine max
  Coding DNA Sequence Number=SeqID_54618
  Pfam annotation: Domain name=G-patch; Domain location=38-82; Score =19.6; E_value=0.00081; Accession=PF01585.14; Description=G-patch domain
MPYVEATEESLETAFQSFEVVSIASVDSFSGQPCVSGTAMMVARVMLGNGYKPEMGLGKDNGGRTSLVNTRGNREKFGLCYKPTQADIRKSVTGMQSRSHGSQLGRQVEGGPPCHISRSFISVGLGHEGQVVAICEDDSPSGSDLVRPCPPGFRLGNW

SEQ ID NO: 146304 - protein, 82 aa, Glycine max
  Coding DNA Sequence Number=SeqID_54619
MAEEPRRVTLEDYSSSTTTQFFTSIARPEVQARTITYPTSMIQLIQNNWFHGLPNEDLYAHLATYIEICNTIRLAGVLADAI

SEQ ID NO: 146305 - protein, 235 aa, Glycine max
  Coding DNA Sequence Number=SeqID_54620
  Homolog annotation: Hit_ID=A5ZQM3; Match level="QueryCoverage=29%, HitCoverage=87%, E-value=2e-16, Identity=52%"; Hit description =Putative uncharacterized protein
CRKVKEVGDLMTGEPTTEAPVNGGRNYNGPKVAKFLVGLGEIDMSVKMRTTCTWTERPYEASLFPGIGFGLFLRSLGGGQRRPPSGGARAISFLGPDGDWPSSAKAEGSLTARPTRRAGTKADLPQELTSTGKVWHLDVGSSPPGAVVCSKGWAVRPLKRYVSWVQERRETVRSISGVGVRALRGPFPSTRGPGRTHLWCASYRAHEPPVAQPRQRWVLCPSGDGAKEVLRIQEK

SEQ ID NO: 146306 - protein, 54 aa, Glycine max
  Coding DNA Sequence Number=SeqID_54621
MGGGGFSCLGNCQEPHYKQTSKRVGLRPQKETTPENLAFHGFKQKTQMKHEAET

SEQ ID NO: 146307 - protein, 162 aa, Glycine max
  Coding DNA Sequence Number=SeqID_54622
  Gene Ontology: Mol. function=aspartic-type endopeptidase activity; Biological process=proteolysis
  Homolog annotation: Hit_ID=A5B3J2; Match level="QueryCoverage=60%, HitCoverage=23%, E-value=3e-12, Identity=43%"; Hit description =Putative uncharacterized protein
MHRSPTGNLVPLDLEIEATLRRNRAKRRRKLLQDRTVESILEEETHFSNSLSPNSPSSRESTTQLPETTSMADEQHQRITLEDYSSSSVPQFVTSIARPEVQAHNINYPHSLIHLIHGNLFQGLPNEDPYAHLAMFIEICSTVKIASVSDEAIRLSLFSFSL

SEQ ID NO: 146308 - protein, 106 aa, Glycine max
  Coding DNA Sequence Number=SeqID_54623
RTTERSESVSEEAEERPIRKPPLPARWPIHECSWHDRFPDWKAGSERNAINRRCNSLTHSLTHCVDFVLHMLKKNGSEKGNNKENEDTTITDVLKVEAHYDGCTPV

SEQ ID NO: 146309 - protein, 56 aa, Glycine max
  Coding DNA Sequence Number=SeqID_54624
  Subcellular localization annotation: CTP_CleavageSite=33; ConfidenceScore=5.09e-01
MSRGNFNGGLPESAPGRQPKLLNPRSLVRLNIQASSVDPSFKTTPNLDSPLRFRLT

SEQ ID NO: 146310 - protein, 161 aa, Glycine max
  Coding DNA Sequence Number=SeqID_54625
MAPKKLSAKRSRRDAAAEGTSAALEFDSHRFRSAEHQQCFEAIKGWSFHRERHVQFRDDEYTDFQEEIARRRWMSLVTPMAKFDPDIVLEFYDNAWPTEEGVRDMRSWVRVLEEGQECEFSQRRNRADGFDEEAMPNYYAYRVRISLRLLQGGGCGSCAPA

SEQ ID NO: 146311 - protein, 85 aa, Glycine max
  Coding DNA Sequence Number=SeqID_54626
MSIVQDAFNTSQVNGTRDDVLQWAQTVVHENEFVAVIMRSDTDTGSRERSSFVLIGCERSGTHKCRNKEFVRKDTGSRNQNLYVS

SEQ ID NO: 146312 - protein, 334 aa, Glycine max
  Coding DNA Sequence Number=SeqID_54627
  Homolog annotation: Hit_ID=Q84VI1; Match level="QueryCoverage=100%, HitCoverage=51%, E-value=1e-145, Identity=77%"; Hit description =Envelope-like protein
SILKDASVPDAEKEVPTSSTPEVSVPDVNKEVPTSSAPNAEVLPSPSEEESTEEEDQASEETPAPRAPEPAPGNLIDLEEVESDEEPIANRLAPGIAERLQSRKGKTPIKRSGRIKTMAQKKSTPVTPATSRRSKVAIPSKKRKEISSSDSDDDVELDVSTSKRAKKSGRKVPENVPDAPLDNISFHSIGNVEKWKYVYQRRLAVERELGRNALDCKETMELIKAAELLKTVTKLGDCYEGLVREFIVNIPSDISNRKSDDYQRVFVRGKPTDGVMDIAVSEHQIAKEITAKQVQHWPKKGKLSAGKLSVKYAILHRIGAANWVPTNHTSTVAT

SEQ ID NO: 146313 - protein, 75 aa, Glycine max
  Coding DNA Sequence Number=SeqID_54628
  Homolog annotation: Hit_ID=A6FJQ2; Match level="QueryCoverage=50%, HitCoverage=84%, E-value=3e-11, Identity=92%"; Hit description=50S ribosomal protein L5
MTVKPLTHAAPGDVHSLSMRKEKIPHQAPFAIQAAQLLGRAIGAGLFAITPAGERGMCCKAIKLGNARVFPVTTL

SEQ ID NO: 146314 - protein, 284 aa, Glycine max
  Coding DNA Sequence Number=SeqID_54629
MAKFDPDIVLEFYANAWPTEEGVRDLRSWVRGQWIPFDADALSQFLGYPLVLEEGQECEYGQRRNRADGFDEEAIAQLLCIPGQDFARTAAGRRVRIMRTNMTTLSQTWMMLLLSNILPNDHNSDLPLPKCVPPTRHPLDPDKSNSALGFPALITGLCQSFGVPVTPNRSRVATRRPQTHRRHLIRLIQLGHLTRSGIYGIWFASRWPNHRAHVQTHDCLYQLSLSLQSQGFAPFPCSILDQFRAEVAWPGDWPEAQVGEAPAEAPGDADEARMDEEMTDLLDF

SEQ ID NO: 146315 - protein, 291 aa, Glycine max
  Coding DNA Sequence Number=SeqID_54630
  Homolog annotation: Hit_ID=Q2HW90; Match level="QueryCoverage=57%, HitCoverage=33%, E-value=4e-21, Identity=37%"; Hit description =Putative uncharacterized protein
MGSVLIPTVNKPTEGPCRLLKNVRRGILLPLDVVSKKGTNSPDPRIPRLHLCHMHSIMHSSIPPMRYRSFDLHQLLSHFSKHGNKSNRQEVLPSQGQKPRYHQHQGIRAVDGPLQMQAFRKTYGKILELTIAEVSIEAIASLTQYYDQPLRCFTFGDFQLVPTIEEFEEILGCPLRGRKPYLSSGCLPSLRRIATVVKDSARGLDRIKQTRNGIAGLPQKYLEDKARGMANQGDWVPFMDVLALLIFGVVLFPNVDGLVDLAAIDAFLAYHHSKESPVVAVLADLFDTFDR

SEQ ID NO: 146316 - protein, 110 aa, Glycine max
  Coding DNA Sequence Number=SeqID_54631
MVLRTMPPKFKHIVVAIEESKNLEELSLEELQGSLESHEQRMNERINEKKSEQALQARSNPKKHGARWKKEKIEGKNNKWRGNQNSDKDHKKGGGSNSQNSSNRKKFDKR

SEQ ID NO: 146317 - protein, 97 aa, Glycine max
  Coding DNA Sequence Number=SeqID_54632
MPSLYDRTTKLEETLAQFMQVSMYNQNSTESAIKNLEVQVGQLAKQLAERPSSSFTANTEKNPKEECKAVMTSSRMAIQAEEGRANQKVEGFQQIVG

SEQ ID NO: 146318 - protein, 50 aa, Glycine max
  Coding DNA Sequence Number=SeqID_54633
MCSATDYKVKSIEVCLGAIHSNCDGSVASNLCGWKCSLVCGGATDLFPCC

SEQ ID NO: 146319 - protein, 38 aa, Glycine max
  Coding DNA Sequence Number=SeqID_54634
MTDRGQIQSKALVEKDEGFCGEGQSPRVEKDEGPSGEG

SEQ ID NO: 146320 - protein, 91 aa, Glycine max
  Coding DNA Sequence Number=SeqID_54635
  Homolog annotation: Hit_ID=B0HC01; Match level="QueryCoverage=36%, HitCoverage=70%, E-value=3e-11, Identity=100%"; Hit description =Putative uncharacterized protein
GAGAYGKTPATRPFYGSWPFAGLLLTCSFLRYPLILWITVLPPLSELIPLAAAERPSAARNSYDHDYEFELGTNYAEVVSLTSFLSGSPTS

SEQ ID NO: 146321 - protein, 39 aa, Glycine max
  Coding DNA Sequence Number=SeqID_54636
MWDNVGVEGAVSDRFQAGREREERLQVNIGFGKTDANII

SEQ ID NO: 146322 - protein, 231 aa, Glycine max
  Coding DNA Sequence Number=SeqID_54637
  Homolog annotation: Hit_ID=Q6WAY6; Match level="QueryCoverage=42%, HitCoverage=17%, E-value=1e-14, Identity=42%"; Hit description =Putative uncharacterized protein
MEGRTRVLISCGGFPNVPLMGTRGCISYNPVLAIRQLGYPMRGAPLEDELTPIISRGFNKTNVETLQKVRKAWEVLQKKDKELRGNNNGPISGYRKWLRAHVQGLDWLLSLRTAKREEVKAPEEDEEVQVLRAELEQAQTVKERFKSAALKIRKENAEIRDMNVATTKALEQETKRARKEEHGRNKFRGALWGSNSELKLWREERDQSRVDSLILKDELKVCSRFKRKLSQ

SEQ ID NO: 146323 - protein, 100 aa, Glycine max
  Coding DNA Sequence Number=SeqID_54638
MSVKNLVGCLGVHDKTNHTLASQITLTRVRGALKLGVFTPKAYIPKSPSGPLPPDSGPTQKRFLYTDSIYERYKTHDFSIVLKIVLTRHPLRVLALTRRP

SEQ ID NO: 146324 - protein, 112 aa, Glycine max
  Coding DNA Sequence Number=SeqID_54639
DQGVPMNPKRIKVIPEWPTPPTPLIELVRNHVPSWEDAQEMGVEGRSPEYEEPRDLRSNPFQGGGNDAILLRKGIGGELSYYRGCVAKLWLLISRRNLLKEASQGGELSYER

SEQ ID NO: 146325 - protein, 244 aa, Glycine max
  Coding DNA Sequence Number=SeqID_54640
  Gene Ontology: Mol. function=FMN binding; Cellular component=1-2nm peptidoglycan-based cell wall; Biological process=electron transport
  Homolog annotation: Hit_ID=Q8ZED3; Match level="QueryCoverage=51%, HitCoverage=59%, E-value=9e-41, Identity=67%"; Hit description =Electron transport complex protein rnfG
MAAGRAARHGGTAAAGEERYRMAYPVQLPAVAGAVRITLPARAGCSPAASLNSPLVASVAPGRPCSVRSLLPQLIRGHSRPPRNRGRLIYGALIGLLVWLIRSFGGYPDGGLMMIETIRKNAFTLGMFAVITTGVTAVVNYVTKPTVDHQTALQQKNLLDQVVPTDLYDNNIQQECLLVTDARALGNDKPHHLYVARKGDQPVAAALETTAPDGYSGAIQMLVGADFHGKVLGVRVIDIMRRRS

SEQ ID NO: 146326 - protein, 92 aa, Glycine max
  Coding DNA Sequence Number=SeqID_54641
MTLLLSNILPSDRNANLPLRKYQLVCVVPTWVSYPNFVRGPLLDDMRPFFGPCEKAVASGGSNPARLGELSSPGRAELAWASWAATTSPILL

SEQ ID NO: 146327 - protein, 132 aa, Glycine max
  Coding DNA Sequence Number=SeqID_54642
MECLEGFWETLEGNARCLFRGTIRLMATSLVHPDEPARTLQRTVEWILPTPTSYLLVEPVQVIEVTSFEEDPEEDPEELPPKPAVDALDFLEGDEDPLPEVDSPEDIMSASEADSTEESGPGGIATSGGSSS

SEQ ID NO: 146328 - protein, 147 aa, Glycine max
  Coding DNA Sequence Number=SeqID_54643
MEKSNKKTFKDKKEKKTYITWEDNDMDSSSDSENEIINMGLMAKDYESGEEVMFSNYDLSISFDELQDAFNDLHKESIILAKLVSYSKKTISSLEKEILKLNVELENDAILPRKGPVTRVMSKRLQEDWARVAEEGPRILMNLRIDF

SEQ ID NO: 146329 - protein, 35 aa, Glycine max
  Coding DNA Sequence Number=SeqID_54644
MDYFEFNIKLGTNMQNGNNLRDEIAYSLKFVIQYD

SEQ ID NO: 146330 - protein, 48 aa, Glycine max
  Coding DNA Sequence Number=SeqID_54645
AHKNPRAFSCISGPIYLEFFYPMPLRSRIASPGAYQHGWRRATFTREL

SEQ ID NO: 146331 - protein, 111 aa, Glycine max
  Coding DNA Sequence Number=SeqID_54646
MAPKKLSTKRSRRDAIGEGSSAAPEFDSHHFRSVEHQQRFEAIRGWSFHRERRVQLREDEYTDFQEEIARKHLTPPVTPMAKFDPEIFLEFYANAWPMEEGVRDMRLWVKG

SEQ ID NO: 146332 - protein, 137 aa, Glycine max
  Coding DNA Sequence Number=SeqID_54647
MSAEKNPFLVYLTTDVAYGCFPQSLNNQSVRNYSVNASMLKAQVEKDEGPSGEGQSPQVEKDEGSSGTYQGNPCGVYPDLSSFTGSGVYPDLSSLTGSGVYPDLSSFTGSGVYHDLSSFTGSGVIQTFVACIKRSAP

SEQ ID NO: 146333 - protein, 114 aa, Glycine max
  Coding DNA Sequence Number=SeqID_54648
  Gene Ontology: Mol. function=aspartic-type endopeptidase activity; Cellular component=small subunit processome; Biological process=DNA integration
  Homolog annotation: Hit_ID=A5CBT1; Match level="QueryCoverage=95%, HitCoverage=11%, E-value=7e-28, Identity=50%"; Hit description =Putative uncharacterized protein
MASPGPVFSFSGTPTITAAKLNWKNYPSWSASVELWFLGQGHHDHLEKASDSVSSDKRAEWEKLDYQLCAVLWQSVEPDILDILRSFKTCRSFWKKAQEIFANDIQSLFDATMK

SEQ ID NO: 146334 - protein, 194 aa, Glycine max
  Coding DNA Sequence Number=SeqID_54649
MDNEEGVQEQMKADLSALKDQMASISEDKATATASSTVREAEPVLQPALNSGQDRNTAVFGRRYSPQAYPYGLPPDFTPCATPEDLSQAPTFEGQLPPYDDYPGQDDEEGDTHLGPLLHLKDPSPHELPQPNIVRHIPASPTPVKESVPFVEDKGKIEALEERLRAVEGLDNYPFSDLADLCLVPNIVIPPKFK

SEQ ID NO: 146335 - protein, 98 aa, Glycine max
  Coding DNA Sequence Number=SeqID_54650
  Subcellular localization annotation: CTP_CleavageSite=79; ConfidenceScore=5.29e-01
MVMLVCMIRTRLFAAARVKSCPSMHSSCVIASLSGCARTVGPPPISGGGPGTIWSPLKVRTRSPLKARACSPLKFRTCRLSKARECSPMMARMCNPLK

SEQ ID NO: 146336 - protein, 185 aa, Glycine max
  Coding DNA Sequence Number=SeqID_54651
MDRLGSSSSAPNNRERDYHNDSRHVTSVLLWKWWVTHLQALRIWTSPGRRIKAGLKRGKFNHPTWTNEKTGANEEGEDEGGAHAVTAIPIQPSFPPTQQCHYSANNKPSPYPPPSYPQRPSLNQPQSLSTALPMTNITFSMNQNTNQEMNFAARKPVEFTPIPVSYADLLPYLLDNSMVAITLAK

SEQ ID NO: 146337 - protein, 134 aa, Glycine max
  Coding DNA Sequence Number=SeqID_54652
SARVQGGHSYWWRDLRKLYHQSDQSIFQQCMSWKQPDLISMMRNFSQDNWRWDLKWRRNLFDHESDLAVNFMEEISSIHIQRHVKDIMTWKVDPSGVYSTKLLKDRLPTRANLIRGNVIIQDTVCPLCGLEQEE

SEQ ID NO: 146338 - protein, 143 aa, Glycine max
  Coding DNA Sequence Number=SeqID_54653
MEAMKEQMATMMEAMMGMKKILEANAVAAALTSVVAEVDSTPPSGLDQINYPTSNMIGQGGKELGSTRGPHFVQNVNNSTPILIESQQPQSDHAHVSQPMREAHEIPHHNLADFEPCLKYATEGQAVGGVPLPNTLEGPQFLL

SEQ ID NO: 146339 - protein, 201 aa, Glycine max
  Coding DNA Sequence Number=SeqID_54654
  Homolog annotation: Hit_ID=Q8H6W2; Match level="QueryCoverage=26%, HitCoverage=58%, E-value=2e-08, Identity=50%"; Hit description=Gag -protease polyprotein-like protein
MVNQRSSKINHKNNSSESRTIQEFKNQEEFKTQEESLESRIKIQESLTTSRFVASSNPLFPEGNSIHRPPIFNGEGYHYWKTRMQIFIEAIDLNIWEAIEIGPHIPTVVDGQWRNHPGNQFNRDQGGPSTRPSQQRPSLYDRTTKLEETLAQFMQVSMSNQKSTKSAIKNLEVQVGQLAKQLTDRSSSSFTANTEKNPKEE

SEQ ID NO: 146340 - protein, 132 aa, Glycine max
  Coding DNA Sequence Number=SeqID_54655
  Gene Ontology: Mol. function=aspartic-type endopeptidase activity; Cellular component=small subunit processome; Biological process=DNA integration
  Homolog annotation: Hit_ID=A5CB76; Match level="QueryCoverage=99%, HitCoverage=47%, E-value=2e-28, Identity=44%"; Hit description =Putative uncharacterized protein
MASASPVFSFSRTLTITTAKLNWKNYLSWFASVELWFLGQGYHDHLEKGANAVPNDKRLEWEKLDFQLCVVLWQSVEPDVLEILRSFKTCCSLWKKDQEIFANDIQSLFDATMKVTTLKQTSHDMIAHIGKA

SEQ ID NO: 146341 - protein, 153 aa, Glycine max
  Coding DNA Sequence Number=SeqID_54656
MIMRSQDIYSSQDEATTSPSSSESEEAKREESSEEIYPQEEEQPLMVKEECKEVSVSSKRQPPHFLLCKKTLVSIATPLGLEFIPQVKNLLDEGLVRKSLNPGALSVPKIGFIRHQIPKIGGMMNVLSGATLFCKITRAPNIFMIYVHRDSLG

SEQ ID NO: 146342 - protein, 217 aa, Glycine max
  Coding DNA Sequence Number=SeqID_54657
  Homolog annotation: Hit_ID=A5BSR3; Match level="QueryCoverage=100%, HitCoverage=61%, E-value=2e-11, Identity=27%"; Hit description =Putative uncharacterized protein
SPSTLKSTRNATRLRSLATRLVGTERPLVHVDPATGKADGPHNKKLRTYLGIVTRDKVDVTYKNKKQVPDAQKDLIWEDIQAEFDIPEAFDQRTKKKILQTMGERDPSWEDVPKKAQAIQKQNTALLVLSRRGYEYLEKKMMDEKTKKKLEEAAQTGSIDTVIDPSSSIRQHVKWKMARIKKIGQMTSEAAKQIADKIDSLEEQASQGSFVTHGRQD

SEQ ID NO: 146343 - protein, 140 aa, Glycine max
  Coding DNA Sequence Number=SeqID_54658
MEAMKEQMATMMEAMMSVKKIMEANAVAIAATSIVAKVNPMPSSGLNQMNHPTSDMVGKRFGKYGRPHDVQIQNKHAFPPYGLPPNYTPPNVAYTPNKDVNNSALILIESRQPHHVHVSQPMGVAHEIPHHNLADFEPCL

SEQ ID NO: 146344 - protein, 230 aa, Glycine max
  Coding DNA Sequence Number=SeqID_54659
MRRQNLVIPHPFAIQTQSCPMARRDKIWSFCTLLSSRGGGPDDMRRQNLVIPHPFAIQTQSCPMARRDKIWSFCTLLSSRGGGPDDMRRQNLVIPHPFAIQTQSCPMARRDKIWSFCTLLSSRGGGPDDMGRQNLVIPHPFAIQTQSCPMARRDKLWSFCTLLSSRGGGPDDMRRQNLVIPHPFAIHTQLCPMARRDKLWSFCTFRQLRPTSPLTRGDLHHLPHSQDLSY

SEQ ID NO: 146345 - protein, 70 aa, Glycine max
  Coding DNA Sequence Number=SeqID_54660
MAGAKLSRLVAVLHFLILLMVQGFSNPDFDALVAFKTASDTSQKLTAWRGSSRVDLQACKLGTGRRFTTS

SEQ ID NO: 146346 - protein, 123 aa, Glycine max
  Coding DNA Sequence Number=SeqID_54661
MVQPKPSAGLKGKPHQHALTHHAFLYFNKQKLGPPRPKSCKNTIEAFHRALGGRTFGYQQQGNGGNVACPIILKYNLCLKPSPTTPQFKETKHKFAPNCLTELVKPCTIQSIKGITGKLETKG

SEQ ID NO: 146347 - protein, 66 aa, Glycine max
  Coding DNA Sequence Number=SeqID_54662
MGRDLKKVPQHLNAISGIDPKKSHEERRSKKAYIAWDDNDSSDSSEKEINLLSKDYESDENISQED

SEQ ID NO: 146348 - protein, 480 aa, Glycine max
  Coding DNA Sequence Number=SeqID_54663
  Gene Ontology: Mol. function=4 iron, 4 sulfur cluster binding; Cellular component=formate dehydrogenase complex; Biological process= formate metabolic process
  Homolog annotation: Hit_ID=Q1H3E9; Match level="QueryCoverage=100%, HitCoverage=50%, E-value=0.0, Identity=81%"; Hit description=Formate dehydrogenase, alpha subunit
  Pfam annotation: Domain name=Fer4; Domain location=21-44; Score=24.5; E_value=5.3e-05; Accession=PF00037.18; Description=4Fe-4S binding domain
  Pfam annotation: Domain name=Molybdop_Fe4S4; Domain location=55-109; Score=79.4; E_value=1.2e-20; Accession=PF04879.7; Description =Molybdopterin oxidoreductase Fe4S4 domain
  Pfam annotation: Domain name=Molybdopterin; Domain location=112-480; Score=169.1; E_value=1.2e-47; Accession=PF00384.13; Description =Molybdopterin oxidoreductase
  Pfam module annotation: Pfam domain module=Fer4::Molybdop _Fe4S4::Molybdopterin; Domain location=21-44::55-109::112-480
GTFALTIQGRGFESKVSAGNKDFLDSECVSCGACVQACPTATLMEKTVIEAGTPEHKVTTTCAYCGVGCSFDAEMKGEQVVRMTPSKEGGANHGHSCVKGRFAWGYATHADRITTPMIRKSIHDPWQKVGWDEAINYAASEIKRIQAQYGKEAVGGITSSRCTNEEVYVTQKLIRAVFGVNNVDTCARVCHSPTGYGLKQTLGESAGTQTFDSVMKSDVIFVMGANPTDGHPVFGSLMKRRLREGAKLIVVDPREIDLVDNSPHVRADYHLKLRPGTNVAMISAISHVIVTEGLVQEDFVKARCEWDSYVAWRDFAAKPENSPEALEKELGVSANVVREASRLYATGGNAAIYYGLGVTEHSQGSTTVMGIANLAMATGNIGREGVGVNPLRGQNNVQGSCDMGSMPHEFPGYRHVSDDETRAEFEQAWGVTLSADPGLRIPNMLDLAAEGSFKAVYCVGEDIAQSDPDTQHVTHALESM

SEQ ID NO: 146349 - protein, 272 aa, Glycine max
  Coding DNA Sequence Number=SeqID_54664
SYLRQLRVRAHGGRLRTPTCELGHRRAEGRCSALSATGVPARGEPRRPDRIDEEGGSVTTTRCILGGLAWRVATSLAFGIWCCAASSPTPYPPRELEGAFAVTDEELVADVFRSIVDGGHARTRGEASSRLHHGVEQFHLRDSILRAAEISLTRGVSIGLKSFFGRDRWGSIRRRRPSSRSRCSDLLRARAAQARLWHGRVGAVTRRGCRRAGTPRRVLWTGLLRQPRPRSALRSRSCAGRARRRESCTSDRTSVKDSPRSAPTFSRRTPTP

SEQ ID NO: 146350 - protein, 138 aa, Glycine max
  Coding DNA Sequence Number=SeqID_54665
  Subcellular localization annotation: CTP_CleavageSite=21; ConfidenceScore=5.51e-01
MASPPASLPPPPPALLDALASLSAIKRTRKASRLRSLSTRPPGVERPVVHVDPATGKADGPHKKKLRTYLGIVACDKAEFDIPKASDNRTKRKLLQTVGERWRQFKSDLTRKWALAADQDGVEDTVCEKYGISMEKWA

SEQ ID NO: 146351 - protein, 120 aa, Glycine max
  Coding DNA Sequence Number=SeqID_54666
  Subcellular localization annotation: CTP_CleavageSite=34; ConfidenceScore=5.78e-01
MATPPSSPPPPSPTDSTSHSPSTIKRTRKVTRLRSMATRPVRTKRPRVHVDPATGKTDGPYRKKLRTYLGIVARNKSDLTSKWALIADKDGVDDTVCQKYDISKEKWTQFCQSHRDPSWQ

SEQ ID NO: 146352 - protein, 72 aa, Glycine max
  Coding DNA Sequence Number=SeqID_54667
  Homolog annotation: Hit_ID=Q7PDL8; Match level="QueryCoverage=83%, HitCoverage=8%, E-value=8e-07, Identity=41%"; Hit description =ERYTHROCYTE MEMBRANE PROTEIN PFEMP3
  Subcellular localization annotation: CTP_CleavageSite=43; ConfidenceScore=5.59e-01
MRTRSPLKVRACSPLRVRTCSPLRVRTSSPLKVRTCSPLKVRECSPLKARTCSPLKVRACSPLLARTCSPLK

SEQ ID NO: 146353 - protein, 81 aa, Glycine max
  Coding DNA Sequence Number=SeqID_54668
MRLRTASGDVVPINLEIEATCRRNNAARRRRKQDTEGSSYISPPLSPNHTEMDAKPARRVTLEDFSKTATPQFFTSIARPE

SEQ ID NO: 146354 - protein, 401 aa, Glycine max
  Coding DNA Sequence Number=SeqID_54669
  Homolog annotation: Hit_ID=Q2HW90; Match level="QueryCoverage=66%, HitCoverage=66%, E-value=4e-23, Identity=28%"; Hit description =Putative uncharacterized protein
MEPLQMQAFRKTYGKILELTIAEVSIEAIASLTQYYDQPLRCFTFGDFQLVPTIEEFEEILGCPLGGRKPYLSSGCLPSLRRIATVVKDSARGLDRIKQTRNSIAGLPRGYLEDKARGMANQGDWVPFMDVLALLIFGVVLFPNVDGLVDLAAIDAFLAYHHSKESPVVAVLADLFDTFDRRCEKSSERIICCLPALCERGVVLTTIPALAIRQLGYPMREAPMEESMSPFLVRDFGAQNFKAIQRIHKAWETPLRKDQELRGIRNGIIGGYHEWLKVHIRGLDWLAKLKVVSEESFEAPEEDEEVQALKSELGKAKLAKEKFKLAATHIRKECAGLWEENATTARALEQETKRARKEEYGRNKFRGALWGSNSELKLRREERDQSRAHSMVLKEELVACS

SEQ ID NO: 146355 - protein, 75 aa, Glycine max
  Coding DNA Sequence Number=SeqID_54670
  Homolog annotation: Hit_ID=A5AV98; Match level="QueryCoverage=81%, HitCoverage=7%, E-value=2e-16, Identity=68%"; Hit description =Putative uncharacterized protein
MDVKLYDCWLMVPVPNSLNSHVSSVPIFNGLNFSDWNEQVQFHLGVLDLDLAILEEKPATITDASSNEQKAHYKA

SEQ ID NO: 146356 - protein, 328 aa, Glycine max
  Coding DNA Sequence Number=SeqID_54671
  Gene Ontology: Mol. function=transferase activity, transferring phosphorus-containing groups; Cellular component=integral to membrane; Biological process=two-component signal transduction system (phosphorelay)
  Homolog annotation: Hit_ID=Q1PXZ9; Match level="QueryCoverage=57%, HitCoverage=29%, E-value=3e-34, Identity=41%"; Hit description =Sensor protein
  Pfam annotation: Domain name=Response_reg; Domain location=200-315; Score=62.8; E_value=1.2e-15; Accession=PF00072.15; Description =Response regulator receiver domain
  Pfam annotation: Domain name=Response_reg; Domain location=67-186; Score=18.5; E_value=0.00014; Accession=PF00072.15; Description =Response regulator receiver domain
  Pfam module annotation: Pfam domain module=Response_reg::Response _reg; Domain location=200-315::67-186
QFIEIAITDTGIGIEAQDITDCLNRLCKWKARFQDGLREPVLAGFGQEAGSASPWRGCRPKCPRQGSTFTSGLSTTCISRSCAGAPNGPDPVQLESDNCRVTRAARRNSAAILGDGVPPDLITLDILLPGMDGWEFLAKLKANDALAHIPVVIISIVADSNRGLSLGAAHVLQKPVSANDLQTALSKLGFAKPENQQAGLNVLVVDDDPKAVEIISAYLEHANHSVLRAYGGKEAINIAKLQTPDLIVLDLMMPEASGFEVVEALKLDKRTAKIPIIIVTSKFLTPDEQLTLKGQVLAVLEKSEFNHGNFLSEVHRALAGQRGNHRAK

SEQ ID NO: 146357 - protein, 167 aa, Glycine max
  Coding DNA Sequence Number=SeqID_54672
MEFGDIVVHFNILDAMKHPFEDHSIFRAEFEFDPVSDFYAESEFEFKSGVVPLNVDFLESECTNHVAVSTYTSDLLYEQPLSVIISASLAAEQEEKLLLVLKKHKKAIGWTLVDIPGVATYPSVGGRRVTRRMRVPRKEYARSRHQRLFEENVGKTGKDAIYELFNE

SEQ ID NO: 146358 - protein, 292 aa, Glycine max
  Coding DNA Sequence Number=SeqID_54673
  Homolog annotation: Hit_ID=Q6WAY6; Match level="QueryCoverage=70%, HitCoverage=38%, E-value=1e-11, Identity=26%"; Hit description =Putative uncharacterized protein
VIDAFLAYHHSKESPVVAILADLFDTFDRSAINWFPRWKEGEEGVLFSCGDYPNVPLLGTRGCINYNPALDIRQLGYPMRGAPTEESLSPLLVRDLGAQSLKVIQRVHKAWRSPLRKDKELRASENFEAPEEDEEVRALKLELGKARLAKEKFKSAATHIRKECTELQEENAATLKLRREERDRSRVHGMILKEELAACARSKRSLAQHLEATEQSRLAIIGQYKEELNQSVTHEQKLVEDFAQVYTEKEARGRVIDALHQEATMWMDRFALTLNGSQDLPRLLAKAKAMAE

SEQ ID NO: 146359 - protein, 17 aa, Glycine max
  Coding DNA Sequence Number=SeqID_54674
MELTSHGTTLPIGLSLS

SEQ ID NO: 146360 - protein, 106 aa, Glycine max
  Coding DNA Sequence Number=SeqID_54675
MTKFDPDIVLEFYANAWPTEEGVRDMRSWVRGQWIPFDVDALSQFLGYPLVLEEGQECKYGQRRNQSDGFDEEAIAQLLCMPGHNFSRTAAGRRVRIMRTNMTTLT

SEQ ID NO: 146361 - protein, 59 aa, Glycine max
  Coding DNA Sequence Number=SeqID_54676
AVSKDALIAELKDTCKSGIDDEEAAEEEGEAAEEEEEAAEEEEDAAEETESDDDSEATP

SEQ ID NO: 146362 - protein, 110 aa, Glycine max
  Coding DNA Sequence Number=SeqID_54677
MKAYRICKRGHPHCKSSCIFRKNIQNEDLVNKVLRYLSREWQPKKHEMELMRLNCRSKLHDDEPSNFDDVKSPSDRFNTSRSSIKNPIQDSRFKGRNQEETSQDFIWNKY

SEQ ID NO: 146363 - protein, 179 aa, Glycine max
  Coding DNA Sequence Number=SeqID_54678
  Homolog annotation: Hit_ID=UPI0000ECBAF8; Match level="QueryCoverage =22%, HitCoverage=48%, E-value=2e-16, Identity=100%"; Hit description= UPI0000ECBAF8 related cluster
MRKRHASRREKGGQVSGKRQGRNRRAHEGASRGKRLGGGAYGKTPATRPFYGSWPFAGLLLTCSFLRYPLILWITVLPPLSELIPLAAAERPSAARNSYDHDYEFELGTPALSVKSAMLFLLSRPAGMQAWHWPSFYNVVTGKTLALPNLIALQHIPLSPAGVIAKRPAPIALPNSCAA

SEQ ID NO: 146364 - protein, 40 aa, Glycine max
  Coding DNA Sequence Number=SeqID_54679
MTTVTQMWMTLLLNNVLPSDHNSDLPLPKCQLVCHLPGTL

SEQ ID NO: 146365 - protein, 72 aa, Glycine max
  Coding DNA Sequence Number=SeqID_54680
MPIGWTSKKSGADTKEEELTDLRLNPHQGGGDDAILPRKEPVTRAMSKRLQEDWARATEEDPRVLMNLRVDF

SEQ ID NO: 146366 - protein, 61 aa, Glycine max
  Coding DNA Sequence Number=SeqID_54681
  Homolog annotation: Hit_ID=A5C3T2; Match level="QueryCoverage=95%, HitCoverage=7%, E-value=4e-08, Identity=38%"; Hit description =Putative uncharacterized protein
MTGIPQPIPDNPVDQVDHQIPDNDEQPVEQHDRQENVDVALRRSTKSNGVWNLVELPNGAK

SEQ ID NO: 146367 - protein, 92 aa, Glycine max
  Coding DNA Sequence Number=SeqID_54682
MTKIIQLIEGAKDTVIIQGVEGSAACCGEVDGDKARNKGKEPLEELGGPMARARTNKAKEALQQVLTMLFEFRPKLQVEKLRIVNCTMFQEE

SEQ ID NO: 146368 - protein, 36 aa, Glycine max
  Coding DNA Sequence Number=SeqID_54683
MAAKKDGLAKDLDLGLFDPFKDVKDDVLLDEEEIVV

SEQ ID NO: 146369 - protein, 154 aa, Glycine max
  Coding DNA Sequence Number=SeqID_54684
  Homolog annotation: Hit_ID=UPI00016621D1; Match level="QueryCoverage =81%, HitCoverage=39%, E-value=3e-08, Identity=32%"; Hit description =UPI00016621D1 related cluster
  Subcellular localization annotation: CTP_CleavageSite=9; ConfidenceScore=5.12e-01
MDTSKPYTGAMRGTVHEPQDGPLGTSTLTFRRSCTFTFRGLQVLAIKGLHALTFRGLHVLTYRGSCTFTFRGLHALAFRGLHVLAFRGLHVFTFRGLHVLAFKGSCTFTFRGLHVLAIKGSCTFSFVGRHALTFRGLHVLAFRGLHVLAIRGLH

SEQ ID NO: 146370 - protein, 60 aa, Glycine max
  Coding DNA Sequence Number=SeqID_54685
MLEVWETWSFKEGLPGVQRKEQGWSKMMTLLGGLIREQQAMCAKIVVGSRNLDQSMMALL

SEQ ID NO: 146371 - protein, 107 aa, Glycine max
  Coding DNA Sequence Number=SeqID_54686
MSFELAQSFNIQFQASRYMTGLNQTSEASTFNFERLDILRASIRHPSKKLLSFELAESFNIQFRASRYVTDIIRYPSKKILSFELAQSFNIQFRGSRYVTGLNQTSE

SEQ ID NO: 146372 - protein, 121 aa, Glycine max
  Coding DNA Sequence Number=SeqID_54687
SAEHQQRFETIKGWSFHRERRVQLRDDEYIDFLEEIACRRWTSLVTPMAKFDPDIVLEFYVNAWPTEEGVRDMRSWVRGQWIPFDADALSQFLGYPLVLEEGQECEYSQRRNWADGHWPEA

SEQ ID NO: 146373 - protein, 353 aa, Glycine max
  Coding DNA Sequence Number=SeqID_54688
  Gene Ontology: Mol. function=transferase activity, transferring nitrogenous groups; Cellular component=cytosol; Biological process =amino acid biosynthetic process
  Homolog annotation: Hit_ID=A4WC70; Match level="QueryCoverage=100%, HitCoverage=100%, E-value=0.0, Identity=93%"; Hit description =Histidinol-phosphate aminotransferase
  Pfam annotation: Domain name=Aminotran_1_2; Domain location=26-348; Score=307.0; E_value=3.6e-89; Accession=PF00155.12; Description =Aminotransferase class I and II
  Pfam annotation: Domain name=Aminotran_5; Domain location=29-344; Score=-180.4; E_value=0.0097; Accession=PF00266.10; Description =Aminotransferase class-V
  Pfam annotation: Domain name=Cys_Met_Meta_PP; Domain location=47-263; Score=-299.2; E_value=0.076; Accession=PF01053.11; Description=CysMet metabolism PLP-dependent enzyme
  Pfam module annotation: Pfam domain module=Aminotran_1_2::Aminotran _5::Cys_Met_Meta_PP; Domain location=26-348::29-344::47-263
MNIEELARENVRRLTPYQSARRLGGKGEVWLNANEFPTAVQFELSQQTLNRYPECQPKAVIENYAQYAGVKPEQVLVSRGADEGIELLIRAFCEPGKDAVMYCQPTYGMYSVSAETFGVACRNVLSLENWQLDLQGIADNLDGVKVVFVCSPNNPTGQIINPQDIRTLLEMTRGKALVVADEAYIEFCPQATLAGWLEEYPHLVVLRTLSKAFALAGLRCGFTLANKEVIDLLLKVIAPYPLSTPVADIAAQALTPQGINAMRERVAQILEERQYLVTALKEIPCVEQVFDSETNYILVRFTASSAVFKSLWDQGIILRDQNKQPSLSGCLRITVGTRAESQRVIDALKAEKV

SEQ ID NO: 146374 - protein, 169 aa, Glycine max
  Coding DNA Sequence Number=SeqID_54689
  Homolog annotation: Hit_ID=Q0KIL1; Match level="QueryCoverage=50%, HitCoverage=9%, E-value=2e-07, Identity=37%"; Hit description =Gag/pol polyprotein, 3'-partial, putative
  Pfam annotation: Domain name=G-patch; Domain location=46-90; Score =23.4; E_value=0.00028; Accession=PF01585.14; Description=G-patch domain
MLVSCPSSAPYVEAAEESLETAFQSFEVVSCASVEPSSSLPSLFKAAIMVARVMLRNGFEPGMGLGKDCLGNADVVNIKGNPYKYGLGYEPGMPRRRNVPSRFRADRVWPDRISQCFTSAGMVSEEEVAAIEEEFPQDPPSFVQPCHPDSQVGNWRVISQSEVYTADSM

SEQ ID NO: 146375 - protein, 69 aa, Glycine max
  Coding DNA Sequence Number=SeqID_54690
MMTTKDDDKSDEQKAQVNQRTSQENQEQVKSSRIKKNSRLKKKAYKQESRFKIQDLKNQDQDSRLRIQE

SEQ ID NO: 146376 - protein, 119 aa, Glycine max
  Coding DNA Sequence Number=SeqID_54691
HQVDLLPEASLPNRPTYNRKPQETQHKDAQAKVEYVKRLYDQVKVQIAKKNESYTKQANKKRKEVVLEPGDDPGHLRENVFQEGRNDENPETGQIQAKGPSGEGQSPRAEKDEGPSGEG

SEQ ID NO: 146377 - protein, 85 aa, Glycine max
  Coding DNA Sequence Number=SeqID_54692
MEEGMRDMRSWVRGQWIPFDADAIGQLLGYPLVLEEGQECKYGQRRNRFCPDCCRETGADHAHQHDHPDSDMDDFAAQQHPAQRP

SEQ ID NO: 146378 - protein, 163 aa, Glycine max
  Coding DNA Sequence Number=SeqID_54693
MDNEEGMQEQMKADLSALKDQMASISEVMLKLQKTIEDKATTTASSTVREAEPVLQPALNPGQDRNTIVFGQRYSPQAYPYGLPPDFTPRATPEDLSQAPTFEGQLPPYDDYPGQDDEEGDIHLGPLLHLKDPSPHELPQPNIVHHIPAVTHTCKKICSLHGR

SEQ ID NO: 146379 - protein, 80 aa, Glycine max
  Coding DNA Sequence Number=SeqID_54694
TYQGNPCGLYPDLSSFTGSSVYPDLSSFTESGIYPDLSSFTRSGVIQTFIACIKRSAPTQVHIIFHQGLILDDPKSAFLQ

SEQ ID NO: 146380 - protein, 57 aa, Glycine max
  Coding DNA Sequence Number=SeqID_54695
MTKSKGKDPLEGLGGPMTRARARKAKEALQQVLSILFEYKPKFQGEKSKVVNGIKLF

SEQ ID NO: 146381 - protein, 100 aa, Glycine max
  Coding DNA Sequence Number=SeqID_54696
ELICGGRRNFTSQWWQDLKSIFQQHHNECLTDNLKWRVGRGSSINFWKHKWMEDNCTLQGKYPQLYLISKQQNSSINYMGDFVEGSGNGSYHGEGLPNAL

SEQ ID NO: 146382 - protein, 97 aa, Glycine max
  Coding DNA Sequence Number=SeqID_54697
  Homolog annotation: Hit_ID=A8GKN8; Match level="QueryCoverage=79%, HitCoverage=86%, E-value=4e-20, Identity=66%"; Hit description =Putative uncharacterized protein
MSESTVVIRVDEELKTAFASAAKAADRTASQLLRDFMREFVSRQAQQEEYNQWLKEKVEVSRKALREGKFADDEERENGADSRYARAGHLPVLFAGL

SEQ ID NO: 146383 - protein, 53 aa, Glycine max
  Coding DNA Sequence Number=SeqID_54698
MKLASTIDSFEEKATQGSFVPHGRQDVLTAVIGCPEHPGHVRAAGASVTIKQY

SEQ ID NO: 146384 - protein, 70 aa, Glycine max
  Coding DNA Sequence Number=SeqID_54699
MLQPYGINICLKEHSNPVTPKAYTPKSPSGPLPPDSGPTPKIEFICIYNTMFMNYVNIPRPHTHVSNTFN

SEQ ID NO: 146385 - protein, 45 aa, Glycine max
  Coding DNA Sequence Number=SeqID_54700
MATPMSTACYLDKDEAGQLVDIKKYRDIKSIEKALVGLATLLVPH

SEQ ID NO: 146386 - protein, 43 aa, Glycine max
  Coding DNA Sequence Number=SeqID_54701
MGAKYFEVVKRGSHPNNRWSPDKIRGHEANTLRAFLSTAMHIT

SEQ ID NO: 146387 - protein, 112 aa, Glycine max
  Coding DNA Sequence Number=SeqID_54702
MEGLVDLAVIDAFLAFHHGKESPVVAILAMYDTFDRGGRKNRDSIFIRRMSKCSLDETRSCINYNPVLAIRQLGYLMRGVPSDESIPPFIAQGFSDHNARVLQGVRKAWDAA

SEQ ID NO: 146388 - protein, 79 aa, Glycine max
  Coding DNA Sequence Number=SeqID_54703
GLHVLTIRGLHALTIRGLHVLAFVGLHAFTFRGLHVLAIIGLHALTLKRTTRPRQQRAARPHLQRTTHPRLERAPRPHL

SEQ ID NO: 146389 - protein, 114 aa, Glycine max
  Coding DNA Sequence Number=SeqID_54704
GSKGSLNCKHHKPHDEGSSIKSMLYKLLVNLRSGVFMLQIDASAVCGWKKGGSGNLNGEDTCLTESLRWQIVSVMMLLAANTSIMMGIYDMGQHSWSFSAETVVALFPARVLFA

SEQ ID NO: 146390 - protein, 372 aa, Glycine max
  Coding DNA Sequence Number=SeqID_54705
  Homolog annotation: Hit_ID=Q6WAY6; Match level="QueryCoverage=72%, HitCoverage=45%, E-value=3e-23, Identity=28%"; Hit description =Putative uncharacterized protein
GTDHRRVRRDLWMPGRRKEAIPFFWVSSFYGKNSKSGQDLRIRARLKRLEKKAKALANQGEWTSFNDILALLVFGTTLFPNVDELVDLAAIDAFLAYHHSKESLVIAILADAYDMFDLRCEKSSARIVYCTPTLYVWLVSHIFCHEGRTVCPLQGHRMCVEKGKANWEERLAGMVGASVNWFPRWKEGGVGVLCLCKGFPNIPLMETRGCINYNPMLAIRQLGYPMRGASSEEIIAPFVARGFSEANMRILQRIRKAWNTVERKDKELRGSSNGIIGGYHKWLRSRTQGITLFLKLKGLSGKEAKVLEESEEVQALKVELKRTRVVKEKLKMAVTRVRKKNELKLRRLESMVLDTLYDTLTERVLELESGVR

SEQ ID NO: 146391 - protein, 214 aa, Glycine max
  Coding DNA Sequence Number=SeqID_54706
MAPRKLASKRSRKDKAAEGTSSAPEYDSHCFRSAEHQQRFEAIKGWDDEYINFQEEIVRRRWASLVTPIAKFDPDIVLEFYANAWPTEEGVRDMRSWVRGQWIPFDADALNQFLGYPLVLEEGQECEYGQRRNRADGFDEEAIAQLLCILGQDFARTVAGRRARIMRTNMTTLTQIWMTLLLSNIQPSDHNSDLPLPKCQLVYAILTRMSIHVA

SEQ ID NO: 146392 - protein, 127 aa, Glycine max
  Coding DNA Sequence Number=SeqID_54707
EFKDVFPKEISHVLLEASLPNRPTYNNKPQETQHKDAQAKVEYVKRLYDQVKVQIAKKNESYAKQAYKKRKEVVLEPGDDPGHLRANVFQEGGNDENPETGQIQLKGPSGEGRRPKWRRTKPPSGEG

SEQ ID NO: 146393 - protein, 126 aa, Glycine max
  Coding DNA Sequence Number=SeqID_54708
MTSRDQIWSFCTLVSSRGGGPDDTRRYLTVIRTLLSSRGGGPYDKQRPNLAAGPMTSRDQVWSFCTLVSSRGGGPDDTRRYLTVIRTLLSSRGGGPDDKQRPKFGHSAPLYHPEAAGPDDARRYLT

SEQ ID NO: 146394 - protein, 87 aa, Glycine max
  Coding DNA Sequence Number=SeqID_54709
MLTSLERVQMTTLVSTCQSDLGSSNDEVRIIGRCLRMLPDSWVMIAKGGVVDKSGAFAPTYPQFVMRKSDLRSSCKSETKIFSVFFN

SEQ ID NO: 146395 - protein, 175 aa, Glycine max
  Coding DNA Sequence Number=SeqID_54710
MSNHKSIESTLKNLEIQVGQLAKQLAEKSSSSFGANTENNPKEECEAVMTRSRKLVAAEDKDVVALKEQFALKDTTDKKKNEVSSGGCEGRWSTCWSSYWATDATKDVLYLTMFLCSMLSPGLLNPDVSCMFSLILAKRHPQIPLVGLNLTRTALRHTYQQLGYHTPIPHENTIN

SEQ ID NO: 146396 - protein, 287 aa, Glycine max
  Coding DNA Sequence Number=SeqID_54711
  Gene Ontology: Mol. function=phosphohistidine phosphatase activity
  Homolog annotation: Hit_ID=A1JK35; Match level="QueryCoverage=56%, HitCoverage=100%, E-value=7e-60, Identity=71%"; Hit description =Putative phosphohistidine phosphatase
  Pfam annotation: Domain name=PGAM; Domain location=45-158; Score =36.1; E_value=1.2e-07; Accession=PF00300.13; Description =Phosphoglycerate mutase family
MCLFNKQPVDYTQAIGVKHSVHSQNEASGAVVPGDIDKQQRCFMQVFIMRHGDAALEAASDAVRPLTLCGCDESRQMASWLNGQTPGIDKVLVSPYLRAGQTLATVREALKLPEGQEVLPELTPGGDPGMVACHLQALAVQGAHAVLVISHLPLVGYLVSELCPQEAPPMFATSAIACVEFDADACEGKLAWQVSPAKLAKAICVGCVNSPQSLTDVSSWGFPVILQAAAVLAASIHPSHLLMVTPAAATLRLQSTPAARRRRQTVWVPGETPSRADAVPATAGFAA

SEQ ID NO: 146397 - protein, 378 aa, Glycine max
  Coding DNA Sequence Number=SeqID_54712
  Homolog annotation: Hit_ID=Q84VI1; Match level="QueryCoverage=84%, HitCoverage=52%, E-value=1e-149, Identity=78%"; Hit description =Envelope-like protein
MAQKKSTPITPTTSRRSKVAIPSKKRKEISSSDSDDDVELDVSTSKRAKKSGRKVPGNVPDAPLDNISFHSIGNVEKWKYVYQRRLAVERELGRDALDCKETMDLIKATGLLKTVTKLGDCYESLVREFIVNIPSDITNRKSDEYQKVFVRGKCVRFSPAVINKYLGRPTDGVVDIAVSEHQIAKEITAKQVQHWPKKGKLSAGKLSVKYAILHRIGAANWHSESFAIKLPIAFPTVLCGIMLSQHPNMLNYTDSVIKRESPLSLHYKLFEGTHVPDIVSTSVSTSGKAAASGAVSKDALIAELKDTCKMLEATIKATTEKKMELELLIKRLSESGIDDEDAAEEEGEAAEEEEEAAEEEEDAAEETESDDDDSEATP

SEQ ID NO: 146398 - protein, 72 aa, Glycine max
  Coding DNA Sequence Number=SeqID_54713
IALARHPVDPEKSNKVLGFPALIIGLCQFYGVHVAPRQAQGETPQQPGDGRQWATYAPPPPLEFTLAHPQKG

SEQ ID NO: 146399 - protein, 292 aa, Glycine max
  Coding DNA Sequence Number=SeqID_54714
  Gene Ontology: Mol. function=motor activity; Cellular component=cell projection
  Homolog annotation: Hit_ID=P15305; Match level="QueryCoverage=98%, HitCoverage=89%, E-value=1e-13, Identity=22%"; Hit description =Dynein heavy chain
GLHVLTIRGRHVLTIRGLHALAFRGLPVLTFRGLHVLLFRGLHVLLFRGLHTLAFRGMDIFTFRGLHALTFRGLHVLAFRGLHVLTIKGQHVLVIRGLHALVFRELHAHAFKGIHFLTFRGLHVLAFRGLHALPSRGGLHVLPCRGGLHVLPCRGLHVLPCRGLHILDFRGLHVLAFRGMDVLTLRGLHALTFRRLYVLPFRGLHALAFRGLHALISRGLHVLTFRGLHALNFRGLHVLAIRGLHALTIRGLHVLDIRGLHVLAFRGLHNLAFRGLQVLNFRGLHVLAFRGL

SEQ ID NO: 146400 - protein, 69 aa, Glycine max
  Coding DNA Sequence Number=SeqID_54715
MPLIAPTVATYPSAGGRRVTRGMRVPRKEYARSRHQRLFEENVGKTRKDAIYELLSERFGSCIYARGRY

SEQ ID NO: 146401 - protein, 63 aa, Glycine max
  Coding DNA Sequence Number=SeqID_54716
MYKNVGVQSDEDMTKSKGKDPLEGLGGPMTRARARKAKEALQQVMSILFEYKPKFQGEKSKVV

SEQ ID NO: 146402 - protein, 184 aa, Glycine max
  Coding DNA Sequence Number=SeqID_54717
MRTVRGLRGLDPCGRRSDGMGISLLPFCPSCSDSFSMGTCGGNVIELPSFQPYFNYFPGEYQVCEAGRHVAYQLLIVKHWQGVYHHGDHLPFDHGWGHLCRQVSPPLHFEFWGDDDIRYQAKVCHVCERITKAFKNPQSLFKEIEFPSFFGRRGWSFCGQEYWLCCEVGLRQSVGCRPLDGNQG

SEQ ID NO: 146403 - protein, 62 aa, Glycine max
  Coding DNA Sequence Number=SeqID_54718
MGLNQAHVLRKGSSSQGQVWKKECALRNPYRMRARARVMSEIEEVQEQIKADMEAMKDQWPP

SEQ ID NO: 146404 - protein, 34 aa, Glycine max
  Coding DNA Sequence Number=SeqID_54719
MARGCFPNEYMMWNCPSRVGNGPEETCLKEIQEG

SEQ ID NO: 146405 - protein, 99 aa, Glycine max
  Coding DNA Sequence Number=SeqID_54720
  Homolog annotation: Hit_ID=A5AUE6; Match level="QueryCoverage=74%, HitCoverage=5%, E-value=1e-17, Identity=49%"; Hit description =Putative uncharacterized protein
MMSIMEDIVKVDNILIHLLSSLKVWVPSKAVQETPSLRHLYVLGCQAEIRIYNPQEKKLDARTIGGYFIGYPVKSKGFIENGETNGSEASQNVEIKEVR

SEQ ID NO: 146406 - protein, 73 aa, Glycine max
  Coding DNA Sequence Number=SeqID_54721
  Subcellular localization annotation: CTP_CleavageSite=49; ConfidenceScore=5.50e-01
MGVQIAPRPTWALQKIPPEGCCFWRKQPGSPGKSKPRRFRNVSVTFSVKNFAKVSTVLRRSSFVLHRSSIFNG

SEQ ID NO: 146407 - protein, 153 aa, Glycine max
  Coding DNA Sequence Number=SeqID_54722
  Gene Ontology: Mol. function=nucleotide binding; Cellular component =intrinsic to membrane; Biological process=defense response
  Homolog annotation: Hit_ID=A7QH65; Match level="QueryCoverage=89%, HitCoverage=12%, E-value=1e-26, Identity=45%"; Hit description =Chromosome chr18 scaffold_96, whole genome shotgun sequence
MHVLLSGGSVHQIHEVKEMNPQDSLKLFCLNAFNESQPKMGYEKLTEEVVKIAQGNPLALEVLGSDFHSRCIDTWECALSKIKKYPNEKILSVLRFNYDGLDELEKKTFLDIAFFFYNHDKDYVIRKLDAQGFHGASGIKGTDEVEAMQIDES

SEQ ID NO: 146408 - protein, 48 aa, Glycine max
  Coding DNA Sequence Number=SeqID_54723
MWTTTGEKLAAQLAQASKVASSRSNSLLEESSGGPKWAWLLFAPPPFY

SEQ ID NO: 146409 - protein, 117 aa, Glycine max
  Coding DNA Sequence Number=SeqID_54724
  Subcellular localization annotation: CTP_CleavageSite=41; ConfidenceScore=5.32e-01
MVESSKKRKGSSSTTAAAGHRRHRPSEAPTTPIHPSLSSPRSSTLFSSDDQRLRNLKIQDGIISSEVHGISMIIDQSLFFSLTKLPSQGAPFEGTIVDDWKFDYSSHDARRMVCNDW

SEQ ID NO: 146410 - protein, 166 aa, Glycine max
  Coding DNA Sequence Number=SeqID_54725
  Subcellular localization annotation: CTP_CleavageSite=31; ConfidenceScore=5.02e-01
LFVLQTAKKNVYTDNHSGIPPVSVTQMLFVLQTAKKNVYTDNHSGISARQRDSNVSMTDLVSAEDDAFRLTDSKKNVYTDNHSGISASQRDSNVSMTDLVSAKDDTAKKNVYTDNHSGISARQRDSNVSMTDLVSAEDDGAEDDDQSLRAIRLFVLQTAKKMFDTG

SEQ ID NO: 146411 - protein, 119 aa, Glycine max
  Coding DNA Sequence Number=SeqID_54726
MVIDQSLFYDLTQLSSDGVPFEGTLDDDWKFDFSVHDARRLVCTNQADMTGRLLAVRYRMHKALRLNAPLPYPHLVTLFLQHFNIPLDSEPYVPIKRSFLIGAAVVASFGYRKEHDGSW

SEQ ID NO: 146412 - protein, 349 aa, Glycine max
  Coding DNA Sequence Number=SeqID_54727
  Gene Ontology: Mol. function=transferase activity, transferring phosphorus-containing groups; Cellular component=outer membrane -bounded periplasmic space; Biological process=two-component signal transduction system (phosphorelay)
  Homolog annotation: Hit_ID=Q7NVE3; Match level="QueryCoverage=98%, HitCoverage=46%, E-value=1e-48, Identity=37%"; Hit description =Sensor protein
  Pfam annotation: Domain name=HATPase_c; Domain location=67-160; Score= 78.6; E_value=2.1e-20; Accession=PF02518.17; Description=Histidine kinase-, DNA gyrase B-, and HSP90-like ATPase
  Pfam annotation: Domain name=Response_reg; Domain location=184-301; Score=108.0; E_value=2.9e-29; Accession=PF00072.15; Description =Response regulator receiver domain
  Pfam module annotation: Pfam domain module=HATPase_c::Response_reg; Domain location=67-160::184-301
EAEALLRLINNVLDISKLEAGKFVLDPAPTDFAHLVHEVVDAYRTRAAEKGLELAAGVPENCGRLILDSSRVAQVLHNLVSNGVKFSAVADTGIGIEPGDQNHLFSPYSHSASPARGRKASGTGLGLLVCRELVECMGGTIGLHSVPGVGTKVVVSLPVEVCVEENSPMVTPPRDGVHPRGESLAILLVEDTPANQYVIQAQLAQLGCNVHLAPDGSRARQAFRDNRFDLVLLDCDLPDTDGYTLAEEFRAHEAEHLLPASSIIAISASSGSEHVSRCLDAGMDGVLSKPIQLGKLRDTIEIWCDVTLNLDADHDSVGAEIPVVSRDFAHSALGEDLSALRRALAERDP

SEQ ID NO: 146413 - protein, 165 aa, Glycine max
  Coding DNA Sequence Number=SeqID_54728
  Gene Ontology: Mol. function=endonuclease activity
  Homolog annotation: Hit_ID=Q9AY32; Match level="QueryCoverage=28%, HitCoverage=71%, E-value=7e-18, Identity=95%"; Hit description=RRNA intron-encoded homing endonuclease
HCNVGLQRGIPSKRESSARVDYVPALCTHRPSLLPIEWSGEVFGLRRREPAEGSLSMPHNQIDPRTCLFIYRREGGDDHGAPCARPPRPRDKHKPRRFCAKELKLLMDSFGGPETVSGGSADVAFRTPLAPYEKSKSLGSGGSMVARLKLKGIDGRAPPGVEPAA

SEQ ID NO: 146414 - protein, 29 aa, Glycine max
  Coding DNA Sequence Number=SeqID_54729
MWIDPFVVTNVFPYVVEETSLLHPISLPP

SEQ ID NO: 146415 - protein, 90 aa, Glycine max
  Coding DNA Sequence Number=SeqID_54730
MTRGNPGDLQPFDLEIDRTFHRLVRHSVHPVHFEHSEHSVEGDSKYSDFEHSTTNFHTENMAQPLPRERTLREMATLISLMKACAFNILM

SEQ ID NO: 146416 - protein, 62 aa, Glycine max
  Coding DNA Sequence Number=SeqID_54731
MVAAQASWVASTSRHCLLLEHPGRPKLCNNPFFDFWNVAKLYGLRNNASLQLPACRGTPRIA

SEQ ID NO: 146417 - protein, 55 aa, Glycine max
  Coding DNA Sequence Number=SeqID_54732
GREWRIALSNHYAWLQTRGWRMHERKRNSWGSEKGATRDSRDACSTKGIRAESPP

SEQ ID NO: 146418 - protein, 102 aa, Glycine max
  Coding DNA Sequence Number=SeqID_54733
WLAKLKIINEENFEAPEEDEEVRALKTELGKARLVKEKFKLVATEVRKECAGLQEENPATARALEQETKRARKEEHGRDKFRGALWGSNSELKLRREERDRS

SEQ ID NO: 146419 - protein, 120 aa, Glycine max
  Coding DNA Sequence Number=SeqID_54734
MEDEGPIAQVPQHVEDESSEATIPDPFVIREETDETLVRQVVAATPERSLEATSEPPAPVVDLPSPQHTVDPSTPILEIPEDPTTPVLAMDTSLPATLVLHLTDEEDVQTQDTQDQSQEF

SEQ ID NO: 146420 - protein, 88 aa, Glycine max
  Coding DNA Sequence Number=SeqID_54735
MTDPVSAEDDVNLRVSTGLSAAIDEGRKMTIICLCVPSDTTVSEWQKGRIMTIICLCVPSDTTVPEWQKGVRNDHNLSPHVIGPAASG

SEQ ID NO: 146421 - protein, 312 aa, Glycine max
  Coding DNA Sequence Number=SeqID_54736
  Homolog annotation: Hit_ID=Q2HW90; Match level="QueryCoverage=69%, HitCoverage=41%, E-value=2e-23, Identity=33%"; Hit description =Putative uncharacterized protein
MDILALLIFGVVFFPNVDGLVDRAAIDAFIAFYDRKESPVVAILADLYDTFDRRCEKNNARIICCMPALYIWLVSHLFRQEMRHVCPLEGHRSCTEKKEVNWDQLLANKEGASVNWFPRWKEGRTGIIISCGKFPNVPLIGTRGCINYNPVIAIRQLGYPMRGAPSKEGLIPFIIRGFNSTNSGVLQRVHKAWEMLQRKDKERRGSSNRPVDSYRRWLKAYTQDLDWLLSLRTTKGVEVETLEEDEEVQALKTEREKAQTIKEKFKSAAVRIRKENAELRGINIATVKALEQETRGPVGKNMAGTNSEGLCG

SEQ ID NO: 146422 - protein, 84 aa, Glycine max
  Coding DNA Sequence Number=SeqID_54737
MMLLNGEGPQHPHVVAEDAPHVDDATEEVFQHPEEAGVDAQGLGSSSSMDSFASWKMNGSGMEKEEREETPLQGEDESRRSSPP

SEQ ID NO: 146423 - protein, 20 aa, Glycine max
  Coding DNA Sequence Number=SeqID_54738
MTRLKRNARQLAATKSTATT

SEQ ID NO: 146424 - protein, 989 aa, Glycine max
  Coding DNA Sequence Number=SeqID_54739
  Gene Ontology: Mol. function=protein serine/threonine kinase activity; Cellular component=cytoplasm; Biological process=protein amino acid phosphorylation
  Homolog annotation: Hit_ID=A7P784; Match level="QueryCoverage=56%, HitCoverage=89%, E-value=1e-163, Identity=51%"; Hit description =Chromosome chr9 scaffold_7, whole genome shotgun sequence
  Pfam annotation: Domain name=MFS_1; Domain location=25-502; Score =11.2; E_value=0.008; Accession=PF07690.7; Description=Major Facilitator Superfamily
  Pfam annotation: Domain name=PTR2; Domain location=97-494; Score =202.6; E_value=9.5e-58; Accession=PF00854.12; Description=POT family
  Pfam annotation: Domain name=Pkinase; Domain location=600-928; Score =238.9; E_value=1.2e-68; Accession=PF00069.16; Description=Protein kinase domain
  Pfam annotation: Domain name=Pkinase_Tyr; Domain location=600-926; Score=-41.3; E_value=7.1e-10; Accession=PF07714.8; Description =Protein tyrosine kinase
  Pfam module annotation: Pfam domain module=MFS_1::PTR2::Pkinase::Pkina se_Tyr; Domain location=25-502::97-494::600-928::600-926
MEMPMEQKKATELLERKKGGWRTMPFIIGCDFHLPVANETFEKVAVVGLRVNMILYLLQEYHFDPATGTIIMFLWNALTNLLPIFCAFLSDSCLGRFRVIAMGTVIHLVGLVVLWLTTIIRHARPQCDTEPCANPTVPQLLILFSSLTLMALGASGIRSCTLAFTADQIYNPENPQNERTMKSFFNWYYLSVAISVTISMAFIVYIQVKAGWVVGFGISMGIVSLSAIMFFLGTSIYVKVKPNKSLLTGFAQVIVAAWKNRHLPLPPKNSDIWYFRNGSNLVQPTNKVRFLNKACIIKNREKDLDYEGRPNEPWSLCTVRQVEELKAIIKVLPIWSTGIILATTVSQQQFFIVQAGTMDRMVFGIDIPATNFALFMMLTLTMWVIVYDRILVPILPNQRILTVKLRMGIGLVISCLATLVATLVEKKRRNQAISEGFIDNPKGVVNMSAMWLVPSYCLFGLAQGFTVIGQIEFFYSQFPKTMSTVAVSLSTLNIGVGNLVGSLIIKVVKDGTRRGGRASWLASNINRGHYDYYYGLLFILNLVNLVCFLVWSRAYGSTQDIKDWDEDRHWTPEWTVSVIEMDPPPKSWSIHTRSEIIAKYEVMERVGSGAYADVYRGRRLSDNLTVALKEIHDYQSAFREIDALQLLQGSPNVVVLHEYFWREDEDAVLVLEFLRTDLATVVADAAKANQPLPAGELKRWMIQILSGLDACHRHMVLHRDLKPSNLLISELGLLKIADFGQARILTEPGIDASNNHEEYSRVLDDADNKDTITSTHDGKATCTTSGVDREEEEKELGCLTSCVGTRWFRAPELLYGSRDYGLEVDLWSLGCIFAELLTLQPLFPGTADIDQLSRIIGVLGSLDESAWAGCSKLPDYAIISFSKVENPAGLEACLPNRSPDEVALVKKLVCYDPAKRATAMELLHDKYFSEEPLPVPVSELRVPMTRKGQDEDSLCGWGDIDEMDCDSDFDEFGPLNITRTGTGFSIQFP

SEQ ID NO: 146425 - protein, 740 aa, Glycine max
  Coding DNA Sequence Number=SeqID_54740
  Homolog annotation: Hit_ID=A7PEN3; Match level="QueryCoverage=99%, HitCoverage=98%, E-value=2e-91, Identity=32%"; Hit description =Chromosome chr11 scaffold_13, whole genome shotgun sequence
MYRSFLRCDDPKGVVQCGTIRKYRTRSHKVKDKTRIQKTGENLETSLSLMNKRYKEDKKVLKGCDGNLIGPSSLQLTQVYGGDQSLKNMLNSWSRDIMCDGKSEDIAKGALGLQDSLIMLRKLQEEASPHSASFRRKRTMKPVRDRIDAKMVGRTQAKPFGEQSNPKGFQRPQPSAGGSSSNCQEELKKVIKESLVRQNMFPKTSERLNSGSETFSTSTSQYSAVRTNSLFDPSLSVIASKMERGPGLIFKLMGLEEAPSKSFPAVKQKQLDSEIDTSKVRKNDSVAEKVNPEKKALRETLDTKHFKGILKESFVEEPKLHVHHFNDTHSKQFGDLSQIALMKPQCTLYQESVKSTYMPVPPKELPITKLKPEIASSKTIKHRKGSSSTTMGKEEVMKLDAKGINPVEESSGKVNETIGQNWKVQTISRKQPEKDISQPRIVTTRPQYQRGIPSTKLRKLKSGSRIDKNEISCLKRTGIKNRMMNQSPVAEPEPAKLTVEQIRKGEEQKVYTEISALEDELLNVCEADAYINKIGEKYKQRKSFSGDDIIMLLKSEHENNAITAYSINADKEGTELKHFLLTSPSFIGHAKKLFNLEVDCPNTLQKDETIYSMANLRLYLDCTYELAERKSLQESQVVRSFLLACGGNSRLHFSLGRLVEEICDGIENLKFYKEDSGEEVFAGNDVFAMMEKDMKCNGEINSMWEKGWRRGFSADEAELVVNKIEILLMSGLIEEVFINL

SEQ ID NO: 146426 - protein, 229 aa, Glycine max
  Coding DNA Sequence Number=SeqID_54741
  Gene Ontology: Mol. function=drug transporter activity; Cellular component=membrane; Biological process=multidrug transport
  Homolog annotation: Hit_ID=A7PEM7; Match level="QueryCoverage=100%, HitCoverage=28%, E-value=4e-70, Identity=57%"; Hit description =Chromosome chr11 scaffold_13, whole genome shotgun sequence
MDEPINRALIDKWNNADALYATPTGSNDDWYWLYAAIKFRCLLVTNDEMRDHLFQLLGNDFFPKWKERHQAVLTLESLSSKFKVRFSFSDTGSPVFHMPPPCSVVIQESEEGHWHIPIDAELNDESERRWLCITRAKLDVVSKDSSTSKDSKPLQKGECARSATRNASAKESQHQNLVNHKEKKETPQELYKNVRDIFLESVSSDKNNSILSDIEAAELIGGCTIDFQI

SEQ ID NO: 146427 - protein, 1295 aa, Glycine max
  Coding DNA Sequence Number=SeqID_54742
  Gene Ontology: Mol. function=ubiquitin-protein ligase activity; Cellular component=ubiquitin ligase complex; Biological process =protein ubiquitination
  Homolog annotation: Hit_ID=A7PEL7; Match level="QueryCoverage=69%, HitCoverage=99%, E-value=0.0, Identity=63%"; Hit description =Chromosome chr11 scaffold_13, whole genome shotgun sequence
  Pfam annotation: Domain name=U-box; Domain location=392-465; Score =45.8; E_value=1.5e-10; Accession=PF04564.6; Description=U-box domain
  Pfam annotation: Domain name=WD40; Domain location=1027-1063; Score =11.3; E_value=1.3; Accession=PF00400.23; Description=WD domain, G -beta repeat
  Pfam annotation: Domain name=WD40; Domain location=1069-1107; Score =12.7; E_value=0.86; Accession=PF00400.23; Description=WD domain, G -beta repeat
  Pfam annotation: Domain name=WD40; Domain location=1113-1149; Score =1.2; E_value=23; Accession=PF00400.23; Description=WD domain, G-beta repeat
  Pfam annotation: Domain name=WD40; Domain location=1202-1237; Score =9.5; E_value=2.1; Accession=PF00400.23; Description=WD domain, G -beta repeat
  Pfam annotation: Domain name=WD40; Domain location=1241-1280; Score =4.9; E_value=7.8; Accession=PF00400.23; Description=WD domain, G -beta repeat
  Pfam module annotation: Pfam domain module=U-box::WD40::WD40::WD40::WD 40::WD40; Domain location=392-465::1027-1063::1069-1107::1113 -1149::1202-1237::1241-1280
  Subcellular localization annotation: CTP_CleavageSite=52; ConfidenceScore=5.05e-01
MTTVTVTTRAQILRHTAAFTSSVLSQSELRRRLIATLLRDTPFSDQKHLNLAADTLESAISFSSPALRFSSLSLAEKLLLPLPDFPLSSLLLSLIHALRNRPTESAVSLLRIFHSNASLARSEIAPALYERLFSLHLFPVFRWFDDQRTRILSTSRNDSDYSVTSEEYSVVLPCAKVLSKMSEEQAAKLREVERDYEEVLNQNCMVLAEYFKEVLVNENGDAAAISPPSLVLKSAAEDGRGGVENRKEEMMKMSVLENGRYNPIWSEREASIEFLSPSSSSRSSQVPFYPQRVFSRILKPQKASKTWTTPVYLNSTTADTDFSLDESLLSSSSDSEAENDEEKDKTVALLEPRQSQIKERMLSIFKQSRGSPDYPMADFDTPLHGIGKHAPPKDFVCPITSHIFDDPVTLETGQTYERKAIEEWFNRGNITCPITRQKLQNTQLPKTNYVLKRLIASWKDRNPHLVPPPCESPYEDTDEAVVIPTTLPSTSPNSVITQATVDGMMSELRCAINNLYMSEVLQESEMAVLQIDKFWRGVNVGVDIHSMLSKPAIINGFMEILFNSVEPQVLQASVFLLAEMGSRDNAVIKTLTRVDTDVECIKALFKNGLTEAVVLLYLLNPSTMSLAEMAIVESLITVFNKKEEDLVKMCLKPKTAAVLLLARIVGSSEEIIASSVVNTLFSEKTIGTIVGSLGADLAKERIAAVEILLRCMEEDGTCRNNIADKAELSPILETLIGATDGDRFKIIQFFFELVKLNRRTFIEQILHIIKEEGPFSTMHTLLIYLQTALQDQCPVMAGLLLQLDLLVEPRKMSIYREEAMDTLISCLRNTDFPVTQLAAADTIISLQGSFDFSGNPRTREVLLKRAGIEKSSRSLVQEEEKAADDWERRIASVLVSHEFGTLFEALADGMKSRNPELRSACFILATWLIYMLTILPDTGIHVAARACLLKQFIAKLNCAKDVEDRILSMLALNSFLHFSDGFGDLTSFTKDIIKGLRELKRSCPLATKMLKVLVEENESKAEIWIHKELIKEDCSENGEVLSVICFKGKFFSGHTDGTMKVWTLKDNLFCLMQEIQEHTKAVTNLVISESDDRLYSGSLDRTARGTGVKVQSLNGESKLLNSSKYVKCLAHVHGKLYCGCHDSSVQEIHLATGTVNTIQSGYKRLLGKANPIHALQIHGELIYAAGSSLDGSAIKIWNNSNYSIVGSLQTGSDVRAMEVSSELIYLGCKGGTVEIWDKKKHKRVDTLQMGTNCRVNCMALDSNEEVLVIGTSDGQIQVPRELYIAQSLYIQVTCT

SEQ ID NO: 146428 - protein, 153 aa, Glycine max
  Coding DNA Sequence Number=SeqID_54743
  Gene Ontology: Mol. function=microtubule motor activity; Cellular component=microtubule associated complex; Biological process =microtubule-based process
  Homolog annotation: Hit_ID=A7PEN4; Match level="QueryCoverage=60%, HitCoverage=95%, E-value=7e-35, Identity=75%"; Hit description =Chromosome chr11 scaffold_13, whole genome shotgun sequence
  Pfam annotation: Domain name=Dynein_light; Domain location=65-151; Score=78.4; E_value=2.4e-20; Accession=PF01221.9; Description=Dynein light chain type 1
MAQDIHLVRGNHILREANLQVANLLAKRGVELHDGVHVFHSPPTRNQLAMLADRCVWKLELEGLQAMVKETDMSTKMQIHAMASASQALDLYDVYDCISIAAHIKKEFDSVYGNGWQCVVGSNFGCYFTHSSGTFIYFALATLNFLIFKGTSS

SEQ ID NO: 146429 - protein, 313 aa, Glycine max
  Coding DNA Sequence Number=SeqID_54744
  Gene Ontology: Mol. function=protein dimerization activity; Cellular component=nucleus; Biological process=regulation of transcription, DNA-dependent
  Homolog annotation: Hit_ID=A7PEL3; Match level="QueryCoverage=89%, HitCoverage=90%, E-value=2e-93, Identity=63%"; Hit description =Chromosome chr11 scaffold_13, whole genome shotgun sequence
  Pfam annotation: Domain name=AUX_IAA; Domain location=21-285; Score =396.7; E_value=3.6e-116; Accession=PF02309.7; Description=AUXIAA family
MSEALEEVVPSMKGGCEEEGLNLKATELRLGLPGCESPEREGVFKSVVVSGAKRGFSDAIDGNWNGGGSEKDAAALFSPTSRGAVSVSVSAAKSLTLTATDCTNQPTALGASVLKETVPHSPKPLHENKPQISAPAAKAQVVGWPPIRSFRKNSMASQPQKNDAAADAEAKSGCLYVKVSMEGAPYLRKVDLNSFTTYKDLSLALEKMFSCFTLSQCGSYGVSSRENLSESRLMDLLHGSEYVLTYEDKDGDWMLVGDVPWEMFTESCKRLRIMKSSEAIGLDVELRKQESHHSNWKTESWFDKHNCTQLLML

SEQ ID NO: 146430 - protein, 435 aa, Glycine max
  Coding DNA Sequence Number=SeqID_54745
  Gene Ontology: Mol. function=protein serine/threonine kinase activity; Cellular component=cytoplasm; Biological process=protein amino acid phosphorylation
  Homolog annotation: Hit_ID=A7PEK4; Match level="QueryCoverage=94%, HitCoverage=94%, E-value=1e-170, Identity=72%"; Hit description =Chromosome chr11 scaffold_13, whole genome shotgun sequence
  Pfam annotation: Domain name=Pkinase; Domain location=9-292; Score =77.4; E_value=4.8e-20; Accession=PF00069.16; Description=Protein kinase domain
  Pfam annotation: Domain name=Pkinase_Tyr; Domain location=9-278; Score=-140.2; E_value=0.00079; Accession=PF07714.8; Description =Protein tyrosine kinase
  Pfam module annotation: Pfam domain module=Pkinase::Pkinase_Tyr; Domain location=9-292::9-278
MERIVGGKYKLGRKIGSGSFGEIYLGEPSLFLSSATDFTVTVDSTHIDTFEIVAVKIVRLRVLLFARGGIPNIKWSGIDGEDNVLVIDLLGPSLEDLFVYCGRKFSLKTVLLLADQMITRIEYVHSKGFLHRDIKPDNFLMGLGRKANQVYIIDFGLAKRYRDSTTNRHIPYRENKNLTGTARYASCNTHLGIEQSRRDDLESLGYVLLYFLRGSLPWQGLKAATKKQKYDKICQKKLSTPIEVLCKSHPVEFASYFHYCHSLTFDQRPDYGFLKRLFRDLFAREGYDFDYVFDWTILKYQQSQKNVMLPPLSPVPGASNSRATPIDVDSHQGLNAYSGHVKERIRAGDATGSGVKIQFKSPVGKNLSYENPLDKNIFGEANIPSTSFSPASTSKRNSLKQSLSAEASNPGHAQGSKMGPSSSWMSSLQRMSSAK

SEQ ID NO: 146431 - protein, 212 aa, Glycine max
  Coding DNA Sequence Number=SeqID_54746
  Gene Ontology: Mol. function=transferase activity; Cellular component= membrane; Biological process=metabolic process
  Homolog annotation: Hit_ID=A7PEJ3; Match level="QueryCoverage=86%, HitCoverage=50%, E-value=6e-42, Identity=45%"; Hit description =Chromosome chr11 scaffold_13, whole genome shotgun sequence
  Pfam annotation: Domain name=Exostosin; Domain location=59-212; Score= -83.1; E_value=0.00086; Accession=PF03016.6; Description=Exostosin family
  Subcellular localization annotation: CTP_CleavageSite=28; ConfidenceScore=5.08e-01
MEMEMPHGLQCPKRMIITAVSIPRRKMRCMMPPKSRTLFQEMNRILVRKRASARAMRPRLSSKLDLEILAARSEIEHAPIVTHDKELYAPLFRKAPYETRHHMEYCIKALCNADVTQGFKIGRDVSLPEAYVRSHWKDKDPDMKIYGPMPHGVTSKMNYINHMKNSKYCICPKGYEVLNWDVFSIILAEKDIPNLKQILLSVSQVSRVATWS

SEQ ID NO: 146432 - protein, 576 aa, Glycine max
  Coding DNA Sequence Number=SeqID_54747
  Gene Ontology: Mol. function=anion channel activity; Cellular component=membrane of vacuole with cell cycle-independent morphology; Biological process=malate transport
  Homolog annotation: Hit_ID=A7PGR9; Match level="QueryCoverage=97%, HitCoverage=96%, E-value=1e-172, Identity=57%"; Hit description =Chromosome chr17 scaffold_16, whole genome shotgun sequence
  Pfam annotation: Domain name=UPF0005; Domain location=64-548; Score =691.9; E_value=4.8e-205; Accession=PF01027.11; Description =Uncharacterised protein family UPF0005
MAPKLAKTGSFRHGLAEKKEKEKLLSAAKSSSSYSEIGIGIGMMQQEEEQSWWNTFKRVAEKALEMGRSDPRKIIFSAKLGLALTILSLLIFLKEPFADLSSYCVWAILTVVVVFEFNIGATLSKGVNGGMGTLLAGGLALGMAELSTLGGKWEELIIIMCTFIVGFCATYTKLYPTFKPYEYGFRMFLITYCFISVSGYQTGEFVDIAINRFVLIALGAAVSLGVNICIYPIWAGEDLHNLVTKNFMGVATSLEGVVNHYLHCVEYKKVPSKILTYQAADDPIYNGYRSAVESTSKEDSLMGFAVWEPPHGHYKMLKYPWKNYVKLSGALRHCAFMVMAMHGCILSEIQAPAEKRLVFRSELQRVGSEGAKVLRELGNKVKKMEKLGRGDLLYEVHEAAEELQQKIDKKSYLLVNSESWEIGNHSREEESDSQQQGLFNMDEERKFLEYKSLSEAVLDLRTVEAPNTWEGNLTLGNSPDVPATDASENMFRKKISRPSHIYYHKSNAEAESKTFESASSLSVTTFTSLLIEFVARLQNLVDSFEELSEVASFVDPLEQQAPVASHWLFNCSKFKD

SEQ ID NO: 146433 - protein, 294 aa, Glycine max
  Coding DNA Sequence Number=SeqID_54748
  Gene Ontology: Mol. function=catalytic activity; Cellular component =nucleus; Biological process=metabolic process
  Homolog annotation: Hit_ID=A7PEJ0; Match level="QueryCoverage=83%, HitCoverage=75%, E-value=1e-71, Identity=38%"; Hit description =Chromosome chr11 scaffold_13, whole genome shotgun sequence
MIVGYAQNGREEDAWMLFGDMLCRNVKPDSYTISSMVSSCAKLASLYHGQVVHGKVVVMGIDNNMLIFETMPIQNVITWNAMILGYAQNGQKYFDSISEQQMTPTLDHYACMITLLGRSGRIDKAMDLIQGDLKNAELAASLLFELDPHNAGPYIMLSNLYAACGKWKDVAVVRSLMKEKNAKKFAAYSWVEVRKEVHRFVSEDHPHPEVGKIYDPFLTNEKLALAFALIRKPNGVAPIRIIKNVCSMRILSEKYSSTSMKISCDLAMQLKMFGTLRQVYSEVIDHYFALNEQV

SEQ ID NO: 146434 - protein, 458 aa, Glycine max
  Coding DNA Sequence Number=SeqID_54749
  Gene Ontology: Mol. function=diacylglycerol kinase activity; Cellular component=nucleus; Biological process=activation of protein kinase C
  Homolog annotation: Hit_ID=A7PEI5; Match level="QueryCoverage=92%, HitCoverage=83%, E-value=1e-174, Identity=68%"; Hit description =Chromosome chr11 scaffold_13, whole genome shotgun sequence
  Pfam annotation: Domain name=PPR; Domain location=175-209; Score =36.7; E_value=8.2e-08; Accession=PF01535.11; Description=PPR repeat
  Pfam annotation: Domain name=PPR; Domain location=210-244; Score=1.0; E_value=6; Accession=PF01535.11; Description=PPR repeat
  Pfam annotation: Domain name=PPR; Domain location=278-312; Score =44.2; E_value=4.7e-10; Accession=PF01535.11; Description=PPR repeat
  Pfam annotation: Domain name=PPR; Domain location=313-347; Score=4.1; E_value=2.5; Accession=PF01535.11; Description=PPR repeat
  Pfam annotation: Domain name=PPR; Domain location=349-383; Score =13.3; E_value=0.2; Accession=PF01535.11; Description=PPR repeat
  Pfam annotation: Domain name=PPR; Domain location=74-108; Score=21.2; E_value=0.0039; Accession=PF01535.11; Description=PPR repeat
  Pfam module annotation: Pfam domain module=PPR::PPR::PPR::PPR::PPR::PP R; Domain location=175-209::210-244::278-312::313-347::349-383::74-108
MSMHSFRFLQLIFPCRRCFSTQNSVFRSLLDYSGNDPVALIATQLSNCATVRELNQVYAHVLTTHFLISNPAPFNWNNIVRSYTRLEAPRNALRILVFMLRNGVLPDCYTLPIALKAVCQTFDVNLGKQLHSIAIKIGLQCNEYCETGFLSLYLKAGEFGGARMVFDENPDPKLGSWNAVIGGLSQAGLARDAISVFLNMRRRGFMPDGVTMVSVMSACGNIGDLNLALQLHKCVFQAEAGARTDILMLNSLIDMYGKCGRMDLAYKVFAMMEEQNVSSWTSMIVGYGMHGHVKEALDCFWRMREAGVRPNFVTFIGMLSACVHGGAVQEGRFYFDMMKNVYGITPQLQHYGCMVDLLGRAGLLEDARRIVEEMPMKPNSVVWGCLMGACEKYGNVDMAEWVAKHLQELEPGNDGVYVVLSNIYANRGLWKEVERIRSVMKQGRLAKVPAYSLATNSN

SEQ ID NO: 146435 - protein, 790 aa, Glycine max
  Coding DNA Sequence Number=SeqID_54750
  Homolog annotation: Hit_ID=A7PEI9; Match level="QueryCoverage=97%, HitCoverage=96%, E-value=0.0, Identity=50%"; Hit description =Chromosome chr11 scaffold_13, whole genome shotgun sequence
  Pfam annotation: Domain name=DUF810; Domain location=21-788; Score =888.0; E_value=4.5e-264; Accession=PF05664.2; Description=Protein of unknown function (DUF810)
MHEHEHVVEFEDILPSPFAPNLSESELRETAYEMLVGACRSSGPKPLTFFSHSEQSNRGGTQRIPSPSLYRSLTVTASSRNGRAATTGELMRVQMKVTELTDTRLRRALLRVAAGQVKCSDFPSEQEYEAWLRRNLKVLEAGLILHPRLPLLDKADTCVLRLQQIIHEGLEKPMDIGKNSESMHALRTLVMSFDGSVPETCHWADGFPLNHGIYQTLLEACFHNNDETCVIQEVDEVFELIKTTWVMLAMNEMLHNVCFSWVLFQRYVANGQVDNDLLFASSNLLAQVENDAKAMNDPFISKSLSYALNLMLSWAEERLLAYHDTFHNGNIESMQSVVSLAVSSAKILAGDISLGCNKEAHKLEKLDPRISKHVPRQHDKVFSTLSVLARDISELAFNEKATFSPILKRWHPLAAGVAVATLHVCYGHELKQYVKSVTELTPDAIAVEDSVDSEDGGKSVLREMYPYEAEAVIINLVKSWIKTRMDGLEECVDRNLQEEVWNPRANKECFAPSVLEILGIIDDSLEAFFLLPIPMHAALLPELMSALDKSLQQYILKAKSGCGSKFHGVFRKKGKSQVTDQRRIFHHGTTNVDSSFALPQFCVRINTMQRIGMGLKVLEKRTISRLGNSKSTKEYGIEDKFKLSKAASVEGIRQLSEAMTYKVIFQDLRYVLWDGLYFGEVSSTRIEPFLEELNQCLKIILSTVHDRVITHVITEVMKASFDGFLLVLLAGGPAQGLPADLIEKQCTTVKEVLPLFRMDTEDLIELFSELILGITKFLKKNYNLPKKSNR

SEQ ID NO: 146436 - protein, 42 aa, Glycine max
  Coding DNA Sequence Number=SeqID_54751
MLPPPRNKARLTTDEEEFHMLSLGSSSKTREIAAMEIKHMNV

SEQ ID NO: 146437 - protein, 334 aa, Glycine max
  Coding DNA Sequence Number=SeqID_54752
  Gene Ontology: Mol. function=pectinesterase activity; Cellular component=cytoplasm; Biological process=cell wall modification
  Homolog annotation: Hit_ID=A7PEG1; Match level="QueryCoverage=99%, HitCoverage=88%, E-value=1e-165, Identity=82%"; Hit description =Chromosome chr11 scaffold_13, whole genome shotgun sequence
  Pfam annotation: Domain name=Pectinesterase; Domain location=44-327; Score=335.2; E_value=1.1e-97; Accession=PF01095.10; Description =Pectinesterase
MTRVEFSEQQFMKWVKFVGGLKHSVFRTAKNKLFPSHTLHVSKKHGKGGFSSIQAAIDSLPFINVVRVVIKVHAGVYTEKVNISPFKSFVTIQGEGADKTIVQWGDTAQSQPLGTYGSATFAVNSPYFIAKNITFKNTAPIPAPGAVGKQGVALRISADTAVFLGCKFLGAQDTLYDHIGRHYYKDCYIEGSVDFIFGNALSLFEGCHVHAIAQLTGALTAQGRNSLLEDTGFSFVHCKVTGSGALYLGRAWGPFSRVVFAYTYMDNIIIPKGWYNWGDPNREMTVFYGQYKCTGPGASYAGRVSWSRELSDEEAKPFISLSYIDGSEWINLSL

SEQ ID NO: 146438 - protein, 766 aa, Glycine max
  Coding DNA Sequence Number=SeqID_54753
  Gene Ontology: Mol. function=unfolded protein binding; Cellular component=cytoplasm; Biological process=response to stress
  Homolog annotation: Hit_ID=P55737; Match level="QueryCoverage=79%, HitCoverage=90%, E-value=0.0, Identity=73%"; Hit description=Heat shock protein 81-2
  Pfam annotation: Domain name=HATPase_c; Domain location=55-172; Score= 6.1; E_value=0.017; Accession=PF02518.17; Description=Histidine kinase-, DNA gyrase B-, and HSP90-like ATPase
  Pfam annotation: Domain name=HSP90; Domain location=175-679; Score =1052.1; E_value=0; Accession=PF00183.9; Description=Hsp90 protein
  Pfam module annotation: Pfam domain module=HATPase_c::HSP90; Domain location=55-172::175-679
MGTIALPRSSSSIISQFLTPSYPLTKNHDASAITKQRQRQNRGKALDKIQLESLSDKSKLDAQPEFFIHIIPDKTNNTLSIIDSGIDIGWSGTKEFMEALAAGADVSMIGQFGVGFYSAYLVSDKDFVTTRQNDDEQYVWESHAGGSFTVTRDTSAENLGRKTKITLFLKEDQLEYLEEHRLKDLIKKHSEFISYPISLWIEKTTENEISDDEDEEEQKDEEGKVEDVDEDKDKGEEKKKTIKEVSHEWSLVKKQKPIWRRKPEEITKEEYAAFYKSLTNDWEEHLAVKHFSVEGQLELKAILFIPKRAPFDLFDTRKKPKNIKLYVCPVFIMDNCEELMPEYLSFVKGIVDSEDLPLHISREMLQQNKILKVIRKNLVKKYIEMFFEIAENKDYNKFYEAFSKNKSKLAELLRYHSTKSGDEMTSLKDYATRLKEGQNDIYYITGESKKAVENSPFLEKLKKKGYEVLYMVDAIDEYAVGQLKEFEGKKLFSATKEGLKLDESEDEKKKKAELKEKFDGLCHVIKDVLGDKVEKVVVSDHVDSPCCLVTGEYGWTANKERIMKAQALRDRSMAGYMSCKKTMEINPENPIMEELSKRADADKNDKSVKDLVLLLFEKALLTSGFSLDYPNTFGNRIHWMLKLGLSIDEDLVMLMLTRLLWRMPMLRVARWKKLIKCMFGLKFANSSDYRFTAPHVHRICREKENKYKVLRTGILKDNCGDIIRTIIKINITYILNCEQLLMETASFVDATLLRLQRLIFSNETHA

SEQ ID NO: 146439 - protein, 507 aa, Glycine max
  Coding DNA Sequence Number=SeqID_54754
  Gene Ontology: Mol. function=drug transporter activity; Cellular component=membrane; Biological process=multidrug transport
  Homolog annotation: Hit_ID=A7PEG4; Match level="QueryCoverage=64%, HitCoverage=62%, E-value=1e-136, Identity=71%"; Hit description =Chromosome chr11 scaffold_13, whole genome shotgun sequence
  Pfam annotation: Domain name=MatE; Domain location=273-436; Score =129.5; E_value=9.4e-36; Accession=PF01554.9; Description=MatE
MGAECCAASGNCARTHDPTSTSVSDAMKNKVCGLELPHGIKNRGSSRLHVDGGSSRKRGAALLEHKERSESGGGAGVSDSLNGADILRAFHGIDAVPGTPRRARTGSRVPRNGVREHHRLFGAVGSSTRDGTAMLPSIRRKTRECVVVDPPPLRHVPDPNITLMAHTYLLFSLPDLLTHSFLHPIRIYLRAQGVTHPVTLASLAGTLLHLPFNYLLVTRLRLGLAGVAAASAASNLSILLFLGAAVFFSGLHCSAPSRECLSGWKPLLRLAAPSCVSVCLEWWWYEIMIILCGLLVDPTATVASMGILIQITSLIYVFPSSLGFAVSTRVGNALGANRPSRAKLSAVVSVFLAAIMGFSAMFFAVGMRRRWGTMFTADEDILRITSMALPILGICELGNCPQTVGCGVVRGTARPNTAANVNLGAFYLVGMPVAVGLGFWFDVGFCGLWLGLLSAQVCCAGLMLYVIGTTDWEFEAHRAQLLTLVEDGVMDGQKQPLTGVVTETPSS

SEQ ID NO: 146440 - protein, 424 aa, Glycine max
  Coding DNA Sequence Number=SeqID_54755
  Homolog annotation: Hit_ID=A7PEF0; Match level="QueryCoverage=100%, HitCoverage=100%, E-value=1e-153, Identity=65%"; Hit description =Chromosome chr11 scaffold_13, whole genome shotgun sequence
  Pfam annotation: Domain name=DUF1005; Domain location=252-420; Score =353.9; E_value=2.8e-103; Accession=PF06219.3; Description=Protein of unknown function (DUF1005)
  Subcellular localization annotation: CTP_CleavageSite=56; ConfidenceScore=5.25e-01
MDPCPFIRLIVESLALKLPSSPAKPPPLSGVHPSTTPCFCKIRINTFPSHTAILPLSSSASSPDTTTSAPAFHLDPAALRRLSSKPLTLTLSVYNGPMGRSCGVRGAKLLGRLHLTINLPAALSRSSANTFHNGWLNLGGGGPHNNNKPSAQLHLVVRSEPDPRFVFQFGGEPECSPVVFQIQGNIRQPVFSCKFSADRNYRSRSLPSDFTKNRSGWRRSSTGEKEHQGRDRKGWMIMIHDLSGSPVAAASMVTPFVPSPGSDRVSRSNPGAWLILRPNGASESSWKPWGRLEAWRERGPVDGLGYKVELFSDNGPANRIPIAEGTMSVKKGGQFCIDYKVIKDAGLGSRLPGEEGFVMGSTVDGEGKVSKPVVQVGAQHVTCMADAALFIALSAAIDLSMDACRLFSHKLRKELCHHEQDSFS

SEQ ID NO: 146441 - protein, 331 aa, Glycine max
  Coding DNA Sequence Number=SeqID_54756
  Gene Ontology: Mol. function=hydrolase activity; Cellular component =mitochondrion; Biological process=metabolic process
  Homolog annotation: Hit_ID=A7PET8; Match level="QueryCoverage=87%, HitCoverage=76%, E-value=1e-127, Identity=79%"; Hit description =Chromosome chr11 scaffold_13, whole genome shotgun sequence
MEKLIKYVPFSNFKIAHLSVIEEAISATYFGVRPQGISLLKVFTAEYSLICKISDYKKPYISFMDGITMGFGIGLSGHGRYRIITERTVLAMPENGIGLFPDVGFAYIAAQSPGEGSVGAYLGLTGKRISTPSDAIYAGLGTHYVPSGKLGSFKDALLATNFSQDPHQDIKVLLARYESNPESEAQLKLLLPQLVSTFGGNKSVTEIIEELKKHQSSTDPNVVEWANEALQGLRKGAPFSLFLTNKYFSSVASAVGNNDGGLSTLSGVMETEYRIALRSSLRHDFSEGVRAVLVDKDQNPKWKPSSLEEIDPSEVEAVFKPLGPEVGELRV

SEQ ID NO: 146442 - protein, 638 aa, Glycine max
  Coding DNA Sequence Number=SeqID_54757
  Gene Ontology: Mol. function=ARF GTPase activator activity; Biological process=regulation of ARF GTPase activity
  Homolog annotation: Hit_ID=A7PES9; Match level="QueryCoverage=99%, HitCoverage=87%, E-value=1e-118, Identity=39%"; Hit description =Chromosome chr11 scaffold_13, whole genome shotgun sequence
MAKFSAQEVSALQEGGNQRAQEIYLKEWDPQRHSLPDSSNVDKLRDFIKNVYVDRRFSGERTYDKPPRVKGDKDDFHENMRTKTYQGSPSYEDTHERRYSDRSSPSGRSPGYDQENRQYGDYKKSPVRPPIINDWRREDRFGDGRKFEDHRISDGNHNVERASPERAKDLDSSSPPVVRPVREILGENVVPLRISEPPKTNSGQAANGSALTQVKLLPMMFHMLQPSVLGVRTVNWTVLMRTASSSSLASSNGTPAEVKLETIKSLIDFDDDPEPPVASAAPQAQQTTVAQHGMPANSNDNNWASFDVAPEAKAPQGPSNVNPLESMLTQLSVPVSLPSHVSGAQGDSRVATANSGSCVTILLIFNDPSVSPAGLVMGSALTATAAGTPIISSFSTFPASGASVTSFGLTPASTHNNAGQWATLQYQQQQPLFTAAASQPTIQQSTSPVGGALNNQPWTVPLVQGNPSTPMPHTSHLVPKPANEAKSRVVLQPSTADIKPSGRSELPEDLFTVKYSPFPAPVPGWQMGPPPSMGISIQYNNVVFPSMSSLQGALPSVTPSATMHPSNMGNISHAWNPPSSSSYVSPPQVQTLAPAMGPGAYMGQQMATNMPMPRHQGIGSFATEATAFGFSNPDQQLT

SEQ ID NO: 146443 - protein, 136 aa, Glycine max
  Coding DNA Sequence Number=SeqID_54758
  Subcellular localization annotation: CTP_CleavageSite=13; ConfidenceScore=5.02e-01
MASQSQVQMSKLRVSVIPESDSGNGTTSSPKGQCLCSPTTHEGSFRRTIKLGKNYNEIEHVNSLAANIGTNKLRWKLLWMKLKKEKKKKKKLFESASPFQVPYDQYTYSQNFDQGTALDEPDDLSLFGLLILPWYL

SEQ ID NO: 146444 - protein, 261 aa, Glycine max
  Coding DNA Sequence Number=SeqID_54759
  Homolog annotation: Hit_ID=Q9LHJ4; Match level="QueryCoverage=100%, HitCoverage=100%, E-value=4e-12, Identity=26%"; Hit description =Genomic DNA, chromosome 3, P1 clone: MMF24
  Subcellular localization annotation: CTP_CleavageSite=60; ConfidenceScore=5.03e-01
MKGSSKVIMGATLVMVVTLAVVLVLIFVLLAELYCSLLRRRRHLRNRNSNNTIPSATTARANASPSHTASQPQQESTPPFRSIYAQGVLQAPRNILLPAVSSKEEKAGPRKQNHYSQLDQFLQVESPSPPPSFISIAPASKPNLCHDDDKQAPCTGGEQQLVYISNPIYENESQGSGADTPPFETPDTSPSRLERSGSSEEDDEATLACVTPPLTPMKKLPAEASSVSLRDARSLATSCSDSRSNNGLSSSSASPCTSPLW

SEQ ID NO: 146445 - protein, 90 aa, Glycine max
  Coding DNA Sequence Number=SeqID_54760
MTWFCSDVWTLESGLSAHPPLSIASACLARPKNLEEHQYQGCALRARSVCYAQQLSSARLSARLALSSNPLTRAKREGGAKRNVTDSEPI

SEQ ID NO: 146446 - protein, 172 aa, Glycine max
  Coding DNA Sequence Number=SeqID_54761
  Homolog annotation: Hit_ID=Q5NRP4; Match level="QueryCoverage=36%, HitCoverage=4%, E-value=5e-07, Identity=39%"; Hit description =Putative gag-pol polyprotein, identical
  Pfam annotation: Domain name=zf-CCHC; Domain location=114-131; Score =23.2; E_value=0.00046; Accession=PF00098.14; Description=Zinc knuckle
MKEIKKEKHASYSCHDSCKSLSEELSNYYRGHHSSHTKHHSQRSEKDRRPQEANINLPYFHGKDNVEANLNWEIRKDQGLGILGAAPSKPKDDKGKTIEKQPLKASMQEKTSSIKCFKCLRRGHITSQCPTKKTMIMRSQDIYSSQDEATTSPSSSESEEAKGEESSAEIYP

SEQ ID NO: 146447 - protein, 162 aa, Glycine max
  Coding DNA Sequence Number=SeqID_54762
  Homolog annotation: Hit_ID=Q6WAY6; Match level="QueryCoverage=77%, HitCoverage=25%, E-value=3e-12, Identity=31%"; Hit description =Putative uncharacterized protein
VEVSMEPIASLAQYYGQPLRCFIFGDFQLSPMVEEFEEILGCPLGGRKPYLFSGQVENGVVGIPRKYLEVKARILADKGEWTPFIDILTLLIFEGVLFPNVDGLVDLEAIDVFLAYHNHKESLVVAMLADLYDTFDRRCPSICYKVTARASKKKDELGPTLG

SEQ ID NO: 146448 - protein, 258 aa, Glycine max
  Coding DNA Sequence Number=SeqID_54763
  Gene Ontology: Mol. function=exonuclease activity; Cellular component= cytoplasm; Biological process=DNA recombination
  Homolog annotation: Hit_ID=A7FLH3; Match level="QueryCoverage=67%, HitCoverage=57%, E-value=5e-69, Identity=78%"; Hit description =Recombination-associated protein rdgC
  Pfam annotation: Domain name=RdgC; Domain location=1-178; Score =210.2; E_value=4.8e-60; Accession=PF04381.3; Description=Putative exonuclease, RdgC
QTFMWIDTVNNLIIVDCASAKKAEDTLALLRKSLGSLPVVPLTLENPIELTLTEWVRSGELPAGFTLMDEAELKAILEDGGVIRCKKQDLVSDEIATHIEAGKVVTKLALDWQERIQLVIADDASVKRLKFSDTLREQNDDIDRDDFAQRFDADFILMTSELAALISNLVEAVSIYADRSPHTSCWRIKKTGNAAQALPVEFAVARHVKYRSGFVPFPLGFARQQHFQRAAHYRHLFWLAGTKGVFAFRHHANAGPAN

SEQ ID NO: 146449 - protein, 112 aa, Glycine max
  Coding DNA Sequence Number=SeqID_54764
MSDGFCGTHLQIMVRTRGLDHALGQVTDIGLGRGDRDDSDDAPQGLRPTASARRLRVAVTADHVDEPVILAPDVQDDPMEAPAAVEDIPADAGAEAAEDQYQGFPGGSSDPS

SEQ ID NO: 146450 - protein, 66 aa, Glycine max
  Coding DNA Sequence Number=SeqID_54765
  Subcellular localization annotation: CTP_CleavageSite=37; ConfidenceScore=5.51e-01
MRRYPRGYPFKISFAISKTQSMIALQRLTSSSAPFVRSAANKPVDTRRFTSSSASDNFCHTDTGVT

SEQ ID NO: 146451 - protein, 87 aa, Glycine max
  Coding DNA Sequence Number=SeqID_54766
  Subcellular localization annotation: CTP_CleavageSite=76; ConfidenceScore=5.00e-01
TYQGNPCGVYLDLSSFTGSGVYPDLSSFTGSGVYPDLSSFTGSGVIQKLYSLYQVIRPVRFTSSLSSYLLKIWHIVASIEVLLQRVK

SEQ ID NO: 146452 - protein, 243 aa, Glycine max
  Coding DNA Sequence Number=SeqID_54767
MSHHSSGVNGEGTSHKDPLSRILDELSSLKLWKEKQERKEKGKKRVEEISQDERKKIREEERRKIIKEMKREKHASYSSHNSCKSLSEELRDYYEGRHRSHLRPHSHRREKKRKPQEANINLSYFHGKDNVEANLDWEIRVEQQLKNKYTSKSYSSHSYPKKDQGQGILGVTPSKPKDDKGKTIEKQAPKVSKQEKTSSIKFFKCLGRGHITSQCPTTKTMILRGQDIYSSQDEATTSPSSSE

SEQ ID NO: 146453 - protein, 300 aa, Glycine max
  Coding DNA Sequence Number=SeqID_54768
  Gene Ontology: Biological process=transposition, DNA-mediated
  Homolog annotation: Hit_ID=Q1J7G7; Match level="QueryCoverage=13%, HitCoverage=71%, E-value=1e-11, Identity=74%"; Hit description =Transposase
WNLYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPGELELHRGGGRSRTSGSPGLQEFDLSWLNISAALPIDPRQHFLHHGSIMVGGTRTNRWKCWWLAVTWTIWQKRNKIIFNNESLDSNKLIDDASFHQAYRYRRPRGGARYQLLFPLVRVNFELGVIMVIAVSFGKPVVPAALMNRPTRGERRFAYWALAECILAYYVGTDEGVSEVLHVAGEKRLH

SEQ ID NO: 146454 - protein, 30 aa, Glycine max
  Coding DNA Sequence Number=SeqID_54769
IQAIVEFKRQCAKTNSNQNFNLEIKSSVYV

SEQ ID NO: 146455 - protein, 105 aa, Glycine max
  Coding DNA Sequence Number=SeqID_54770
MAEVSTEAIASLTQYYDQPLRCFTFGDFQLTLTNFQNSQNLGTGIGPGEASRKWGGWSTKERFGSKGENLGKSRRMGSVHGRPDALDLRSGPLSKRRWVGGLGSN

SEQ ID NO: 146456 - protein, 74 aa, Glycine max
  Coding DNA Sequence Number=SeqID_54771
  Homolog annotation: Hit_ID=A0ST23; Match level="QueryCoverage=33%, HitCoverage=51%, E-value=3e-07, Identity=100%"; Hit description =Putative reverse transcriptase
MAPEHACVLAASTKLLFPLVRVNFELGVIMVIAVSFGKPVVPAALMNRPTRGERRFAYWALAECILAYYVGTDE

SEQ ID NO: 146457 - protein, 88 aa, Glycine max
  Coding DNA Sequence Number=SeqID_54772
  Subcellular localization annotation: CTP_CleavageSite=42; ConfidenceScore=5.72e-01
MQRNSLASSSDTSFLPQPSLFSGRPFTGVATYPSVGGRRVTRGMRVPRKEYARSRHQRLFEENVGKTGKDAIYDLLSERFGSRIYARG

SEQ ID NO: 146458 - protein, 146 aa, Glycine max
  Coding DNA Sequence Number=SeqID_54773
MKKAVEPGNKQDFAQGKLVKESHEDVEEGFRPHWYLKSEEAWEEANRDLSSTSNSSLEVHVTFWLKIGALIRIEQRLQELGMQRMSNEDVQNILSTGDNEFEMSLVGELIIFWDSSENAEKTPDSLQAYERTSINLQGVPPLEIQP

SEQ ID NO: 146459 - protein, 136 aa, Glycine max
  Coding DNA Sequence Number=SeqID_54774
  Gene Ontology: Mol. function=4 iron, 4 sulfur cluster binding; Cellular component=integral to membrane; Biological process=protein -chromophore linkage
  Homolog annotation: Hit_ID=P56767; Match level="QueryCoverage=100%, HitCoverage=29%, E-value=2e-47, Identity=77%"; Hit description =Photosystem I P700 chlorophyll a apoprotein A2
DPLHVRPIAHAIWDPHFGQPAVEAFTRGGHLVHVAIPGSRGEYVRWNNLLSILPHPEGLGPFFTGQWNLYAQNPDSNSHIFGTPQGAGTAILTLLGGFHPQTQSLWLTDIAHHHLAIAFLFLVAGHMYRTNFGIGH

SEQ ID NO: 146460 - protein, 179 aa, Glycine max
  Coding DNA Sequence Number=SeqID_54775
MTNKRKVLGKNNEETRSYFTWNLEMERVLADVLRDQRNLGNKGDGGWKSDILGQSGFDWDGTKHMITIENENAWNEYCTSHKSAKPFRYKVLQNWDDIVDLCAKDRATGHRAETAMDADEATSRETNEVEFMGLGATAIDLEEPSSNTKGKRQGSTSSGTHPHKRKKDGRKRRNSSFFG

SEQ ID NO: 146461 - protein, 103 aa, Glycine max
  Coding DNA Sequence Number=SeqID_54776
MNVIAWRCSCILHQRLWSPAKLLRSALRQLSILHFLTEPHECHCLALFMHPPPTSLWSPAKLLRSAVRQFSILHFFTEPHECHCLALFMHPPPTSLEPREVIA

SEQ ID NO: 146462 - protein, 137 aa, Glycine max
  Coding DNA Sequence Number=SeqID_54777
  Homolog annotation: Hit_ID=Q1RU49; Match level="QueryCoverage=42%, HitCoverage=47%, E-value=8e-13, Identity=58%"; Hit description =Putative polyprotein, related
KFAKLDKFEGQNFKRWQKKMHFLLTTLNVVYVLSTLMPVYMEDETLDRTRKHSKWENDESWTHSERDCRVFKGKNKAGPSGSNDPEKQPDDDVAWWFDSGATSHVCKDRRWFKEFRPIDDGSIVKMGNVATEPILGL

SEQ ID NO: 146463 - protein, 87 aa, Glycine max
  Coding DNA Sequence Number=SeqID_54778
MSEFTRDYPPQILASPHQLDLAPYASGSYNTQRNALELLHDKHMLHSSCILRKMEVEEPWLGLWPPLNYRVDMGAGFVADLRGGLCG

SEQ ID NO: 146464 - protein, 169 aa, Glycine max
  Coding DNA Sequence Number=SeqID_54779
VDSRGSHLSQPPLLRVSEVRLTGASSKGGKCAESPPTKVDKSRALAPTYPPSKRKSDLRSSFKRGCHTLISSGDYYLMTCNLWFARSVKVRNVTEVEKRPTWAFQKAVASGGSNLARLGELGGKHLPYFAINRGGTEALPKRFRNVSVKNFAKGFNRSSAFFIVLRSST

SEQ ID NO: 146465 - protein, 99 aa, Glycine max
  Coding DNA Sequence Number=SeqID_54780
  Homolog annotation: Hit_ID=A5B591; Match level="QueryCoverage=78%, HitCoverage=8%, E-value=1e-11, Identity=51%"; Hit description =Putative uncharacterized protein
EERLKQGRTESAHVVSTSKDKGKRKRTEEPKNEAAKGLGQKKQNQGDNCFVCNIVGTGSPLVNDNLYLLDTVASYGESYCMVLSVELIIQTQEHYGISA

SEQ ID NO: 146466 - protein, 216 aa, Glycine max
  Coding DNA Sequence Number=SeqID_54781
MRGAPTEESLSPFLVRNLGAQSLKAIQRIHKAWRSPLRKDKELRGIRNGVIGGYHGWLRIHTRGLDWLTKLKVIDEENFEAPEEDEEVRALKLELGKARLAKEKFKLAATHIRKECAELQEENAATAKALEQETKRARKEEYGREKFRGALWGSNNELKLRREERDRSRVHGMILKEELVACEVQKEFGSTLGSHGAKHASYHRAIQGRVEPVCGP

SEQ ID NO: 146467 - protein, 224 aa, Glycine max
  Coding DNA Sequence Number=SeqID_54782
RVQHSISSVSIYDGTQSDIRVKSYCRLNWLGDSTFNFDGLDILRDSIRHPSKKLLSFELAQSFNHSILSISAILRDSIKHPSKKLLSFEFGSEVQHSISSVSIYYGSQFRHPKVQHSISSVSLYYGTQSDIRVKSILSFELAQRHQHSISSGLDILRTQSDIQVKSYCRLNWLRGSTFNCERLDMLRDSIRHPSKKLLSFEFAQRFNIKFRGSRYVTGLNQTSE

SEQ ID NO: 146468 - protein, 111 aa, Glycine max
  Coding DNA Sequence Number=SeqID_54783
MGEVEKVQEQMKADMEAMKEQMATMMEAMMSMKKIMEANAVAIAATRAIAKVNLMPSSGLNQMNHPTSDMVDKDLGSTDGPLLCANSKQARLPAIWLASQLSTTQCGVHSQ

SEQ ID NO: 146469 - protein, 232 aa, Glycine max
  Coding DNA Sequence Number=SeqID_54784
  Gene Ontology: Mol. function=RNA-directed DNA polymerase activity; Biological process=regulation of transcription, DNA-dependent
  Homolog annotation: Hit_ID=A7P5J6; Match level="QueryCoverage=96%, HitCoverage=18%, E-value=4e-31, Identity=37%"; Hit description =Chromosome chr4 scaffold_6, whole genome shotgun sequence
MCLRDIRHNKFEDSLIGTVETSLGHGPVYFNCYPNKIVSLMDRNILDSLFLNIHFHGLDMKEGSIPAALIYRIQYKVMNTCASRFLLKPQRGETTLFIIDMTKANVSLPRTIKWDEAMPSVPRPTPTIEKIKQDNSRKVEITFNWRNYFSSRIEVSRSEYESTRRFFLMRTRSIPVGLTRSESHNQFPMVNLQGLDTTSSIPRTTYNQEQEDDRKSIQSPTYSSMHEPYDVI

SEQ ID NO: 146470 - protein, 111 aa, Glycine max
  Coding DNA Sequence Number=SeqID_54785
MDRTHKTPSGPGKVQQGPGVSSSGYGPLSVLQGARQGYVIIGIAPARHPVDPKKSNRVLELSSSNYGSLSVLQSTYAPPPPLEFTSAHPQKGLSIAYDTWPTNRQPSPKPK

SEQ ID NO: 146471 - protein, 245 aa, Glycine max
  Coding DNA Sequence Number=SeqID_54786
  Homolog annotation: Hit_ID=A5BSR3; Match level="QueryCoverage=76%, HitCoverage=54%, E-value=3e-07, Identity=28%"; Hit description =Putative uncharacterized protein
  Subcellular localization annotation: CTP_CleavageSite=52; ConfidenceScore=5.17e-01
KWLHRLALLLLLLLLVQHHRSPSTLKRTRKVTRLRSLANRQVGAERPLVHVNPATGKADGPHRKKLRTYLGIVAHDKAEYDIPEAFDLRTKKENTSDCERVLTRKVSTTLYAKSMALATRSGPNFVKLAKTLCGRMYEKRHRQSRSKTLPLTCCLVGKRKKKLEEVAQSRSTNTMIDPPSPIRRHMKWKMTCTKKTGQMMSQAAKEIANKIDQTSQGSFVTHGRQDVLTAVIGQPEHPGHVRAAR

SEQ ID NO: 146472 - protein, 60 aa, Glycine max
  Coding DNA Sequence Number=SeqID_54787
MKTDMEAMKEQMTTMMEAMMSMRKMMEVNTTIVIAASTATEVDPTYPFGLNQVNRLVSDM

SEQ ID NO: 146473 - protein, 131 aa, Glycine max
  Coding DNA Sequence Number=SeqID_54788
MVRVLVIRTLYLESYMSLSSLNLWKEKLERREKGKERVEINQDEREQIREEERRKILKELRKEKHDSYNSHDPCKSLSKELCDYCEGRHRSHLRPHSYTREKERKPQEANNNLPYFHGKDNVEGYLDWEIR

SEQ ID NO: 146474 - protein, 198 aa, Glycine max
  Coding DNA Sequence Number=SeqID_54789
  Homolog annotation: Hit_ID=Q6WAY6; Match level="QueryCoverage=62%, HitCoverage=21%, E-value=1e-10, Identity=31%"; Hit description =Putative uncharacterized protein
RRVDWDQHLAGIGGRTINWFPRWKEGKEGVLFPCGDYPNILLIGTRGCINYNPALAIRQLRYSMRGAPTEESLSPFLVSNFGTQSFKIIQRVHKAWESPLRKDKELRAIRNGIIDGYHEWLKIRTRGLDWLSKLKIINEENFEAPEEDEEVRALQTELGKARLAKERFKLVATDVRKECAGNGELKPRKGRERPIMST

SEQ ID NO: 146475 - protein, 82 aa, Glycine max
  Coding DNA Sequence Number=SeqID_54790
MAMGSFSQARGALGKIARFQLSNKFSLIGKINGYGSMTTVDITHHKAGYVHSVDLKMRRQSTYFLTAPVPYPCGGSLYLGLI

SEQ ID NO: 146476 - protein, 91 aa, Glycine max
  Coding DNA Sequence Number=SeqID_54791
MVGYAPSSFADLVFAGERIEAGLKRDKFDHPALMNEKIGANEEDENEEGTHVVAAIPTWPNFPPAQQCHRSANIGLSHYPSPNHPQKPSPN

SEQ ID NO: 146477 - protein, 212 aa, Glycine max
  Coding DNA Sequence Number=SeqID_54792
MAPRKLASKRSRKDKAVEGTSSTPEYDSHRFRSAEHQQRFEAIQGWSFLQERRVQLRDDEYTDFQEEIARRRWPLLVTPMAKFDPDIVLEFYAKAWPTEEGVRDMRSWVRGQWIPFDADAFSQFLGYPLVLEEGQECEYGQRRNQADGFDEEAIAQLLCIPGKDFAWTAVGRRVRIMCTNMTTLTQIWMTLLLSNIQPSDHNSDLPPAEVSA

SEQ ID NO: 146478 - protein, 61 aa, Glycine max
  Coding DNA Sequence Number=SeqID_54793
METSLFFAKLYGACGTTFHDHHQWKSHKISASERKNRSKKKMKNEEQLREKERKEKNLHNK

SEQ ID NO: 146479 - protein, 89 aa, Glycine max
  Coding DNA Sequence Number=SeqID_54794
MASTIMNINKKAEEMSFVERWKDELEPTWHLLHSSGNMHFVTYNQDLVSPTLLARWTELQEFYRLTGNHQVTLTHYGQCFPLHHLQKHL

SEQ ID NO: 146480 - protein, 61 aa, Glycine max
  Coding DNA Sequence Number=SeqID_54795
MKGNQQREESPTVATYPSAGGRRVTRGMRVPRKEYARSRHQRLFEENVGKTGKDAIYELFR

SEQ ID NO: 146481 - protein, 32 aa, Glycine max
  Coding DNA Sequence Number=SeqID_54796
MKEAVDYCKKNFSKDKKQLKDFSVDGLSQMTP

SEQ ID NO: 146482 - protein, 53 aa, Glycine max
  Coding DNA Sequence Number=SeqID_54797
MNLRRFRAQEIKQDSSQGVIDYNILVIDYKNSYPERKFKFKCEESTLSIKCIV

SEQ ID NO: 146483 - protein, 56 aa, Glycine max
  Coding DNA Sequence Number=SeqID_54798
RASAKCNTQWLSTRKNPEEDELYRFAECTAPGHQAHRFSSSAKRKKRAKPRITNMR

SEQ ID NO: 146484 - protein, 93 aa, Glycine max
  Coding DNA Sequence Number=SeqID_54799
MAEDVADMIEDVPDLAEEAPEMTTDVQGTEGAEGSNVDDAEGFPGGPRDPSVLTSFADHVAHAVWSGQERPDLKLVSHGRKVTLIGRSAPEIE

SEQ ID NO: 146485 - protein, 224 aa, Glycine max
  Coding DNA Sequence Number=SeqID_54800
MDGNITLILQHGGRFTPRASDGKVEYIGGEFDVWEDISANYMNTFILYDLVKSMSCTIDGDILYLVKDALENENEINVYFHHEVDPIPKEVPQMLYLKCHPIPKVVENEDDLDDVPVDGHEEDVGGGEKGINVDVGGGEEKDVGGGEEENVGNPNDEDDNDKDECDDEDEDVDKVYSQYNESSQVGGEKLELGMEFGTLTEFKSSLREYSIFMDREFKWKKNDK

SEQ ID NO: 146486 - protein, 162 aa, Glycine max
  Coding DNA Sequence Number=SeqID_54801
MASNSQQFSARNDAIVLRGVHEVATDSSSSAENKKLEGKLDALVNLVTQLAMNQKSAPVARVCGWRNHPNLRWTSPPQQQQPVPPFQNAAGPSKPYVPPPMQQQHQQSQQRQQATEAPPQPYLEELVRQMTIQNMQFQQETRASIQSLTNQMGQMATQLNQT

SEQ ID NO: 146487 - protein, 86 aa, Glycine max
  Coding DNA Sequence Number=SeqID_54802
MVICTLSEDVDIFWWRLFQVSQVIQNYVGHVTCTLVSSRGGGPDDTRRYLTVIRTLLSSRGGGLDDKQRPSLVILHPCIIQRRRAR

SEQ ID NO: 146488 - protein, 95 aa, Glycine max
  Coding DNA Sequence Number=SeqID_54803
ADPIGFGYPLWSPFIRYALDPGKRDISLWSMRDSYPLCQSQVEEKRVYGIPSFGSPGRLAQSTDSGAGKRRIFAIGNYVNQRLLKPLHDWLMKAL

SEQ ID NO: 146489 - protein, 232 aa, Glycine max
  Coding DNA Sequence Number=SeqID_54804
  Gene Ontology: Mol. function=L-aspartate oxidase activity; Cellular component=cytoplasm; Biological process=pyridine nucleotide biosynthetic process
  Homolog annotation: Hit_ID=A8GI33; Match level="QueryCoverage=100%, HitCoverage=42%, E-value=1e-133, Identity=96%"; Hit description=L -aspartate oxidase
  Pfam annotation: Domain name=FAD_binding_2; Domain location=1-166; Score=-117.3; E_value=0.0011; Accession=PF00890.15; Description=FAD binding domain
MAWRAGCRVANLEFNQFHPTCLFHPQARNFLLTEALRGEGAYLKRPDGSRFMPDFDPRGELAPRDIVARAIDHEMKRLGADCMYLDISHKPAEFITQHFPMIHEKLLTLGFDLTRQPIPIVPAAHYTCGGVMVDQHGRTDLDGLYAIGEVSYTGLHGANRMASNSLLECLVYGWSAAEDILQRLPFIQQAKQVPHWDESRVDDADERVVIQHNWHELRLFMWDYVGIVRTTK

SEQ ID NO: 146490 - protein, 105 aa, Glycine max
  Coding DNA Sequence Number=SeqID_54805
MTPTHDALLYYNGRWNMPHQNEFVGYSFIGKNPKKFDIPSKCTMDELKDLIKQVVLHGIPPYGIHETQTVLVQSNYWKKFGPIEILAVFSKHVMEMEDDVSLSQN

SEQ ID NO: 146491 - protein, 99 aa, Glycine max
  Coding DNA Sequence Number=SeqID_54806
MHKKRSSVGELIPIDLEINATCRRRNQERIRNFLQDLEAAAIPEEEPQSSEASSSFPIAEHSHLDPSEDYIMAEEPRRVTLEDYSSSNLPQFFTSIAQP

SEQ ID NO: 146492 - protein, 88 aa, Glycine max
  Coding DNA Sequence Number=SeqID_54807
  Subcellular localization annotation: CTP_CleavageSite=58; ConfidenceScore=5.40e-01
MFVFVGGGYMPFCFKSNVPLEWPRGSLPQRGPGRTRRPKELVPLRSTTVTALGALYTSSASKPSRDGRFSGSDASSSGTTSILIFRRK

SEQ ID NO: 146493 - protein, 70 aa, Glycine max
  Coding DNA Sequence Number=SeqID_54808
MGNVRFLEEVEFGKEENIKNVVFEEEPVIYSDQVLIPITVQDTTPVIEDNVQTIDIVPEQDNMRIPLKYL

SEQ ID NO: 146494 - protein, 175 aa, Glycine max
  Coding DNA Sequence Number=SeqID_54809
MSRGSGDLGDVRWGAIAQNQAWVVDRALIIDYQLGVIDYTVLPATGNRLPFMCNRLHNIAMAAQLIHDRVVTECLKGVWETLEGNERCRFRGTIRLTATSLPVQVIEVSSSEEDLEEDQEELPPEPVVDALDFPEDDEDPLPDVDSPEDIMSASEADSTEESGPGGTANSDDSSS

SEQ ID NO: 146495 - protein, 49 aa, Glycine max
  Coding DNA Sequence Number=SeqID_54810
MCTCATFGTPKCLEYTSITTHSSKLEGGGHMNENAIHGAPKKVENRELH

SEQ ID NO: 146496 - protein, 153 aa, Glycine max
  Coding DNA Sequence Number=SeqID_54811
LCQSFGVPVVPSKVIRPPITRAFIEKYCTQRQAQGDAPQAADAPPPHQVGPAGSFDTEQYLRHLVRQQAANHRAHVQTHDCLYQLSLSLQSKGFTSFPCPTPDQFRAEVAWPGDWPEARAGEAPAEAPDEADEAREDEEMTDLLDFLGGSGAT

SEQ ID NO: 146497 - protein, 151 aa, Glycine max
  Coding DNA Sequence Number=SeqID_54812
MPSLYDRTTNLEETLAQFMQVSMSNQKSTESAIKNLEVQVGQLAKQLAEKSSNSFTTNTEKNPKEECKAVMTRSKMAVQAEDSKADKKVEGFKQPLVDELALELVDDLVELEEIVEEVEGDEEGETPIRDCQEKMKKKEEKEKRRRNSGIL

SEQ ID NO: 146498 - protein, 49 aa, Glycine max
  Coding DNA Sequence Number=SeqID_54813
FRAEVAWPGDWPEAQAREAPAEAPGDADEARMDEEMTDLLDFLGGSGTT

SEQ ID NO: 146499 - protein, 131 aa, Glycine max
  Coding DNA Sequence Number=SeqID_54814
MEESHRENNKYNISQSRGSALDGEEHIGEWRNPIGKITKISISQSRGFVPLDGEEHIGEWRNPIGKITKYNISQYKRGPLLMVKNTLENGGINRENNKDHISQSEGAALDGEEHIGEWRNPIGKITKITFS

SEQ ID NO: 146500 - protein, 108 aa, Glycine max
  Coding DNA Sequence Number=SeqID_54815
MTETVCTESRLGISVRHLTSRVRMTESAEDDGAEDDVSLYMLLDSESDRQRKSVYTDNQLGISACHLTSRMTTLASACQSNLGSPNDEVRITERCLRMLPDSWVMIAK

SEQ ID NO: 146501 - protein, 141 aa, Glycine max
  Coding DNA Sequence Number=SeqID_54816
MRLPGKESLLMKSPITINEILDVSILFLNDHLEETLGSTKIEEIHSKCINLAQGKDYGESGFWLKVCRMARHDTCRGLVWLKVCRMARHDTCRGLVWLKDKRDAPHYFHDTNAKMMIWKLYAKLVMHASTRTLKCQLFMVM

SEQ ID NO: 146502 - protein, 78 aa, Glycine max
  Coding DNA Sequence Number=SeqID_54817
  Subcellular localization annotation: CTP_CleavageSite=38; ConfidenceScore=5.01e-01
TYQGNPCGVYPDLSSFTGSGVYPDLSSFIGSGVYPDLSSFTGSGVYPDLSSFTGSGVIQISVACIKRSTPSKIHINVG

SEQ ID NO: 146503 - protein, 65 aa, Glycine max
  Coding DNA Sequence Number=SeqID_54818
  Homolog annotation: Hit_ID=A5AGE5; Match level="QueryCoverage=89%, HitCoverage=4%, E-value=9e-22, Identity=81%"; Hit description =Putative uncharacterized protein
MGHIAKICWWVSKKPTQSDDIPQALAALTLDNTIAETKWTSDTGASNHMTGTRNRETDYHREAQG

SEQ ID NO: 146504 - protein, 82 aa, Glycine max
  Coding DNA Sequence Number=SeqID_54819
MGNQPRPNFNADQGGPPNRPQQQGPSLYDRTMKLEETLAQFMKVSMSNQKSIGSTIKNLEVQVGQLAKQLADRPLSSFGANT

SEQ ID NO: 146505 - protein, 57 aa, Glycine max
  Coding DNA Sequence Number=SeqID_54820
LQEVWARDAREDPKVLMSLKVDFEPMGKVSYPNFVRGPLLDDMRPFFGPREVLGTHH

SEQ ID NO: 146506 - protein, 132 aa, Glycine max
  Coding DNA Sequence Number=SeqID_54821
MLQGSRPQDTQWTKEVQQGPGFPALITGLCQFYGVPVIPSKVIRPPANRVSSRSIAPPDRQRARHHNSLGDGRQQATNAPPPPPEPLSSSTKSRTHLVAHDPRNLNKTSTSSEGSENTLDMHVERYLGYACM

SEQ ID NO: 146507 - protein, 227 aa, Glycine max
  Coding DNA Sequence Number=SeqID_54822
MNLIIVIKRKEHALQRPYRTRARARVMGEEEEVQEQMKADTEALKEKMATMMEAMMSIKEIMEVSATAIAATSTIVEVDLTPPPPIWPQPNKSSNLIYGRSRRQRVGRYGRPSFSAKNKHAFPPYGLPPNYTPPNVTSTPSEDVNNSAPILIERQQPQSDHAYVSQPMGETHEMPRHNLADFEPCHGYATKGQAVGGIPLQNTLEAPQYHPQPHPLHFTASKNSHAM

SEQ ID NO: 146508 - protein, 188 aa, Glycine max
  Coding DNA Sequence Number=SeqID_54823
MQFRASRYITGLNQTSEYKVIRCLNWLRASTFNFERLDILRDSIRHPSKKLLSFELAQSFNIQFRASQYVTGLNQTSEDSTFNFERLDILRDSIRYPSKKLWSLNWLRDSTFNFERLDILRDSIRYPSKKLWSLNWLRDSTFNLERLDILRDSIRHPSITLLLFELAESFNIQFRASRYIAGLNQTSE

SEQ ID NO: 146509 - protein, 168 aa, Glycine max
  Coding DNA Sequence Number=SeqID_54824
MASNSQQFSARNDAIVIKGVHEVAINSSASSETKKLEGKLDALVNLVTQLALNQKSVPVARVCGLCSSADHHTDLCPSMQQPGIIEQPEAYVANIYNRPPQPQQQNQPQNHPNLRWSSPQQQQQQPAPSFQNAAGPSRPYIPPPIQQQQQPQKQQQLMLLRNLPSKNL

SEQ ID NO: 146510 - protein, 182 aa, Glycine max
  Coding DNA Sequence Number=SeqID_54825
MVMGDFINILSFPENTETFSSLTSYPELRGSEFLIGGYVGARASLLSTCTLFVIQRRRSPMTCGDKILGHIRTPLPFNTAVPKWRAETKMWSFCTLCHPEAAGPMTCGDKICHSAPLFHLDTAVSDGAQRQKLVILHPLSRGGGPDDMQRQNLSFRTPLPFRHSSVRWRAETKIGHSAPFVI

SEQ ID NO: 146511 - protein, 76 aa, Glycine max
  Coding DNA Sequence Number=SeqID_54826
  Subcellular localization annotation: CTP_CleavageSite=25; ConfidenceScore=5.39e-01
MSLFQGFFKVSVKTSNNASKGDSWRSSVVNGGGGGGWGVGGGFRGREGGINGSFTLLDVFVAYNTRPGKIWLAWAS

SEQ ID NO: 146512 - protein, 101 aa, Glycine max
  Coding DNA Sequence Number=SeqID_54827
  Subcellular localization annotation: CTP_CleavageSite=84; ConfidenceScore=5.33e-01
MNSLPSAIHVSSAIESGAPRIHCLALFANSLFSNLIRRPMNSLPSAVHVSSTIESGAPRIHCLALFANSLFSNLIRRPMNSLPSAVHLSPPTSLEPREFIA

SEQ ID NO: 146513 - protein, 146 aa, Glycine max
  Coding DNA Sequence Number=SeqID_54828
MSPFLVRDLGAQSSKTIQRIHKAWETPLRKDQELRGIRNGIIGGYHEWMKVHIRGLDWLAKLKVVSKESFEAPEEDEEVQTLKSELGKAKLAKEKFKLAATHVRKKNAELRDVNVATTKALEQKTKRARREEHDQSKVLRGFIGQQ

SEQ ID NO: 146514 - protein, 189 aa, Glycine max
  Coding DNA Sequence Number=SeqID_54829
MDRLFTMILGFTSKLQLRCPFEYQTAVILQAKKSEYTIPSSYPTNNFWMKFTTGSHSPIQLLCTVGRTPDGIINLLQRTMPRTHDAILYYNRKWNMPPQNKFFGCVFTGKNPKKFQIPSACTIDELKDLIKQVAPKGIPPLAIHESQTVRQLFFRQSGRFEYSDTLIKYEINELKTNEELLKVLVQSNY

SEQ ID NO: 146515 - protein, 37 aa, Glycine max
  Coding DNA Sequence Number=SeqID_54830
IKNYVGLSSSSQLRIRRSKSLAFVGHPTISVILTLKS

SEQ ID NO: 146516 - protein, 218 aa, Glycine max
  Coding DNA Sequence Number=SeqID_54831
  Gene Ontology: Mol. function=aspartic-type endopeptidase activity; Cellular component=small subunit processome; Biological process=DNA integration
  Homolog annotation: Hit_ID=A5BEY3; Match level="QueryCoverage=84%, HitCoverage=17%, E-value=6e-20, Identity=32%"; Hit description =Putative uncharacterized protein
MIAHEGKARAAVEELKKFLVADSLEEMNRKLNKFYMVLILRSPHSDFDHVRDQVLAGDQVPSMDSLITRLLRVPHALKEENPADVVETLAMVASRGRGGGHNSRGGRSGKCGRPQCTYCKRMSHTQENCYSLHGFPEKVAKGAQTEKSESKFSDEEYQEYLKLKSEKSSSPASPSSVPCYSTACISQSIDGSSPWILDSGASDHISGTWHRSSDWRRT

SEQ ID NO: 146517 - protein, 90 aa, Glycine max
  Coding DNA Sequence Number=SeqID_54832
MLRDSIRHPSKKLLSFELAQKFNIQFRASRYVTGLNQTSEASTFNFERLDKLRDSVRHPSKKLLSFEFAQRFNIQFRASRYVTGLNQKFE

SEQ ID NO: 146518 - protein, 138 aa, Glycine max
  Coding DNA Sequence Number=SeqID_54833
MYRKRGLPVTGGMSTGGFARLCLIFSKASWQSLFHRTAWFLRNSLKMGSHVGVSCEINLANKGHLSDQGLPMDPKRIKVIPEWSTPPCIREIWGFNDLKNFYKSVDERIPEFQEHMDLRSNPFQGIGNDAILPRKGIR

SEQ ID NO: 146519 - protein, 343 aa, Glycine max
  Coding DNA Sequence Number=SeqID_54834
  Gene Ontology: Cellular component=membrane; Biological process=UDP -glucose metabolic process
  Homolog annotation: Hit_ID=Q7CS46; Match level="QueryCoverage=100%, HitCoverage=41%, E-value=1e-157, Identity=81%"; Hit description=CelB protein
  Pfam annotation: Domain name=BcsB; Domain location=1-343; Score =138.0; E_value=2.7e-38; Accession=PF03170.4; Description=Bacterial cellulose synthase subunit
MDRRQWSIYLTPEQVNAAVSLNVGYQNAIVVAPESSNFQVSVNNVGLGAARIEAPDSQGNISLKIPPGVLQVGANVVSLGVQQRHRTDCTIQSTYDLWTDVDPANTFIGFNADVAGSFANIDDIQATGPDGKATTSIEIVAPALGNPAFADSLLRLSQALALRTQMPNQTVRFVTAPPVERKAGTLSVLVGTAREIAGMAGTLPPEASAGAFAGFGSAVAGGASPLLVTGPTPQAVQAAIETLFSSISRTPGAQRATFSTRSWHAPDVPLIMSDRRIALSELGIESSEFSGRRFRNEFYIGMPADFYASAYGEASLLLDAAYSSQVLPGSHVDIYVNGQIAST

SEQ ID NO: 146520 - protein, 91 aa, Glycine max
  Coding DNA Sequence Number=SeqID_54835
  Gene Ontology: Mol. function=nucleic acid binding
  Homolog annotation: Hit_ID=A5AYU6; Match level="QueryCoverage=82%, HitCoverage=13%, E-value=2e-14, Identity=46%"; Hit description =Putative uncharacterized protein
MDGTSTRFKENKGGNRSSQDYDEDQANLCLMTKSHESNKEESVRTKWYIDSGCSKHMTGDVSKFTTISPKKSGHITYGDNNKGKIIRVGKI

SEQ ID NO: 146521 - protein, 127 aa, Glycine max
  Coding DNA Sequence Number=SeqID_54836
  Homolog annotation: Hit_ID=B0HC01; Match level="QueryCoverage=26%, HitCoverage=72%, E-value=1e-11, Identity=100%"; Hit description =Putative uncharacterized protein
MRKRHASRREKGGQVSGKRQGRNRRAHEGASRGKRLGGGAYGKTPATRPFYGSWPFAGLLLTCSFLRYPLILWITVLPPLSELIPLAAAERPSAASHWHDRFPDWKAGSERNAINAHDYTTDLPFSS

SEQ ID NO: 146522 - protein, 98 aa, Glycine max
  Coding DNA Sequence Number=SeqID_54837
MKYKGKGNIREYIMEMSNLASKLKSLKLELGEDLLVFSKKLVEKASQRNHEEASGGSLLMKLLEKATWSCLEACVESTSKDKKESSSDATRNPWGSSL

SEQ ID NO: 146523 - protein, 115 aa, Glycine max
  Coding DNA Sequence Number=SeqID_54838
  Homolog annotation: Hit_ID=A7UQU7; Match level="QueryCoverage=100%, HitCoverage=20%, E-value=2e-09, Identity=35%"; Hit description=IMP dehydrogenase/GMP reductase, putative
MYDNLNDASKSTARQLVEYITLLQCWIYEHFSFVGSVVPVEDYDERRPRACRWTSGKALLVSTYHKRLDRLTPDVVCWISYDDHHSFREFEVISLFFGHLRWGPLTVIYRPERVV

SEQ ID NO: 146524 - protein, 159 aa, Glycine max
  Coding DNA Sequence Number=SeqID_54839
  Homolog annotation: Hit_ID=UPI00016621D1; Match level="QueryCoverage =86%, HitCoverage=40%, E-value=5e-15, Identity=37%"; Hit description =UPI00016621D1 related cluster
DCTSSSSKGCLPSPSRGLRVLAIRGLHILTFRGLHVLTFRGLHVLTFRGLHVLTFRGLHILTFRGLHVLTFKGLHVLTFRGLHVLTFRGLHVLAVRGLDVLAVRGLDVLAFKGLHVLYFRGLHVLAFRGLCALAFRGLCTLAFSGLHIRTLREFKVLYP

SEQ ID NO: 146525 - protein, 119 aa, Glycine max
  Coding DNA Sequence Number=SeqID_54840
MGEVEEIQEKMKADMQAIKEKMATMMEAMMSVKIMEANAVAVAATSAVARVNPMLPSGLKHMNHPTSNMAHISQTMGETLEIPHHNLADFKPCLGYATEGQAVGGIPLQNTLEGPQCHP

SEQ ID NO: 146526 - protein, 158 aa, Glycine max
  Coding DNA Sequence Number=SeqID_54841
  Gene Ontology: Mol. function=rhodopsin-like receptor activity; Cellular component=integral to membrane; Biological process=G -protein coupled receptor protein signaling pathway
  Homolog annotation: Hit_ID=Q8LAS5; Match level="QueryCoverage=43%, HitCoverage=13%, E-value=1e-22, Identity=82%"; Hit description =Putative uncharacterized protein
  Pfam annotation: Domain name=LrgB; Domain location=22-146; Score= -150.6; E_value=0.086; Accession=PF04172.7; Description=LrgB-like family
DAGSRQARQGASAGVGGCRGWLNYAASEQIVLRVHHMRAIGAGLFAITPAGERGMCCKAIKLGNARVFPLVKRHAAEIFTSVIISTLFSLYSTAFVGRLVQLEPSLTVSILPRCITVALALSIVSLFDGKYYAHTATIYPHKSIILSTLELGVPSSNS

SEQ ID NO: 146527 - protein, 65 aa, Glycine max
  Coding DNA Sequence Number=SeqID_54842
MGLHQQVRVRGHLIKFDEDTLNTFLKTPVVVEEGETDMNGSRMEKEEREETPLQGEDESRRSSPP

SEQ ID NO: 146528 - protein, 219 aa, Glycine max
  Coding DNA Sequence Number=SeqID_54843
  Homolog annotation: Hit_ID=Q2HW90; Match level="QueryCoverage=60%, HitCoverage=31%, E-value=2e-07, Identity=28%"; Hit description =Putative uncharacterized protein
MGQLQRQAFRKAYGKIWDLARDFQLVPTVKEFEEILGCPLGGRKPYLFSGFYPSTIRVAKVVKISAQELDRANGLSFIDILALLISGVVLFPNMEGLVDLAAVDAFLAFHHGKESPIVAILAMYDTFDRGCEKSSARIVCCALALYVWLVSHLFLQEGRPVYPLQGHRSCVEKGKANWDQLLASMEGHLLIGSLARRKEESGFYLHAKWMSECSLDGNK

SEQ ID NO: 146529 - protein, 76 aa, Glycine max
  Coding DNA Sequence Number=SeqID_54844
MEQRGHGMYYTPLTFSQYPSQMYQYPFEGVDLRHEFSAEAEQQGRRQRARRNPDREARRWDRPYGTSSRHHGHHND

SEQ ID NO: 146530 - protein, 186 aa, Glycine max
  Coding DNA Sequence Number=SeqID_54845
  Homolog annotation: Hit_ID=A4WE84; Match level="QueryCoverage=100%, HitCoverage=87%, E-value=4e-94, Identity=91%"; Hit description =Putative uncharacterized protein
  Pfam annotation: Domain name=DUF179; Domain location=1-186; Score =330.8; E_value=2.4e-96; Accession=PF02622.6; Description =Uncharacterized ACR, COG1678
MNLQHHFLIAMPALQDPIFRRAVVYICEYNEDGAMGIIINKPLENLQVEGILDKLKIPAEARLQEIRLDKPVMLGGPLAEDRGFILHTPPVFSSSIRISDNTVITTSRDVLETLGTAEQPSEVLVALGYSSWEKGQLEQEILDNAWLTAPADMNILFKTPIADRWRDAAKLIGIDILTMPGVAGHA

SEQ ID NO: 146531 - protein, 57 aa, Glycine max
  Coding DNA Sequence Number=SeqID_54846
  Subcellular localization annotation: CTP_CleavageSite=22; ConfidenceScore=5.13e-01
MGPSVATLPPKPWNKKPRGLVRKSMARTSSEGLCGAATASLSSEGKRKTNHEHIAWS

SEQ ID NO: 146532 - protein, 65 aa, Glycine max
  Coding DNA Sequence Number=SeqID_54847
  Homolog annotation: Hit_ID=A5BKY7; Match level="QueryCoverage=78%, HitCoverage=10%, E-value=1e-17, Identity=76%"; Hit description =Putative uncharacterized protein
  Pfam annotation: Domain name=zf-CCHC; Domain location=29-46; Score =22.9; E_value=0.00052; Accession=PF00098.14; Description=Zinc knuckle
MGRTKQLSLKLIRKGNGKIPPQADIKNVAKCFFCKKKGHMKKNCPGFQKWLEKKGYAKPKETSGK

SEQ ID NO: 146533 - protein, 94 aa, Glycine max
  Coding DNA Sequence Number=SeqID_54848
  Subcellular localization annotation: CTP_CleavageSite=40; ConfidenceScore=5.21e-01
MLSPPPLLAALSQTSQAQCPQSPHHLSFQPQLCASLPSPHAAAFESLFIADLAKVMQSYPARALDRRLQVDWARDPREGPRVLMSLRVYFEPMG

SEQ ID NO: 146534 - protein, 134 aa, Glycine max
  Coding DNA Sequence Number=SeqID_54849
MAEKNFEEHCGVATMSSSSEERKDTMVTGHGMILKEELAACARSKRSLAQHLEATEQSMLAIIGQYKEELNQSVAHEQKLVEDFAQVYAEKEARGRVIDALHQEATMWMDRFALTLNGSQDLPRLLAKAKAMDE

SEQ ID NO: 146535 - protein, 333 aa, Glycine max
  Coding DNA Sequence Number=SeqID_54850
  Homolog annotation: Hit_ID=Q84VI1; Match level="QueryCoverage=97%, HitCoverage=47%, E-value=1e-129, Identity=75%"; Hit description =Envelope-like protein
MATSSKQTAAPGSPAVPSSPHQEQPEFNIQPIQIIPGQASVPEKLVPRRQQGVKIAENPSLATSPREVDTEMDKKIRSMVSSILKEASVPEADEDVPTSSTPNVSMPDVEKDVPTSSGPNDEVLSSPSKERSTEEDDQAAEETPAPRAPEPAPGDLIDLEEVESDEEPIANRLAPGIAERLQSRKGKTPIKRSGRIKTMAQKKSTPVTPATSRRSKVAIPSKKRKEISSSESDDDVELDVSTSKRAKKSGRKVPGNVPDAPLDNISFHSIGNVEKWKYVYQRRLALERELGRAAMDCKEIVDLIKAAGLLKTVSKLGECYEGLVQGIHCQHSL

SEQ ID NO: 146536 - protein, 129 aa, Glycine max
  Coding DNA Sequence Number=SeqID_54851
MAGTFFLLKKQNSLEITSGLHALTFRGLHALAIRGLHVLTFVGLHALTFRGLHVLANRGLHALTLRGLHVLANRGLYALTLRGLHALTSRGLHILALRGLHALTFRGLRVLIFNVLHIHTLREFKVLYP

SEQ ID NO: 146537 - protein, 396 aa, Glycine max
  Coding DNA Sequence Number=SeqID_54852
  Gene Ontology: Mol. function=aspartic-type endopeptidase activity; Biological process=proteolysis
  Homolog annotation: Hit_ID=A7QL19; Match level="QueryCoverage=100%, HitCoverage=76%, E-value=9e-63, Identity=31%"; Hit description =Chromosome undetermined scaffold_116, whole genome shotgun sequence
  Pfam annotation: Domain name=DUF755; Domain location=153-248; Score= -34.3; E_value=0.02; Accession=PF05501.2; Description=Domain of unknown function (DUF755)
MVATAYQTSHECSEETIIDILVAGFSGQLKGWWDNYLTNEEKSKIYSAVKTDLNGKVITNDDDKEIPDAVNTLIFTIAQHFIGDPSLWKDRSAELLSNLKCRTLADFRWYRDTFLTRVYTREDSQQPFWKEKFLAGLPRSLGDKVRDKIRSQSANGDIPYENLSYGQLISYVQKVALKICQDDKIQRQLAKEKAQTKKDLGSFCEQLGLPACPTQKKKQTSRKEAQDHKPANRRRFSKRRYSQKPSTSHISKYCRLKKKLRNLNLEPAIEEQINNLLIETSEEETETSSSVLSNENLNLIQQDDHLSSTDDDGQINTLTREQDLLFEAINSIPDPQEKKVFLEKLKKTLEVKPRRKDFITNNKFDVSNILKRLENSSTKPTTIQDLQTEINNLKRE

SEQ ID NO: 146538 - protein, 305 aa, Glycine max
  Coding DNA Sequence Number=SeqID_54853
  Homolog annotation: Hit_ID=Q2HW90; Match level="QueryCoverage=69%, HitCoverage=40%, E-value=6e-20, Identity=32%"; Hit description =Putative uncharacterized protein
MDVLVLLIFGVVLFPNVDGLVDLAAIDAFLAFHDRKESPVVAILADLYDTFDRRCEKNSARIACCTPALYVWLVSHLFCQEVKHVCPLEDHRSCTEKKEANWDRLLASKEGAFVSWFPRWKEGRTKILISCGGFPNVPLMGTRGCINYNTVLSIRQLGYPMRGVPLEEGLTPFIAQGFNSTNVGVLRRVCKAWEMVQKKDEELWGSSNGPIGGYHKWLKAYAQGLGWLPNLRATKEVEVEAPEEGEEVQALRMKLEQAQAVKEKFKSAVARIRKENAELRDINIATTKALVQKTKRARKKEHGRN

SEQ ID NO: 146539 - protein, 103 aa, Glycine max
  Coding DNA Sequence Number=SeqID_54854
  Homolog annotation: Hit_ID=A5ZQM3; Match level="QueryCoverage=63%, HitCoverage=92%, E-value=2e-19, Identity=53%"; Hit description =Putative uncharacterized protein
GKEGLLLGGPEPSVRYHSGRARILTLCQDLRAEGQSQAEGSLTARPTRRAGTKVGLSDPTVPSGRAVAQRIKGWAVRPLKRYVSWVQNVVRQFGPYPVWALEH

SEQ ID NO: 146540 - protein, 119 aa, Glycine max
  Coding DNA Sequence Number=SeqID_54855
  Homolog annotation: Hit_ID=A0ST23; Match level="QueryCoverage=26%, HitCoverage=65%, E-value=1e-11, Identity=100%"; Hit description =Putative reverse transcriptase
DAGSRQARQGASAGVGGCRGWLNYAASEQIVLRVHHMRAIGAGLFAITPAGERGMCCKAIKLGNARVFPVTTFLTGDNIDCNLVFHAVGKPVVPAALMNRPTRGERRFAYWALFRFLAH

SEQ ID NO: 146541 - protein, 121 aa, Glycine max
  Coding DNA Sequence Number=SeqID_54856
  Gene Ontology: Mol. function=electron transporter, transferring electrons within the cyclic electron transport pathway of photosynthesis activity; Cellular component=light-harvesting complex; Biological process=...
  Gene Ontology: Biological process=photosynthetic electron transport in photosystem II
  Homolog annotation: Hit_ID=Q8HT11; Match level="QueryCoverage=90%, HitCoverage=43%, E-value=1e-43, Identity=59%"; Hit description =Photosystem II CP43 protein
NRAAEDPEFETFYTENILLNEALTGRDQETTGFAWWAGNARLINLSGKLLGAHVAHAGLIVFWAGAMNLFEVAHFVPEKPMYEQVLGFGGIYHALLGPETLEESFPFFGAFLLVFKALYFG

SEQ ID NO: 146542 - protein, 64 aa, Glycine max
  Coding DNA Sequence Number=SeqID_54857
MVFHLRLVVSFKTRKGKQGSKGLSKELIQGRINKNQATRYCASNQCPQNTPNDYNDGWLKFSQR

SEQ ID NO: 146543 - protein, 44 aa, Glycine max
  Coding DNA Sequence Number=SeqID_54858
EGETLTDSSECKPLGEQMNRWMIRKNLMLEDTEHNALIGCDIRI

SEQ ID NO: 146544 - protein, 344 aa, Glycine max
  Coding DNA Sequence Number=SeqID_54859
MAPRKLASKRSRKDKAAEGTSSAPKYDNHRFRSAVHQQRFEAIKGWSFLQERRVQLRDDEYTDFQEEIGRRRWASLVTPMAKFDPEIVLEFYANAWPTEEGVRDMRSWVRGQWIPFDADAIGQLLGYPLVLEEGQECEYGQRRSRSDGFDEEAIAQLLCIPGQDFARTAAGRRVRIMHTNMTTLTQIWMTLLLSNILPTDHNSDLPLPKCMAPTRHPLDPDKSNRALGFPALITGLCQSFGVPVAPTKVIRPPITRAFIEKYCTQRQAQGDAPQAAGAPPPPHQAGQAGAFDMEQYLRHLVRQQAANHRAHVQTHDCLYQMSLSMQSQGFASFSCPTPDQFRAE

SEQ ID NO: 146545 - protein, 123 aa, Glycine max
  Coding DNA Sequence Number=SeqID_54860
MIMRGQDIYSSQVEATTSPFSSESEEAKEEESKTSLLKQPPHLLLCKKKLVSIATPLGLEIIPQVKELLDECLVRKSLNPCALLVPKIGIEGRSLLFQEPLDLRSNPFQGGGNDAILPPKGIG

SEQ ID NO: 146546 - protein, 97 aa, Glycine max
  Coding DNA Sequence Number=SeqID_54861
  Subcellular localization annotation: CTP_CleavageSite=66; ConfidenceScore=5.22e-01
DRAHKTPSGPRRSPTGSWGFQLWLRASVVLQGARSPGKGPRPARHPVDPKKSNKVLKFPSSNYSLCQFYGVPVAPSKVIRPPTNRSFIKKYCVPRQA

SEQ ID NO: 146547 - protein, 190 aa, Glycine max
  Coding DNA Sequence Number=SeqID_54862
  Homolog annotation: Hit_ID=UPI0000ECBAF8; Match level="QueryCoverage =21%, HitCoverage=48%, E-value=2e-16, Identity=100%"; Hit description= UPI0000ECBAF8 related cluster
ATLPEGRKADRYPVSGRVGTGERTRELPGGNACLWKNASNAAFLRFLAFCWPFAHMFFPALSPDSVDNRITAFEKRKSAQYANRLSPRVGRFINAAGTTGFPTGKRAVSATQLIYDHDYEFELGTEGCTYVMHNFRVSMQAWHWPSFYNVVTGKTLALPNLIALQHIPLSPAGVIAKRPAPIALPNSCAA

SEQ ID NO: 146548 - protein, 35 aa, Glycine max
  Coding DNA Sequence Number=SeqID_54863
MATRPGEQVLTPEVTGLPKRVGSFRLNWCQIMQFG

SEQ ID NO: 146549 - protein, 165 aa, Glycine max
  Coding DNA Sequence Number=SeqID_54864
  Homolog annotation: Hit_ID=Q6WAY6; Match level="QueryCoverage=78%, HitCoverage=20%, E-value=5e-14, Identity=36%"; Hit description =Putative uncharacterized protein
IPLVFYDRKESPVVAILADLYETFDRRYKKNNARIVCCTLALYVWLVSYFFRQEMRHVCPLEGHRSCTEKKEANWDRLLASKEGASVNWFPRWKEGRVGILISCGEFPNVPLLGTRDCINYNPVLTIRQLGYPMRGAPSEEGLTPFIARGFNNTNAEVLQRVHKA

SEQ ID NO: 146550 - protein, 109 aa, Glycine max
  Coding DNA Sequence Number=SeqID_54865
  Gene Ontology: Mol. function=protein binding; Cellular component=cell projection; Biological process=polysaccharide catabolic process
  Homolog annotation: Hit_ID=UPI0000F2E5CB; Match level="QueryCoverage =81%, HitCoverage=15%, E-value=2e-13, Identity=38%"; Hit description =PREDICTED: similar to LON peptidase N-terminal domain and ring finger 3
MTDPLDESISCFLVRVNPWVLVPSPSEGRTPSPSEDYTSSPSEDFTSSPLEGRTPSPSEGRTPLPSEDYTSSPSEDFTSSPLEDYTSSPTEDYMSSPSEGRTPSPSEDY

SEQ ID NO: 146551 - protein, 120 aa, Glycine max
  Coding DNA Sequence Number=SeqID_54866
NVYTDNHSGISARQRDSKVSMTDLVSVEDDIAKKNVYTDNHLGISARQRDSKVSMTDLVSAEDDGAEDDVSLCVLSGFSSYRQQKVLKVRTTTWSPPEDADISEKGADDHIGLYPSTTLG

SEQ ID NO: 146552 - protein, 99 aa, Glycine max
  Coding DNA Sequence Number=SeqID_54867
MSQKNDDLGLIHRWIIVKFKHQVRNPIPSILTVGNFKSCLSSEENPSHFSLLFSHRNLKLSWEKKESHEDSTNEGFNPFSFSLTFGNPIRATRGISRTY

SEQ ID NO: 146553 - protein, 317 aa, Glycine max
  Coding DNA Sequence Number=SeqID_54868
  Homolog annotation: Hit_ID=A1IW39; Match level="QueryCoverage=19%, HitCoverage=95%, E-value=2e-13, Identity=68%"; Hit description =Putative uncharacterized protein ophh-69
ALAPKMNGAKRSAEAVGCKKESVGERSALEGRTRASSAGRSGSENVGLSNANVGENPMPRKPKGSSARPKGVVDGQQVNIPVLPFVGPEGRRRLGGRENASSQSSSTRRYSAEVIHAILPGKARTTFNKWVPVPETDTGLRKVVRPCMGLTPAQCRKVKEVGDLMTGEPTTEAPVNGGRNYNGPKVAKFLVGLGEIDMSVKMRTTCTWTERPYEASLFPGIGFGLFLRSLGGGQRRPPSGGARAISLPKGNGGVQRFPRARRRLALECKGRRELDCKTHPSSRDETHIDGKVWHLDVGSSPPGAVVCSKGWAVRPLK

SEQ ID NO: 146554 - protein, 358 aa, Glycine max
  Coding DNA Sequence Number=SeqID_54869
  Gene Ontology: Mol. function=structural constituent of cell wall; Cellular component=cell projection; Biological process=cellulose and pectin-containing cell wall organization and biogenesis
  Homolog annotation: Hit_ID=Q9LJK0; Match level="QueryCoverage=34%, HitCoverage=94%, E-value=4e-09, Identity=32%"; Hit description =Genomic DNA, chromosome 3, P1 clone: MZN14
MSSPSEDYTSSPSEDYTSSTLDGYMPSPSEDYTSSPSEGYMPSPSEDYTSSPSKVYMPSPLKEYIGLHDLALRTTRPHLPRATHPHLQRTTRPRLEDYTSSPSEGYTPSPLEDYTSSPSEGYMPSPSEDYMSSPSEDYTSSPFRGLNILTFRGLHALAFRGLHVLAFRGLHALAFRVLHVLAFRRLHALAFRGQHVLALKGLHALAMRGLHTLTFRVLHILAFRGLHALAFKELHKTTRPPLQRATRPRLQRTTRPPLQRTTSPHLQRIHILTFRGLHALPFKGLHVLAFRGLHALAFRGLHALTFKRLHALAFRGLHVLTFIGLHALTFRGLHAHALRGLHFLALRGLHAFVFRGLQ

SEQ ID NO: 146555 - protein, 158 aa, Glycine max
  Coding DNA Sequence Number=SeqID_54870
MPISPYGSISWSVTSEHRGHAHKTPSGPEEVQQGPRVSSFGYGPLSVLQGARTPRQGIVPAGHPVDPKKSKRFLGLPTLITGLCQFFGVLVTPSKVIRPPTNQAFIKKYCTCRQAKGETPQQPGDGQQQATNAPPPPPEPLSSSTKGLEYCLRNMADQ

SEQ ID NO: 146556 - protein, 115 aa, Glycine max
  Coding DNA Sequence Number=SeqID_54871
MDQLRVDNLILKDELSICLRSKRSLSQRLCQTETNMLAIISKYQEELNLATAHEHKVADEYARVYAEKEARGRESRTSPIAGQGQSNGGRLLCPRGDPWTPQLLSAYDRLYGPYN

SEQ ID NO: 146557 - protein, 154 aa, Glycine max
  Coding DNA Sequence Number=SeqID_54872
  Gene Ontology: Mol. function=carbamate kinase activity; Cellular component=cytoplasm; Biological process=amino acid biosynthetic process
  Homolog annotation: Hit_ID=UPI00005FA805; Match level="QueryCoverage =100%, HitCoverage=51%, E-value=6e-69, Identity=83%"; Hit description= COG0549: Carbamate kinase
  Pfam annotation: Domain name=AA_kinase; Domain location=2-153; Score=- 20.2; E_value=0.00038; Accession=PF00696.19; Description=Amino acid kinase family
MKTLVIALGGNALLQRGAVLSAENQYKSIALIADAIGKLAQKYRIAIVHGNGPQVGLLALQNLAYRDVPPYPLDILVAESQGMIGYMLAQQLSASHPQRPVSTLLTRVLVDAQDADYQAPSKFIGPVYAPEQRQALEAKYGWTLKADGNYIRRV

SEQ ID NO: 146558 - protein, 270 aa, Glycine max
  Coding DNA Sequence Number=SeqID_54873
MEGRKRRIPFLMWKIPIHSADQELRGIRNGIIGGYHEWLKVHIRGLDWLAKLKVVSEESFEAPEEDEEVQALKSELGKAKLAKEKFELAATHIRKECAGLREENATTARALEQETKRARKEEYGRNKFRGALWGSNSELKLRREERDQSRAHSMVLKEELVACSRSKWSLSQRLCETETNMLAIIAKYQEELGLATAHEHRIADEYAQVYAEKEARGRVIDSLHQEATMWMDRFALTLNGSQELPRLLAKAKAMADTYSGPEEIHGLLSY

SEQ ID NO: 146559 - protein, 269 aa, Glycine max
  Coding DNA Sequence Number=SeqID_54874
  Gene Ontology: Mol. function=monooxygenase activity; Cellular component=endoplasmic reticulum membrane; Biological process =electron transport
  Homolog annotation: Hit_ID=Q2U8G8; Match level="QueryCoverage=100%, HitCoverage=50%, E-value=1e-152, Identity=98%"; Hit description =Cytochrome P450 CYP4/CYP19/CYP26 subfamilies
  Pfam annotation: Domain name=p450; Domain location=1-269; Score= -178.5; E_value=0.0011; Accession=PF00067.13; Description=Cytochrome P450
MNFPVLDRLGKLIPCRVRARNVVEQFSAALQYGVRHGQGTPNASNLGARLMAARDGGVLTGKQFRDNLNVLFVAGQENPQLLLISMLYLLAKHPVSVSCPLKSMELMSQDVQSRLRREIDACSTLDPSNVAFSELPYLTCVIYESLRLLPPISQLINRRTSQDVILGNQIYIPKGTYVGYNCYSTNRDPAVWGPIADEFRPERWGQNNTEISQCYRQRRARAEFVSFHGGSRACLGEKFALLEARVALFVLVSRLSWSLDPEWPDRKTP

SEQ ID NO: 146560 - protein, 106 aa, Glycine max
  Coding DNA Sequence Number=SeqID_54875
MSLHSSSSINGRHRAHLRPHSHRREKERKPQEANIHLPYFHGKDNVEANLDWEIRVEQQLKRKSTSKSYGSHSYPKNYQGQGILGVTPSKPKNDNGKTIEKQPLKD

SEQ ID NO: 146561 - protein, 289 aa, Glycine max
  Coding DNA Sequence Number=SeqID_54876
  Subcellular localization annotation: CTP_CleavageSite=31; ConfidenceScore=5.16e-01
MVEPSKKRKGSSSRSQRHSEVQDTPIPSSISSSSLFSSKEQRIQYTNLFSSRSIIDPKFIDMDFFSDESFECIQAFQNSNLIPFMSLKLSVYSELVKDFYSNLEIQESTLISEVYGIKMVIDQSLFYDLTQLSSDGVPFEGALDDDWKFDFSMHNARQLVGTNQADMTRRLLAGSLALKSRILHYLIIRILLPRSSNLAQVYEDLIVMWAFHIGRQIDWAHLVWYRMHKALRLNAPLPYPHLVTLFLQHFNIPLDFEPYVPIKRSFLVGAVVVASFGYCKERDASWVKK

SEQ ID NO: 146562 - protein, 42 aa, Glycine max
  Coding DNA Sequence Number=SeqID_54877
MEYLLVGDEQKRETESKNAKNDDPSTANSGGSPRRAQLAQAS

SEQ ID NO: 146563 - protein, 279 aa, Glycine max
  Coding DNA Sequence Number=SeqID_54878
  Gene Ontology: Mol. function=electron transporter, transferring electrons within the cyclic electron transport pathway of photosynthesis activity; Cellular component=light-harvesting complex; Biological process=...
  Gene Ontology: Biological process=photosynthetic electron transport in photosystem II
  Homolog annotation: Hit_ID=P56778; Match level="QueryCoverage=93%, HitCoverage=64%, E-value=1e-128, Identity=77%"; Hit description =Photosystem II 44 kDa reaction center protein precursor
  Pfam annotation: Domain name=PSII; Domain location=1-279; Score =349.9; E_value=4.5e-102; Accession=PF00421.10; Description =Photosystem II protein
MTTILGIHLILLGIGAFLLVFKALYFGGIYDTWAPGGGDVRKITNLTLSPSIIFGYLLKSPFGGEGWIVSVDDLEDIIGGHVWLGSICILGGIWHILTKPFAWARRALVWSGEAYLSYSLGALSVFGFIACCFVWFNNTAYPSEFYGPTGPEASQAQAFTFLVRDQRLGANVGSAQGPTGLDLSRLKKDIQPWQERRSAEYMTHAPLGSLNSVGGVATEINAVNYVSPRSWLATSHFVLGFFLFVGHLWHAGRARAAAAGFEKGIDRDFEPVLSMTPLN

SEQ ID NO: 146564 - protein, 91 aa, Glycine max
  Coding DNA Sequence Number=SeqID_54879
MVNDIFTPSRYKETIMVQPKPSAGLKGKSLQHALTFMPSRIQKSKAWVPRPKSCFGIYPNFRKISIYPKMVIIHAQAQSISNIHKLRRKQH

SEQ ID NO: 146565 - protein, 198 aa, Glycine max
  Coding DNA Sequence Number=SeqID_54880
  Gene Ontology: Mol. function=chitin binding; Cellular component =extracellular region; Biological process=chitin metabolic process
  Homolog annotation: Hit_ID=UPI00006A17C9; Match level="QueryCoverage =65%, HitCoverage=100%, E-value=1e-19, Identity=36%"; Hit description= UPI00006A17C9 related cluster
MLVRMIRTRPLAAARVKSCLGTHSSYVIASLSGCTRIVGPPPISGGDPGPLKGNYWTLNSLKVRMWSTLKMRTRSPLKVRACSPLKARMCSPLEERACSPPKVRTCSPLMARACSPLKVRTCSPLKVRACSPLMVRTCSPLKARTCSPLKVRACSPLLAKTCSPLKVRACSPTKVRTCSPLMARACSPLKVRTCSPLK

SEQ ID NO: 146566 - protein, 102 aa, Glycine max
  Coding DNA Sequence Number=SeqID_54881
MSPVESPTVATCPSRASEGEAHGCAFQRRKDARSHHQRLFVENVGKTEGNCGAFAPTYPPLERKSDLRSSFLSVNQAILFTLRGDHLKALDLKNDPFYLLRN

SEQ ID NO: 146567 - protein, 58 aa, Glycine max
  Coding DNA Sequence Number=SeqID_54882
MYLQCVKTKNSQAVSPLNLCKWEAKDISGEFSLVEEQGLENRKLRKLFGQRKKKKKDE

SEQ ID NO: 146568 - protein, 98 aa, Glycine max
  Coding DNA Sequence Number=SeqID_54883
MLGFTSDSPQISASPHQLDFAPYASRPYNAQWNAPGLLHDKHMLCSSRILGKMEVGFVVDLGMTFVDNWVAGMAVTTWVSPSSSTSSFAPVFSFVQAG

SEQ ID NO: 146569 - protein, 151 aa, Glycine max
  Coding DNA Sequence Number=SeqID_54884
  Homolog annotation: Hit_ID=A2Q186; Match level="QueryCoverage=78%, HitCoverage=42%, E-value=3e-09, Identity=25%"; Hit description =Reverse transcriptase-beet retrotransposon, putative
ALWGHSDFDWKWFPAVNTAGGLLCVRNNNNFQGVWLVESQRVVVANIYASWDFNCIKHPAERMGSTLCNADTNLIAEFNEWLAEMEVDDIPCLGKPFTWVRPNGSCKSKLDRVLVFDDWDFNKVVRDCWFANQPMGWGGYALKCKLQKIKQ

SEQ ID NO: 146570 - protein, 239 aa, Glycine max
  Coding DNA Sequence Number=SeqID_54885
  Homolog annotation: Hit_ID=Q2HW90; Match level="QueryCoverage=59%, HitCoverage=26%, E-value=2e-11, Identity=35%"; Hit description =Putative uncharacterized protein
MGSSQMPSLKKRFYQVKVKSLGITSLRELGQLMGQLQRQAFHKAYSKIWDLAMVEVSTEAIASLAQYYDQPLRCFTFGDFQLSRRGEWAPFIDILVLLIFGGVLFPNVDGLVDLAAIDDFLAYHDRKESPVVAILADLHDTFDRRCEKSSTRIVCCTSALYVWLVSHLFRQEVRHACPLESHYSCTEKRGANWDRLLASKEGASVNWFPRWKEGRTGILISCGGFPNVPFDGDKGLHQL

SEQ ID NO: 146571 - protein, 88 aa, Glycine max
  Coding DNA Sequence Number=SeqID_54886
MKSDKASQDIHSISQACSELQNKERETRLKRAIKGINSRMHQQESSQGYYASNQWGKTHQMIIMMDGSNSHKGKIITFKLSFQNYHDM

SEQ ID NO: 146572 - protein, 259 aa, Glycine max
  Coding DNA Sequence Number=SeqID_54887
  Gene Ontology: Mol. function=motor activity; Cellular component=cell projection
  Homolog annotation: Hit_ID=UPI00006A2D9E; Match level="QueryCoverage =86%, HitCoverage=100%, E-value=3e-17, Identity=18%"; Hit description= UPI00006A2D9E related cluster
EDYTSSPSEDCTCSPSRGLHTVTFRGVHVLTSRGLHAVTFRGLHVLTFKGLHVLAIGGLHVLAFRGLHGLTFRGLHALTLNGLHVLGFRGLQTLSFRGVHALAFIGLHTLTFRVLLVLTFKGLHVLAFSGLHVPAFRELHALSFSGLHVLSFRRLHVLAFTGLDALTLRVLNVLAFGGLHALAFVGLHALPFRGLHVLTFRGLHALTFSGLHVLAFRGLHGLTFRWSSPLEGYTPSPLEVYTPSPLEDYMSSPLEHYMS

SEQ ID NO: 146573 - protein, 104 aa, Glycine max
  Coding DNA Sequence Number=SeqID_54888
  Gene Ontology: Mol. function=aspartic-type endopeptidase activity; Biological process=RNA-dependent DNA replication
  Homolog annotation: Hit_ID=Q6UUS9; Match level="QueryCoverage=85%, HitCoverage=4%, E-value=4e-09, Identity=38%"; Hit description =Putative gag-pol
MKLYIAASDKTIGSMLAQEDDDGIEHAIYYLSSYFIVDHSVIEMPQDYVDTEPWILYFDGSKHKHGTGIGVLIISPNKVPTKFKYKSKGFVLIMRLSMSSNYRP

SEQ ID NO: 146574 - protein, 303 aa, Glycine max
  Coding DNA Sequence Number=SeqID_54889
  Homolog annotation: Hit_ID=Q8PMX0; Match level="QueryCoverage=51%, HitCoverage=13%, E-value=2e-09, Identity=30%"; Hit description=Wall -associated protein
  Pfam annotation: Domain name=CBM_2; Domain location=127-215; Score= -39.4; E_value=0.065; Accession=PF00553.10; Description=Cellulose binding domain
MAAALLLGFVLILICQVAHAQAWIELTGPAQTSYTAPATYQLQLKSGVRGTGPKAEYLSGIQLLRNGQVISRLPNGTYTENGISPGSYQYVYRALAVRNVNGDEFTRELTSPVITITVAAPPAPFDGAEYVSASWPRSADRGTPFSGTVTFRNTGNTTWRAGDGYRLGQAERYVSSAVRLGITDVAVPHDVGPGGTVTFAFNGAAANENGPSTLQWQMNRNGVRFGSTSSEQTFETTGRLNRGVMYEQEVPTSMETGRTYRVKLKFVNTGNTTWSASAGYALGSWNPNDNVRWGRARVPMPND

SEQ ID NO: 146575 - protein, 172 aa, Glycine max
  Coding DNA Sequence Number=SeqID_54890
MSALKEQMASMMEAMLGMRQLMEKNAATAAAVSSATEADPTLLATAHHPPSNIVGRGRDTLGHDGSPHLGYNRAAYPYGLPPNYSPPVLQDDAGHIASPVLEREPPQQPKEVHKDPQDYARRDVEFHPPIPEGLAPSTLPQPNIATQPIVLSTEGPPPATEERRKLDLLEER

SEQ ID NO: 146576 - protein, 72 aa, Glycine max
  Coding DNA Sequence Number=SeqID_54891
MGDSLEDMIHDLGQEFFQIKINFKLHEKKSRRFKIQEKFDFKIQEKMNSRFKRRNQEDFTREVLKRFFEKQT

SEQ ID NO: 146577 - protein, 47 aa, Glycine max
  Coding DNA Sequence Number=SeqID_54892
MDTSKPYTRAMRGTMHEPQVNQGADQKFSPNRREEQCKEHMHEVGQQ

SEQ ID NO: 146578 - protein, 91 aa, Glycine max
  Coding DNA Sequence Number=SeqID_54893
MEVKEISYENKWKFGNLLEAPNTLPMKGLLLQKLESNEVLLSPIALKVVGPLLLDSNSSRDGTNPPSNSYMATHKQGNKETSNNQRPKKIK

SEQ ID NO: 146579 - protein, 96 aa, Glycine max
  Coding DNA Sequence Number=SeqID_54894
IPRKKTLVSTATPLGLEVIPQVKELLDEGLVRKSLNPCALLVPKIGVPTNPKRIKVIPDWPTPPSVEGMSPEYEEPRDLRSNPFQGGGDDAILAPN

SEQ ID NO: 146580 - protein, 347 aa, Glycine max
  Coding DNA Sequence Number=SeqID_54895
  Gene Ontology: Mol. function=motor activity; Cellular component=cell projection
  Homolog annotation: Hit_ID=UPI00016621D1; Match level="QueryCoverage =92%, HitCoverage=41%, E-value=3e-25, Identity=34%"; Hit description =UPI00016621D1 related cluster
ELHVLTFRGLHVLAVRALHVLTFRGLHVLTFRGLQILTFRGLHALTFRGLHVLAFRGLHTLTFKGLHVLTFRELHALTFRGIHVLTFRGLHVLPFRGFHALTFKGLHLLTFRGLHLLTFRRVHALTFRGPHTLTFRGLHALTFREQHVLTYRELHVLPFRGIYILTFRGLHILAFKGLHDLIFRGLQVLTFRGLHILTFRGLHALTFRGLHVLAFRGLHTFTFRGLHFLTFRGLHVLTFRGLHILTFRGLHAITIRGKHVLAFRGLHALAIRGLHVLAFRGIHSLVFRGLHALAFRGLHLLALRGLRALAFRGLHVLPFRGLHTLAFRGLHVLPFRGLHVLPFRGLH

SEQ ID NO: 146581 - protein, 59 aa, Glycine max
  Coding DNA Sequence Number=SeqID_54896
MWYHFSVKNLVGRLGVHDGTCLTMGRPIRVTLFYENAPIIWDQHRLKGTLKSGVFTPKA

SEQ ID NO: 146582 - protein, 80 aa, Glycine max
  Coding DNA Sequence Number=SeqID_54897
MDKVDIFVPHPLTNACLLIQLSPECGCKPLVCLLKRPALLSVDFQDCSIRDYSSCTLRSELSRIGYWTNGLSYLKNGGLN

SEQ ID NO: 146583 - protein, 98 aa, Glycine max
  Coding DNA Sequence Number=SeqID_54898
MYLPIPQAFKIVETNASDIGYGGILKQRIHNQEHSTSGAPQILYLTISLMNSYRKRVMPPRATGTSLRGGRSSGKIFKLALPETTVKKSSSTSSGSPT

SEQ ID NO: 146584 - protein, 123 aa, Glycine max
  Coding DNA Sequence Number=SeqID_54899
MAQPPPRERTLREMAAPDFTYESLCIQYPDEDVPCVLKTGLIHLLPMFHGLAGLSNIERSMIDAANGGALGDMTPAEARNLIEKMASNSQQFSARNDAIVIRGVHEVATNSSSLAETKKLEVN

SEQ ID NO: 146585 - protein, 109 aa, Glycine max
  Coding DNA Sequence Number=SeqID_54900
MDNHLGILACHLTSRVSINRNCLCTDNHLGISACHLSSRVSINRNCLCTDNHSGYLRTSSDFTGQDDTKYGVVDKSEALAPTYPQFVMRNSDLRGSFKSETKIVSVFFN

SEQ ID NO: 146586 - protein, 34 aa, Glycine max
  Coding DNA Sequence Number=SeqID_54901
MGFWARRKNSGAFDQDVLASPVWALARIGTFMRW

SEQ ID NO: 146587 - protein, 56 aa, Glycine max
  Coding DNA Sequence Number=SeqID_54902
SIGACRPWIFFINGVPCFLKFDGSGMEKEKDDWRRHFKEKTSLEKAHHHREPWIRA

SEQ ID NO: 146588 - protein, 164 aa, Glycine max
  Coding DNA Sequence Number=SeqID_54903
  Homolog annotation: Hit_ID=Q6WAY6; Match level="QueryCoverage=56%, HitCoverage=16%, E-value=9e-11, Identity=39%"; Hit description =Putative uncharacterized protein
INAFLAYHDHKESSVVAMLANLYDTFDRRCEKSRFSNVPMMGTRGCISYNLVLAIRQLGYPMRGAPLEEEIAPVISRGFNKANVETLQKVRKAWEVVRKKDKELRGSNNGPIGGYRKWLRAHVQGLDWLPCLRTAKREEVEAPKEDEEVQALRTELEKAQQSKK

SEQ ID NO: 146589 - protein, 111 aa, Glycine max
  Coding DNA Sequence Number=SeqID_54904
  Homolog annotation: Hit_ID=A0PAV3; Match level="QueryCoverage=34%, HitCoverage=17%, E-value=5e-07, Identity=76%"; Hit description =Restriction endonuclease
MVKVGTSYVPINVSFSPKVGPGLPGINRDTRIYLFCEVIFRHSCPSCSATDGVGASHSPFRLRNCWEGRSVRASSLLRQLAKGGCAAKAIKLGNAKGFPKSRRCKTTASEL

SEQ ID NO: 146590 - protein, 54 aa, Glycine max
  Coding DNA Sequence Number=SeqID_54905
SIQRLTNWIEGIVTGVFEWEKALGRIDGDPVLRETRIWATWEYVSSVGGGQQGM

SEQ ID NO: 146591 - protein, 266 aa, Glycine max
  Coding DNA Sequence Number=SeqID_54906
MWMDRFALTLNRSQELPRLLANANAMADTYSAPEEIHGLLGYWKNTVTKRATRHPYRTRSKSRTMGDQEETHEQMKADMSALKEQMASMMEAMLSMKQLIEKNAATATAISSAAEADPTLLATAHHPPSNIVGRGRDTLGHDGSPHLGYNRAAYPYGLPPNYSPPVLQEDAGHIASPSLKESLLNSPTKSTKTLKTMLEGSNPSKRLMVPISTRNITRASRLIPGTPLVQHPCSLRHSPRGKLPKGSSRVDLQACKLGTGRRFTTS

SEQ ID NO: 146592 - protein, 263 aa, Glycine max
  Coding DNA Sequence Number=SeqID_54907
  Homolog annotation: Hit_ID=Q6WAY6; Match level="QueryCoverage=47%, HitCoverage=21%, E-value=4e-14, Identity=34%"; Hit description =Putative uncharacterized protein
MDAKHLTRTKERSHVIKQRSPDEIRRRIDWDQLLAEIGGRTINWFPRWKEGKEGVFFSCGGYPNIPLIGTRGCINYNPALAIRQLGYPMRGAPMEESMSPFLVRDFGTQNFKAIQRIHKAWETPLRKDQELRGIRNGIIGGYHEWLKVHIRGLDWLAKLKVVSEESFEAPEEDEEVQALKSELGKAKLAKEKFKLAATHIRKECAGLREENATTARALEQETKRAHKEEYGRNKFRGASVGVATMNSSCEGKRATSREHIAWF

SEQ ID NO: 146593 - protein, 307 aa, Glycine max
  Coding DNA Sequence Number=SeqID_54908
  Homolog annotation: Hit_ID=Q6WAY6; Match level="QueryCoverage=88%, HitCoverage=45%, E-value=3e-31, Identity=31%"; Hit description =Putative uncharacterized protein
MARIAKVFEISAQELDRVKQNKNGVVGIPRKHLEEKAKALADQGEWVSFVDVLALLVFGVILFPNVDGLVDLAAINAFLAYHHSKESPAITILADAYDILERRCEKSGTRIVCCTPALYVWLVSHLFHHESRPVYALQGHHMCAEKGKANWEQLLASMVGASINWFPRWKKGRVGVLSSCEGFSNIPLMGMRGCINYNSVLAIRQLGYPMRGVPSEESITPFIARGFSYPNAMIFQRVRKAWSAVQRKDKELRGNKNGIVGGYYKWLKAWTQELDWLPKVKVSSEEEAETPEESKKVQALMAKLERA

SEQ ID NO: 146594 - protein, 232 aa, Glycine max
  Coding DNA Sequence Number=SeqID_54909
  Homolog annotation: Hit_ID=Q6WAY6; Match level="QueryCoverage=87%, HitCoverage=35%, E-value=1e-23, Identity=33%"; Hit description =Putative uncharacterized protein
MGSSQKPSLKKRFYQVKVKSLGITSLRELGQLMGQLQRQAFCKAYGKIWDLVVVEVSTEAIASLAQYYDQPLRCFTFGDFQLSPMVEEFEEILGCPLGGRKPYLFSGFYPSLAKISKIVQISAQELDRQKQVENGVVGIPRKYLEAKARILAGKGEWAPFIDILALLIFGGVLFPNVDGLVDLAAIDAFLAYHNHKESPVVAMLADLYDTFDRRCEKSIQGLFAVLQLFMYG

SEQ ID NO: 146595 - protein, 66 aa, Glycine max
  Coding DNA Sequence Number=SeqID_54910
KKKVDLVENRIGEVAYRLKRSARLKLTPYSMANLRARQAGNGLKLTILRPSQRLLDVSQSDSQRGR

SEQ ID NO: 146596 - protein, 17 aa, Glycine max
  Coding DNA Sequence Number=SeqID_54911
EFYKESGNLKWFLEDWT

SEQ ID NO: 146597 - protein, 26 aa, Glycine max
  Coding DNA Sequence Number=SeqID_54912
MACEERVACGADRQVMMKGSSLWVMA

SEQ ID NO: 146598 - protein, 154 aa, Glycine max
  Coding DNA Sequence Number=SeqID_54913
  Gene Ontology: Mol. function=chitin binding; Cellular component =extracellular region; Biological process=chitin metabolic process
  Homolog annotation: Hit_ID=UPI00006A17C9; Match level="QueryCoverage =90%, HitCoverage=98%, E-value=1e-09, Identity=30%"; Hit description =UPI00006A17C9 related cluster
  Subcellular localization annotation: CTP_CleavageSite=8; ConfidenceScore=5.08e-01
MTRTRLFAAARVKSCLGMHSSYVIASLSGSARTVGLAPISGGGHKTLNSLKAQIWSPLKVRMCSPLNARTCNPLKVRVRSPLMATTCSFLKVRACSPLKARACSPLKVRMHSPLKAKACSPLMARTCSPLMARTCSPLMARTCSPLNARTCSPR

SEQ ID NO: 146599 - protein, 49 aa, Glycine max
  Coding DNA Sequence Number=SeqID_54914
MEFRMTPLPAKEDKSRKISSGKRHKDYLDKSDNWFNKEPREKLSPNFIK

SEQ ID NO: 146600 - protein, 143 aa, Glycine max
  Coding DNA Sequence Number=SeqID_54915
  Homolog annotation: Hit_ID=B0HC01; Match level="QueryCoverage=23%, HitCoverage=72%, E-value=1e-11, Identity=100%"; Hit description =Putative uncharacterized protein
GGGAYGKTPATRPFYGSWPFAGLLLTCSFLRYPLILWITVLPPLSELIPLAAAERPSAASHWHDRFPDWKAGSERNAINPTAQYSVSYPSLAQSPVNATAVATAIGTENCYTVDSHDQPEAGGSSRVDLQACKLGTGRRFTTS

SEQ ID NO: 146601 - protein, 42 aa, Glycine max
  Coding DNA Sequence Number=SeqID_54916
YQNFNKVMTKDNNRYLRALHWGNERHHAGASSEPRGRSEVLT

SEQ ID NO: 146602 - protein, 158 aa, Glycine max
  Coding DNA Sequence Number=SeqID_54917
  Homolog annotation: Hit_ID=A6FJQ2; Match level="QueryCoverage=24%, HitCoverage=84%, E-value=3e-11, Identity=92%"; Hit description=50S ribosomal protein L5
  Pfam annotation: Domain name=zf-CCHC; Domain location=122-139; Score =28.7; E_value=2.1e-05; Accession=PF00098.14; Description=Zinc knuckle
MTVKTSDTCSSRRRSQLVCKRMPGADKPVRARQRMRKEKIPHQAPFAIQAAQLLGRAIGAGLFAITPAGERGMCCKAIKLGNARVFPVTTLIPTSNSGKDRKKSVGTNKGKIPTQPTIKKESKCFFCKKKGHMKKDCPKFKSWFEKKGYGKPKEASGK

SEQ ID NO: 146603 - protein, 286 aa, Glycine max
  Coding DNA Sequence Number=SeqID_54918
  Gene Ontology: Mol. function=acyltransferase activity; Cellular component=cytoplasm; Biological process=poly-hydroxybutyrate biosynthetic process
  Homolog annotation: Hit_ID=Q7CYW3; Match level="QueryCoverage=99%, HitCoverage=46%, E-value=1e-152, Identity=90%"; Hit description=Poly- beta-hydroxybutyrate synthase
  Pfam annotation: Domain name=Abhydrolase_1; Domain location=2-224; Score=-6.4; E_value=0.017; Accession=PF00561.11; Description =alphabeta hydrolase fold
EGIDFALDTIEERTGEKEINAVGYCVGGTLLASALALHAQQDNERIRSATLLAAQTDFIHAGDLKVFVDEGQLAALDRHMQAVGYLDGSIMATVFNMLRASDLIWPYVVDNYLRGTEPLPFDLLYWNSDSTRVTAASHSYYLRNCYLENNLARGLMRVAGKRINLGDINIPVYDLATRDDHIAPAKSVFTGAALFGGPVEFVLGASGHIAGVVNPPQLEKYQYWTGPSPAGDFDAWQAAATPHKGSWWVHWQNWIESQNAEKVKARKPEDGKRPVLGDAPGTYVLL

SEQ ID NO: 146604 - protein, 185 aa, Glycine max
  Coding DNA Sequence Number=SeqID_54919
MRGTVNEPQANLGADQKGLHVLAFRGLYILAFRGLRVLDFRGLHVLDFRGLHILDFRRLHVLTFRGLYVLAFRGLHFLSFKGIYILAYRGLHVLASRGLYVLAFKGLRVLVLQRASTSSTLEVCMSSPSEGCTVLAFRGLARPHLQRAACPRLQKVVRPRLQRATRPRLQRATRPQLQRPVCPRL

SEQ ID NO: 146605 - protein, 207 aa, Glycine max
  Coding DNA Sequence Number=SeqID_54920
MKMNPLANHRGEAVNAIESGRPCRSKPLKNVTTPRRFIYEALQKRGIIPHGGHEEDSCLLHPGELHNMETCLAMEDLLQQMIDRGRLEVGDEGSEKQHISTQFPWRYAPPSKRKEEATDISSLLAKVTNITGLSGVTRSGRVFVPPDLPTQPANDKGKAKITEGQNDKMIPTSSKDIPVKGLPEKKDGYGKKEVSLEEAGEFLRIIQ

SEQ ID NO: 146606 - protein, 51 aa, Glycine max
  Coding DNA Sequence Number=SeqID_54921
MTEARQKGVRKVNENENKGEELATQLTQASKVASSRSNRLLEEESGRPKWA

SEQ ID NO: 146607 - protein, 183 aa, Glycine max
  Coding DNA Sequence Number=SeqID_54922
  Homolog annotation: Hit_ID=Q6WAY4; Match level="QueryCoverage=53%, HitCoverage=17%, E-value=8e-10, Identity=34%"; Hit description =Putative uncharacterized protein
MGSSQKPSLKKRFYQVKIKSLEVTSLRELGQLMGQLQRQAFRKAYGKIWDLARVEVSMEPIASLSQYYGQPLRCFTFEDFQLVPTVKQFEEIRGCPLGGRKPYLFSGFYPSTTRVAKLVLHLFLQEGRPVYPLQGHRSCVEKRKTNWDQLLASIEGRLLIGSLARRKEESGFYLHAKDVQMFP

SEQ ID NO: 146608 - protein, 122 aa, Glycine max
  Coding DNA Sequence Number=SeqID_54923
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=54%, HitCoverage=65%, E-value=2e-33, Identity=100%"; Hit description=LacZ protein
MKERLGHDQSGRGGGWEVDAEEGAGRGDPLESTCRHASLALAVVLQRRDWENPGVTQLNRLAAHPPFASWRNSEEARTDRPSQQLRSLNGEWRLMRYFLLTHLCGISHRIWCTLSTICSDAA

SEQ ID NO: 146609 - protein, 102 aa, Glycine max
  Coding DNA Sequence Number=SeqID_54924
MWVQAIGLFAQATCAPEWLTSKTVQSEITRPARWEERNANLIYTGSATFRAYVQSSSNPLEIFHSLCKTPFTKSELHRDNLSLVFRNPLQQETLGLLIPFQK

SEQ ID NO: 146610 - protein, 150 aa, Glycine max
  Coding DNA Sequence Number=SeqID_54925
PHQLDLAPYALGPYNAQWNVPGILHDKHTLRSSRILGEMEVDEPWLGLSRCKIHFLVGVLVYAKGMTFVDNWAVGKEKVCYWLSNDIVGLVGNLATHIDPFTGKDQILKALKVLHLWAYSLKDLCPFLHMFCSCILSEDIILTLPNEGNH

SEQ ID NO: 146611 - protein, 34 aa, Glycine max
  Coding DNA Sequence Number=SeqID_54926
MEDRNVEEEELRHHFKEKMSLEEAHHHRKPWIRA

SEQ ID NO: 146612 - protein, 62 aa, Glycine max
  Coding DNA Sequence Number=SeqID_54927
MDRHLGGLSYKSMAPLSAAQQWDESNLLEDALFLAWTWFRTMEENFTMHFNYWSSNLPAGFL

SEQ ID NO: 146613 - protein, 91 aa, Glycine max
  Coding DNA Sequence Number=SeqID_54928
MKKKLEEVAQSGSVDRAIDPPSPVRRHVKWKMARTKKTREMTTEAAKEIAAKIDSFEEQDVLTAAIGRPEHPGRPEHPGRVRAAGAGVTIK

SEQ ID NO: 146614 - protein, 253 aa, Glycine max
  Coding DNA Sequence Number=SeqID_54929
  Gene Ontology: Mol. function=cytochrome-c oxidase activity; Cellular component=integral to membrane; Biological process=electron transport
  Homolog annotation: Hit_ID=P0ABJ4; Match level="QueryCoverage=51%, HitCoverage=63%, E-value=3e-64, Identity=92%"; Hit description =Cytochrome o ubiquinol oxidase subunit 3
  Pfam annotation: Domain name=COX4_pro; Domain location=166-252; Score= 177.5; E_value=3.5e-50; Accession=PF03626.5; Description=Prokaryotic Cytochrome C oxidase subunit IV
MSDCIIFATLFATYAVLVNGTAGGPAGKDIFELPFVLVETALLLFSSITYGMAAIAMYKNNKSQVVSWLALTFLFGAGFVGMEIYEFHHLIVEGMGPDRSGFLSAFFALVGTHGLHVTSGLLWMAVLMVQPVLALPGRGVDLRVLCCLSDGGDVMSHSTDHSGASHGSVKSYMTGFILSIILTAIPFAMVMSGSASHAAILGTILVTAVVQILVHLVYFLHMNSKSDEGWNLTAFIFTVIIIAIVVVGSIWIM

SEQ ID NO: 146615 - protein, 182 aa, Glycine max
  Coding DNA Sequence Number=SeqID_54930
MTPPERRVLSYSHGVFRVMALIIGKPFGGGHTREGLPVTIPQYKVQHLINAGWLSFQEEVPNVKTNPLASHGGASVNAIEKDRSLGLKRLEDVATSRRFIYQSLQAACMVSRGEDKSDECLFHLGESHDMETCSTVEELLQRLMDWGQLEVSERGREESQICMQSAERKAPPNPQSPSNMLH

SEQ ID NO: 146616 - protein, 67 aa, Glycine max
  Coding DNA Sequence Number=SeqID_54931
MKEEVRKEVLNVLEAVLIYLISDSSWVSPVQVVQKREWILKTKKRQLSHAPLVYLLIVACLSVYVMP

SEQ ID NO: 146617 - protein, 84 aa, Glycine max
  Coding DNA Sequence Number=SeqID_54932
MAQPPPRERTLREMAAPDFTLSQCALRGRAKARLTGALSKGGKMRGVATNVYLWKTSEKPKETGRQKRGFCAYVPSIKEEIRPT

SEQ ID NO: 146618 - protein, 230 aa, Glycine max
  Coding DNA Sequence Number=SeqID_54933
MAKFDPDIVLKFYANAWPTEEGVRDMRSWVRGQWIPFDADAIGQLLGYPLVLEEGQECEYGQRRNRSDGFDEEAITQLLCIPGQDFARTAAGRRVRIMRTNMTTLTQIWMTLLLSNILPSDHNSDLPLPKCQLVYAILTRMSIHVAQLIVDAIYIFAGMAPTRHLLDPDKSNKALGFPALITGLCLSFGVPVAPSKVIWPPITRAFIEKYCKQRQVQGDAPQAANAPPPH

SEQ ID NO: 146619 - protein, 387 aa, Glycine max
  Coding DNA Sequence Number=SeqID_54934
MTSRKRRAVPTPGEASNWDTSRFTSEIAWHRYQDNIQLRNILPERNVELGPGMFDEFLQELRRRRWDQVLTHLPEKRIDVALVKEFYSNLYDPEDHSPRFCRVRGQIPQHSPDPDTIAATLCTPGGRFVLNADGLPWKLLRKDMTTLAQTWSVLSYYDLAPTSHTSDVNLDRARLIYGLVSRMDMDVGSFISQQISQIAQSSTSRLGFPALITALCDIQGVVSDTLIFESLSPAINLAYVKKNCWNPADPSITFPGPRRTRTRASASASEAPLPTQSPSQPSQRPRHPPASTSASMDTHGQMLRSLHVGQQLIMENMHRLSLHLQMDPPLTTPEAYRQRVAWPGDQPSTDRGEEPSGAAEDPAVDEDLIADLATADWGSWADLGRGS

SEQ ID NO: 146620 - protein, 317 aa, Glycine max
  Coding DNA Sequence Number=SeqID_54935
LILSGDMRDIEVASLNLLVNKVIVQEDVLHPRVKNKAGKLEVLTLFLGKPGYRVAAKEDDEREGGGSVVNIPSSICIRAFEVLEVKGGGLCINWEILLMEKDRSGLVMVKVRYCKAPMMLQYRVAPTVGVPSFKMKVAIGDKGVHEVNVDADEEKGALKEGIVDVKLMHGLVMVKSNGEDNFDASNRAVEMSFDTEEPLATRNVMILGCKNKSEWAWDECGWGGVIWEDVVMEDAWCGSWLEFVVGVWANKPWEIKATKGVTRNIGISVHGVEGLNQFQLCGDDIAQLLHLVQVLKSYLWLLAVLHEMHGWVELDLI

SEQ ID NO: 146621 - protein, 66 aa, Glycine max
  Coding DNA Sequence Number=SeqID_54936
MAFSYKMTLFIMLLIIFTILVAFPQFGAASRALQEDECLFNGALRSYPVQIQFVHNKPTNSPACAN

SEQ ID NO: 146622 - protein, 304 aa, Glycine max
  Coding DNA Sequence Number=SeqID_54937
  Homolog annotation: Hit_ID=A7PUN5; Match level="QueryCoverage=89%, HitCoverage=57%, E-value=1e-123, Identity=80%"; Hit description =Chromosome chr7 scaffold_31, whole genome shotgun sequence
MVKALQKLVALTTVTMQQRPFWAGAAANAVIIEADAFKESDVIYKALSSRGHHDMIQTAELVHQASTDAASSLLVTALNEGRDVIMDGTLSWVPFVVQTITMARNVHRRRYRMGEGYRLKEDGTVIENYWERIKDEEPEQVGGKKRKPYRIELVGVVCDAYLAVVRGIRRAIMCRRAVRIKSQLKSHRRFAEAFMTYCQLVDNARLYFTNALEGPAKLIGWKDRDKTLLVDPDEFDCMKRLAKLNEDANSIYELYKHPNPACEAGSVWKDIVLSPSRLNIQQELKYSIQKIESMNYNNVTMENR

SEQ ID NO: 146623 - protein, 92 aa, Glycine max
  Coding DNA Sequence Number=SeqID_54938
MTMVAIIVMSMKMMIMVRWNRGGDDGDDSGGMVTVMIVADGIMVVMVEATIMVIMVAKVRCNGSGDKMVEAIMVMVMRQCSGGGRGGIVVVW

SEQ ID NO: 146624 - protein, 573 aa, Glycine max
  Coding DNA Sequence Number=SeqID_54939
  Gene Ontology: Mol. function=transferase activity, transferring hexosyl groups; Cellular component=Golgi apparatus; Biological process=carbohydrate biosynthetic process
  Homolog annotation: Hit_ID=A7PUM3; Match level="QueryCoverage=94%, HitCoverage=89%, E-value=1e-166, Identity=52%"; Hit description =Chromosome chr7 scaffold_31, whole genome shotgun sequence
  Pfam annotation: Domain name=Glyco_transf_8; Domain location=259-547; Score=262.0; E_value=1.2e-75; Accession=PF01501.11; Description =Glycosyl transferase family 8
MKRSGRWQRTLILALLFLSLVAPLVYVSHLLNTLTSDGAEELEEPKEIVYKEEDFDSTNSYILQKTNDTAASKSEGYRNNTLERNEFDQDKKQGQEAQQKGLFSMDGDVNVFNTTVTLKQNMHTQSQRMTDVNVEVIDKKSSPKAIQHRQSSRSQSQRVTNQKVLEIKDQIIRARAYLGFAPPGSNSHLMKELKLRIKEMERAVGEATKDSDLSRSELHSALQKMRHMEASLSKANRAFPDCTAMAAKLRAMNHNAEEQLTADYFALKPEDRKLPNENKIHDPKLYHYAVFSDNLLACAVVVNSTVSNAKKKEKLVFHVVTNSLNFPAIWMWFLLNPPGKATVHIQSIENFEWLPMYNTFNKHNSSDPRYTSELNYLRFYLPDIFPTLNKILLFDHDVVVQQDLSGLWNANLKGKVIAAVGTCQEGGTSFHRMDMLINFSDPFIAERFDANACTWAFGMNLFDLQQWRRHNLTALYHRYLQMGSKRPLWNIGSLPLGWLTFYNKTKVLDRRWHILGLGYDSGVDKNEIEGAAVIHYDGIRKPWLDIAMGRYRSYWTKYMNFDLPILQRCNLQA

SEQ ID NO: 146625 - protein, 109 aa, Glycine max
  Coding DNA Sequence Number=SeqID_54940
MDLYDHNKLEEKKKIKLLKSDFIEYDDDATVMVVLAPKAECFKDQKWFKEVASIPISNSVEQRDANGSVLVSDPPYIGVEGVVFSIGVYRMKKDLRGVYFLRGHLHEIA

SEQ ID NO: 146626 - protein, 213 aa, Glycine max
  Coding DNA Sequence Number=SeqID_54941
  Homolog annotation: Hit_ID=A7PUI2; Match level="QueryCoverage=90%, HitCoverage=94%, E-value=3e-59, Identity=61%"; Hit description =Chromosome chr7 scaffold_31, whole genome shotgun sequence
MDASEPDNVDDYSPSSTVIKFDRPVPLLRGPLPAGPSDDPSAGPYVLAFRDSRAWASSFAACERKIVEQCEEGARIGCAVSASRKCKLPWWKSLAGPTLSDLKEREQCEVREMADCEAAAKEKCVGFARDKCLVPFRDARIRVGKGFLSSRDAVKLIGWASMPESERSLKLMSLMGGGGGGDLGVTNCRASELLGFDNYVQCILGEQQHGTGN

SEQ ID NO: 146627 - protein, 148 aa, Glycine max
  Coding DNA Sequence Number=SeqID_54942
  Gene Ontology: Mol. function=phosphoprotein phosphatase activity
  Homolog annotation: Hit_ID=A5BTQ6; Match level="QueryCoverage=95%, HitCoverage=9%, E-value=1e-11, Identity=29%"; Hit description =Putative uncharacterized protein
MGNRVHLIYLTVLANLERVRRYNWGSACLATLYREMTLRRKSWAGVRHCCILGHSITCPSVQQELIADHRICWLRVEWKHADRVKLQFRLQQGIPDPQKNMDKFHKIDMRGQTDTNWAEKHAKWIMYWQQRQSMVLHGQSIVGHAKHS

SEQ ID NO: 146628 - protein, 244 aa, Glycine max
  Coding DNA Sequence Number=SeqID_54943
  Gene Ontology: Mol. function=nucleic acid binding; Cellular component= intracellular; Biological process=regulation of transcription
  Homolog annotation: Hit_ID=A7P6S4; Match level="QueryCoverage=79%, HitCoverage=34%, E-value=5e-79, Identity=74%"; Hit description =Chromosome chr9 scaffold_7, whole genome shotgun sequence
  Pfam annotation: Domain name=RS4NT; Domain location=139-176; Score =15.1; E_value=0.025; Accession=PF08071.3; Description=RS4NT (NUC023) domain
  Pfam annotation: Domain name=zf-C2H2; Domain location=154-176; Score =20.2; E_value=0.008; Accession=PF00096.17; Description=Zinc finger, C2H2 type
  Pfam annotation: Domain name=zf-C2H2; Domain location=181-202; Score =7.5; E_value=1.7; Accession=PF00096.17; Description=Zinc finger, C2H2 type
  Pfam annotation: Domain name=zf-C2H2; Domain location=78-100; Score =25.6; E_value=0.00018; Accession=PF00096.17; Description=Zinc finger, C2H2 type
  Pfam module annotation: Pfam domain module=RS4NT::zf-C2H2::zf -C2H2::zf-C2H2; Domain location=139-176::154-176::181-202::78-100
MFPTAISNSTSLSEDASVSSGTKVQDLGGLNPWVSNISPQQQQQPQKIKKKRSLPGNPDPDAEVIALSPKTLLATNRFVCEICHKGFQRDQNLQLHRRGHNLPWKLKQRSSKEVKKKAYVCPEPSCVHHDPSRALGDLTGIKKHFCRKHGEKKWKCEKCSKIYAVQSDWKAHSKTCGTREYRCDCGILFSSGSLVLHKNGKHSPWNIRMAFTGSTKVGQHASVAREIETLLIFESQNCQMNMRQ

SEQ ID NO: 146629 - protein, 1284 aa, Glycine max
  Coding DNA Sequence Number=SeqID_54944
  Gene Ontology: Mol. function=protein binding; Biological process =regulation of ethylene biosynthetic process
  Homolog annotation: Hit_ID=A7PUG9; Match level="QueryCoverage=55%, HitCoverage=98%, E-value=0.0, Identity=65%"; Hit description =Chromosome chr7 scaffold_31, whole genome shotgun sequence
  Pfam annotation: Domain name=BTB; Domain location=735-842; Score= -7.4; E_value=0.017; Accession=PF00651.22; Description=BTBPOZ domain
  Pfam annotation: Domain name=DUF828; Domain location=20-323; Score =104.2; E_value=3.9e-28; Accession=PF05703.2; Description=Plant protein of unknown function (DUF828)
  Pfam annotation: Domain name=PH_2; Domain location=370-479; Score =156.7; E_value=6.4e-44; Accession=PF08458.1; Description=Plant pleckstrin homology-like region
  Pfam annotation: Domain name=TPR_2; Domain location=1164-1197; Score =3.6; E_value=11; Accession=PF07719.8; Description=Tetratricopeptide repeat
  Pfam annotation: Domain name=TPR_2; Domain location=1198-1231; Score =14.8; E_value=0.33; Accession=PF07719.8; Description=Tetratricopeptid e repeat
  Pfam annotation: Domain name=TPR_2; Domain location=943-976; Score =2.5; E_value=15; Accession=PF07719.8; Description=Tetratricopeptide repeat
  Pfam module annotation: Pfam domain module=BTB::DUF828::PH_2::TPR _2::TPR_2::TPR_2; Domain location=735-842::20-323::370-479::1164 -1197::1198-1231::943-976
MEPKCTINCRRPEFVPTPLPESPRVPMEFLSRSWSASALEVSKALAPHSSYNNSSSIPEQTSASAPNHNNNPFSEDLSTISSKNQFSFASSATSQLVLERIMSQSAREEVSPLTSGRLSHSSEPLNGGGSLTGTDSPPISPSDEFDDVVKFFRANNSIHPLFNGGRASATIGNGTACSGPKTVGRWLKDRREKKKEENRTHNAQLHATISVAAVAAAVAAIAAATAGSSAPSKDEKMAKTDTAVASAATLVAAQCVEAAEAMGAERDHLASVVSSAVNVRSHDDITTLTAAAATALRGAATLKARALKEVWNIATVTPLERGIGGIGLCGKSINSNTSNTSNTSTSDSGEIFKGENFPGSCSQDLLAKGSELLKRTRKGDLHWKIVSVYIHRTGQVMLKMKSRHVAGTITKKKKNVVLDICADLPAWPGRHLLDDGEKRRYFGLKTDARGIVDNEEDNVKSKASGGGNEEKSDGANEDDDGGDGDGEEQLNGEDGVDLANEGPTELRVLKHGGVEWPGIGIAIPTAFNISFHQHVFFLSSVLSLLKGCGAVVEIRDLFRLLCPMRSFFPAESCKEAHPNALNPQSWLHIERGKLPKLSSHPSSASIESLIKVPQPAILPFFKPVDYVEVLARIHEELESCPPQERSNLFLLQYQVFRGLGEVKLMRRSLQGAWQRAHTVHEKIIFGAWLKYEKQEEELMADLLAACGKCAKEFAPVDIAFHLPFDVNASSEGRTTNENRISQNVTFTIGSEKIVCDRQKISELSAPFHAMLKGHFSESLSETIDLSENNISPSGMKAISDFSLNGSLIEVPPNLLLEILVFANKYCCERLKDACDRRLASLVSSKEDAVELMEYALDEHSSVLAASCLQVLLRDLPNCMNDNRVVEIFVHANKQQLEVMVGPGIFALFCFLSEVSMNLNSSSDTTAHFLERLVEFAENGKQRLLALHQLGCVRLLRKEYDEARCLFEGAVNAGHMYSVAGLARLDYIKGDKLLSYGQLSSVISSVTSLGWMYQERSLYCDGDKRWEDLEKASNLDPTLIYPYMYRAATLMRTQNAHAALAEINRILGFKLSLECLEIRFFIHLSLEDYKAALCDVQTILTLRSDYRMFEGRVAASQLCTLVREHVERWTTADCWARLYDCWSAVDDIGSLSVIYQMLESDAAKGILYFRQSLLLLRLNCPEAAMRSLLLARQHASSEHERLVYEGWILYDTGHYEEGLQKAEESIDIKRSFEAFFLKAYALADSSIDPSCSPTVISLLEDALKCPSDNLRKGQERSLQGFPLRK

SEQ ID NO: 146630 - protein, 690 aa, Glycine max
  Coding DNA Sequence Number=SeqID_54945
  Gene Ontology: Mol. function=secondary active sulfate transmembrane transporter activity; Cellular component=integral to membrane; Biological process=response to stress
  Homolog annotation: Hit_ID=A7PUE5; Match level="QueryCoverage=99%, HitCoverage=99%, E-value=0.0, Identity=72%"; Hit description =Chromosome chr7 scaffold_31, whole genome shotgun sequence
  Pfam annotation: Domain name=STAS; Domain location=546-664; Score =149.7; E_value=8e-42; Accession=PF01740.12; Description=STAS domain
  Pfam annotation: Domain name=Sulfate_transp; Domain location=189-523; Score=463.3; E_value=3.1e-136; Accession=PF00916.11; Description =Sulfate transporter family
  Pfam module annotation: Pfam domain module=STAS::Sulfate_transp; Domain location=546-664::189-523
MGNADYAYPSGMNVECVHRVAIPPPQPFFKSLKYSMKETFFPDDPFRKFKNQPASKRFLLGLQYFFPIFEWAPKYTLHFLKSDLISGITIASLAIPQGISYAKLANLPPVLGLYSSFIPPLIYAMMGSSRDLAVGTVAVGSLLMASMLGRVVNFNENPNLFLHLAFTATFFAGVLQASLGLFRNHVEECRLGFIVDFLSHATIVGFMGGAATVVCLQQLKSILGLEHFTHEADLVSVMRSVFSQTHEWRWESAVLGCCFIFFLLVTRYFSKRQPKFFWVSAMAPLTSVILGSLLVYLTHAEKHGVQVIGNLKKGLNPPSVTDLVFVSPYMGTAIKTGLVTGIIALAVKYLNLISFGRGHVSKALRTELIDLVQEGIAVGRSFAMFKNYHIDGNKEMIAIGTMNIFGSFTSCYLTTGPFSRSAVNYNAGCKTAASNIIMAIAVMLTLLFLTPLFHFTPLVVLSAIIVSAMLGLIDYQAAIHLWKIDKFDFLVCFTAYVGVVFGSVEIGLVIAVAVSLLRVLLFIARPRTFLLGNIPNSAVYRNVEQYPNANHIPGILILEIDAPIYFANASYLRERITRWIDEEEDRIKATGQTSLQYVIMDMTAVANIDTSGISMLEECKKTTDRRGLQLALVNPGSEVMKKLNKAKFLDELGQKWIYLTVEEAVGACNFMLHTYKPNTMKDESEGWNNA

SEQ ID NO: 146631 - protein, 361 aa, Glycine max
  Coding DNA Sequence Number=SeqID_54946
  Gene Ontology: Mol. function=molecular_function; Cellular component =nucleoplasm; Biological process=biological_process
  Homolog annotation: Hit_ID=Q93WD7; Match level="QueryCoverage=93%, HitCoverage=80%, E-value=1e-104, Identity=56%"; Hit description =Putative uncharacterized protein At1g03110
  Pfam annotation: Domain name=WD40; Domain location=126-168; Score =36.5; E_value=9.5e-08; Accession=PF00400.23; Description=WD domain, G-beta repeat
  Pfam annotation: Domain name=WD40; Domain location=32-70; Score=0.6; E_value=27; Accession=PF00400.23; Description=WD domain, G-beta repeat
  Pfam annotation: Domain name=WD40; Domain location=78-116; Score =22.1; E_value=0.0021; Accession=PF00400.23; Description=WD domain, G- beta repeat
  Pfam module annotation: Pfam domain module=WD40::WD40::WD40; Domain location=126-168::32-70::78-116
MESESKNDTEVAPALIAVHPDQSSVAVAVGPHLRVFDLLSSEKRVTAVAISNDGTFVCFADKFGVVWVVDVDPPLHDKKPAPLLSHYCSIITSLEFSPDGRFILSADRDFKIRVTNFPQKPLNGAHQIQSFCLGHTEFVSCLAFIQAQECPQGLLLSGSGDSTVRLWNIDSGALLDTCEVAIKAGLLESNGKAEEHGHAVIDLCTVLDGLIVAVAIQSLQGIVLLSCNVCAQTLSFAKVVSVAGEAFVPTCLGSSPSIRKLWMVTGVSGLPGCNYLSLARVRVISGIDVEQEPVVPGDDNIPGGEKLLETLQGSASVDDSAFLATAEAVKTAMCNLLIKKQYPSENREYRKKSRNDRKLKG

SEQ ID NO: 146632 - protein, 116 aa, Glycine max
  Coding DNA Sequence Number=SeqID_54947
  Homolog annotation: Hit_ID=A9PK79; Match level="QueryCoverage=48%, HitCoverage=33%, E-value=2e-13, Identity=55%"; Hit description =Putative uncharacterized protein
  Pfam annotation: Domain name=DUF260; Domain location=2-83; Score= -15.8; E_value=0.00038; Accession=PF03195.5; Description=Protein of unknown function DUF260
MSCNECRVLRKGCIESCILRLCLQWIDTHEASMIFFSSLFQSLLCEACGRTMNPVNSLRFDKGGFDGKHKQFEELAKLQTTEIHWSGSPSMNSKEFETMTSCLESGIEDNYAPDED

SEQ ID NO: 146633 - protein, 447 aa, Glycine max
  Coding DNA Sequence Number=SeqID_54948
  Homolog annotation: Hit_ID=A5BW45; Match level="QueryCoverage=64%, HitCoverage=74%, E-value=3e-12, Identity=25%"; Hit description =Putative uncharacterized protein
AKYGSFNIQGWWGAFVFKRWSSERFGDPKAKLDGLISNINMLDLKEEMMVFLWRWHEAYGNTKFFHNMINWRRRFKEQGSMQVLLDEVQFKSINDEDNNMLTQIFSKEETKNVIWDLNVITAISEFHGHGRLPRGTDASFLMLTLKKDNPQDLGEFRPIFLIVLGGKECFEYGVLVANKVVHEAKAKNKRCLIFKVDFEKAYDFAKGKNVLSDVGIRKGKLRVSLLQYVEDDMRDTLILKATPRYFELAFRLKEYSICLFGTTGWSRCKKGKWMWRFLSENDSLWRDVFLKKYNIKCEDSLVGGCYGKKGSQWWCDLTGARWLSVECLRSTLNRLFLNLEQKSHKISDMGYWCEGGPNNGQFAKKEYHSWWLGLKLCFLQLLLGDSRAPFSSIASFLIHCGLNVINVYRPRSFEQYGSSGTILDLTKGCAILRQLLMHHGTEPGLGA

SEQ ID NO: 146634 - protein, 62 aa, Glycine max
  Coding DNA Sequence Number=SeqID_54949
MTEELTPDATMAGDATMSFIGRRWWHEVTLRPDEGVAVVAGDADTDKGHARQIGHGEEEEDR

SEQ ID NO: 146635 - protein, 104 aa, Glycine max
  Coding DNA Sequence Number=SeqID_54950
MKKESESDLDGEVGREGPGEGIVVGSAFAGGVFGGVEEERGHFEGAIDEIGVGVGGDRLEEPLEGEIKGERSHVREGEKRLKPTLHLSQVLRSRVLGRTRTLRH

SEQ ID NO: 146636 - protein, 613 aa, Glycine max
  Coding DNA Sequence Number=SeqID_54951
  Gene Ontology: Mol. function=ent-copalyl diphosphate synthase activity; Cellular component=chloroplast; Biological process =metabolic process
  Homolog annotation: Hit_ID=O04408; Match level="QueryCoverage=95%, HitCoverage=74%, E-value=0.0, Identity=70%"; Hit description=Ent -kaurene synthase A, chloroplast precursor
  Pfam annotation: Domain name=Terpene_synth; Domain location=212-431; Score=375.3; E_value=9.6e-110; Accession=PF01397.12; Description =Terpene synthase, N-terminal domain
  Pfam annotation: Domain name=Terpene_synth_C; Domain location=448 -612; Score=12.6; E_value=1.8e-06; Accession=PF03936.7; Description =Terpene synthase family, metal binding domain
  Pfam module annotation: Pfam domain module=Terpene_synth::Terpene _synth_C; Domain location=212-431::448-612
GSLATLKFREINVEDDIEEEQDIGVFVANEIKKRVDTIKSILGSMEDGEITVSAYDTAWVALIEDVHGSGAPQFPSSLEWIAKNQHPDGSWGDKELFSAHDRIINTLACVIALKSWHMHPEKCEKGMTFFKENLNQLQNENVEHMPIGFEVAFPSLLDMARGLNIEVPDNSPILNKIFAMRNVKLTRIPKAMMHKVPTSLLHSLEGMSGLDWKELLKLQSQDGSFLFSPSSTAFALMQTKDQNCHNYLNKVVKRFNGGVPNVYPVDLFEHIWVVDRLERLGISQYFQQEIKDCLNYVHRNSNVQDIDDTAMGFRLLRLHGYQVSADVFKNFERNGEFFCFTGQTTQAVTGMFNLYRATQVMFPGEKILEHGKHFSAKFLRDKRAANELVDKWIIMKNLAEEVAYALDVPWYASLPRVETRFYIDQYGGESDVWIGKTLYRMAYVNNNNYLELAKLDYNNCQTLHLIEWGRIQKWYSESRLGEFGLNRRTLLLAYFLAAASIFEPEKSHVRLAWAKTSVLLETITSYVSDAEMRKDFMKKFSDCINRRDYSMGCDSEMMSSKKVKVYNSVIDVGYTLVVASTWLRVSHDYVILIENELLLNTEYFETLDIGMNK

SEQ ID NO: 146637 - protein, 49 aa, Glycine max
  Coding DNA Sequence Number=SeqID_54952
MVRRRERGKVAVSGERKAEFKRKGRGKQTEMTSQEIPANGCMASSKTKE

SEQ ID NO: 146638 - protein, 124 aa, Glycine max
  Coding DNA Sequence Number=SeqID_54953
MGKYETGARNSQNHIIPLQSEDHNPLATGNHNFSYNLLNRFDESIERNKSKQRKEKEQLRNMNELLVSGEDETEAKRTRPRKEENAILERERGNLGCLKKADFSFPGQSENEREGASGPKIEKG

SEQ ID NO: 146639 - protein, 135 aa, Glycine max
  Coding DNA Sequence Number=SeqID_54954
PPSPSTYEARGRDEDEMGTARGRPRDNVDFLGVTFRRDVLRLQLIPLPLSTSQLQSAELPHELASTGESHSRRLCGGSGVHEQENRAHEVGGVQVDAVGTRWRTTSQPALSPNVVKKVGEKYSLVRDLNGKLRLL

SEQ ID NO: 146640 - protein, 711 aa, Glycine max
  Coding DNA Sequence Number=SeqID_54955
  Gene Ontology: Mol. function=transferase activity, transferring glycosyl groups; Cellular component=intracellular; Biological process=protein amino acid ADP-ribosylation
  Homolog annotation: Hit_ID=A5AIW8; Match level="QueryCoverage=94%, HitCoverage=71%, E-value=0.0, Identity=62%"; Hit description =Putative uncharacterized protein
  Pfam annotation: Domain name=BRCT; Domain location=304-381; Score =31.3; E_value=3.5e-06; Accession=PF00533.17; Description=BRCA1 C Terminus (BRCT) domain
  Pfam annotation: Domain name=PADR1; Domain location=200-253; Score =111.5; E_value=2.5e-30; Accession=PF08063.3; Description=PADR1 (NUC008) domain
  Pfam annotation: Domain name=PARP; Domain location=642-711; Score= -65.3; E_value=0.0029; Accession=PF00644.11; Description=Poly(ADP -ribose) polymerase catalytic domain
  Pfam annotation: Domain name=PARP_reg; Domain location=508-640; Score= 100.1; E_value=6.8e-27; Accession=PF02877.5; Description=Poly(ADP -ribose) polymerase, regulatory domain
  Pfam annotation: Domain name=WGR; Domain location=429-514; Score =83.4; E_value=7.3e-22; Accession=PF05406.6; Description=WGR domain
  Pfam annotation: Domain name=zf-PARP; Domain location=24-92; Score= -14.9; E_value=0.028; Accession=PF00645.9; Description=Poly(ADP -ribose) polymerase and DNA-Ligase Zn-finger region
  Pfam module annotation: Pfam domain module=BRCT::PADR1::PARP::PARP _reg::WGR::zf-PARP; Domain location=304-381::200-253::642-711::508 -640::429-514::24-92
MVEHANQGSKSPEFWPLLLGLTGNLASSQFSSPSFDHEVRISTKQGGQGAKGLAWHHAKCLIDLSPSIEVDKLSGWNNLSSSDQSAVIDFAKKGGSDTKIETEEGKESTPQQTSKGGIKRGKDVDSERKSKVAKAKGDVSVGSAMSVKSGEACDLEKKMETQSKELWDLKDDLKKHVTTTELREMLEASGQDSTGSELDLRDRCADGMMFGALDLCPICSGFLRYSGGMYRCHGYISEWSKCSYSTCEPKRIEGKWKIPKETNNQYLKKWFKSQKGKKPVRILPLPSPRKSAESQMIASQHQSSNSGNLRDLKVAICGLPNDSIAEWKCKIDGICGMFHAKVNKDTNCLVVGGSLNYEAEMRKARRMKIPIVREDYLIDCLARKKRLPFDMYKVEMIGEASSMVTIKVKGHSAVHEASGLQDSGHILEEGKSIYNTTLNMSDLSTGINSYYILQIIQEDKGSDCYVFRKWGRVGNDKIGGTKLEEMSKSDADYGVNKQVSKKEKNDVDSKLPPPLIELMKMLFNVETYRAAMMEFEINMSEMPLGKLSKSNIQKGFEALTEIQNLLKISNPDPSVKESLLINASNRFFTMIPSVHPHIIRDEDDFKSKVKMLEALQDIEIASRLVGFDANNDDSIDDNYKKLHCDISPLPHDSEEFCLIEKFLHNTHAPTHTDWSLELEEVFSLEREGEFDKFAPYRDKLGNRMLLWHGRL

SEQ ID NO: 146641 - protein, 46 aa, Glycine max
  Coding DNA Sequence Number=SeqID_54956
MNEVPSGLLDLRTYVGERFDSLDGRIDAIDARFEGMDTRITQLEED

SEQ ID NO: 146642 - protein, 50 aa, Glycine max; identical to SEQ ID NO: 139779
  Coding DNA Sequence Number=SeqID_54957

SEQ ID NO: 146643 - protein, 74 aa, Glycine max
  Coding DNA Sequence Number=SeqID_54958
FYGVPVTPGKVITSPTNQAFIKKYCAPRQAQGETPQQPGDGWQRATNALPPPLEFISAHPQKRLEHCLRHMADQ

SEQ ID NO: 146644 - protein, 88 aa, Glycine max
  Coding DNA Sequence Number=SeqID_54959
  Gene Ontology: Mol. function=helicase activity
  Homolog annotation: Hit_ID=Q8RV60; Match level="QueryCoverage=97%, HitCoverage=6%, E-value=2e-14, Identity=43%"; Hit description =Putative uncharacterized protein At2g05640
MREYFCYRLQSRTNEDQTILHLKRLFQQWIVDGYCMIESQKINYVRQHQQQLRVDKYINLNTSNNDPETLGSEKGKRIILPSSFVGSQ

SEQ ID NO: 146645 - protein, 67 aa, Glycine max
  Coding DNA Sequence Number=SeqID_54960
MENYDDRNCQILDICPLNLQTTFQEDPTINECRRALLPRWFWTTSLRSFIKRLPRKASLGSFLERLL

SEQ ID NO: 146646 - protein, 119 aa, Glycine max
  Coding DNA Sequence Number=SeqID_54961
MVDQTKSIQNLSTERSIEHKKHNQLDIKNSALKALYPNSDEDMTKNKGKDPLEGLGGLMTRARARKAKEALQQVLSILFEYKPKFQGEKSKVVSCIMAQMEEDSMAPLHLNFRVFSSSK

SEQ ID NO: 146647 - protein, 78 aa, Glycine max
  Coding DNA Sequence Number=SeqID_54962
VTSSEEDPEEDPEELPPEPAVDALDFLEGDEDPLPEVDSPEVVMSASEADSTEDSGPGEMATSGGSSSYYYSGHLCSG

SEQ ID NO: 146648 - protein, 75 aa, Glycine max
  Coding DNA Sequence Number=SeqID_54963
  Homolog annotation: Hit_ID=B0HC01; Match level="QueryCoverage=46%, HitCoverage=74%, E-value=3e-12, Identity=100%"; Hit description =Putative uncharacterized protein
MRKRHASRREKAGQGAGAYGKTPATRPFYGSWPFAGLLLTCSFLRYPLILWITVLPPLSELIPLAAAERPSAASQ

SEQ ID NO: 146649 - protein, 139 aa, Glycine max
  Coding DNA Sequence Number=SeqID_54964
MNILTAQDQEWEQELSPYNHYEEERTLNLESVFEEFMVYHASSKANQNSMENHEIHFERGSNLDKLLMQFMETTKSTQRALQSVEIHVGELAEAVTQFMVRQEKSFVEVEAQKKSPVKKHESREKDEEKDEEQAQQQWE

SEQ ID NO: 146650 - protein, 134 aa, Glycine max
  Coding DNA Sequence Number=SeqID_54965
  Subcellular localization annotation: CTP_CleavageSite=49; ConfidenceScore=5.16e-01
MPISPCKSISWSVSSRHGDRTPQDTPVDPGKVQQGPGVSSSDYGPLSVLQGARTPPARSRHHRDRNCKTPSGPEEVQQGLGILYGVPVTSSKGIRPPTNRAFIKKYCAPDRRRAHPPSRIGMIGSGKQTHHHHL

SEQ ID NO: 146651 - protein, 130 aa, Glycine max
  Coding DNA Sequence Number=SeqID_54966
MPELVNSRVGSLPGTSGADGTMVWPLPLKNSRKSLRIWEVVNLADAFIGGWQVSGPAPPVSVIRVVAGRTADAVAVEAASGQQIGGLAPLRQVLRAGLAKASADQITGIFLPVAFVAVHRRGNRGTVQAV

SEQ ID NO: 146652 - protein, 79 aa, Glycine max
  Coding DNA Sequence Number=SeqID_54967
GQEIYSSQDEATTSPSSSESEEAKREESSEEIYPKKKEWMMQSYPLMALDRRLQEDWARAAEEGPRVLNSLRVDFGAVG

SEQ ID NO: 146653 - protein, 189 aa, Glycine max
  Coding DNA Sequence Number=SeqID_54968
  Homolog annotation: Hit_ID=A5BSR3; Match level="QueryCoverage=76%, HitCoverage=46%, E-value=7e-15, Identity=36%"; Hit description =Putative uncharacterized protein
DVRMKAHAIQKQNTAPHVLSRGGYDYLEQKLLAEKTKKKMQEAAQSGSVDGVIDPPSPVRRHMKWKMARTKKTGEMTTEAAKEIAEKIDSFEEQATQGSFVPHGRQDVLAAAIGRPEHPGRVRGIGAGVTIKQYFGSAPRTSRSASSLSPEELHQLTQQIRDQLEESITEKVMRQVMASFQPPSVADAI

SEQ ID NO: 146654 - protein, 131 aa, Glycine max
  Coding DNA Sequence Number=SeqID_54969
  Subcellular localization annotation: CTP_CleavageSite=42; ConfidenceScore=5.03e-01
MAPPLTSSPLSSAMVQKKDLIEAQRSNLHKSFSSMFPSSDIRVQELQIQLGFYYNVKKVKNKNRNLTKRKKKTNTRILYWFGNNPCPHLVPKQPAVLGISFNLVKTFTSKDPQGMYPPLFSLNNQVDVPST

SEQ ID NO: 146655 - protein, 64 aa, Glycine max
  Coding DNA Sequence Number=SeqID_54970
MRDGRRSSYVIGSGVNSGNGLGGKFLVVLELPAGRVVFGVGTWGASLWRRSQHEPRSLGVCCAY

SEQ ID NO: 146656 - protein, 83 aa, Glycine max
  Coding DNA Sequence Number=SeqID_54971
MEGDSVIHTVAYADDVVRVPQSIPHNEDAHVPKPANVDADDPLRGLIKYSFDIYDNPLEISFDGSFLWNCRCIYIDIHHIFRC

SEQ ID NO: 146657 - protein, 93 aa, Glycine max
  Coding DNA Sequence Number=SeqID_54972
MGLGIRFLGGGYTNSARQSIRGAPNSMVEDACKTINSWVSEKASNSWGSRLDGGGCMNDNQVMGLGIRFVGGGYTNIARQSIRWAPDSMVEDA

SEQ ID NO: 146658 - protein, 91 aa, Glycine max
  Coding DNA Sequence Number=SeqID_54973
MARSVFASCPYFRDLHGRELKRLLVIIPKVVISLLMVSRVESPTVATYPSVGGRRVPRGMRLPRKEYAWSSHQRLFEENVRKTGKDVVYEL

SEQ ID NO: 146659 - protein, 117 aa, Glycine max
  Coding DNA Sequence Number=SeqID_54974
MEVRDIDVKIGDEDLTMILLASLPHSYENFVSSLRSMHSDYRWLILLKCRRRRKTKDICNYHKEPSHWKKDCPKKAKNDFAYAIVQNDPSSKNDLVMSVGEQLEQHFEQWVLDSVGK

SEQ ID NO: 146660 - protein, 45 aa, Glycine max
  Coding DNA Sequence Number=SeqID_54975
MGAKHLTRTKEWSHVIEQRSPDEIRGPVGLLRVHWVSCGRDPCKQ

SEQ ID NO: 146661 - protein, 172 aa, Glycine max
  Coding DNA Sequence Number=SeqID_54976
  Gene Ontology: Mol. function=DNA-directed RNA polymerase activity; Cellular component=chloroplast; Biological process=transcription, DNA-dependent
  Homolog annotation: Hit_ID=Q8HVY5; Match level="QueryCoverage=90%, HitCoverage=15%, E-value=9e-81, Identity=90%"; Hit description=DNA -directed RNA polymerase subunit beta
  Pfam annotation: Domain name=RNA_pol_Rpb2_1; Domain location=27-171; Score=74.0; E_value=4.8e-19; Accession=PF04563.6; Description=RNA polymerase beta subunit
MAANRWNIFDKFTGKLKMLGDGNEGMFIDRGLPEGLFKFPKIEDTDQEIEFQLFVETYQLLEPLINEKDAVYESLTYSAELYVSAGLIWKSSRDIQEQTIFVGNIPLMNSLGTSIVNGIYRIVINQILQSPGIYYRSELDPSGISVYTGTIISDWGGRLELEIDRKARIWAR

SEQ ID NO: 146662 - protein, 203 aa, Glycine max
  Coding DNA Sequence Number=SeqID_54977
DFARTAAGRRVRIMRTSMTTLTQMWMTLLLNDILPSDHNSDLPLPKCQLVYVILSRMRVHLAQLIANAIYLFAGMPPTKHPLDPDKSNRTLGFPALITGLCQSFGVPVTPSNVIRPSITQAFIEKYCMSRQVQGNAPQATDVPPPPHQADPAESLGMERYLQHLVRQQATNHRGQVQIHECLYQLSLSQQGQGFVPFACPTPD

SEQ ID NO: 146663 - protein, 82 aa, Glycine max
  Coding DNA Sequence Number=SeqID_54978
MAQQERQVFYVQDPCDSRYSVVLQGRPSGLNDRHDGSTLDICETTPFSTKIPSTDDSLHIDEDHGNTTSIPSAVQSAVRGDV

SEQ ID NO: 146664 - protein, 225 aa, Glycine max
  Coding DNA Sequence Number=SeqID_54979
  Gene Ontology: Mol. function=hydrogen ion transporting ATP synthase activity, rotational mechanism; Cellular component=proton -transporting ATP synthase complex, catalytic core F(1); Biological process=plasma membrane ...
  Gene Ontology: Biological process=ATP synthesis coupled proton transport
  Homolog annotation: Hit_ID=P19366; Match level="QueryCoverage=100%, HitCoverage=52%, E-value=1e-113, Identity=85%"; Hit description=ATP synthase subunit beta
  Pfam annotation: Domain name=ATP-synt_ab; Domain location=1-134; Score=125.1; E_value=2e-34; Accession=PF00006.16; Description=ATP synthase alphabeta family, nucleotide-binding domain
  Pfam annotation: Domain name=ATP-synt_ab_C; Domain location=147-219; Score=86.4; E_value=9.2e-23; Accession=PF00306.18; Description=ATP synthase alphabeta chain, C terminal domain
  Pfam module annotation: Pfam domain module=ATP-synt_ab::ATP-synt_ab _C; Domain location=1-134::147-219
MNEPPGARMRVGLTALTMAEYFRDVNEQDVLLFIDNIFRFVQAGSEVSALLGRMPSAVGYQPTLSTEMGSLQERITSTKEGSITSIQAVYVPADDLTDPAPATTFAHLDATTVLSRGLAAKGIYPAVDPLDSTSTMLQPRIVGEEHYETAQRVKQTLQRYKELQDIIAILGLDELSEEDRLTVARARKIERFLSQPFFVAEVFTGNIDEATAKATNLEMESNLKK

SEQ ID NO: 146665 - protein, 293 aa, Glycine max
  Coding DNA Sequence Number=SeqID_54980
  Gene Ontology: Mol. function=chitin binding; Cellular component =extracellular region; Biological process=chitin metabolic process
  Homolog annotation: Hit_ID=UPI00006A17C9; Match level="QueryCoverage =99%, HitCoverage=100%, E-value=2e-36, Identity=30%"; Hit description= UPI00006A17C9 related cluster
  Subcellular localization annotation: CTP_CleavageSite=96; ConfidenceScore=5.64e-01
MCSPLKVRACSPLIGRACSPLQVRACSPLMVRTCSPLKGRTCSPLMVKNCSSLKVRTCSPLKMRPCDPLMVRMCSPLKMRACDPLMARTCSPLKVRACSPLKVKAYSLLIVRTCIPLMERTCSPLKVRACSPQLAGTCSPLKVRAYNPLMVRTCSPLMVRTCSPQKVTASIPLMARTCSPLKMRAWSPLMARTCSPLKVREYCPLMARTCSPLMPRTCSPLKVRAGNPLIAKTCSPLKVRACSPLMETTCSPLKVEACSPPMAKTCSPLKARMSSPLKVRACSPLIARTCNPL

SEQ ID NO: 146666 - protein, 127 aa, Glycine max
  Coding DNA Sequence Number=SeqID_54981
  Subcellular localization annotation: CTP_CleavageSite=20; ConfidenceScore=5.27e-01
MAGRRANCSFMASMSAFICSCASSTSPITLALAQDMGLNQFRFFNMVHDILVKVKLEVTRTSTVLNVFGSRRSSDVTRFIFCPNFCKMVTSILQLDLMNFFRKSMSLLQPDNPRNGNFNRQYFDNIS

SEQ ID NO: 146667 - protein, 80 aa, Glycine max
  Coding DNA Sequence Number=SeqID_54982
  Gene Ontology: Mol. function=nucleoside-triphosphatase activity; Cellular component=chloroplast
  Homolog annotation: Hit_ID=Q2PMM5; Match level="QueryCoverage=100%, HitCoverage=3%, E-value=1e-33, Identity=87%"; Hit description =Protein ycf2
MVERKNPYLTRLLTIPMNSIGPTNDTLEESYESSNINRVIVPLPYLPQGEKISESYFPDPQESTRVLPTTQKYIMPESNW

SEQ ID NO: 146668 - protein, 70 aa, Glycine max
  Coding DNA Sequence Number=SeqID_54983
MKKQQWNRSFYGGWIFELQRRRGEGRHHSQGNQPWKMELHHQECALDKKLEDDALMEEKKERGGSMKLKE

SEQ ID NO: 146669 - protein, 91 aa, Glycine max
  Coding DNA Sequence Number=SeqID_54984
MVMDMADTFGEDFGIHFNQWSSNIRARFNHIFFSTLKKDSQSRILADQPWKGSNSLPLIKGRRKAFVDRFTELEIKSAVWACGGDKSPGLD

SEQ ID NO: 146670 - protein, 111 aa, Glycine max
  Coding DNA Sequence Number=SeqID_54985
MDQLSQSYGLGSVYGFLEPQAILNANDKCGQCQEYIEKWLKESNRDVYLGAYLNHAFNTLETKSEGKFGHSTPRWIEVKSHVQSGTYECGYYVMHWMWNIIVGQLKTNWTL

SEQ ID NO: 146671 - protein, 126 aa, Glycine max
  Coding DNA Sequence Number=SeqID_54986
DNDPHLHFKDDNVFSHCMLSKGNNDLHLHFKDDNVFGHYMLSKGDNDPHLYFEDDNVFSNNDLHLHFEDDNVFGHYMLSKGDNEPHLYFKDDNVFSGNAVIYAFKDDNVFISKTPMSFVLVLHRTR

SEQ ID NO: 146672 - protein, 132 aa, Glycine max
  Coding DNA Sequence Number=SeqID_54987
  Subcellular localization annotation: CTP_CleavageSite=32; ConfidenceScore=5.02e-01
MLDLGASVSVMPLSIFNSLSLGPLQYTNVVIHLANRSVAYPAGVVPLNVDFLESECTNHVARSTYTSDLLYEPPPTPELKPLPATLKYAYLEDKEKFPVIISASLDAKQKEKLLLVLKKHKKAIRWTLADIP

SEQ ID NO: 146673 - protein, 140 aa, Glycine max
  Coding DNA Sequence Number=SeqID_54988
MAVQLIHDHVVMECLEGVWETLEGNKRCRFRGTIRLTATSLVHPEEPAHTLQQPVEWILPTPTPYRLVEPVQVIEVSSSEQDPEEDPEELPPEPTLDYPEDDEDPLPDVDSLEDIMSASKADSTEESGPGGTANSEDFSS

SEQ ID NO: 146674 - protein, 46 aa, Glycine max
  Coding DNA Sequence Number=SeqID_54989
MGVCVAKALASLGIFSRKLLKELLKEVFSKKLLKEVFSRKLLKAAT

SEQ ID NO: 146675 - protein, 81 aa, Glycine max
  Coding DNA Sequence Number=SeqID_54990
MIQGTNRLRILCLNTLEGTSFVVLVEGTSTWVVIQRTREGTSLVDQLNWRVHPLDCSKRTREGFYNVIGNPKNRGLLGDWT

SEQ ID NO: 146676 - protein, 71 aa, Glycine max
  Coding DNA Sequence Number=SeqID_54991
  Homolog annotation: Hit_ID=A6FJQ2; Match level="QueryCoverage=53%, HitCoverage=84%, E-value=3e-11, Identity=92%"; Hit description=50S ribosomal protein L5
MTVENLGHMQLPETMRKEKIPHQAPFAIQAAQLLGRAIGAGLFAITPAGERGMCCKAIKLGNARVFPVTTL

SEQ ID NO: 146677 - protein, 56 aa, Glycine max
  Coding DNA Sequence Number=SeqID_54992
EACDAIAERLERHLNLGIVTPGTSTHEVIEECLRIARSVTEDRIAYVRSRCRRRMD

SEQ ID NO: 146678 - protein, 111 aa, Glycine max
  Coding DNA Sequence Number=SeqID_54993
  Homolog annotation: Hit_ID=Q2HW90; Match level="QueryCoverage=72%, HitCoverage=16%, E-value=1e-07, Identity=35%"; Hit description =Putative uncharacterized protein
MGTNQTGKRFYQVKIKGLDVTSLKELGRLMGPLQMQAFRKAYRKILDLTIAEIFTEVVVSLTQYYDQPLRCFMLGDFQLVPTIEVFEEILGCPLGGRLQLWLGIRQESWIV

SEQ ID NO: 146679 - protein, 143 aa, Glycine max
  Coding DNA Sequence Number=SeqID_54994
MVPQLIHDRVVMECLEGVWETLEGNERCRFRGTIRLTATSLVHPEEPAHTLQQPVEWILPTPTPYRLVEPVQVIEVSSSEEDPEEDPEELPLEPAVDALDLPEDDEDPLLDVDFPEDIMSASVADSIEESGPGGAANSEDSSS

SEQ ID NO: 146680 - protein, 49 aa, Glycine max
  Coding DNA Sequence Number=SeqID_54995
MSSDLPFLDDNRCRRRRRLRVPTDSQVTIVKGGAVDKSGAFAPTYPQSR

SEQ ID NO: 146681 - protein, 144 aa, Glycine max
  Coding DNA Sequence Number=SeqID_54996
  Gene Ontology: Mol. function=biotin-[acetyl-CoA-carboxylase] ligase activity; Cellular component=intracellular; Biological process =protein modification process
  Homolog annotation: Hit_ID=Q1GZI9; Match level="QueryCoverage=83%, HitCoverage=40%, E-value=9e-33, Identity=55%"; Hit description =Biotin--acetyl-CoA-carboxylase ligase
  Pfam annotation: Domain name=GntR; Domain location=3-62; Score=-0.1; E_value=0.066; Accession=PF00392.12; Description=Bacterial regulatory proteins, gntR fam
  Pfam annotation: Domain name=HTH_11; Domain location=8-61; Score =44.9; E_value=2.9e-10; Accession=PF08279.3; Description=HTH domain
  Pfam module annotation: Pfam domain module=GntR::HTH_11; Domain location=3-62::8-61
MGFRAFIGQVCKAAVLADGKFHSGEALAQRFGVTRATVYNAIQSVEALGITVFSVRGRGYRLPKPVTLLDVEQIAHACGEYAPWFHIQVLAQESARGVAHGTCVAAQIQTAGRGRRGRTWLSQLGGSLTFSLLWAVSVWGGRLV

SEQ ID NO: 146682 - protein, 35 aa, Glycine max
  Coding DNA Sequence Number=SeqID_54997
MEVEWRWKNDDWRRHFKEKMSQEEAHHHAMDKSLK

SEQ ID NO: 146683 - protein, 162 aa, Glycine max
  Coding DNA Sequence Number=SeqID_54998
  Subcellular localization annotation: CTP_CleavageSite=42; ConfidenceScore=5.44e-01
ARACSPLKARTWSPLKVRTCSPLKARVSNPLKVIGTSTQGSTLMRKQEIDSSRGPVIPNSQDWTLDSLDHFGVTTMESSKLHDESRLIQRSFDDNKGDDKKLKGYILCGTSRGYIYLGLTENKRGYISCGSVLVEGTSTRLFKENKGGYIPCGSLLVKGFLQ

SEQ ID NO: 146684 - protein, 32 aa, Glycine max
  Coding DNA Sequence Number=SeqID_54999
RKREKFVENASTEKWEGERKVEEMLLDWDKEK

SEQ ID NO: 146685 - protein, 171 aa, Glycine max
  Coding DNA Sequence Number=SeqID_55000
MIGHRLTNCKIVTANKHVLITACPTLDQPQVGDSAMPPHTNTAGPSNNPKNVQTNLSVPPHRKHVLVANHVPVLQNSSDLKETGNIELDDPIEEGFVQGGGDFLPSESMIIASWNIRGFNLPLKHHAMQSFLRCKEINVMVVLETKLNKASVEEIMRRKFGDDPPRRYELP

SEQ ID NO: 146686 - protein, 58 aa, Glycine max
  Coding DNA Sequence Number=SeqID_55001
MATARGALKHPVYGIVILQLEIYTDRPNVSKTTFLNEKLYTGWWSQQALLTTTKKVPT

SEQ ID NO: 146687 - protein, 154 aa, Glycine max
  Coding DNA Sequence Number=SeqID_55002
  Subcellular localization annotation: CTP_CleavageSite=33; ConfidenceScore=5.78e-01
MGSPPASTTPPPPPSPPTSDASASTSAVKRTRKASRLRSLSTRPPGVERPVVHVDPATGKADGPHKKKLRTYLGIEARDKVDITYENWKEVPIAQKDLIWEDIQFKSDLTRKWALATDQDGVEDTVCDTYDISKEKWAQFCQTRRDPSWEDVRM

SEQ ID NO: 146688 - protein, 81 aa, Glycine max
  Coding DNA Sequence Number=SeqID_55003
MENKRLQCEGFSSKLSHNIEIPNGESARNWVANVVFKFHNDPTVNEPEIIVFLRQVWWDTRKRKGFERRMGKTKMRPKRGI

SEQ ID NO: 146689 - protein, 98 aa, Glycine max
  Coding DNA Sequence Number=SeqID_55004
MGMEYQKIHACPNDCILYRLVGRGGVATCPFAGERRRGSRVRFPKEERCAELPPTFICGKRQENRRKPVKMKILSSGVVFTFEEGISTSYVCLEGVGP

SEQ ID NO: 146690 - protein, 84 aa, Glycine max
  Coding DNA Sequence Number=SeqID_55005
MASMMEAMLGMKRLIESNAATAATASTATEADPVLPNLAHQLGPDMVGRGRDTFWNTNSPRLGFYSLGNRLPDCCNRLPVAKWI

SEQ ID NO: 146691 - protein, 107 aa, Glycine max
  Coding DNA Sequence Number=SeqID_55006
MFSSNKRWWRLRAFSSLERCTCESRVALLPKEWLRVCPQGLDWLPKLRAVREEETEALKESKEVQALKAELEKAQAVKEKFKSTAVKVQKEYDELKDINMAIAEALE

SEQ ID NO: 146692 - protein, 29 aa, Glycine max
  Coding DNA Sequence Number=SeqID_55007
MSNQRKIEESQEIARDAAITVGRYVSLLR

SEQ ID NO: 146693 - protein, 81 aa, Glycine max
  Coding DNA Sequence Number=SeqID_55008
MMKRRGHGISTCYFKKNYSNIKMIWVPKGSSVYTSMQGPNKIWVSLRKKWYIDSGCSKTYDWRCIKFYTYLSKAKRACNIW

SEQ ID NO: 146694 - protein, 117 aa, Glycine max
  Coding DNA Sequence Number=SeqID_55009
  Gene Ontology: Mol. function=aspartic-type endopeptidase activity; Biological process=DNA integration
  Homolog annotation: Hit_ID=A5AFZ5; Match level="QueryCoverage=91%, HitCoverage=9%, E-value=8e-37, Identity=69%"; Hit description =Putative uncharacterized protein
MVVASIFANLDSVPVLNGANFKDWKENIKFGHVKKKCTKYHAWRAKKGIFLTLLCSEVNLALVPRNTWWLDSGATTNISVSMHGCLSYRKPIDSKRWIYVGDGKSVEVEAIGHFRLL

SEQ ID NO: 146695 - protein, 197 aa, Glycine max
  Coding DNA Sequence Number=SeqID_55010
  Homolog annotation: Hit_ID=Q6WAY4; Match level="QueryCoverage=85%, HitCoverage=30%, E-value=9e-21, Identity=36%"; Hit description =Putative uncharacterized protein
MGTNQTGKRFYQVKIKGLDVTSLKELGRLMGPLQMQAFRKAYGKILDLTIAEIFTEVVASHTQYYDQPLRCFTFGDFQLVPTVEEFEEILGCPLGGRKPYLFSGFLPSLSKIAVVVRDSARELDHVKKTRNGVVGLPWKYLEGKARDMANEEEWIPFMDVLALLIFRVFLFPNMDGLVDLAAIDAFLAYHHSKETPV

SEQ ID NO: 146696 - protein, 297 aa, Glycine max
  Coding DNA Sequence Number=SeqID_55011
  Homolog annotation: Hit_ID=UPI00016621D1; Match level="QueryCoverage =62%, HitCoverage=44%, E-value=7e-15, Identity=36%"; Hit description =UPI00016621D1 related cluster
GYTPLPSEDYMSSPSEWLHALAFVGLRALTFRGLHVLTFRGQHVLALTFRGLHVLTFRRLHVLAFKGQHVLALAFVGLHALTFRGLHVLTFRGLHVLAFRGQHILAFAFVGLHALTFRGLHVLAFRGLHVLTFSGLHALAFRGLHVLHFRGLHVLVFRGLHALAFKGRHALNFRGLHAVAFRGLRVLTFIPGPPPDPGGGPTMQVQPEEEAIAQLLCIPGQYFTRATDSVQRPQCRSPPVEVLVGLCHPDIGPWGFQLWLWAPVSPTGCPFPAARSRHHDIGIVPARHLVDPKKSNR

SEQ ID NO: 146697 - protein, 167 aa, Glycine max
  Coding DNA Sequence Number=SeqID_55012
VENFLKKYFPKSKIAEGKAGISSFHQFPDESLSEALVRFRGGKIKLKTPKEATELIENMSASDHAILRDKTHQPTKKNLLELLSQPTLLRASEARLSGAFSKGGKCAESPPTFICGKRRKNRRKPVIKNIPDSGVVFTFEEGISTSHVDKSGALAPTYPPSKRKSDL

SEQ ID NO: 146698 - protein, 17 aa, Glycine max
  Coding DNA Sequence Number=SeqID_55013
MGMLYAKNERSPTGSIR

SEQ ID NO: 146699 - protein, 54 aa, Glycine max
  Coding DNA Sequence Number=SeqID_55014
MHNQVNNVKESGGTYGRSQLAQYNWDLFFQVLNPLIIPAHQSMVSTQYRALDFH

SEQ ID NO: 146700 - protein, 168 aa, Glycine max
  Coding DNA Sequence Number=SeqID_55015
MPKMGDSAKVVIKQDMKGRRHKYGFNNNEREKAQKKRVVDDETADKHQLDEILLYIKHEDLSEIAHGGQCLSISVLQLWILHLTETCMRAGNSDIYGFLEPQSIQRFHCSGHWQMVVILPKEHLVVWFCSLHNRPHNYLKGIINSAIKGLDDAPQPKSKAPARWIVVK

SEQ ID NO: 146701 - protein, 65 aa, Glycine max
  Coding DNA Sequence Number=SeqID_55016
MSKIGRFGGLGMEERRKGQEAAQGWRQPTGNRLHEYCNRLQAICSSVIDSSIHVIDYQNKTIAFS

SEQ ID NO: 146702 - protein, 40 aa, Glycine max
  Coding DNA Sequence Number=SeqID_55017
MPGHELSDWPPGVMAGRNDRAIADALQALAQAIGNPNRGE

SEQ ID NO: 146703 - protein, 95 aa, Glycine max
  Coding DNA Sequence Number=SeqID_55018
  Homolog annotation: Hit_ID=A6FJQ2; Match level="QueryCoverage=40%, HitCoverage=84%, E-value=2e-11, Identity=92%"; Hit description=50S ribosomal protein L5
MRKEKIPHQAPFAIQAAQLLGRAIGAGLFAITPAGERGMCCKAIKLGNARVDSRGSPKPSSNSIHYIIKLETLKIKVCGKLIACLVTLQQYFYGS

SEQ ID NO: 146704 - protein, 212 aa, Glycine max
  Coding DNA Sequence Number=SeqID_55019
  Homolog annotation: Hit_ID=A5B6Y9; Match level="QueryCoverage=19%, HitCoverage=8%, E-value=1e-13, Identity=83%"; Hit description =Photosystem I P700 chlorophyll A apoprotein
CRKVKEVGDLMTGEPTTEAPVNGGRNYNGPKVAKFLVGLGEIDMSVKMRTTCTWTERPYEASLFPGIGFGLFLRSLGGGQRRPPSGGARAISLPKGNGGVQRFPRARRRLALECKGRRELDCKTHPSSRDETHIDGKVWHLDVGSSPPGAVVCSKGWAVRPIKAEDREGRTSGVPVIVPTVNAGASGSTAETAMGSLPQRGWSERSFENSRE

SEQ ID NO: 146705 - protein, 122 aa, Glycine max
  Coding DNA Sequence Number=SeqID_55020
MISVGWLAFQEQGPNVKTNPLASHGGASVNAVEEDGPSRAKRLGEVVTSRRFIYQSLQAACMVSRGGDKRDECLFHLGESHDMETCPAVEELLQRLMDCRQLEVSIGGREEPQICMQSEEKK

SEQ ID NO: 146706 - protein, 133 aa, Glycine max
  Coding DNA Sequence Number=SeqID_55021
MLRTVLSFGEHGMEFHVKRPNDFDSKSFLIRMILLTYVQRIELLDSDQKMLADDIMSKETNEEEAIHSVSFDLEGSSSATRKNIRPSKSREKEGLISSMKEVAESLKEFVEVTKKKMENKKKMEIKRSSRSGT

SEQ ID NO: 146707 - protein, 191 aa, Glycine max
  Coding DNA Sequence Number=SeqID_55022
  Homolog annotation: Hit_ID=A6FJQ2; Match level="QueryCoverage=19%, HitCoverage=84%, E-value=5e-11, Identity=92%"; Hit description=50S ribosomal protein L5
MTVKTSDTCSSRRRSQLVCKRMPGADKPVRARQRMRKEKIPHQAPFAIQAAQLLGRAIGAGLFAITPAGERGMCCKAIKLGNARVFPVTTFRETCRASCINESANARGEAVCVLGALPLPRSLTRCARSFGCGERYQLTQRRLRPPDEHHKKSTLKSEVAKPDRTIKIPGVSPWKLPRALSCSDPAAYRIP

SEQ ID NO: 146708 - protein, 134 aa, Glycine max
  Coding DNA Sequence Number=SeqID_55023
  Homolog annotation: Hit_ID=A6FJQ2; Match level="QueryCoverage=28%, HitCoverage=84%, E-value=2e-11, Identity=92%"; Hit description=50S ribosomal protein L5
MTVKTSDTCSSRRRSQLVCKRMPGADKPVRARQRMRKEKIPHQAPFAIQAAQLLGRAIGAGLFAITPAGERGMCCKAIKLGNARVPSSSSNGGRIGSDLSLSMSDQQQWQAGPPHLLATAAASSGFPQQIRPSQ

SEQ ID NO: 146709 - protein, 77 aa, Glycine max
  Coding DNA Sequence Number=SeqID_55024
  Homolog annotation: Hit_ID=A5BKY7; Match level="QueryCoverage=97%, HitCoverage=14%, E-value=2e-13, Identity=52%"; Hit description =Putative uncharacterized protein
  Pfam annotation: Domain name=zf-CCHC; Domain location=41-58; Score =22.9; E_value=0.00052; Accession=PF00098.14; Description=Zinc knuckle
MEMGESALLTTAYGKNKAIKSQAYQKGNGKIPPQADIKKVAKCFFCKKKGHMKKNCPGFQKWLEKKGYAKPKETSGK

SEQ ID NO: 146710 - protein, 67 aa, Glycine max
  Coding DNA Sequence Number=SeqID_55025
MKFGYVVRNSTAHTFTVGICEIKFVEGEKESHEDNTSGGFNLFSVSLTFENSIGTVGGITEGISGNR

SEQ ID NO: 146711 - protein, 94 aa, Glycine max
  Coding DNA Sequence Number=SeqID_55026
MVGYTPSNFADMVFTDERIKVGLKKGKFSHPAWTNEKTGANEEGEDEGEARAVTAIPIQPSFPPTQQCHYSANNKPSPYPPPSYPQRPSLKQPQ

SEQ ID NO: 146712 - protein, 235 aa, Glycine max
  Coding DNA Sequence Number=SeqID_55027
  Homolog annotation: Hit_ID=Q2HW90; Match level="QueryCoverage=63%, HitCoverage=27%, E-value=9e-14, Identity=32%"; Hit description =Putative uncharacterized protein
MDGLVDLSAIDAFLVYHNHKESPIVAMLADLHDTFDRRCEKSNTRIVCCTPALYVLLVSHLFRQEVRHACPLESHCSCTEKGGANWDQLLANQEGASINWFPRWREGRVGVLISCGGFPNVPLMGTWGCISYNPVLAVRQLGYPMRVAPLEEKLTLVISRGFNKTNMETLQKVRKEWEVVRKKNKELTGSNNGPIGGYHKWFRAHMQGLDWLLSLRTAKREEVEAPEEDEEVQAT

SEQ ID NO: 146713 - protein, 154 aa, Glycine max
  Coding DNA Sequence Number=SeqID_55028
  Homolog annotation: Hit_ID=A2Q186; Match level="QueryCoverage=53%, HitCoverage=24%, E-value=3e-10, Identity=40%"; Hit description =Reverse transcriptase-beet retrotransposon, putative
MADNFLGELSQQQIQPNTEDRCSWKHDQTGYYSTKSGYDLIWEAQMGVNKNLDFVDIWKLKIPNSTQFVLDRDFSDHCPILLRSTTVDWGPRPFKVMNWWLKDKDFQKMWSLQNGVINVSKIQNLKKELNDLEAGSSIGILSQAEVDLKKSLQE

SEQ ID NO: 146714 - protein, 43 aa, Glycine max
  Coding DNA Sequence Number=SeqID_55029
MKFVGVGFFGVMMGSSTRKLVEMMGRVNLGLNESLGRANEKNE

SEQ ID NO: 146715 - protein, 173 aa, Glycine max
  Coding DNA Sequence Number=SeqID_55030
  Gene Ontology: Mol. function=aspartic-type endopeptidase activity; Biological process=DNA integration
  Homolog annotation: Hit_ID=Q2QW16; Match level="QueryCoverage=67%, HitCoverage=8%, E-value=8e-14, Identity=29%"; Hit description =Retrotransposon protein, putative, unclassified
MRLNERNSQRSTEQAMQAQTTKGNNYDVVRIRREKKSGRTISGRGQAQDEDFDSDKVLLMATTNSEEDSVNLWYLDTCCSNHMTGHREWFVNIDDKVKSKIKFADNSFVTAKGIGKGYSIQMEDSQLKMFDSNKRLILKASLSRNKTFKIGIQIAEFQCLAASISDEAGCDIT

SEQ ID NO: 146716 - protein, 76 aa, Glycine max
  Coding DNA Sequence Number=SeqID_55031
MNFDDAKEELNNAASKDKHLLQDYFKIASTNKVLFQDSLKIKHCLKTKGFKVMQGSGNRLPGNVIDYQKGRMKNSY

SEQ ID NO: 146717 - protein, 212 aa, Glycine max
  Coding DNA Sequence Number=SeqID_55032
  Homolog annotation: Hit_ID=UPI00006A2939; Match level="QueryCoverage =92%, HitCoverage=100%, E-value=6e-13, Identity=27%"; Hit description= UPI00006A2939 related cluster
MSSPSEEYTSSPLEDYTSSPSEGCTPSPLEDYMSSPSEGCTPSPSEDYIGLHILAIRGLQVLAIRGLHALTIRGLHVLAIKGLHAFTIKGLHVHTFRGLHALTFRGLQVLAIRGLHALTFRGLHVLTIRGLDALTFRRLHALAFRGLQALAFRGLHALSFRGLHVLAIRGLHALTIRGLHVLAIRGLHALNFIGLHVLTFRGLHVLAFRGPH

SEQ ID NO: 146718 - protein, 140 aa, Glycine max
  Coding DNA Sequence Number=SeqID_55033
  Gene Ontology: Cellular component=periplasmic space
  Homolog annotation: Hit_ID=A6TF91; Match level="QueryCoverage=100%, HitCoverage=75%, E-value=8e-42, Identity=60%"; Hit description =Periplasmic protein
  Pfam annotation: Domain name=DUF1795; Domain location=5-140; Score= -19.8; E_value=0.0011; Accession=PF08786.2; Description=Domain of unknown function (DUF1795)
MDGKLSFSLPAGMSDKSGKLGSESTNMHVYADETGQRAIIVIAGDPTSEGLDALAQRLEQQQRNRDPQLQVVSNKAVTLKDQPAQQLDTVISANNQTSWSSVILAKVDGKLLTLQITLPADNQQQAQSDADAIVKSITLK

SEQ ID NO: 146719 - protein, 219 aa, Glycine max
  Coding DNA Sequence Number=SeqID_55034
  Gene Ontology: Mol. function=motor activity; Cellular component=cell projection
  Homolog annotation: Hit_ID=UPI00016621D1; Match level="QueryCoverage =97%, HitCoverage=41%, E-value=2e-17, Identity=30%"; Hit description =UPI00016621D1 related cluster
GLHTLAFRGLHVLAFRGLHAIAFRALHVLTIRGLHVLTIRGLHALAFRRLHFLAFRGLCVLTIRGLQVLTFRGMHALAFRGLHVRAFRGLHTIDFRGLHVLAFRGLHALAFIELHSLTFKGLHILIFKRLHVRTFRELHALTIGGLHVLTIRGLRVLTFRGLHALAFRGLHILALRGLHVVPFRGTHALALRGLHVLAFRGLHTLTFRGLHVLAFRRLH

SEQ ID NO: 146720 - protein, 93 aa, Glycine max
  Coding DNA Sequence Number=SeqID_55035
  Homolog annotation: Hit_ID=Q6WAY3; Match level="QueryCoverage=58%, HitCoverage=2%, E-value=1e-07, Identity=53%"; Hit description =Gag/pol polyprotein
MIEPRTEKQVQGFLGRLNYIVSPPSKEVHAELHHLVGVQNGPSQVIEGSTLADYLAQQPINDYQPMHPEFPDEDIMALFEEEVEDEDRDKWIV

SEQ ID NO: 146721 - protein, 108 aa, Glycine max
  Coding DNA Sequence Number=SeqID_55036
MEFGDIVVHFNILDAMKHPSEDHSVFRAEILDQIVDDYMFDFDSLHGVVPLDVDFLESECTNHVVGSTYTSDLLYEVQAEESFSSPTLVPPTVQPPPTSELKPLPVNL

SEQ ID NO: 146722 - protein, 66 aa, Glycine max
  Coding DNA Sequence Number=SeqID_55037
ARLTGALSKGGKMCGVATNVYLWETSEKPKETGKNENSKFGECIYVDKSGALAPTYPPSKRKSDLR

SEQ ID NO: 146723 - protein, 188 aa, Glycine max
  Coding DNA Sequence Number=SeqID_55038
MVGEMLVAKAISLESSSKILQLYNDEIAWRLWELARHIQDMELTAIIYGPKRAGLETIGKDFFKEKLKFQRKKNSEVGMWRVEDVEGRRLILSKEFWRSLKKWPKNLGWDGLVRVMKTLATEEVKLQICEACSRSHLSHSPFTRALYNSMFLSMLLYDMFLNAPIGKRGSGAGGLGLGLVRDVGCFMH

SEQ ID NO: 146724 - protein, 130 aa, Glycine max
  Coding DNA Sequence Number=SeqID_55039
MTGFFGAMFLNQSMGAEGDWEIQMLDAKFWLDNRNGDTVFGLWLTSIAGYSQILVIRMPWWLKWDIRYPPKKTMLFLEGPMGIGKLCCVAAWDLAKHRAWAWINAKGKGRKFSYCEWEMNPRACLNCLTL

SEQ ID NO: 146725 - protein, 80 aa, Glycine max
  Coding DNA Sequence Number=SeqID_55040
VKKRLSFELQKVAIGLSSAVGLSAYPPLSAKDNLAEHQHQSRVLSARSNFQRHWCTAFHSAYFGKRALEAAKRNNLCIEA

SEQ ID NO: 146726 - protein, 77 aa, Glycine max
  Coding DNA Sequence Number=SeqID_55041
TNNNADRLDLPEEYGVSTTFNISDLIPFAGGADIEEEELTDLRKGPVTRAMSKRLQEDWARSVEEGPRVLMNLRIDF

SEQ ID NO: 146727 - protein, 176 aa, Glycine max
  Coding DNA Sequence Number=SeqID_55042
  Gene Ontology: Mol. function=oxidoreductase activity; Biological process=electron transport
  Homolog annotation: Hit_ID=Q60CU1; Match level="QueryCoverage=97%, HitCoverage=47%, E-value=1e-48, Identity=55%"; Hit description =Oxidoreductase, Gfo/Idh/MocA family
MAPSRMYRINRDMAHGGGAMWDIGPYAIHALRWCFGGGDKPAEPQHVIAYGKLNEHGADVVASGVLDFGPDAQGRARFGNFDVSFERGRKAEYELIGDKGWIKCHNMWAYPGDDPVISWEAGGKSETIVLPKANHFNLEIEHFSDCVLYGKPPLLTFDDARGNCKAIEAVIAALKK

SEQ ID NO: 146728 - protein, 126 aa, Glycine max
  Coding DNA Sequence Number=SeqID_55043
MGRGLRQGDPLSLFHFMTFVEGISIMQREVKIIAFKYRFTSRGGYKKNGYLSSYDRGGEMEIMNVGNLWSMSENTLPSKLISHSSFGIQFRVKDEHQRGLCKGGSCHKFGHMATNMQSTKNLSDQF

SEQ ID NO: 146729 - protein, 71 aa, Glycine max
  Coding DNA Sequence Number=SeqID_55044
MYDRCPFDEDMTKSKGKDPLEGLGGPMTRARARKAKEALQQVLSILFEYKPKFQGEKSKVVSCIMAQMEED

SEQ ID NO: 146730 - protein, 114 aa, Glycine max
  Coding DNA Sequence Number=SeqID_55045
MATTKALEQETKRARREEHGRDKFRGALWGSNSELKLRREERDQSRVDALILKDELKACSRSKRSLSQRLCETETNMLAIIIKYQEELSLATAHEHRVADEYGQVYAENEARGR

SEQ ID NO: 146731 - protein, 195 aa, Glycine max
  Coding DNA Sequence Number=SeqID_55046
MSASDHAILRDRGHQPTKKSLLELSTQVPMLAQNKLLSRKLAILKETLSCTICGGTHESSLCIPFEEQTQEGPYNQQGQWRSHPDNQFNKDQGGPSNRPPQQGPNIFQRTTKLEETLTQFMQVTMSNHKSTESTLKNLEIQVGQLAKQLAEKSSNSFGANTEKNPKEECNVVMKRNKKHMVVEDEDRVALEKQLL

SEQ ID NO: 146732 - protein, 25 aa, Glycine max
  Coding DNA Sequence Number=SeqID_55047
MTEIVCAEYDENLRVSMSLLAAIDK

SEQ ID NO: 146733 - protein, 43 aa, Glycine max
  Coding DNA Sequence Number=SeqID_55048
MDSLKQSWYVDRGSTKDMAGDALKFIHISPKNSEHVTYGDNNK

SEQ ID NO: 146734 - protein, 20 aa, Glycine max
  Coding DNA Sequence Number=SeqID_55049
MSWASSSSAFVLSGNTQDLE

SEQ ID NO: 146735 - protein, 43 aa, Glycine max
  Coding DNA Sequence Number=SeqID_55050
ECLLPPARSSGPLPIELSSRSTAPPGRCSAKHHISIGMAGSGQ

SEQ ID NO: 146736 - protein, 49 aa, Glycine max
  Coding DNA Sequence Number=SeqID_55051
MWYHGDQSGSPVFCENAPTIWDQHRLKGALKLGDPQGLHSEESVRASPS

SEQ ID NO: 146737 - protein, 73 aa, Glycine max
  Coding DNA Sequence Number=SeqID_55052
  Subcellular localization annotation: CTP_CleavageSite=50; ConfidenceScore=5.13e-01
MCIHRKWPRGNLPQRDPGRIKRPKEPVPLPSMTVTALGALNTSSVSRPSRDGHFSGSDASSSGTTSIPISRKR

SEQ ID NO: 146738 - protein, 206 aa, Glycine max
  Coding DNA Sequence Number=SeqID_55053
  Subcellular localization annotation: CTP_CleavageSite=24; ConfidenceScore=5.09e-01
VEKPGRPFGPPSNLIRRPMNSLPSVVHVSSTIESGAPRIDCLSLFAYPPSSNLIRRPMNSLPSAVHVSSTNESGAPRIDCLALFANSPFSNLIRRPMNSLPSLVHVPSVIKRGASERRRRDESRYRLITERAGRTKSVSYLCFPLISNERYLAPFVAQYVKSRDVPEIQRKQAYAIREIPPTWAFQFLPPEGGCVWRKQPCSPGRA

SEQ ID NO: 146739 - protein, 50 aa, Glycine max
  Coding DNA Sequence Number=SeqID_55054
MQVSLPGRAELAWASNPCTKWFKKGKGEGDGPRPMVHSEIMGHATLPPFP

SEQ ID NO: 146740 - protein, 107 aa, Glycine max
  Coding DNA Sequence Number=SeqID_55055
  Gene Ontology: Mol. function=serine-type peptidase activity; Cellular component=periplasmic space; Biological process=proteolysis
  Homolog annotation: Hit_ID=A6EBZ5; Match level="QueryCoverage=93%, HitCoverage=9%, E-value=3e-36, Identity=63%"; Hit description =Putative Tricorn-like protease
  Pfam annotation: Domain name=PD40; Domain location=4-37; Score=9.1; E_ value=1.3; Accession=PF07676.3; Description=WD40-like Beta Propeller Repeat
  Pfam annotation: Domain name=PD40; Domain location=46-81; Score=42.2; E_value=1.8e-09; Accession=PF07676.3; Description=WD40-like Beta Propeller Repeat
  Pfam module annotation: Pfam domain module=PD40::PD40; Domain location=4-37::46-81
FASIQVSAQEKSYFLSSPSLSPDGKTAYFAYDGDIWKVDSNGGNASRITALEGEEINPRISPDGKWLAFSSNQYGNYDVYVMPAEGGSIKQLTFHTGKDEIENWGWD

SEQ ID NO: 146741 - protein, 76 aa, Glycine max
  Coding DNA Sequence Number=SeqID_55056
MTSKLQMLITFATVVRLRPTIYQNAQNSEENPDKGIWIEPVSRAEALIPDDVILTRNRSLDTGYGDLDDATSSKGR

SEQ ID NO: 146742 - protein, 56 aa, Glycine max
  Coding DNA Sequence Number=SeqID_55057
MSASSDRDCENVLVAIRQTQESACLWGFYGGWIFELQWGPLMVIFHHGDAAEDKGK

SEQ ID NO: 146743 - protein, 293 aa, Glycine max
  Coding DNA Sequence Number=SeqID_55058
  Homolog annotation: Hit_ID=Q6WAY4; Match level="QueryCoverage=93%, HitCoverage=47%, E-value=9e-26, Identity=31%"; Hit description =Putative uncharacterized protein
MGTNQIGKRFYQVKIKGLDVTSLKELGQLMGQLQRQAFHKAYGKIWDLVMVEVSIEAIASLAQYYDQPLRCFTFGDFQLSPMVEEFEEILGCPLGGRRPYLFSGFYPSLARISKIVQIPTQELDHGKQVRNGVVGIPRKCWEAKARTLAGRGEWAPFIDIIALLVYGGVLFPNVDGLVDLAAIDAFLAYHDHKESPVVAMLADLYDTFFWRCENSSTRIVCCTPALYVWLVSPLFRPEVRHACTLENHRSSTEKGGANWGQLLASKEGASVNWFPQLKEGRIGVLISCGEFPN

SEQ ID NO: 146744 - protein, 58 aa, Glycine max
  Coding DNA Sequence Number=SeqID_55059
MTQELVARGDTLRLSAPRHSVTPSVIDEQRPMWSEFLIGGYVGARALLLSAAPQSLSY

SEQ ID NO: 146745 - protein, 52 aa, Glycine max
  Coding DNA Sequence Number=SeqID_55060
MAISRIGNGPFGASSPGVEQSTQNCETTAKGTGLAESAGKEDPVELDSSPTL

SEQ ID NO: 146746 - protein, 93 aa, Glycine max
  Coding DNA Sequence Number=SeqID_55061
MEFGHGFVNYVDCGADLCVYGQLVEEMAPKKLSTKRSRRNAAAEGSSATPEFDSQRFRSAEHQQRFEAIKGWSFHRRGSSSSERMSIRTFRRK

SEQ ID NO: 146747 - protein, 233 aa, Glycine max
  Coding DNA Sequence Number=SeqID_55062
  Gene Ontology: Mol. function=electron transporter, transferring electrons within the cyclic electron transport pathway of photosynthesis activity; Cellular component=light-harvesting complex; Biological process=...
  Gene Ontology: Biological process=photosynthetic electron transport in photosystem II
  Homolog annotation: Hit_ID=P56778; Match level="QueryCoverage=100%, HitCoverage=53%, E-value=1e-115, Identity=83%"; Hit description =Photosystem II 44 kDa reaction center protein precursor
  Pfam annotation: Domain name=PSII; Domain location=1-233; Score =143.2; E_value=7.4e-40; Accession=PF00421.10; Description =Photosystem II protein
VDDLEDIIGGHVWLGSICILGGIWHILTKPFAWARRALVWSGEAYLSYSLGALSVFGFIACCFVWFNNTAYPSEFYGPTGPEASQAQAFTFLVRDQRLGANVGSAQGPTGLGKYLMRSPTGEVIFGGETMRFWDLRAPWLEPLRGPNGLDLSRLKKDIQPWQERRSAEYMTHAPLGSLNFRGWRSYRDLMQSIMFLLEVGHLWHAGRARAAAAGFEKGIDRDFEPVLSMTPLN

SEQ ID NO: 146748 - protein, 142 aa, Glycine max
  Coding DNA Sequence Number=SeqID_55063
EPAMYNYHEKGRALDLESVLANFMTYQASSKEGLSNLDDLLMQFKDTVDSMQQAFKRTETQIGKLVDDMTKVVVKREEDSPEYPCMANAGYVVGKDKGRLELSVEDQKISFDLFEAMKHSNMGDVCVEEEVEQEIALSASTM

SEQ ID NO: 146749 - protein, 72 aa, Glycine max
  Coding DNA Sequence Number=SeqID_55064
KLEASLGELRSRKTKEKTFLPPFVCEARLTGASSKGGKCAESPPTKVDKSGALATTYPPSKRKSDLRSSFLR

SEQ ID NO: 146750 - protein, 104 aa, Glycine max
  Coding DNA Sequence Number=SeqID_55065
MKIIFSKNFPLVIDYNVCVIDYTVEFGKGLRLLNLNFQCFVAGNRLHVENSNSKHFSTAISQPCLLKGYLAKISYKATVESYMTKKRSHLSHARGDLLQCPYWK

SEQ ID NO: 146751 - protein, 29 aa, Glycine max
  Coding DNA Sequence Number=SeqID_55066
MMCKNKYKHVGLPNRCPMLKRYSLSNNAH

SEQ ID NO: 146752 - protein, 166 aa, Glycine max
  Coding DNA Sequence Number=SeqID_55067
MGEVEEVQEKMKADMEAMKEQIATMMEAMMSMKKIMEANAVIVAATGAVAKVNPMLPSGLKQMNHPTSNMVGKDLGSTDDPMMCKFKTSTPSRIWLASQTIHHPMWCIFPMRMSITPLPYSLRANNLNLIMHMSLDPWRRHMKFPTTIYLTSSLGSDMPLKGKQLV

SEQ ID NO: 146753 - protein, 80 aa, Glycine max
  Coding DNA Sequence Number=SeqID_55068
  Homolog annotation: Hit_ID=A0ST23; Match level="QueryCoverage=33%, HitCoverage=55%, E-value=2e-08, Identity=100%"; Hit description =Putative reverse transcriptase
MKGECRESFSRMPIKLIDTVDLEGGPVGKPVVPAALMNRPTRGERRFAYWALAECILAYYVGTDEGVSEVLHVAGEKRLH

SEQ ID NO: 146754 - protein, 105 aa, Glycine max
  Coding DNA Sequence Number=SeqID_55069
MSPVESPTVTTYPSAGGRRVTRGMRVPRKEYARSRHQRLFEENVGKTGKDVIYELLSERFGSCIYARGRRETLRHWTINDLLGWSTKAGLLLLPILNCDEEIRPT

SEQ ID NO: 146755 - protein, 47 aa, Glycine max
  Coding DNA Sequence Number=SeqID_55070
MHSRPMFVWRLPVWEIPEWMAPWLALEEPVLILCLYFILPLGRFLMP

SEQ ID NO: 146756 - protein, 119 aa, Glycine max
  Coding DNA Sequence Number=SeqID_55071
  Homolog annotation: Hit_ID=Q1J7G7; Match level="QueryCoverage=24%, HitCoverage=41%, E-value=2e-09, Identity=96%"; Hit description =Transposase
MVKVGTSYVPINVSFSPKVGPGLPGINRDTRIYLFLRSDLPSQVLQWLLFLSAVPPVQLLTGWCVTAKAPPGHQRWQAAQLLGRAIGAGLFAITPAGERGMCCKAIKLGNARVFPVTTL

SEQ ID NO: 146757 - protein, 247 aa, Glycine max
  Coding DNA Sequence Number=SeqID_55072
  Homolog annotation: Hit_ID=Q6UUU1; Match level="QueryCoverage=24%, HitCoverage=40%, E-value=3e-18, Identity=78%"; Hit description =Putative uncharacterized protein
  Subcellular localization annotation: CTP_CleavageSite=42; ConfidenceScore=5.15e-01
GTSYVPINVSFSPKVGPGLPAVPPVQLLTGWCVTAKAPPDISAGKCSGRVPFAIQAAQLLGRAIGAGLFAITPAGERGMCCKAIKLGNARVFPEFDPPSTRMGPSFYQTCLDSVITLCSGRLPACLTFGFIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 146758 - protein, 140 aa, Glycine max
  Coding DNA Sequence Number=SeqID_55073
LAPYTSEPYNAQWNAPGLLCDKHTLRSSRILGEMEVDEPWLGLWLPLNYQVDMGSSLAYDNGIWGGLRHWKCGRQTLVDLGMAFVDNWVVVTALGISPVFAHPLNLPPVFSVVLKVGLIKFVTPILGSHFVSGGENENLK

SEQ ID NO: 146759 - protein, 83 aa, Glycine max
  Coding DNA Sequence Number=SeqID_55074
MTDLVSAEDDVNLRVTTGLSPAIAEGCRRRHDVNLHVSPTGSDQRSFEKDAEDDESLAWLFSTKRNVYTRQIFPPERDFKCSI

SEQ ID NO: 146760 - protein, 379 aa, Glycine max
  Coding DNA Sequence Number=SeqID_55075
  Homolog annotation: Hit_ID=A5B5G7; Match level="QueryCoverage=56%, HitCoverage=14%, E-value=5e-07, Identity=24%"; Hit description =Putative uncharacterized protein
MASRKRKAPSTPTQARIDRSRFTFQEAWVRYTDIIVPRKLLLERNVVVYTTKFDEFLDELDRRHWREELTDFLDSNIDVAIVKEFYANLYAPEDKSPKQVRVRGHLIKFDEDTLNTFLKTPVVMEEGETLCAYSRFALLRPDPQELAAKFCIPGRFELNADGQSLKILRKNMTTLAHTWSILSISNLIPTSHTSDVTLDRAKLIYGIIMKMDMNVGGPRKARGKRSEAPSTSAPLEAPTPSSSPIPPSSSTQILVIPPAPPQMLYSMLQSIHRGKSIIMQSLQGLGLPSIMSMEEFETQVAWPGDQPSSSGGGGASAAQEPDTKEPPAPTPAEEETTPDQTPQPYLAPAHIPEDVAPVAEPEQLIQDSSAAPALDLNED

SEQ ID NO: 146761 - protein, 390 aa, Glycine max
  Coding DNA Sequence Number=SeqID_55076
  Gene Ontology: Mol. function=methyltransferase activity; Biological process=tetrapyrrole biosynthetic process
  Homolog annotation: Hit_ID=A6TGI6; Match level="QueryCoverage=93%, HitCoverage=93%, E-value=1e-134, Identity=70%"; Hit description =Uroporphyrinogen III methylase
  Pfam annotation: Domain name=HemX; Domain location=8-373; Score =602.5; E_value=4.1e-178; Accession=PF04375.5; Description=HemX
MTEQQNQSAVVEETREAVETTPQPENNEKKKAGNKTSLALSAIAIAIALAAGIGLYGLNKQQVTRQNETSSELASQLAALQKAQDSQKSELESVIKQQADQLSEAKREQETLTKQLDELQQKVAVISGSDAKTWLLAQADFLVKLAGRKLWSDQDVTTAAALLKSADASLADMNDPSLIGARRAITDDIASLSAVSQVDYDGIILKVNQLANQIDNLRLADNNDDDSPMDADSDELSSSIGEWRVNLQKSWQNFMDSFITIRRRDETAVPLLAPNQDVYLRENIRSRLLVAAQAVPRHQEETYKQALENVSTWVRAYYDTEDATTKAFLEEVDKLSQQSITMSVPETLQSQSLLEKLMQTRVRNLMAQPAAAAPTPAPAATAPAPAPQGE

SEQ ID NO: 146762 - protein, 139 aa, Glycine max
  Coding DNA Sequence Number=SeqID_55077
MVAITLAKVHQPPFLREYDSNATCACHGEAPGRSIEHCRALKRKVQVQAIGLFAQATCALEFGLPRPFNQRLLVLHVGGGAVKQRGQPFPCVQESSTTRDPRSLNPFSEIRRREEEISLKRDRLYNEDQSKFLIEYASV

SEQ ID NO: 146763 - protein, 59 aa, Glycine max
  Coding DNA Sequence Number=SeqID_55078
THLLLEVASPLSLPFSIPLPFIFQEAKESIDEEDPRPTSSNGACISMAVLRDVSLDRGR

SEQ ID NO: 146764 - protein, 52 aa, Glycine max
  Coding DNA Sequence Number=SeqID_55079
MREKLATQLAQASKVASSRSNTLLEEGSRRPKWARLLFAPPFLLSAPPFYFF

SEQ ID NO: 146765 - protein, 157 aa, Glycine max
  Coding DNA Sequence Number=SeqID_55080
MHDAPRKTISLLFPWHTPSCGPHYWKIIWWWPYPGRSSSHHTPSGTTRMPSVHTIVEPPDTTLTPACRSKEGPNVKTNPLASHGGASINAIEKDGPSGAKRLEDVATSRRYIYQSLQAACMVSRGGDERDECLFHLEESHDMETCPTVEELLQWLMD

SEQ ID NO: 146766 - protein, 106 aa, Glycine max
  Coding DNA Sequence Number=SeqID_55081
KYAPPPTDSDVIYSLQGSCPQHTSGPEEGQQGLGVANSKYGSLSIQGSACCPQQGHQAPYKSSFHQEVLRPQAGAGRNTTAALGWPVAGNRHTATTSRVHLSSSIK

SEQ ID NO: 146767 - protein, 78 aa, Glycine max
  Coding DNA Sequence Number=SeqID_55082
MEVKHKRYATNTLDSSLHAMWYHFSVKNLVGRLGVHDETCLTMGRPVRVTLFCENAPIIWDQHRLKGALKLGVFTHKA

SEQ ID NO: 146768 - protein, 150 aa, Glycine max
  Coding DNA Sequence Number=SeqID_55083
VVPYVVVLMNSAFAFLLKSKRKRLATWGINKGRDTIKVDSQDSSRVLTTNKESGDHTLTINSTKTRVTMSNHKSTKSTLKNLKIQVGQLAKHLAEKSSNSFGANTEKNPKEEYDVVMTRKKKCLVVEDEDRVALEKQIVVKDGIERNKEE

SEQ ID NO: 146769 - protein, 179 aa, Glycine max
  Coding DNA Sequence Number=SeqID_55084
MFLLYQLNIFRFTFAFVNYTVIYKTKVERKDIELVDEEEAHIGADRSSATSNKSEIYKEEARNATQKHKPKRVESVNADAEAFAEALEHTKKRDTGHRSVLLENKTGDSTVLKIGDSTKVVIKQDMKGRKHKYGFNNNKHEKTEKKRVVDDETGDKHELYEVLRIPSKRKYRCLNQRKM

SEQ ID NO: 146770 - protein, 89 aa, Glycine max
  Coding DNA Sequence Number=SeqID_55085
MAPRKLSTKRSRRDAAAEGISAALEFDNHRFRSAEHQQRFEAIKGWSFHRERRVQLRDDEYEDFQEEIARRRWTSLVTPMAKFDSDIVL

SEQ ID NO: 146771 - protein, 128 aa, Glycine max
  Coding DNA Sequence Number=SeqID_55086
MAAQLIHDRVVMECLEGVWETFEGNESTSGGTRTHTSADCGVDTTYTTPYRLVESVQVIEVSSSEEDPEEDLEELPPEPAVDALDFPEDDEDPLPDVDSPEDIMSASGADSTEESGPRGTASSEDSSS

SEQ ID NO: 146772 - protein, 98 aa, Glycine max
  Coding DNA Sequence Number=SeqID_55087
  Homolog annotation: Hit_ID=Q2HW90; Match level="QueryCoverage=65%, HitCoverage=13%, E-value=2e-08, Identity=45%"; Hit description =Putative uncharacterized protein
MEPLQMQSFRKTYGKILELTIAEVSIEAIASLTQYYDQPLRCFTFGDFQLVPTIEEFEEILGCPLGGRKTIFFLRDVSPSLSRIATVVKGFRKEVWTA

SEQ ID NO: 146773 - protein, 366 aa, Glycine max
  Coding DNA Sequence Number=SeqID_55088
  Homolog annotation: Hit_ID=Q6WAY6; Match level="QueryCoverage=94%, HitCoverage=61%, E-value=4e-37, Identity=31%"; Hit description =Putative uncharacterized protein
MGTNQIGKRFYHVKIKGLDVTSLKELGQLMGQLQRQAFRKAYGKIWDLAMVEVSTEAIASLAQYFDQLLRCFTFGDFQLSPMVEEFEEILGCPLGGRRPYLFSGFYPSLARISKIVQISAQELDHGKQVKNGVVGILRKCLEAKARTLAGRGEWAPFIDILALLIFRGALFPNVDGLVDLAAIDAFLAYHDHKESPVVAMLADLYDTFDRRCEKSSTRIVCFTRALYVWLVSHLFRQERKEGQIGTDFLANKEGASVSWFLRWKEGGTEVLISCEGFPNVALMGTRGCISYNLVLAIRQLGYPMRGTPLEEELTPVISRGSNKTNVEVLQKVRKAWEAVQKKDKELRGSNNGPIGGYHKWLKAHVQ

SEQ ID NO: 146774 - protein, 104 aa, Glycine max
  Coding DNA Sequence Number=SeqID_55089
MPISPCRCIGWDRAHKTSSGPEEVQQGPGVSSSGCGPLSVLQGTRSPSEESRPQRHPVDPEKSNRALGFPALVTGLCSPTGCPFPPARSRHHDIGKYAPRSTDF

SEQ ID NO: 146775 - protein, 187 aa, Glycine max
  Coding DNA Sequence Number=SeqID_55090
IRRSKSLAVVDHTAFRAPCHPEAAGPRAGSPRRHLTVIRTLSVIDKRRPIWSSAPFPEMIRRSKSLAFVGRPIILSETLKGHVTCTLVSSRGGGPDDTRRYLMVIRTLVSSRGGGPDDTRRSKFRSIRTLVLSRGGGPDDTQENLRLSAPFCRPEAAGPMIPGDTLRLSAPLCHPEAAGPMIRGDTL

SEQ ID NO: 146776 - protein, 235 aa, Glycine max
  Coding DNA Sequence Number=SeqID_55091
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=36%, HitCoverage=71%, E-value=1e-23, Identity=68%"; Hit description=LacZ protein
MKHFTDTLISANIGTKAGTGPPLEVDGIDKLDISRKHHHLGRSRPVLEGSAPGHAANTTFYLLSRYLVHGHCRKTPWHATELGLRQGPYLRAFLHKKPSSWGKLLNSAEWSSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 146777 - protein, 54 aa, Glycine max
  Coding DNA Sequence Number=SeqID_55092
ASVFNYGRLDILRDTIGHPSQNGRHRGGAPIRPIVSRITIHWPSFYNVVTGKTL

SEQ ID NO: 146778 - protein, 30 aa, Glycine max
  Coding DNA Sequence Number=SeqID_55093
MKLEEEVVLRALDESFWSSLVPQEEFEDDA

SEQ ID NO: 146779 - protein, 165 aa, Glycine max
  Coding DNA Sequence Number=SeqID_55094
  Homolog annotation: Hit_ID=Q2HW90; Match level="QueryCoverage=96%, HitCoverage=37%, E-value=6e-15, Identity=32%"; Hit description =Putative uncharacterized protein
GLDITNIKELGRLMGPLQMQAFRKVYGKILDLTIAEISTEVMVSLTQYYDQPLRCFMFGDFQLVPTVEEFEEILGCPFGGRKLYLFSGFLPSLSKIAVVARDMANQEEWVPFMDILALLIFGVVLFPNMDGLVDLAAIDDFLEYHHSKESPVVAILADLFDTFDR

SEQ ID NO: 146780 - protein, 73 aa, Glycine max
  Coding DNA Sequence Number=SeqID_55095
MTTKENDKKKKGIALKASSSIQEESDKEDLNEIEEDDDFSFFVKRFNKFLRNKGNQRRSNFKPKKSIFYSKVL

SEQ ID NO: 146781 - protein, 109 aa, Glycine max
  Coding DNA Sequence Number=SeqID_55096
MTILQTTLSLVILHPCDHPEAAGPMIRGDTLRLSAPFCHPEAAGPMTSRDQVWSFCTLVSSRGGGPDDTQRYLTVIRTLLSSRGGGPDDKQRPSLVILHPCIIQRRRAR

SEQ ID NO: 146782 - protein, 35 aa, Glycine max
  Coding DNA Sequence Number=SeqID_55097
MKDLGLRILCMENKWVYDPNMVGSWCLTHATKNVA

SEQ ID NO: 146783 - protein, 103 aa, Glycine max
  Coding DNA Sequence Number=SeqID_55098
MGWTAHMSKYDYDTDHEKLDSNLIATCIVSYPNFVRGPLLDDVRPFFGPREHPGPLGPSGIFLQKAVASGGSNPARLGELGGNHLPYFAINRGGRQEGRGSAP

SEQ ID NO: 146784 - protein, 339 aa, Glycine max
  Coding DNA Sequence Number=SeqID_55099
  Gene Ontology: Mol. function=DNA-directed RNA polymerase activity; Cellular component=chloroplast; Biological process=transcription, DNA-dependent
  Homolog annotation: Hit_ID=Q8HVY4; Match level="QueryCoverage=100%, HitCoverage=61%, E-value=1e-168, Identity=75%"; Hit description=DNA -directed RNA polymerase subunit beta'
  Pfam annotation: Domain name=RNA_pol_Rpb1_1; Domain location=5-162; Score=-105.4; E_value=1.2e-05; Accession=PF04997.3; Description=RNA polymerase Rpb1, domain 1
  Pfam annotation: Domain name=RNA_pol_Rpb1_2; Domain location=164-268; Score=113.2; E_value=7.6e-31; Accession=PF00623.11; Description=RNA polymerase Rpb1, domain 2
  Pfam module annotation: Pfam domain module=RNA_pol_Rpb1_1::RNA_pol _Rpb1_2; Domain location=5-162::164-268
MDSSLIEWKELGEEGSPDNENEWEDRKVGRRKNFLVRRIELAKHFLRTNIEPEWMVLCLLPVLPPELRPIIQIDGGKLMSSDINELYRRVIYRNNTLIDLLTTSRSTPGELVMCQEKLVQEAVDTLLDNGIRGQPMRDGHNKVYKSFSDIIEGKEGRFRETLLGKRVDIRVVCHCVGIAKSKIREKEPIVWEILQEVMQGHPVLLNRAPTLHRLGIQAFQPILVEGRAICLHPLVCKGFNADFDGDQMAVHVPLSLEAQAEARLLMFSHTNLLSPAIGDPISVPTQDMLIGLYILTSGNRRAYQQKRINFDSPLWLRWRLDQRIISSREVPIEVHYESL

SEQ ID NO: 146785 - protein, 129 aa, Glycine max
  Coding DNA Sequence Number=SeqID_55100
MNSLNEHAALSEFINTYCIRVLSRAQDSASPSQGRQRSHRSEPLIKRKRVVETQEAAATSKKSLEATSEPSEPVADTTSIQQAADPFAPEDQTTPVLSPNTSPLATPVLPLTDEEDVRTSDTQDRSQDF

SEQ ID NO: 146786 - protein, 200 aa, Glycine max
  Coding DNA Sequence Number=SeqID_55101
  Gene Ontology: Mol. function=motor activity; Cellular component=cell projection
  Homolog annotation: Hit_ID=UPI00016621D1; Match level="QueryCoverage =97%, HitCoverage=40%, E-value=2e-20, Identity=35%"; Hit description =UPI00016621D1 related cluster
PIAFRGLHVLTFRGLHALTIRGLHALAFRGLHVLTFRGLHILAFKVLHVLTIRGLHVLTFRGLHVLTFRGLHVLTFRGLHVLAIRGLHALAFRGLHVLTFRGLHVLTFRGLHILAFRGLHVLTFRGLHVLAIRGLHVLAIRGLHILAIRGLHVLAIRGLHVLAIRGLDVLAIRGLHALTFRGLHVLTFRGLHALTFRGLH

SEQ ID NO: 146787 - protein, 147 aa, Glycine max
  Coding DNA Sequence Number=SeqID_55102
MERSMIDAASGGALGDMTPAEARNLIEKMASDSQQPPQPQQQNQPQQNNYDLSSNRYNPGWRNHPNLRWSSPSQQQQQQQQPYFQNVAGPSRPYVPPPIQQQQQKQQPQQPQKQQTVEAPPQPSLKELMRQMTMQNMQFQQEIGASI

SEQ ID NO: 146788 - protein, 95 aa, Glycine max; identical to SEQ ID NO: 109893
  Coding DNA Sequence Number=SeqID_55103
  Homolog annotation: Hit_ID=A0PAV3; Match level="QueryCoverage=40%, HitCoverage=17%, E-value=5e-07, Identity=76%"; Hit description =Restriction endonuclease

SEQ ID NO: 146789 - protein, 286 aa, Glycine max
  Coding DNA Sequence Number=SeqID_55104
  Gene Ontology: Biological process=transposition, DNA-mediated
  Homolog annotation: Hit_ID=Q6UUU1; Match level="QueryCoverage=20%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPVTTLANWSSTAVAAALELVDPPGCRNSINHDTWGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 146790 - protein, 258 aa, Glycine max
  Coding DNA Sequence Number=SeqID_55105
MAPPKEIATIIYHTGHIVDDPVQGSMYTSVNPIFFYVICSITFIQFIRKINNRLPAQATEQVAQLLFRVPISFHLGQTRFISAQLFDNDDLRGAMETFLQNPQLNSAEFYAVIDLISQPQPSSPQPSCPQLQLPPPQQLLYNNIDLNNPTPLTFILHTHNYYPKMILFFMPNKPPLANKTILHPPFTPPSQLPQTQTSNRDEHLIANEDPIIRFHDENMDDFSEDEDQKFFDHINHQSDDQIDDEGVGRPTTPPSPPL

SEQ ID NO: 146791 - protein, 127 aa, Glycine max
  Coding DNA Sequence Number=SeqID_55106
MHKALRANAPLSYPQLVTLFLRHFQIPLDNEPFVQVKRSFAIGDGAVTSFGNRKDRDGKWLKKGALPPQDERTPSPPPQRDDSSTLMNEVLSELRGLRTYVGMDTRITQLEEDVGYLCRCFVLPPPS

SEQ ID NO: 146792 - protein, 16 aa, Glycine max
  Coding DNA Sequence Number=SeqID_55107
MVIFHHGVAAEDKGEE

SEQ ID NO: 146793 - protein, 118 aa, Glycine max
  Coding DNA Sequence Number=SeqID_55108
  Homolog annotation: Hit_ID=Q1J7G7; Match level="QueryCoverage=22%, HitCoverage=38%, E-value=5e-08, Identity=100%"; Hit description =Transposase
ALFLSAVPPVQLLTGWCVTAKAPPDISAGKCSGHAARRVPFAIQAAQLLGRAIGAGLFAITPAGERGMCCKAIKLGNARVFPVTTLANWSSTAVAAALELVDPPGCRNSIHYGMVLSS

SEQ ID NO: 146794 - protein, 105 aa, Glycine max
  Coding DNA Sequence Number=SeqID_55109
MPFCGRAKARLTGALSKGGKMRGVATNVYLWKTSEKPKETGQNENSKFESCIYVDKSGALAPTYPPSKRKSDLRSSFLRVNHTISFYLKGDHLKVLDLKNDPLTW

SEQ ID NO: 146795 - protein, 271 aa, Glycine max
  Coding DNA Sequence Number=SeqID_55110
  Homolog annotation: Hit_ID=Q2HW90; Match level="QueryCoverage=65%, HitCoverage=44%, E-value=2e-14, Identity=26%"; Hit description =Putative uncharacterized protein
PLRCFIFRDFQLSPMVEEFEEILGCPLGGRKPYLFSGFYPSLARISKKVQISAQELDRQRQVENGVVGIPRRYLEGVLFPNVDGLVDLAAIDVFLAYHNHKESPVVAMLADLYDTFDRRCEESNARIVCCTPALYVGLVSHLFLQEGGSVNWFPRYKEGRIRILSSCEGCPNVPLMGTRDRELRGSSNGIIGGYHKWLRVRTQGLDWLPNLKTVREDEVKASEESDEVQALKAELERARVVEEKFKSIAIKGSNSKLKLRRGERNHHGSKA

SEQ ID NO: 146796 - protein, 386 aa, Glycine max
  Coding DNA Sequence Number=SeqID_55111
  Homolog annotation: Hit_ID=Q84VH5; Match level="QueryCoverage=100%, HitCoverage=62%, E-value=1e-162, Identity=73%"; Hit description =Envelope-like protein
VPTSSTPNAEVLSSYSKEESTEEEDQDTEETPAPRAPEPAPGDLIDLEEVESDEEPIANKLAPGIAERLQSRKGKTPITRSGRIKTMAQKKSTPITPTTSRWSKVAIPSKKRKEISSSDSDDDVELDVLDIKRAKKSGKKVPGNVPDAPLDNISFHSIGNVKELGRDALDCKEIMDLIKAAGLLKTVTKLGDCYESLVREFIVNIPSDITNRKSDDYQKVFVRGKCVRFSPAVINKYLGRPTEGVVDIAVSEHQIAKEITAKQVQHWPKKGKLSAGKLSVKYAILHRIGAANWVPTNHTSIVATESFAVKLPIAFPTVLCGIMLSQHPNILNNIDSVMKRESALSLHYKLFEGTHVPDIVSTSGKAAASGAVSKDALIAKLKDTCK

SEQ ID NO: 146797 - protein, 64 aa, Glycine max
  Coding DNA Sequence Number=SeqID_55112
MYSPALIENNANRRRPGKMTDRGRLGFFVRAVPRLCFGRHWHVLIYSARKRLAHLGKKNVIHRH

SEQ ID NO: 146798 - protein, 357 aa, Glycine max
  Coding DNA Sequence Number=SeqID_55113
  Gene Ontology: Cellular component=mitochondrion
  Homolog annotation: Hit_ID=O47882; Match level="QueryCoverage=75%, HitCoverage=88%, E-value=5e-85, Identity=54%"; Hit description =Putative uncharacterized protein orf1
  Subcellular localization annotation: CTP_CleavageSite=40; ConfidenceScore=5.19e-01
DTRPFSWESFSTQCCLARTDVMSVLFMKDRSVTRSAVMVRVTNGTDMRQLRGITSQGVTHDKDGGKRPVLLPETNNKQNIMKRIGLSAVPEVLSKIEQNYDVFTITDKFRNLSLKDSSASSSNHSFVSTLTPTASLLERFKIRTNPSAFTRNVIEMTKAPFFDIKNPIINLTEKANNYMMSIGFRFMPGQGEFLIKDLRAPDTLGISDSVSNSMESLASRVLVEVITFNEGYYGRFLILVQMGIGCTVWYGFVPGDGINMPIEGLNTLFSPIENYDTIFTNPDAHVIPGFNKMTLIEGVNNPAAPLSQAFAQDRPFMDMDIEIPDSNKSIIIGVSLGLAVAILFTFGINPCCGEVIV

SEQ ID NO: 146799 - protein, 71 aa, Glycine max
  Coding DNA Sequence Number=SeqID_55114
MKFGNLLEQVSALRHESFLLQNLNNEVLLSPIALKVVGPLLLDSNSSRDGTNPPSNSLYGNPQTRKQRDNQ

SEQ ID NO: 146800 - protein, 42 aa, Glycine max
  Coding DNA Sequence Number=SeqID_55115
MAISDSFTVGSFQRKKLEESQRTARDAAIAVWKHVSPLRGKG

SEQ ID NO: 146801 - protein, 172 aa, Glycine max
  Coding DNA Sequence Number=SeqID_55116
MVPRPPPDIRGRPIVRAHPEREAVTHLLCIPRQDFTCAAAKRRVRIMRTNMTTLTWIWMTLLFSNILPSDHNANLPLQMYQLGSRPQDAQWTRRCPTGLWGFQLWLRASVSPTKCPFPPARSRHHDIGIAPARYPVDPKKSNRFLELPSSNYGPLSVLWSACRPQQGHQAPY

SEQ ID NO: 146802 - protein, 56 aa, Glycine max
  Coding DNA Sequence Number=SeqID_55117
MKHFTDTLISANIRITISHRKQRMTMITPSAELTRPRNKRCFWLPGPPRRRLNRIG

SEQ ID NO: 146803 - protein, 66 aa, Glycine max
  Coding DNA Sequence Number=SeqID_55118
CFVSKRPFRGNTGSNKIEENHSKCINLTQHVGLLTVNGSFFLGDPTVPSSEGKDGNSHPGSRFMVI

SEQ ID NO: 146804 - protein, 90 aa, Glycine max
  Coding DNA Sequence Number=SeqID_55119
MAVGYDVCMIHDFEGELYEYDLEGETAAEDECCKLLEDAAQKADVTRDVLTSWRRLVDLQLEEFPLCLITLIMEVADPTCITARTCSGSV

SEQ ID NO: 146805 - protein, 46 aa, Glycine max
  Coding DNA Sequence Number=SeqID_55120
MKGNQQRVPSGVANCRNLPFGGRATRDSRDACSTKGIRVESPPTFI

SEQ ID NO: 146806 - protein, 243 aa, Glycine max
  Coding DNA Sequence Number=SeqID_55121
  Subcellular localization annotation: CTP_CleavageSite=30; ConfidenceScore=5.13e-01
MASFSQLQSQMQSQGLAVPPEPLVGPSGPRVSTKGSCVDHSGNDPETSDSDRCGLYIETYHARLVAMGRVYEGSLIVHNTPLLPGQVKVSVEEVTDVDAPVPVPTDEIIVSPAKPPLKPDPEVDDPLYLMTLTIPELFSRPCQVRWDATVFGVFNPDFPLYIKHEDLSKIAHGGQCLNISVLQLWILHLTETCMRVGNSDIHGFLEPQSIQRSGQSQFESESYIKSRMYSSQRDVYLGAYPNG

SEQ ID NO: 146807 - protein, 65 aa, Glycine max
  Coding DNA Sequence Number=SeqID_55122
MEDLLHKTIQVEKQLKRKERGVPMSSSMRFFIVIHLFICSPEHKFKIITGSKHNNTQGVSYHSPS

SEQ ID NO: 146808 - protein, 249 aa, Glycine max
  Coding DNA Sequence Number=SeqID_55123
  Gene Ontology: Mol. function=phosphopantetheine binding; Cellular component=nucleus; Biological process=metabolic process
  Homolog annotation: Hit_ID=A5FI38; Match level="QueryCoverage=95%, HitCoverage=77%, E-value=3e-70, Identity=39%"; Hit description=Amino acid adenylation domain
  Pfam annotation: Domain name=PP-binding; Domain location=36-99; Score= 38.8; E_value=2e-08; Accession=PF00550.16; Description=Phosphopantethe ine attachment site
MKKIRVWWCTIKSLPEVSSEDLITTEYVAATSKEEKVLVSVCEQVLKHSPISIRDNYYNLGGDSIKSIQIVSRLRQQGYSLKVEHILQYPVLEELACYMTTDVAKIDQSEVTGESILTPIQRYFFESEGITNKNHYNQSVILKSSERLSASVLETSLKCLVEHHDALRMVYSHKDGKWNQYNSGIDGVHYRLASFDIRDSGSESEELFQLQQIGKDLQSTINIESGVLFHVGHVSMSDGDRIILVVHHL

SEQ ID NO: 146809 - protein, 78 aa, Glycine max
  Coding DNA Sequence Number=SeqID_55124
MAAEWRRKRERRCHFKEKMSLEEAHHHRRPWIRAWRKKEMNERRGREEHEILCSKRALKFEMSYRMSRHHASAHADYI

SEQ ID NO: 146810 - protein, 218 aa, Glycine max
  Coding DNA Sequence Number=SeqID_55125
ASSLNFERLDILPDSIGHPSKKLLSFEFPTSFRFQFGASRYITGLNQTSVYKVIVNSIFSELRISILSVSIYYGTQSDIRVKSYCRLNLIRASVFNLEHLDILRHSLGHPSKNLLSFEFFKSFRFQFGASRYITGLNQTSVYKVIVISIISELLVSILSVSIYYPIQSDIRVKSYCHLNFLRASVFNLEHLDILHDSTGHPRIMLLSIQFSQSFGSKF

SEQ ID NO: 146811 - protein, 190 aa, Glycine max
  Coding DNA Sequence Number=SeqID_55126
  Gene Ontology: Mol. function=chitin binding; Cellular component =extracellular region; Biological process=chitin metabolic process
  Homolog annotation: Hit_ID=UPI000069F178; Match level="QueryCoverage =66%, HitCoverage=45%, E-value=2e-09, Identity=31%"; Hit description =Mitochondrial antiviral-signaling protein (Interferon-beta promoter stimulator ...
  Homolog annotation: Hit description=protein 1) (IPS-1) (Virus-induced- signaling adapter) (CARD adapter inducing interferon-beta) (Cardif) (Putative NF-kappa-B- activating protein 031N).
MLVRMIHTRLFAVARVKPCPGMHSSCAIAFLWLCSHSWPSFEIKGWPGKKNGRREITGQRTLNPLKVWIWSPLKVRTRSPQKTRESAALRSPLKVRACSPLKVRVCSPLKARTGSPLKVRACNPLKARTCSPLKVRTCSPLKVRVCNPLMARKCSPLKVMACSSLKARTCSPLKVNVHDPLKARTCSPLK

SEQ ID NO: 146812 - protein, 196 aa, Glycine max
  Coding DNA Sequence Number=SeqID_55127
VSEENFEAPEEDEEVQALKSELGKAKLAKEKFKLAATHVRKECAGLREENAITARALEQETKRARKEEYGRNKFRGALWGSNNELKLRREERDQSRAHNMVLKEELIACSRSKRSLSQRLCETETNMLAIIAKYEEELGLATAHEHRIADEYAQVYAEKEARGRAKAMADTYSTPEEIHGLLGYCQHMIDLMGPHN

SEQ ID NO: 146813 - protein, 159 aa, Glycine max
  Coding DNA Sequence Number=SeqID_55128
  Gene Ontology: Mol. function=iron-sulfur cluster binding; Cellular component=mitochondrion; Biological process=biotin biosynthetic process
  Homolog annotation: Hit_ID=Q9APS8; Match level="QueryCoverage=96%, HitCoverage=44%, E-value=2e-76, Identity=92%"; Hit description =Biotin synthase BioB
MEVEQVLESARQAKNAGSTRFCMGAAWKNPNDRDMPYLEQMVKGVKALGLESCMTLGTLTDSQAQRLAGAGLDYYNHNLDTSPEFYGNIITTRTYQERLDTLDKVRDAGIKVCSGGIVGLGETVNDRAGLLLQLANLPTPPESVPINMLVKVKVYAAGG

SEQ ID NO: 146814 - protein, 278 aa, Glycine max
  Coding DNA Sequence Number=SeqID_55129
  Homolog annotation: Hit_ID=Q6WAY4; Match level="QueryCoverage=60%, HitCoverage=30%, E-value=1e-21, Identity=35%"; Hit description =Putative uncharacterized protein
MGSVLIPTVNKPTEGPYRLLKNVRLGISLPLDVVSKKGTNSPDPRIPRLHLCHMHSIMHSSIPPMRYRSFDLHQLLSHFSKHGNKSNWQEVLPSQGQKPDTTSIKELGRLMEPLQMQAFRKTYGKILELTIAEVSIEAIASLTQYYDQPLRCFTFADFQLVPTIEEFEEILGCPLGGRKPYLSSGCLPSLSRIATVVKDSARGLDRIKQTRNGIAGLPQKYLEDKARGMANQGDWVPFMDVLALLIFGVVLFPNVDGLVDLAAIDAFLAYHHSKESPV

SEQ ID NO: 146815 - protein, 38 aa, Glycine max
  Coding DNA Sequence Number=SeqID_55130
MDMLADAEVMFNASYLTLPIGETDHDPLLGRPLTPTKR

SEQ ID NO: 146816 - protein, 74 aa, Glycine max
  Coding DNA Sequence Number=SeqID_55131
  Subcellular localization annotation: CTP_CleavageSite=54; ConfidenceScore=5.16e-01
MWSSAPFPEMSASSGGDFFESHKIRRSKSLAFVGHPIQTLSRFGHTAPFVIQRSDDMRRQNLVIPHPFAIQTRS

SEQ ID NO: 146817 - protein, 45 aa, Glycine max
  Coding DNA Sequence Number=SeqID_55132
IAQQCFLSTSGISRNFTDCLTMGVKYLEAVKRRLHSTKQMVPGRN

SEQ ID NO: 146818 - protein, 156 aa, Glycine max
  Coding DNA Sequence Number=SeqID_55133
  Gene Ontology: Mol. function=hydrolase activity, acting on acid anhydrides, in phosphorus-containing anhydrides; Cellular component =nucleus; Biological process=nucleobase, nucleoside, nucleotide and nucleic acid metabolic process
  Homolog annotation: Hit_ID=A7QPD2; Match level="QueryCoverage=42%, HitCoverage=5%, E-value=4e-17, Identity=64%"; Hit description =Chromosome chr18 scaffold_137, whole genome shotgun sequence
  Pfam annotation: Domain name=DEAD_2; Domain location=1-108; Score= -45.0; E_value=0.0047; Accession=PF06733.6; Description=DEAD_2
  Subcellular localization annotation: CTP_CleavageSite=47; ConfidenceScore=5.01e-01
MARVISTLNLVQKEGHCHALLKSPSGTGNHRSSGSGGGFVPEEVAVRARSMSNDAQLVFCPYNYINNPVIWAPMEVDIKVGIVIFDEAHNMEDITRDASSVDNEEDVLDRLRVEGFRVQGSGFSVQGLRVQGSGFKVQGSRFRIQGLGFTVSRFHS

SEQ ID NO: 146819 - protein, 1282 aa, Glycine max
  Coding DNA Sequence Number=SeqID_55134
  Gene Ontology: Mol. function=metal ion binding; Cellular component =cytoplasm; Biological process=regulation of transcription, DNA -dependent
  Homolog annotation: Hit_ID=A7NV62; Match level="QueryCoverage=98%, HitCoverage=85%, E-value=0.0, Identity=45%"; Hit description =Chromosome chr18 scaffold_1, whole genome shotgun sequence
  Pfam annotation: Domain name=C1_1; Domain location=1054-1102; Score =8.1; E_value=0.0031; Accession=PF00130.13; Description=Phorbol estersdiacylglycerol binding
  Pfam annotation: Domain name=C1_3; Domain location=1062-1092; Score =19.4; E_value=0.0028; Accession=PF07649.3; Description=C1-like domain
  Pfam annotation: Domain name=C1_3; Domain location=283-315; Score =2.8; E_value=0.25; Accession=PF07649.3; Description=C1-like domain
  Pfam annotation: Domain name=PHD; Domain location=1063-1110; Score =36.9; E_value=7.3e-08; Accession=PF00628.20; Description=PHD-finger
  Pfam annotation: Domain name=PHD; Domain location=284-333; Score =36.4; E_value=1.1e-07; Accession=PF00628.20; Description=PHD-finger
  Pfam annotation: Domain name=zf-C3HC4; Domain location=1064-1107; Score=2.8; E_value=0.044; Accession=PF00097.16; Description=Zinc finger, C3HC4 type (RING finger)
  Pfam module annotation: Pfam domain module=C1_1::C1_3::C1 _3::PHD::PHD::zf-C3HC4; Domain location=1054-1102::1062-1092::283 -315::1063-1110::284-333::1064-1107
MTGDRCHPWEGMVEVGDAAAVERRCEANFPAEIPRNSAAVREIDYLSQARKALAERSPFDVAEETSTSAAAVTLPGGLASLLNRQGDNRRRLKKSHSGANKRKSSNRANQKKPEDSNIWTETEEYFRDLTLADIDTLFEASRTSSLVSQDCFTIPCLGNAPRHNAVTSNSGNEMEPVPKFNVVVSSEDGEKGEDENKDGEAVESEDELLVIEAIDDVAVEQAPPQDDKSQDISDSSVSLEWFLGCRNRVSLTSERPTKKRRLLGVEAGLEKVVMTCPFDEGQLFCHYCGRGDTGRDSNRLIVCASCKVAVHRKCYGVHDDIDEAWLCSWCKQKVDVDVSVNPCVLCPMKGGALKPVNSSAEGVGSVPFVHLFCSLWMPEVYIDDLKKMEPVMNVGEIKETRKKLVCSVCKAKCGACVRCSHVFHWLLRVEHNTPSFPSFETGYEIIGSCRASFHPLCAREARHRMEVWAKYGNDNVELRAFCLKHSDLPENRSIFPLEGSIAVRNDISEAKGFPVTLPLSGEQNLKDCRNRELASDSSPDKLNHNDEPPDGGLSGCRISAHDDMLGCGAVPQQNVGVVGRANENIDASDSLSFALVLKKLIDRGKVDVKDVALEIGISPDTLTANTNEAYMAPDVQHKIVNWLKAHVYTNAFQKGLKVKFKPANASKNDSGATDGSDTLPMSDSGLLDPVAVKSVPPRRRTTNNIRILKDNNVLCSSEGVTGENGMPVDMCRVGQSDCDNPTNYNEASIPNATEMNLTKSEDIFHEVQGNASGCVSEDKSTACLQNASVLSDHCVVHSASEPPDFGFIKKDAISSYIHPYINKKLLQIRDGVPLEDIICSSDEGNSSLVESFGGSACSSTQNQNLTQVDFSKPDEVNMEQLVRAIKMGLFEFSPQDELEGELVYFQHRLLQNAVAKKRHIDNLIYSVAKSLPHEIDKAHQQRWDEVIVNQYLRDLREAKKQGRKERKHKEAQAVLAAATAAAAASTRALRKDNLDESMQQENTIFFQNLLKLDTLNGRTGACSQPMPRAKETLSRVAVTRTSSEKYSEFCMPTSDLSKEQCKSCDICRRSEFILNPILVCSGCKVSVHLDCYRSVKETTGPWYCELCEDLSSRSSGAAAINFWEKSVVECALCGGTTGAFRKSSDGQWVHAFCAEWVFESTFKRGQIDAVEGMETLQKGVDICCICHHKHGVCMKCCYGHCQTTFHPSCARRAGLYMNVRPTGGKAQHKAYCEKHSLEQKAKFVLLICQAETQKHGIEELKSIRQIRCLLIYRSLRGSAELK

SEQ ID NO: 146820 - protein, 544 aa, Glycine max
  Coding DNA Sequence Number=SeqID_55135
  Gene Ontology: Mol. function=zinc ion binding; Cellular component =intracellular; Biological process=translation
  Homolog annotation: Hit_ID=A7NV66; Match level="QueryCoverage=42%, HitCoverage=71%, E-value=2e-83, Identity=67%"; Hit description =Chromosome chr18 scaffold_1, whole genome shotgun sequence
  Pfam annotation: Domain name=DUF1644; Domain location=46-210; Score =358.5; E_value=1.1e-104; Accession=PF07800.3; Description=Protein of unknown function (DUF1644)
  Pfam annotation: Domain name=Ribosomal_S13; Domain location=426-530; Score=204.7; E_value=2.2e-58; Accession=PF00416.13; Description =Ribosomal protein S13S18
  Pfam module annotation: Pfam domain module=DUF1644::Ribosomal_S13; Domain location=46-210::426-530
MAKVGKLRSKARGHRPSPHLLSCERKNLKDVNVRKSSSKALEKKDWEDATCSVCMEVPHNAILLLCSSYDKGCRPYMCATSHRYSNCFEQYKKAYTKATSVQSLQLEANNSNIDLSTGEPKDDTEVPELLCPLCRRQVKGWTVVEVARKCLNAKKRSCMQDDCSFVGNYKELRKHVRSKHPFARPREVDPLKEEKWKRFECERERNDVISTILSSTPGAMVLGDYVLEPNDHAFYSDEYDSDEEYLEDDFFSVRSIGLGRTGHFLPNIRYNQDRAADNFDVDHFGLQSVASTGSAAVSGRGLHRILLGRSRRRRRHRIANARRTTWHNNFKQKSATSSLNLMQKINGCGYGKGQENSQFAPHIRPDLMMVLFMKKISKEQKKMAQTLAMPVAPSLAIISNSRLSNTLSVPVLNKPKVQGSSIKCVRVGGVEIPNNKRIEYSLQYIHGVGRTRAKQILCDIQMDNKITKELTEEELITLRDEVSKYMIEGDLRRFNAVNIKRLKDIQCYRGIRHIQGLPCRGQRTKNNCRTLKGKKVAIAGKKKK

SEQ ID NO: 146821 - protein, 164 aa, Glycine max
  Coding DNA Sequence Number=SeqID_55136
  Gene Ontology: Mol. function=nucleic acid binding
  Homolog annotation: Hit_ID=Q9M3Y5; Match level="QueryCoverage=66%, HitCoverage=58%, E-value=2e-32, Identity=56%"; Hit description=25.7 kDa protein
MGFSKQQLLARLKELQIPFSQYEHPVVLTVDAQRLGLGKGGLRMAPEEALGEVLQANPKVGKDQPPDLAALVPSGLIVLPDQPQKQSSSQVPEDANHVSMDNGTNTVSDAGQFVEEILQKTSQLLLSEVKDENIKLHGEQLGTVLSDKLLKNLNAEFKNLAVSI

SEQ ID NO: 146822 - protein, 426 aa, Glycine max
  Coding DNA Sequence Number=SeqID_55137
  Gene Ontology: Mol. function=nucleic acid binding; Cellular component= intracellular; Biological process=regulation of transcription
  Homolog annotation: Hit_ID=A7NV78; Match level="QueryCoverage=98%, HitCoverage=98%, E-value=1e-135, Identity=61%"; Hit description =Chromosome chr18 scaffold_1, whole genome shotgun sequence
MSKPKTQRKPTITKHVSQNQNQEAQKTEKQPSWVVRGLLACRNVQIQQNQPQQKEAKSPPEAKENRKKQEHRKLQEERVPEENSKKSKKMKCSGSLCNNTKITAKPDTATPDVHKKRLLLSGCNNKNDASSRSMKAPLNELNGTVSASSSSLSASSTSSGGGSFRGMPFRRLSGCYECRMVVDPVLGFTRDPSLRSSICSCPDCGEIMKAESLEHHQAVKHAVSELGPEDTSKNIVEIIFHSSWLKKQSPVCKIDRILKVHNTQKTITKFEEYRDSIKAKATKLSKKHPRCIADGNELLRFHCTSFNCSLGLNGSSNLCNSIPQCNVCSIIKHGFKVTGGAGILTTATSGKAHDKAACVEESEEKRAMLVCRVIAGRVKKNAEGGMEEYDSVAVAGAVGAYSNLDELLVFNPKAILPCFVVIYRGF

SEQ ID NO: 146823 - protein, 268 aa, Glycine max
  Coding DNA Sequence Number=SeqID_55138
  Gene Ontology: Mol. function=binding; Cellular component=nucleus; Biological process=metabolic process
  Homolog annotation: Hit_ID=A5BGP4; Match level="QueryCoverage=98%, HitCoverage=47%, E-value=1e-68, Identity=40%"; Hit description =Putative uncharacterized protein
  Pfam annotation: Domain name=PPR; Domain location=126-159; Score =11.1; E_value=0.37; Accession=PF01535.11; Description=PPR repeat
  Pfam annotation: Domain name=PPR; Domain location=32-66; Score=4.8; E_ value=2.1; Accession=PF01535.11; Description=PPR repeat
  Pfam annotation: Domain name=PPR; Domain location=67-101; Score=5.5; E_value=1.7; Accession=PF01535.11; Description=PPR repeat
  Pfam module annotation: Pfam domain module=PPR::PPR::PPR; Domain location=126-159::32-66::67-101
MVSAITNSGRPHEALTLYNHMLESKTVQPNQFLYSAVLKACGLMGDVELGKLAHQHVSQARLEFDTVLMNALLDMYVKCGSLRDAKRVFCVKIPLHGTPSFLDHAKQGLMRDALNLFDQMPEPDLVSWNSIIAGLADNASPHALQFFSMMHGKGLKHDAFTFPCALKTCSLLGELTMGRQIHCCIIKSGFECSCYCISALIDIMEFYAFWVCCQWRLVEGTQYDLYTFCIALKVCIYFGNLRLVFQVHGLVITGGYELDYVVGSIPPK

SEQ ID NO: 146824 - protein, 475 aa, Glycine max
  Coding DNA Sequence Number=SeqID_55139
  Gene Ontology: Mol. function=symporter activity; Cellular component =integral to membrane; Biological process=auxin mediated signaling pathway
  Homolog annotation: Hit_ID=Q9FEL6; Match level="QueryCoverage=100%, HitCoverage=100%, E-value=0.0, Identity=84%"; Hit description=Auxin transporter-like protein 3
  Pfam annotation: Domain name=Aa_trans; Domain location=37-441; Score =252.3; E_value=1e-72; Accession=PF01490.9; Description=Transmembrane amino acid transporter protein
MASEKVETVVAGNYLEMEREEEGSKSTSGKLSRLFWHGGSVYDAWFSCASNQALTHTALIIMCIFPILKQIKPSFGVAIKGLMIFLLFYGLMGSWTAYLISVLYVEYRTRKEREKVDFRNHVIQWFEVLDGLLGKHWRNLGLFFNCTFLLFGSVIQLIACASNIYYINDNLDKRTWTYIFGACCATTVFIPSFHNYRMWSFLGLVMTTYTAWYMTIASLTHGQAEGVTHTGPAKLVLYFTGATNILYTFGGHAVTVEIMHAMWKPQKFKMIYLIATLYVLTLTLPSASAVYWAFGDQLLTHSNALSLLPRSGFRDTAVILMLIHQFITFGFACTPLYFVWEKFIGVHETKSLFKRALARLPVVIPIWFLAIIFPFFGPINSTVGSLLVSFTVYIIPALAHMVTFASAPARENAVERPPSKLGGWVGLYSMNVFVVVWVLVVGFGLGGWASMINFIHQIDTFGLFAKCYQCPPHKA

SEQ ID NO: 146825 - protein, 31 aa, Glycine max
  Coding DNA Sequence Number=SeqID_55140
MEIPHQVVFLPVLVGAFLNQYFQSLVIFGMQ

SEQ ID NO: 146826 - protein, 60 aa, Glycine max
  Coding DNA Sequence Number=SeqID_55141
MAPPLKHLAIDWMILLRVREKDIALFKGGYVLVLCIGALNLLSVHCEGFSLAQFVPPQYI

SEQ ID NO: 146827 - protein, 242 aa, Glycine max
  Coding DNA Sequence Number=SeqID_55142
  Gene Ontology: Mol. function=DNA binding; Biological process =regulation of transcription, DNA-dependent
  Homolog annotation: Hit_ID=A7P9A4; Match level="QueryCoverage=94%, HitCoverage=84%, E-value=1e-28, Identity=30%"; Hit description =Chromosome chr3 scaffold_8, whole genome shotgun sequence
  Pfam annotation: Domain name=B3; Domain location=141-232; Score=41.9; E_value=2.2e-09; Accession=PF02362.12; Description=B3 DNA binding domain
  Pfam annotation: Domain name=B3; Domain location=2-82; Score=28.5; E _value=2.5e-05; Accession=PF02362.12; Description=B3 DNA binding domain
  Pfam module annotation: Pfam domain module=B3::B3; Domain location =141-232::2-82
MQRIPEEFIKRFGDELSNVATVTVPDGRVWKMRLKKCGKDVSFRSKWREFVEYYSLGYGSYLVFRYEGNSKFRVLIFDTTSAEICYPDLDNRKRSKVDDQTRKKEHKEAIDEDDVNLKAWKKESDCSEIAKDASTKPKHPSVTCTIQPYRLYVRSHFSKKHLKPNVCMMLQNCNGEQWDVSCVCHNTRYGGMMLTRGWRKFVRDNDLSEGDPCVLELIETNPAVVLKLTVLGAPEYHSSRPH

SEQ ID NO: 146828 - protein, 367 aa, Glycine max
  Coding DNA Sequence Number=SeqID_55143
  Gene Ontology: Mol. function=nucleotide binding
  Homolog annotation: Hit_ID=A5AJ80; Match level="QueryCoverage=60%, HitCoverage=70%, E-value=6e-34, Identity=43%"; Hit description =Putative uncharacterized protein
MLLRSVLNLFVIDEYAVHGVEGSISGIPLTSESGKKKFLLLKGKQQDIPSVGFVLPMKATEATVKQQNVQSGNSPISTPAKQNQRREASGRLIRSILLNNEARQSQSTTGTQHKIQILSSENGQRPSRRFGSRSGLNNQVSNHDAAQINSEGDSRRALDEKFIKRDLHGLGSSAKTEKRTRNKDRPDRGVWTPLRRSDVSHAGNDYSSSSLAQPTQSNPESAEGEVKENVPSGNRGGEFSASAGGHGGNPSIENGSQRNFIHHGASYVVKDDGAVSSISKGKPSKKSVGHSAHESGHHSCYGLRIGRNPQLIQVNLSLSDLKGWLSVRGSHLGSWGRIDICSPTPQPERLFIELEPVTCKLQGSNLK

SEQ ID NO: 146829 - protein, 397 aa, Glycine max
  Coding DNA Sequence Number=SeqID_55144
  Gene Ontology: Mol. function=methylenetetrahydrofolate reductase (NADPH) activity; Cellular component=cytosol; Biological process =methionine metabolic process
  Homolog annotation: Hit_ID=A5ATB7; Match level="QueryCoverage=99%, HitCoverage=58%, E-value=1e-163, Identity=72%"; Hit description =Methylenetetrahydrofolate reductase
MAALEPIKDNEEAVKAYGIHLGTEMCKKILAHGIKTLHLYTLNMEKSALAILMVNLGLIEESKVSRSLPWRRPANVFRVKEDVRPIFWANRPKSYISRTIGWDQYPHGRWGDSCNPSYGALSDYQFMRPRARDKKLVEEWAVPLKSVEDIYERFRLYCLGKLRSNPWSELDGLQPETKIINEQLEKINTKGFLTINSQPAVNGEKSDSPTGLSSHRLIAGWNHIQPQLFVVLNNGGQEYDQNSHYNKTLVIICFLTMLGYLQMSSSGIEKAYVEFFCSKEKLDALVDKCKDRTSLTYMAVNKDGSWKSNVGQTDVNAVTWGVFPAKEIIQPTIVDPVSFNVWKDEAFEIWSRGWASLYPEDEASRKLVEEVGGSHFLVSLVDNDYINGDLFAVFADF

SEQ ID NO: 146830 - protein, 351 aa, Glycine max
  Coding DNA Sequence Number=SeqID_55145
  Gene Ontology: Mol. function=protein serine/threonine kinase activity; Biological process=protein amino acid phosphorylation
  Homolog annotation: Hit_ID=A7PQ05; Match level="QueryCoverage=84%, HitCoverage=96%, E-value=1e-103, Identity=62%"; Hit description =Chromosome chr18 scaffold_24, whole genome shotgun sequence
  Pfam annotation: Domain name=DUF579; Domain location=63-304; Score =475.6; E_value=6.1e-140; Accession=PF04669.4; Description=Protein of unknown function (DUF579)
  Subcellular localization annotation: CTP_CleavageSite=41; ConfidenceScore=5.71e-01
MRSKTTQFTCTFKVALLSLAVFCLFILVFRSSIFSLSPQLTSQTNMSSSDTIVPVSPQETENAGTPSSSSCPNSPPLNPPCTKAPPSLANAIIHYATANVTPQQTLHEISVSARVLEKKSPCNFLVFGLGHDSLMWTSLNYGGRTVFLEEDKSWIDQIQEKVPSLESYHVMYDTQVHQAEELMKTGMKEDCQKVTDPRFSRCPLAHKGLPSEVYDIDWDVIMVDAPTGYFDEAPGRMSAIYTAGLIARNKERGQTDVFVHDVDRKVEDMFSKAFLCEGYFKEQEGRIRHFNIPSHSEWVLAATCTNEGLYVLTYEQRCILGEAAAVLRNNDGEVGSSRREPSGASCACGWK

SEQ ID NO: 146831 - protein, 330 aa, Glycine max
  Coding DNA Sequence Number=SeqID_55146
  Gene Ontology: Cellular component=integral to membrane; Biological process=peroxisome organization and biogenesis
  Homolog annotation: Hit_ID=A0MEF0; Match level="QueryCoverage=90%, HitCoverage=69%, E-value=2e-92, Identity=51%"; Hit description =Putative uncharacterized protein
  Pfam annotation: Domain name=Aa_trans; Domain location=19-330; Score =141.6; E_value=2.2e-39; Accession=PF01490.9; Description =Transmembrane amino acid transporter protein
MPASEQQNLENWLPISASRKAKWWYSTFHNVTAMVGAGVLGLPFAVAQLGWIPGVFMIMFSWILTFYALWQLIHLHEVVPGKRFDRYFELGKHVLGPKKGFWLVMPQQLTVQVASAIVYTVTGGKSLKKVFDTVVPSMTDIRQTYYILFFVCLQLLLSQTPNFNKLKSVSSLAALMSVCYSMVASCMSIVEGIGRHHHHHHIDYGVRSHTTPGIVLDAFNALGTIAFAFAGHSVALEIQATLPSTEEKPSNIPMWRVSGFWAYGNAVDDDVLITLEHPNWLIAIANFMVFIHVLGSFQICVIVGGIIAVVAPIGGVRTIIVSAKTYKLFS

SEQ ID NO: 146832 - protein, 273 aa, Glycine max
  Coding DNA Sequence Number=SeqID_55147
  Gene Ontology: Mol. function=mismatched DNA binding; Cellular component=nucleus; Biological process=mismatch repair
  Homolog annotation: Hit_ID=A5H619; Match level="QueryCoverage=99%, HitCoverage=44%, E-value=3e-77, Identity=48%"; Hit description=MLH1
MAARRKTLQNSSDDYSKIVDLVSRFAIHHINVSFSCRKHGAVRADVHTVAMSSRLDAIKSVYGVSVARNLIEIEASDNDPSTSVFEMHGYMSNANYAAKKITMVSLLNQEVIIEKIQSVVESTLRSSNEARTFQEQSAGQSSSPRINTSKEVNLSPMPTGSRLLKVPVHKLVRTDSLDPAGRLHAYTQIMSDRHLEKSASLNAIRSSVRQRRNPKDSLELTSVQELLDKINSNCDPGMTDIIRHCTYVGMADDVFALLQHNTRLYLANVVNLR

SEQ ID NO: 146833 - protein, 489 aa, Glycine max
  Coding DNA Sequence Number=SeqID_55148
  Gene Ontology: Mol. function=protein dimerization activity; Cellular component=nucleus; Biological process=regulation of transcription, DNA-dependent
  Homolog annotation: Hit_ID=A7NV45; Match level="QueryCoverage=62%, HitCoverage=83%, E-value=5e-84, Identity=53%"; Hit description =Chromosome chr18 scaffold_1, whole genome shotgun sequence
  Pfam annotation: Domain name=DnaJ; Domain location=319-364; Score= -12.4; E_value=0.068; Accession=PF00226.22; Description=DnaJ domain
  Pfam annotation: Domain name=bZIP_1; Domain location=63-122; Score =25.5; E_value=0.0002; Accession=PF00170.12; Description=bZIP transcription factor
  Pfam annotation: Domain name=bZIP_2; Domain location=63-113; Score =14.1; E_value=0.015; Accession=PF07716.6; Description=Basic region leucine zipper
  Pfam module annotation: Pfam domain module=DnaJ::bZIP_1::bZIP_2; Domain location=319-364::63-122::63-113
MDIYEPFQQVSMWGGNFKVDGGLNSIASPMLMVGTNVENKSEYIPREPREPSGSGADQETTNKDVNKMLRRLAQNREAARKSRLRKKAYVKQLESSRLKLMQLELEIGKARKQGLYMGTALDAGYIGSTSETINPGIVAFEIEYGQWVEEQERRNEELRHAFQTQAPGVQLNVVVQSVLNHYSNLFRMKAEAVKADVLYLLSGAWKPSVERIFLWIGGSRPSQLLNIIVPQLEPLTDQQIVSINNLRLSSQQAEDALSQGLEKLQQSLVHDMAVDPLSVGNLGLQMARTMEKFEALEGFVNQNVRMKQFMASECFFNCVPYNLVVIQLFCGGTLEEGETAEARFIKIQAAYELLIDGERRRQYDMDNWVNPMKASQAWMEWLIKKRKAFDQRGDMAIAAWAEQQQRELNLRVRQLSRSKIDPDEARRILAREKKASAEYYSNTLKRHTLVLKKRDLMRRKAEEEKKKTISRLLAAEGLELDDSDSDEAL

SEQ ID NO: 146834 - protein, 610 aa, Glycine max
  Coding DNA Sequence Number=SeqID_55149
  Gene Ontology: Mol. function=phosphotransferase activity, alcohol group as acceptor; Cellular component=nucleus; Biological process =nucleobase, nucleoside, nucleotide and nucleic acid metabolic process
  Homolog annotation: Hit_ID=Q6ZND8; Match level="QueryCoverage=100%, HitCoverage=100%, E-value=0.0, Identity=79%"; Hit description=cDNA FLJ16191 fis, clone BRTHA2013610, moderately similar to Arabidopsis thaliana ...
  Homolog annotation: Hit description=deoxyguanosine kinase -related (At1g72040) mRNA
  Pfam annotation: Domain name=dNK; Domain location=296-443; Score =103.1; E_value=8.7e-28; Accession=PF01712.10; Description =Deoxynucleoside kinase
  Subcellular localization annotation: CTP_CleavageSite=66; ConfidenceScore=5.80e-01
MQKLLRPSSVPFLSISVTVATPFLSLPPKVANQPMSAAAAGSSLKRQLSYSRYLALSSTNTCSVCRCLSLTHTHSHPKNNKTLLLLNHSRNRSLHSASEGSFITQPDPVEYGSLVDSKEKPFNSRLNRRQKGSTSSSPAPSNPDLLAIPGVGPRNFRKLVQKGIAGVAQLKQLYKDKFFGKSSDKMVEYLQNSVGIIHKNHAESITTFIKQSVDEEELEDNSSSSVQKKRLTFCVEGNISVGKTTFLQRIANETIELRDLVEVVPEPISKWQDVGPDHFNILDAFYAEPQRYAYTFQNYVFVTRVMQERESSAGIKPLRLMERSVFSDRMVFVRAVHEANWMNGMEISIYDSWFDPVVSSLPGLIPDGFIYLRASPDTCHKRMMLRKRTEEGGVSLDYLCDLHEKHESWLFPSQSGNHGVLSVNQLPHHIDNSLHPDIRDRVFYLEGGHMHSSIQKVQYLEIPCRNLFVMVNWLNHLNYKQVPALVLDCEPNIDFSKDIEAKRQCLCPNCKVWDLIPTSQSLLGTRLVHSLAMCAGTGEHSGIYARQVAEFFEFVKKRNEVSSKEGSSQAQPQVLLPHEGGLWLPDGKPFPREALKSLDFRQAATSFMSG

SEQ ID NO: 146835 - protein, 629 aa, Glycine max
  Coding DNA Sequence Number=SeqID_55150
  Gene Ontology: Mol. function=nucleic acid binding; Cellular component= nucleus; Biological process=mRNA processing
  Homolog annotation: Hit_ID=UPI00015A68FE; Match level="QueryCoverage =65%, HitCoverage=83%, E-value=0.0, Identity=87%"; Hit description =UPI00015A68FE related cluster
  Pfam annotation: Domain name=RRM_1; Domain location=295-371; Score =42.9; E_value=1.2e-09; Accession=PF00076.13; Description=RNA recognition motif. (a.k.a. RRM, RB
  Pfam annotation: Domain name=RRM_1; Domain location=415-486; Score =85.6; E_value=1.6e-22; Accession=PF00076.13; Description=RNA recognition motif. (a.k.a. RRM, RB
  Pfam annotation: Domain name=RRM_1; Domain location=552-614; Score =9.2; E_value=0.021; Accession=PF00076.13; Description=RNA recognition motif. (a.k.a. RRM, RB
  Pfam module annotation: Pfam domain module=RRM_1::RRM_1::RRM_1; Domain location=295-371::415-486::552-614
MTDYEERYEGNGEEEELHNSHHQPHPDSSPLPTHDDLTDSKSRLLFSMDLAIMTEILPEAEIRSGRKGETGREKGKRGGTGKGRKVGIGIRREAGTRTEIGIRAKTGRGTGIVMVRRKGTVTGTAIIEIDTGIVVREGKGQGIEMTMIITEVVTLTEEGIMIERISIGAGLGLDLNPGQGVDLSIDQGHVRVLVQRVQVEGHPFLFLDHFKASRFKNFVRCGKRTSGFDMAPPASAMLTGASAVAGQITGANPTIPGMFPNMFPLATSQMQQFSALPVMPVQAMTQQATRHARRVYVGGLPPTANEQSVATFFSQVMAKIGGNTAGPGDAVVNVYINHDKKFAFVEMRSVEEASNAMALDGIIFEGAPVKVRRPTDYNPSLAATLGPSQPNPNLNLGAVGLTPGSAGGLDGPDRVFVGGLPYYFTETQIRELLETFGPLRGFDLVKDRETGNSKGYAFCVYQDLAVTDIACAALNGIKMGDKTLTVRRANQGANPQQPKPEQESILMHAQQQIALQKLMLQPALVATKVVCLTHAVSSDELKDDEDYEEILDDMRQECSKFGTLVNVVIPRPPSDGEPAAGVGKVFLEYVDIDGATKARAGLNGRKFDGNQVVAVFYPENKFAQGDYEG

SEQ ID NO: 146836 - protein, 535 aa, Glycine max
  Coding DNA Sequence Number=SeqID_55151
  Gene Ontology: Mol. function=transcription regulator activity; Cellular component=nucleus; Biological process=regulation of transcription
  Homolog annotation: Hit_ID=A7Q9R6; Match level="QueryCoverage=83%, HitCoverage=98%, E-value=1e-166, Identity=63%"; Hit description =Chromosome chr5 scaffold_67, whole genome shotgun sequence
  Pfam annotation: Domain name=PPR; Domain location=185-219; Score =14.3; E_value=0.16; Accession=PF01535.11; Description=PPR repeat
  Pfam annotation: Domain name=PPR; Domain location=247-281; Score =40.4; E_value=6.6e-09; Accession=PF01535.11; Description=PPR repeat
  Pfam annotation: Domain name=PPR; Domain location=282-316; Score=6.1; E_value=1.5; Accession=PF01535.11; Description=PPR repeat
  Pfam annotation: Domain name=PPR; Domain location=348-382; Score =23.1; E_value=0.001; Accession=PF01535.11; Description=PPR repeat
  Pfam annotation: Domain name=PPR; Domain location=385-419; Score=0.2; E_value=7.4; Accession=PF01535.11; Description=PPR repeat
  Pfam annotation: Domain name=PPR; Domain location=453-486; Score=1.8; E_value=4.8; Accession=PF01535.11; Description=PPR repeat
  Pfam annotation: Domain name=PPR; Domain location=487-521; Score=2.7; E_value=3.7; Accession=PF01535.11; Description=PPR repeat
  Pfam annotation: Domain name=PPR; Domain location=71-105; Score=14.6; E_value=0.14; Accession=PF01535.11; Description=PPR repeat
  Pfam module annotation: Pfam domain module=PPR::PPR::PPR::PPR::PPR::PP R::PPR::PPR; Domain location=185-219::247-281::282-316::348-382::385 -419::453-486::487-521::71-105
MTGTYSRISCMTQHLCSMLELKQVQAIITKAGLHSHLPFTAKLIFFSALSPMGNLSHAHSLFLQTSMHNSFICNTMIRAFANSSYPLQALYIYNHMHTTNVVSDHFTYNFVLKACSRAHKFAQEFVKCDEFIIISKGGEVHCTVLKLGLDQDPSIQNSLLCMYSQCGLVHVAQHLFDEISNRSLVSWNIMISAYDRVNDSKSADYLLESMPHKNVVSWNTVIGRYIRLGDIEGARRVFQIMPQRDAVSWNSLIAGCVSVKDYEGAMGLFSEMQNAEVRPTEVTLISVLGACAETGALEMGSKIHESLKACGHKIEGYLGNALLNMYSKCGKLNSAWEVFNGMRIKTLSCWNAMIVGLAVHGYCEEALQLFSEMESGLDTVRPNRVTFLGVLIACSHKGLVDKARWNFDHMAKQYKILPDIKHYGCIVDLLSRFGLLEEAHQMIKTAPLQNSAILWRTLLGACRTQGNVELAKVSFQQLAKLGRLTDGDYVLLSNIYAEAERWDEVERVRSEMIGLHVPKQVAYSQIDMTESDKLP

SEQ ID NO: 146837 - protein, 460 aa, Glycine max
  Coding DNA Sequence Number=SeqID_55152
  Gene Ontology: Mol. function=glycine hydroxymethyltransferase activity; Cellular component=phagocytic vesicle; Biological process =one-carbon compound metabolic process
  Homolog annotation: Hit_ID=A9PL07; Match level="QueryCoverage=80%, HitCoverage=68%, E-value=1e-173, Identity=79%"; Hit description =Serine hydroxymethyltransferase
  Pfam annotation: Domain name=SHMT; Domain location=90-448; Score =623.2; E_value=2.3e-184; Accession=PF00464.10; Description=Serine hydroxymethyltransferase
MDSQPGLSLGLSVPLSSPAAPLCDTTSVLWRLFNKRHPIKEEEEEDEDYGETINFMDQSVKRKIEGHQQPCFPSKRVAVDSSVGWWNQPLGVADPEIFYIMGKEKQRQFKGIELIASENFVCRAVMEALGSHLSNKYSEGMPGAKYYTGNQYIDEIEFLCCQRALLAFDLHPNNWGVNVQPYSCTSANFAVYTGILHPGDRIMGLDSPSGGHLSHGYYTLGGKKVSAASIFFETLPYKVNPQSGYIDYDKLEEKALDFRPKILICGGSSYPREWDYARFRQVADKCGAVLMCDMAHISGLVAAKEVASPFDYCDIVTSTTHKSLRGPRGGIIFYRRGAKPRKQGFVHNHGDDSNYDFEEKINFALYPSLQGGPHNNHIAALAIALKQVATPEYKAYMQQVKRNAQALASALLRRNFRLVTDGTDNHLLLWDLTALGLIVTSYYLVYWCLKMGNDSSTEVA

SEQ ID NO: 146838 - protein, 53 aa, Glycine max
  Coding DNA Sequence Number=SeqID_55153
MASYGVASLNHLSSFSIPLPLIIKKQRTPLMKNIQGLQPPHGATSCGIKSIFI

SEQ ID NO: 146839 - protein, 132 aa, Glycine max
  Coding DNA Sequence Number=SeqID_55154
MVTMIMDTLPVFYYEKLVGYMPSSFAELVFAGERIEVGLKRGKFDYVSPACASGRRTGTAEAKKKEGDAHTVTSTPAWPKPPQTPHGTHQYAQHHPSFSAHAGSSSDSTLAQPRAPTPPQRGAPQAPAPTQP

SEQ ID NO: 146840 - protein, 285 aa, Glycine max
  Coding DNA Sequence Number=SeqID_55155
  Gene Ontology: Biological process=transposition, DNA-mediated
  Homolog annotation: Hit_ID=Q6UUU1; Match level="QueryCoverage=21%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPVTTLNSIFIIFLLHCFLALMLSGFPFPYFLPPTSKGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 146841 - protein, 255 aa, Glycine max
  Coding DNA Sequence Number=SeqID_55156
  Homolog annotation: Hit_ID=Q6WAY6; Match level="QueryCoverage=91%, HitCoverage=38%, E-value=5e-24, Identity=30%"; Hit description =Putative uncharacterized protein
MANQEEWVPFMDVLALLIFGVVLFPNVDGLVDLAAIDAFLAYHHSKESPVVAILADLFDTFDRRCEKSSARIICCLPALCVWLVLHLFQQDIRHPCLLRSHRSCVEKRRVDWYQHLAGIEGKTISWFPRWKEGKEGVLFSCGDYPNIPLIGTRGCINYNPALAIRQLGYPMRGAAAEESLSPFLVRDFGAQGFKVMQRVHKAWEGLLRKDKELRGFRNGIIGGYHEWLKVRTRGLDWLSKLKIIDEENFKALEED

SEQ ID NO: 146842 - protein, 134 aa, Glycine max
  Coding DNA Sequence Number=SeqID_55157
  Gene Ontology: Biological process=response to stress
  Homolog annotation: Hit_ID=P0ADX3; Match level="QueryCoverage=100%, HitCoverage=100%, E-value=1e-65, Identity=93%"; Hit description =Protein yhfA
  Pfam annotation: Domain name=OsmC; Domain location=15-128; Score =101.1; E_value=3.4e-27; Accession=PF02566.10; Description=OsmC-like protein
MQARVKWVEGLTFLGESASGHQILMDGNSGDKAPSPMEMVLMAAGGCSAIDVVSILQKGRHDVTDCEVKLTSERREEAPRLFTHINLHFVVTGKALKDAAVSRAVDLSAEKYCSVALMLEKAVKITHSYEVIEA

SEQ ID NO: 146843 - protein, 116 aa, Glycine max
  Coding DNA Sequence Number=SeqID_55158
  Subcellular localization annotation: CTP_CleavageSite=61; ConfidenceScore=5.31e-01
MASNIVAICSFMASMSAFICSCASSTSPITLALAQDMGLNQFRFFNMVHDILVKVKLEVTRTSTVLNVFGSRQSSDVTRSIFCPNFCKMVTSIFQLDLMNLFVKAGAWFNPIIQGM

SEQ ID NO: 146844 - protein, 153 aa, Glycine max
  Coding DNA Sequence Number=SeqID_55159
MEANAVAVAATITVAKVNPMPPSGLNQMNHPTSAMTHEIPHHNLAEFKPCLGYATEGQAVGGIPLQNPLEGPQYHPQLHLLHSTTSKNPHAMAEMGKLDHLEERLRAIEGGEDYAFANLEELFVVPNIITPPKFKVLDFDKYKGTTCPKNHLK

SEQ ID NO: 146845 - protein, 227 aa, Glycine max
  Coding DNA Sequence Number=SeqID_55160
  Gene Ontology: Mol. function=transporter activity; Cellular component= integral to membrane; Biological process=transport
  Homolog annotation: Hit_ID=A6TDU8; Match level="QueryCoverage=99%, HitCoverage=73%, E-value=1e-102, Identity=84%"; Hit description =Putative transport protein
MGMLIARIVLGVAEGPLFSLKTRFINDNFAADEIGKPNALTALGVSLGLAVGFPLVTWLMAHVGWIGSFYALALLNLLLGGGLIWRFLPAPQVTAQRAKPGFSQTFSLAWRTPLLGWILLVEIATLSYLWGSSAWLPAWLRDEHHFSLQATGLLAAVPFLLSLGSKFLGGVLLDKMRPEQAPLLFIIGGLLTAGSVLALMLSHQPAMLALFMLAANVFWGLQGRRSP

SEQ ID NO: 146846 - protein, 66 aa, Glycine max
  Coding DNA Sequence Number=SeqID_55161
  Subcellular localization annotation: CTP_CleavageSite=47; ConfidenceScore=5.12e-01
MSCTGSLSTPLHLTKRTALVHSLSEKGALSQKSLTCAKHTSTNKATYLSMKSDFRPKLETGAGLRA

SEQ ID NO: 146847 - protein, 80 aa, Glycine max
  Coding DNA Sequence Number=SeqID_55162
  Subcellular localization annotation: CTP_CleavageSite=31; ConfidenceScore=5.09e-01
MMTKVMNKKLIRSKNNSSESKNNSSESKNISSESRTSQEFKNQEEFKTQEESLQSRIKIQDLKNQDQDSRMKKRLNQDKY

SEQ ID NO: 146848 - protein, 164 aa, Glycine max
  Coding DNA Sequence Number=SeqID_55163
MVKVGTSYVPINVSFSPKVGPGLPGINRDTSDVISAPTALLRSADRSEITGLIGAYRAPRAVPSCSVLTGWYRVTIRHTSIPAGTSALASGCPLSIRETMSGCAAAYESANARAIECGPLRITPAGAKGRMCCILAITMLALITPGCSSQNAFVAEKRLHRCSA

SEQ ID NO: 146849 - protein, 50 aa, Glycine max
  Coding DNA Sequence Number=SeqID_55164
MASSSSSSSHINIKSDPIDTDVLWMQPKHVSEHVWNGEEERKLHIRRAVP

SEQ ID NO: 146850 - protein, 260 aa, Glycine max
  Coding DNA Sequence Number=SeqID_55165
MVLPPRGGVIGSRPRSWEQCLWRWLCGDFFGRRLAHVHEVRGIVLRLYISVRRRPFAAGPVRRGLQARVPSRLHDEDHDTEEDTDDRSQHVAAQPQDDLARVDADGLPDDAPRAVPDEVHREQPAPLEVQLAAEPEQDDHAQTVPDDLVEEGRVEQRALGKPRGERRVGRLDLQPPRQVGRQAEQLVVEPVAETAHRLGQQQARGQGVGERPEPDARPAASEVRADRAADERAIDRDAALPDGPHGSRLKRVPGVQPLAE

SEQ ID NO: 146851 - protein, 130 aa, Glycine max
  Coding DNA Sequence Number=SeqID_55166
MTGPLVPIFIRGLHVLAIRGLHVLAFRGLHTLTFRGLHVLASRGPHALTFKGLHVLAFRGSPALAFRGLRVFNFRGLHVLAVKGSCTFTFIGLHALTFRGLHVLAFSGLHVLAIRGLHVPHFQRATRPHL

SEQ ID NO: 146852 - protein, 183 aa, Glycine max
  Coding DNA Sequence Number=SeqID_55167
MEAMMSVKKIIEANAVAISATSVVAKVNPTSPFGINQMNHPTSDMVDKDLGSMGGPHDVQIQNEHAFPPYGLPLNYTPPNMAYATEGQAVGGIPLENTSEGPQYHPQLHLLHSTTSKNPHAMAEMGKLDHLEERLRAIEGGEDYAFANLEELFLVPNIITPPKFKVPDFDEYKGTTCPKNHLK

SEQ ID NO: 146853 - protein, 425 aa, Glycine max
  Coding DNA Sequence Number=SeqID_55168
  Gene Ontology: Mol. function=two-component sensor activity; Cellular component=membrane; Biological process=two-component signal transduction system (phosphorelay)
  Homolog annotation: Hit_ID=P38097; Match level="QueryCoverage=99%, HitCoverage=38%, E-value=1e-122, Identity=52%"; Hit description =Uncharacterized protein yegE
  Pfam annotation: Domain name=GGDEF; Domain location=255-416; Score =195.5; E_value=1.3e-55; Accession=PF00990.12; Description=GGDEF domain
  Pfam annotation: Domain name=PAS; Domain location=128-245; Score =20.7; E_value=0.005; Accession=PF00989.15; Description=PAS domain
  Pfam annotation: Domain name=PAS; Domain location=2-113; Score=13.4; E_value=0.023; Accession=PF00989.15; Description=PAS domain
  Pfam annotation: Domain name=PAS_3; Domain location=24-116; Score =54.0; E_value=5e-13; Accession=PF08447.2; Description=PAS fold
  Pfam annotation: Domain name=PAS_4; Domain location=134-250; Score =44.9; E_value=2.8e-10; Accession=PF08448.1; Description=PAS fold
  Pfam module annotation: Pfam domain module=GGDEF::PAS::PAS::PAS _3::PAS_4; Domain location=255-416::128-245::2-113::24-116::134-250
MERITLANEAGGIGVWEWNLLNGEMLWDKRMYELFALEPQRVPSYDLWLHLVDVQEREAAALTIQQAIERRSAFQLEYRINLPQGVRYVRSEANSIISKDGQIERMLGICQDITSLRTLNEALFQEKERMAITLDSIGEAVICTDDEMRVTFMNPVAETLSGWPQAKAAGVALSELLTITRGAQGPRVENLLLCSLPASKTTPDLEEELVLHTPDGAQVEIHYSITPLKTLTGSDIGAVMVIHDVSESRRMMKRLSYSASHDMLTRLPNRHSFEQQLKRLVNDAAAHHSEHVLVFIDLDKFKAVNDTAGHAAGDALLRALADLMQQHLRNSDVLARLGGDEFGLLLPYSNVDQVREVVQGIVSAVHDFTFIWQDRPYHVGASAGITQIDQHNCISNVVMSQADVACYSAKHAGRGQYQVYQEVQG

SEQ ID NO: 146854 - protein, 150 aa, Glycine max
  Coding DNA Sequence Number=SeqID_55169
MSSPKRATRPHLERTTRPRLERTTHPHHQRAARPHLQRTTRPRLERATRPRLGAARLHLERTTRPRLERTTCPHHERAARPHLQRTTRPRLERRTTHPRLQRTARPHLERTTRPRLERTTCPHHQRAACPHLQRTTRPRLERATRPRLGY

SEQ ID NO: 146855 - protein, 93 aa, Glycine max
  Coding DNA Sequence Number=SeqID_55170
PPNLSQKNDDLGLIHRWIVVKFKQHVQNPFRSILTVGNLDITSELREIPGALEKKESHEDSPNGGFNPFSVSLTFGNSIGAVGGKTGRILGNR

SEQ ID NO: 146856 - protein, 270 aa, Glycine max
  Coding DNA Sequence Number=SeqID_55171
  Homolog annotation: Hit_ID=Q2HW90; Match level="QueryCoverage=81%, HitCoverage=44%, E-value=5e-23, Identity=31%"; Hit description =Putative uncharacterized protein
MGPSQTPSLKKRFYQVKVKSLGITSLRELGQLMGHLQRQVFRKTYGKIWDLAMAEVSAEAIASLAQYYDQPLRCFTFGDFQLSPMVEEFEEILGCPLGGRKSYLFSGFYPSLARISKIVQISAQEFDHRKQVENGVVGIPRKCLEAKARILAGRGEWAPFIDILALLIFRGVLFPNVNGLVDLEAIDTFLAYHDRKESPVVAILADLYDTFDRRCEKSSTRIVCCTPDLYVWLVSHLFCQEVRHACPLESHRSCTEKRGANWDQLLASKE

SEQ ID NO: 146857 - protein, 53 aa, Glycine max
  Coding DNA Sequence Number=SeqID_55172
MIRRQSKAARGGHRWSVVVEEELGGVVVGLGEEKEEEDGCFMLVGKIGEVQNL

SEQ ID NO: 146858 - protein, 86 aa, Glycine max
  Coding DNA Sequence Number=SeqID_55173
  Subcellular localization annotation: CTP_CleavageSite=31; ConfidenceScore=5.38e-01
MTHQPSSARTGPTSKTNPLANQGRGAFNAIEASSSRGPKPLKDVTTSRRFIYEALQKSGMIPRGGHKKDSCLMHPSTSHNMEACSA

SEQ ID NO: 146859 - protein, 86 aa, Glycine max
  Coding DNA Sequence Number=SeqID_55174
MAAVAVQLTTTLTMAHDLILLSKTLTCDPVTRQQCLLVASFPGACPETDHVRRFQQLNLGTLYQITDIVDSFCLEAVSRADSQFEI

SEQ ID NO: 146860 - protein, 291 aa, Glycine max
  Coding DNA Sequence Number=SeqID_55175
  Gene Ontology: Mol. function=nucleoside-triphosphatase activity; Cellular component=integral to membrane; Biological process=peptide transport
  Homolog annotation: Hit_ID=A9CJD8; Match level="QueryCoverage=100%, HitCoverage=81%, E-value=1e-144, Identity=89%"; Hit description=ABC transporter, nucleotide binding/ATPase protein
  Pfam annotation: Domain name=ABC_tran; Domain location=1-183; Score =143.6; E_value=5.6e-40; Accession=PF00005.18; Description=ABC transporter
  Pfam annotation: Domain name=oligo_HPY; Domain location=186-255; Score=73.6; E_value=6.4e-19; Accession=PF08352.3; Description =Oligopeptidedipeptide transporter, C-ter
  Pfam module annotation: Pfam domain module=ABC_tran::oligo_HPY; Domain location=1-183::186-255
MTALSLMRLLPQGAEIDSGRISFAGRDILALSSAELDALRGADIGMLFQQPQAMLDPTSRVRTQVAEPLWVHRKMSRHAALNRVVGLLSDVGIPDPSARAQCFAHELSGGMAQRVMIAAALSGNPQLLIADEPTTALDVTVQAQILRLLDDERRKRRLATLLITHDLSVVAAFADRIAVMYAGRIVEEGPTQAILKAPQHPYTKALISCSLLTTDGEGQLLTIPGSSSQAHDMSCGCRFHPRCALAKSPGMGSRCMAAEPNLNALPEGRKARCWAVGDEQVNHDHAGHAMC

SEQ ID NO: 146861 - protein, 84 aa, Glycine max
  Coding DNA Sequence Number=SeqID_55176
MAIQFKKKTNVNQKQIFIVNQRIKNRCLGEKFPSNDTKNLIELGKCTGHTSSIKWMASSSSSILFQSSHGKSSPNSLELGPFSL

SEQ ID NO: 146862 - protein, 117 aa, Glycine max
  Coding DNA Sequence Number=SeqID_55177
MAPTRHPLDPEKSNRALEFLTLITGLCQSEGVPVTPSKVIRLPITRAFIEKYCKPRQAQGDTHQDAGAPLPPRLADSAGPLGVERLSQQGQGFAPFVCPTPEQFRAKVAWPGDWPDA

SEQ ID NO: 146863 - protein, 44 aa, Glycine max
  Coding DNA Sequence Number=SeqID_55178
AHAYSTWLASSSSFSFFSSSCSSIIVAVYLEADTKSHTATILGD

SEQ ID NO: 146864 - protein, 198 aa, Glycine max
  Coding DNA Sequence Number=SeqID_55179
MEVSRAEADRGCVDFQAVHIGGITRGRAKKEEGEVYMQLGDKNPSKLKPLVIHFTKDITTHIPRVFQPPIAKTPAPFLYKSDKAIPWKYGVQGPNRRQNASVICVENGMLAAKITNIFGTSGMTRSGCIFAPPKLPARSKDKGKAKADIGEREKTGPTENDEAPIGKLAGEGDDFSKREISAEEAIEFMRIIQHSEFK

SEQ ID NO: 146865 - protein, 180 aa, Glycine max
  Coding DNA Sequence Number=SeqID_55180
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=47%, HitCoverage=72%, E-value=4e-24, Identity=68%"; Hit description=LacZ protein
  Subcellular localization annotation: CTP_CleavageSite=28; ConfidenceScore=5.07e-01
MTMITPSSKLTLTKGNKSWYRAPPREKDASHVGPWNGHFNPFSFSLTFGNPKKTIGSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 146866 - protein, 132 aa, Glycine max
  Coding DNA Sequence Number=SeqID_55181
MSNHKSTESELKNLEVQMGQLAKQIADKSSNSFVANTEQNPKEECKAVMTRSKSFVEVEDEESVVHKEKAAKKKGTEVKKNDLRGSVPAACSLDLSMSASGSCCAFSGSFIRQCHHGRRAAIRTARTRRNPG

SEQ ID NO: 146867 - protein, 68 aa, Glycine max
  Coding DNA Sequence Number=SeqID_55182
MLCKAMLERPLLYIEFQLATLKQNRCNKIMRLMEDPSQLGVATIAHNWVGPKAQQKILNVGQTAPYNL

SEQ ID NO: 146868 - protein, 162 aa, Glycine max
  Coding DNA Sequence Number=SeqID_55183
  Homolog annotation: Hit_ID=A5B0W4; Match level="QueryCoverage=38%, HitCoverage=11%, E-value=5e-10, Identity=53%"; Hit description =Putative uncharacterized protein
MAIQSPESQEELATWTAAKQKKYKQHDAKALLFIQQGVSREIFPRIMQAKNAKEAWETLKNEFKGIDKPLEQAFQSKINISKNDGDKKNNHGKFPQKRGGAFTIVVKGAKSNGVIMLQDPLANYARKIIMVQMIVGTNAKSAKSTYTTKKIIFTNKKKKQIF

SEQ ID NO: 146869 - protein, 111 aa, Glycine max
  Coding DNA Sequence Number=SeqID_55184
MDRFALTLNESQELPKLLARAKTVVDTYSTPDEVHSLFNYCKHMMTMMMEEMMRMRKMMEVNTATVVVASTATEMDPIHLFDFNQVSRLVSNVVGQGGEVAENACGPHYVQ

SEQ ID NO: 146870 - protein, 280 aa, Glycine max
  Coding DNA Sequence Number=SeqID_55185
  Gene Ontology: Biological process=transposition, DNA-mediated
  Homolog annotation: Hit_ID=Q6UUU1; Match level="QueryCoverage=21%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPVTTFVQQANSRPSVHGGEKGAVGITNRALIVPNHSLNGQVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 146871 - protein, 277 aa, Glycine max
  Coding DNA Sequence Number=SeqID_55186
  Gene Ontology: Biological process=transposition, DNA-mediated
  Homolog annotation: Hit_ID=Q6UUU1; Match level="QueryCoverage=21%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPVTTLANWSSTAVAAALELVDPPGCRNSILPISIVNNRVSLGIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 146872 - protein, 115 aa, Glycine max
  Coding DNA Sequence Number=SeqID_55187
  Homolog annotation: Hit_ID=A5BSR3; Match level="QueryCoverage=55%, HitCoverage=20%, E-value=2e-08, Identity=46%"; Hit description =Putative uncharacterized protein
MARTKKIGQMTSEAIKEIVEKIDSLEEQASQGSFIPHGCQDVLTATIGRPEHPGRVYAAGAGVTIKKYFGSAPRTSCSSSSLPSEDLQQLTQQIRDQLEESITKKVTRQLMASFS

SEQ ID NO: 146873 - protein, 296 aa, Glycine max
  Coding DNA Sequence Number=SeqID_55188
  Gene Ontology: Mol. function=guanosine-5'-triphosphate,3'-diphosphate diphosphatase activity; Cellular component=plasma membrane
  Homolog annotation: Hit_ID=A4WG31; Match level="QueryCoverage=99%, HitCoverage=59%, E-value=1e-122, Identity=77%"; Hit description =Guanosine-5'-triphosphate,3'-diphosphate pyrophosphatase
  Pfam annotation: Domain name=Ppx-GppA; Domain location=1-142; Score= -11.0; E_value=2.4e-06; Accession=PF02541.7; Description=PpxGppA phosphatase family
MGCVTWLERYFADRNLGKENFDEAENAAREVLRPVMDELRYHGWKVCVGASGTVQALQEIMMAQGMDERITLAKLQQLKQRAIQCGRLEELEIEGLTLERALVFPSGLAILIAIFTELNITCMTLAGGALREGLVYGMLHLSVDQDIRSRTLRNVQRRFLVDIDQAGRVAQLASRFADQVANAWDLDHLSRDLLLSACALHEVGLSIDFKQAPAHAAYLVRNLDLPGYTPAQKKLLATLLLNQTNAVDLSSLHQQNAVPPRVAEHLCRLLRLAILFASRRRDDLLPAINLVAVDEK

SEQ ID NO: 146874 - protein, 246 aa, Glycine max
  Coding DNA Sequence Number=SeqID_55189
  Subcellular localization annotation: CTP_CleavageSite=84; ConfidenceScore=5.07e-01
TGTKRKKGDTHVVTSTPAWIKPPQISHGTHQYAQHHPSFSACVGDSSNSAPVQPRALAPIQREAPQALAPTPTRPAGNAHFGVSSNAIRNFPLRPTPEFASIPMTYEDLLPSLVANQMAVISPGRLTFQEDRPNVKTNSLANHGGGAVNAVKSEQHICMQSADKEGLRKPKPLVIHFTKGKAKITEGQNVKVIPTPDEDVPIKCVSERRDGCDKKKVSLEEASEFLRIIQQSEFKVIEQLNKTLAR

SEQ ID NO: 146875 - protein, 73 aa, Glycine max
  Coding DNA Sequence Number=SeqID_55190
MTGDASKFTHISPKKNGHVTYGDNNKGRILGVGKIESLEEMHIYGEDHKGKGDGNNEDFHIDEIKANADLPRE

SEQ ID NO: 146876 - protein, 241 aa, Glycine max
  Coding DNA Sequence Number=SeqID_55191
  Homolog annotation: Hit_ID=Q6UUU1; Match level="QueryCoverage=24%, HitCoverage=40%, E-value=3e-18, Identity=78%"; Hit description =Putative uncharacterized protein
GPGLPGINRDTRIYLFCEVISVTAVPPVQLLTGWCVTAKAPPDISAGKCSGRVPFAIQAAQLLGRAIGAGLFAITPAGERGMCCKAIKLGNARVFPVTTLYQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 146877 - protein, 436 aa, Glycine max
  Coding DNA Sequence Number=SeqID_55192
  Gene Ontology: Mol. function=hydrolase activity, hydrolyzing O -glycosyl compounds; Cellular component=membrane; Biological process =carbohydrate metabolic process
  Homolog annotation: Hit_ID=A7PCF2; Match level="QueryCoverage=62%, HitCoverage=19%, E-value=9e-66, Identity=50%"; Hit description =Chromosome chr2 scaffold_11, whole genome shotgun sequence
MGCYNPHVYKVVSPYYMFKFLKNTRISGWMFLGGILLCITGSLLQAPLDDDASRGSVTKHLCDTQRCPIDLITPPKDFHICRVEDLLVNRIMKGSIIHIHRARTVIVDTDGMIAASELGCTEGIGKGNFLNGASGGAGHGGKGGSEYFNGRESIGGSEYGNAILPCELGSGTEGLNESYEHVVGGEMIVMGSIQWPLLRLDLYGSLRADGESFSKSIKSSDGSLVRGLGGGYGGIVLFFLQQIRLLENPYLSVVGGNGGPIDGGGGGGGRIHFHWSKISMEDEYVPVASITGTMNNRIVLFIAGGVTRRSCPYKCISDKVGPISKFNSGLVVPRYPLLINTWGYSTIILFAPMSHYASASGGPVNASREFKQMVKALHSAGIEVILDVVYNHTNEADDAFPYTTSFRDIDNKEAGPCPSYLNPIFLQALAKGQAWA

SEQ ID NO: 146878 - protein, 175 aa, Glycine max
  Coding DNA Sequence Number=SeqID_55193
  Subcellular localization annotation: CTP_CleavageSite=28; ConfidenceScore=5.16e-01
DYAKAEFSAIFAKWPPMSLSGSVYFVKMASRKRKSIGARPTAQYDTRRFHPLDAWNRYTNNILGKSILPERKVEIYHTKFDDFKAELEGRNLHKCLTNLADGIIDVALKRGRHYPPSLGTAGPSGEDSQEEFDYLGRGVECSLLLQPGPYISYVKPYCGQSQVDLWPSLSYGHEH

SEQ ID NO: 146879 - protein, 199 aa, Glycine max
  Coding DNA Sequence Number=SeqID_55194
MSHHSSSANGEGTSHKDPLSRILDELSSLKLWKEKLERKEKGKERVKINQEEREQISSHNSCKSLSEELHDYYEGRHGSHVRPHSHRREKERKPQEANINLSYFHGKDNVEANLDWEIRIEQQLKRKSTSKSYGSDSYPKKDQGQGILGVTPSKPKDDKGKTIEKQPLKASMQEKTNSLKCFKCLGKDTLLLNAPPRKP

SEQ ID NO: 146880 - protein, 89 aa, Glycine max
  Coding DNA Sequence Number=SeqID_55195
MYPCQKWHENASQMNICCGIAPQVYLDGMQEWLRESFPRKDLGGTPRLKGPVPPPSLIATVSGAPSTSSVSRPSKDGRSTKRDASSSRR

SEQ ID NO: 146881 - protein, 151 aa, Glycine max
  Coding DNA Sequence Number=SeqID_55196
MGKARAIVEELKRFLVADSLKERSLHSNFDHVRDQVLARDQVPSMDSLITKLLRVPHVLKDENLADVVETSVMVAPRGRGGRCNSSFSKIPHFVTVANGSKVVSQGSVTFNANSFVIQEHGTGQLIGEGRLPSLPKLKMMVSSLKNLRLLE

SEQ ID NO: 146882 - protein, 128 aa, Glycine max
  Coding DNA Sequence Number=SeqID_55197
  Subcellular localization annotation: CTP_CleavageSite=47; ConfidenceScore=5.19e-01
MIIIKTSKAIASTLLFAGIAPTKTPSGPGEVQQGPGGSRPQDTLWTRRSPTGSWSCQALITGLYQFYGVPVAPSKVIRPPTNRAFIKKYCVPRQAQGETPQQPGDGRQRATDAPPSPLEFTSAHPQKG

SEQ ID NO: 146883 - protein, 189 aa, Glycine max
  Coding DNA Sequence Number=SeqID_55198
  Gene Ontology: Biological process=transposition, DNA-mediated
  Homolog annotation: Hit_ID=Q1J7G7; Match level="QueryCoverage=16%, HitCoverage=45%, E-value=4e-11, Identity=100%"; Hit description =Transposase
VLQWLLFLSAVPPVQLLTGWCVTAKAPPDISAGKCSGHAARRVPFAIQAAQLLGRAIGAGLFAITPAGERGMCCKAIKLGFLEPIPFGYQGMTVYTFVDQAYRYRRPRGGARYQLLFPLVRVNFELGVIMVIAVSFGKPVVPAALMNRPTRGERRFAYWALAECILAYYVGTDEGVSEVLHVAGEKRLH

SEQ ID NO: 146884 - protein, 76 aa, Glycine max
  Coding DNA Sequence Number=SeqID_55199
  Subcellular localization annotation: CTP_CleavageSite=54; ConfidenceScore=5.17e-01
MEGANTFLKRKYNSRIWNILHDRFPSVFPTFSTNKRWWRLRAFSSFGRRTCEPRLAHPQKGRLRQLATPLGIIFVS

SEQ ID NO: 146885 - protein, 159 aa, Glycine max
  Coding DNA Sequence Number=SeqID_55200
MDAGWLTFQEDRPNVRTNPLANHGGGAVNAVESDRPHRSKPLRDVATPRRFIFEALQKGGVIPHSGCKEDSCLLHSGEMHDMETCLEVEELLQRMIDQGRLEVGIEGKEEQHICMQSTEGSGVAKPKPLVIYFTKSAASQKPGHPLMAIPGCLLLAGKE

SEQ ID NO: 146886 - protein, 110 aa, Glycine max
  Coding DNA Sequence Number=SeqID_55201
  Homolog annotation: Hit_ID=A0ST23; Match level="QueryCoverage=22%, HitCoverage=51%, E-value=3e-07, Identity=100%"; Hit description =Putative reverse transcriptase
MNLYSWSLEIKIEAFGDKNDQAYRYRRPRGGARYQLLFPLVRVNFELGVIMVIAVSFGKPVVPAALMNRPTRGERRFAYWALAECILAYYVGTDEGVSEVLHVAGEKRLH

SEQ ID NO: 146887 - protein, 161 aa, Glycine max
  Coding DNA Sequence Number=SeqID_55202
MENHRFISKSDLAKARSNRKRIRQQKVHLDVQHSVHASLNPASSHTEDDYNQPKTPPHSVHATADRAPHDAEDHFNICDSSENETSGSAEESETISSVRYPNCESSHHDSSMDTGAHTNVDIGNAKMWYHENISKRSNASAHDLAYVVEMARLNFHCIEST

SEQ ID NO: 146888 - protein, 79 aa, Glycine max
  Coding DNA Sequence Number=SeqID_55203
  Subcellular localization annotation: CTP_CleavageSite=38; ConfidenceScore=5.18e-01
SPGKGAPERVRAPSCPGPCRTTRRCRRVGLFGKCSPNRAGSGWGPAMCPGRMWNGESRSADRLGTLTDADCDGGPSPGC

SEQ ID NO: 146889 - protein, 136 aa, Glycine max
  Coding DNA Sequence Number=SeqID_55204
  Homolog annotation: Hit_ID=Q84VH5; Match level="QueryCoverage=80%, HitCoverage=27%, E-value=1e-21, Identity=94%"; Hit description =Envelope-like protein
HTIAKEITAKQVQHWPKKGKLSAGKLSVKYAILHRIGTANWVPTNHTSTVAIDIVSTSGKAAASGDVSKDDLIAELKDTCKVLEATIKANTEKKMELERLIKRLSDNGIDDGEAAEEEEDAAEDTESDDDDSDATP

SEQ ID NO: 146890 - protein, 289 aa, Glycine max
  Coding DNA Sequence Number=SeqID_55205
MAPRKLASKRSRKDKAAEGTSSAPEYDSHRFWSAEHQQRFEAIKGWSFLRVRRVQLRDDEYTDFQEEIVHRQWASLVTPMAKFDPDIVLEFYANAWPTEEGVRDMRSWVRGQWILFDADALSQFLGYPLVLEEGQECEYGQRRNRADGFDKEAIAQLLCIPGQDFARTAAGRRLRIMRTNMTTLTQIWMTLLLSNIQPSDHNSDLPCRSVSWCMAPTRHPLDPDKSNRALGFPALITGLCQSFGVPVAPSKVIWLPITRAFIEKYCTQRQAKGDAPQVTTSSGWPSWII

SEQ ID NO: 146891 - protein, 152 aa, Glycine max
  Coding DNA Sequence Number=SeqID_55206
MTKGNPGDLQPFDPEIDRTFHKLVRHSLHPGHFEHFEHPDHFEHFVTGDSEYFDFEHSAINFHTENMAQPPPYERTLREMVAPDFTYESLCIQYPDEGKDPLKHLKEFHIFCSTMKPPDVQEDHIFLKAFPHSLEGVAKDWLYYLAPRSIFS

SEQ ID NO: 146892 - protein, 160 aa, Glycine max
  Coding DNA Sequence Number=SeqID_55207
MARAGDNGGVYHQLDESQRLFLDAWTTQMQRLLNRNKEKPYRQIAKSSSFTLKPLSPREVCDDQIRMEEKREQEKENSEALQMNMKKKSDTPEEKSDTHERKFNYFAEASEVRKVLPAHELLNLQYCKDSKISTDNSNEFTISISPSVQPLLQEFKNVFS

SEQ ID NO: 146893 - protein, 105 aa, Glycine max
  Coding DNA Sequence Number=SeqID_55208
  Gene Ontology: Mol. function=nucleic acid binding
  Homolog annotation: Hit_ID=Q2AA09; Match level="QueryCoverage=51%, HitCoverage=19%, E-value=7e-09, Identity=53%"; Hit description =Retrotransposon gag protein
MAEDHPQRMTLEDYSSFATPQYLTSIARLDVQAANISYPHSLIQLIQGNIFHGVPEDAIHLNLFSFSLASEAKRWLHSFKGNSLWTWEAMVEKFLKKYFPKSKTA

SEQ ID NO: 146894 - protein, 91 aa, Glycine max
  Coding DNA Sequence Number=SeqID_55209
MCCYEWIKSEALRVGRLSLNSVIVMAVQLIRERVEMECLEGAWETLEGNTRCRFRGTTRFTATSLVHPDEPARTLQRTVEWTAPWISFVYF

SEQ ID NO: 146895 - protein, 188 aa, Glycine max
  Coding DNA Sequence Number=SeqID_55210
  Subcellular localization annotation: CTP_CleavageSite=74; ConfidenceScore=5.05e-01
MVKVGTSYVPSTVSLLPKVGPGAPVAYHVVYQLFPPVQLLTGNWLSASQFGTQALQPEASACKSNSPHPPRLIACRYRAASHSPFRLRNVGKGLIGAPFAINESANAGERGMCCKFAIKLGNATGVELEKAATAVAVSSELVNRIYPLPRAALNSPYAHGRSTCGERKWLTNGAEISWKMPGRYLTGK

SEQ ID NO: 146896 - protein, 141 aa, Glycine max
  Coding DNA Sequence Number=SeqID_55211
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=61%, HitCoverage=73%, E-value=3e-24, Identity=67%"; Hit description=LacZ protein
MEGCCPYSYVSSDVMRKSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 146897 - protein, 118 aa, Glycine max
  Coding DNA Sequence Number=SeqID_55212
  Subcellular localization annotation: CTP_CleavageSite=34; ConfidenceScore=5.00e-01
MPSFSQMQSQFQSQMQSQGLTLPPEAEVGPSGARASTKESCVDPSGNDPETGHSDKCGLFYEGSTTVYNIPLLHGQVKVGVEKVKDVEALIPVPTDEEAVSPANLQKARMKRSMIPCT

SEQ ID NO: 146898 - protein, 90 aa, Glycine max
  Coding DNA Sequence Number=SeqID_55213
MARTKKTGQMTSEAAKEIAEKIASQGSFVPHGRQDVLIAAIGRPEHPGRVHASGASVTIKQYFGPAQRTSRTSSSVAPEELEQLTQQIRD

SEQ ID NO: 146899 - protein, 154 aa, Glycine max
  Coding DNA Sequence Number=SeqID_55214
  Homolog annotation: Hit_ID=A5BGH9; Match level="QueryCoverage=53%, HitCoverage=16%, E-value=2e-07, Identity=34%"; Hit description =Putative uncharacterized protein
MTRGNPSDLQPFDPEIDRTFHRLVRHHFIPFDHSELSITGESVHYVIGDFEHPDLEHYNFEHSDSEHSDFAHSENMAQPPPRERTLREMAAPDFTYESLCIQYPDEDVPYVLKTGLIHLLPKFHGLAGEDPHKHLKEFHIVCSTMKPPDVQEDH

SEQ ID NO: 146900 - protein, 62 aa, Glycine max
  Coding DNA Sequence Number=SeqID_55215
  Subcellular localization annotation: CTP_CleavageSite=40; ConfidenceScore=5.30e-01
MTAKRASTTKSSFSALSTTEESGMASASRPCAKREISVLSAGGVFSQAQRTTDTKPESTYPH

SEQ ID NO: 146901 - protein, 343 aa, Glycine max
  Coding DNA Sequence Number=SeqID_55216
  Gene Ontology: Mol. function=transmembrane receptor activity; Cellular component=membrane; Biological process=signal transduction
  Homolog annotation: Hit_ID=Q2L1D4; Match level="QueryCoverage=65%, HitCoverage=40%, E-value=1e-100, Identity=89%"; Hit description =Methyl-accepting chemotaxis protein precursor
  Pfam annotation: Domain name=MCPsignal; Domain location=38-259; Score= 345.5; E_value=9.5e-101; Accession=PF00015.12; Description=Methyl -accepting chemotaxis protein (MCP) signaling domain
MQESLTRTVSSVRRGVDEINTGSHEIAAGNTDLSSRTEQQAASLEETAASMEELASTVKQNADNARQANQLAASASDVAERGGSAVAEVVNTMQGISASSRKISEIVSVIDGIAFQTNILALNAAVEAARAGEQGKGFAVVAGEVRSLAQRSAQAAKEIKGLIEDSVSKVGAGSQQVERAGATMQEIVASVKRVTDIMGEISAASEEQSSGIDQVNRAVSQMDEVTQQNAALVEEAAAAAGSLQEQAQRLAEAVAVAGAPAGAAPQCAAGCRATSGNGCADPGAGHDRCRARGAPDAQRAARQNGDGGGGQRGASAAAPGPPRGGQRCQADTGGHPPPGAGRR

SEQ ID NO: 146902 - protein, 70 aa, Glycine max
  Coding DNA Sequence Number=SeqID_55217
MIGTYVILAQYLEHAYAIGQLLRYPLVLEEGQECEYGQRRNRSDGFDEEAIAQLLCIPGQDFARTTAGRR

SEQ ID NO: 146903 - protein, 107 aa, Glycine max
  Coding DNA Sequence Number=SeqID_55218
MNDNSIHGAPKSENGELHYRNHYAWLQTHGWRMHERKRNSWGSEKGARMEDCTKGSSLIDPESWLENLWWRMHERKCHSWGSERGLRMENCTKQSLRMAPNSWVEDA

SEQ ID NO: 146904 - protein, 153 aa, Glycine max
  Coding DNA Sequence Number=SeqID_55219
  Homolog annotation: Hit_ID=A5ATL8; Match level="QueryCoverage=37%, HitCoverage=45%, E-value=3e-19, Identity=82%"; Hit description =Putative uncharacterized protein
SYGRQQWGIFRNGRKPDGAMPREGRRPTVRRQIPGLNPGQAVETTKLEYETKARGANGIRYPSSPSRKRWILGAVRIDPCNAVANALSIPPGEYRRTLPGLDMPRILLKERGAFGNADTGGAWLSSARATAGDKPEEGEDDVKSSCPLCPGRH

SEQ ID NO: 146905 - protein, 325 aa, Glycine max
  Coding DNA Sequence Number=SeqID_55220
IATVVKDSARGLDRIKQTRNGIAGLPQKYLEDKARGMANQGDWVPFMDVLALLIFGVVLFPNVDGLIDLAAIDAFLAYHHSKESPVVAVLADLFDTFDRRGCINYNPALAIRQLGYPMRGAPTEESMSLFLVRDFGARNSKTIQRIHKAWETPLKKEEELRGIRNGIIGGYHEWLKVHVRGLDWLAKLKVVSKESFEALEEDEEVQALKSELGKAKLAKEKFKLAATHVRKECAGLREENAITARALEQETKRARKEEYGRNKFRGALWGSNSELKEDRDQSRAHSMVLKEELVACSRSKRSLSQRLCETETNMLAIIAKYQEEL

SEQ ID NO: 146906 - protein, 34 aa, Glycine max
  Coding DNA Sequence Number=SeqID_55221
MENWQTALGNDIRGAPDSKGSRLEGGGHMNNARQ

SEQ ID NO: 146907 - protein, 237 aa, Glycine max
  Coding DNA Sequence Number=SeqID_55222
MQSQMQSQGLALPLEPLVGPSGPRVSTKGSYVDPSRNDPETGDSDRCSLYIEADPARLVALGRVYEGSTVVHNTSLLSGQVKVSVEEVTDADALVPATTDEVAMSPAKPPLKPDSQVDDPLYLMTLTIPELFLRPYQVTWDATMFGVFNPDFPLYIKHKDLSEIAHGGQCLSISVLQLWILHLTETSMRAENSDIYGFLEPQSIQRSGQSQFEFESYIKTWMQSSKRDVYLGAYLNG

SEQ ID NO: 146908 - protein, 285 aa, Glycine max
  Coding DNA Sequence Number=SeqID_55223
  Homolog annotation: Hit_ID=UPI00006A2939; Match level="QueryCoverage =74%, HitCoverage=100%, E-value=2e-11, Identity=28%"; Hit description= UPI00006A2939 related cluster
GLHVLAFRGLHVLTIRGLHALTSRGLHVLALRGLHAFTLGTSYPHLQRTTRPHHQRAARPHLQRTTRPRLERATRPRLGGLHALAIRGLHVLTFVGLHALTFRGLDVLANRGLHALTLRGLHVLANRGLYALTLRGLHTLTSRGLHTLTIRGLHVLTFRGLHALTIRGLHVLTFVGLLALTFRGLHVLANRGLYALTLRGLHALTSRGLHILASRGLHALTFRGLRIAPTRHPVDPEKSNRALGFPALVTGLYQSYRVPVPPRQGHVIIGIAPARHPVDPKKSNR

SEQ ID NO: 146909 - protein, 166 aa, Glycine max
  Coding DNA Sequence Number=SeqID_55224
  Gene Ontology: Mol. function=alcohol dehydrogenase activity; Cellular component=membrane; Biological process=electron transport
  Homolog annotation: Hit_ID=A8GE76; Match level="QueryCoverage=79%, HitCoverage=11%, E-value=6e-52, Identity=78%"; Hit description =Aldehyde oxidase and xanthine dehydrogenase molybdopterin binding
  Pfam annotation: Domain name=Cytochrom_C; Domain location=32-119; Score=15.5; E_value=0.0065; Accession=PF00034.12; Description =Cytochrome c
MANYVMSLSTKATLNVEPQAQLAARALPAAGQLAGERLFQGACQACHSAAAGGPQLFGVSPDLANNTNIFSDRPDNLIKVILQGIPKPATAELGFMPGFKDSFSDRQVTALVNYLRQRYAGDKPAWRDVEAQAKVPAIIVCHGFCGIQELLLPAFAEAFVNVGFAA

SEQ ID NO: 146910 - protein, 43 aa, Glycine max
  Coding DNA Sequence Number=SeqID_55225
MIDDDYLVSNSYVEESLDEDDSVDGISDTDDEVTDILNQCTTN

SEQ ID NO: 146911 - protein, 100 aa, Glycine max
  Coding DNA Sequence Number=SeqID_55226
MSYRMSRHHASEHADYMCPYEQIKQPLFTTFSPNHYPCDLYLRATLRYENLRSLPLTHTPVFTIKSKTHQRSTLNKRDQLYTLEINSRHKGSTLHTRSNT

SEQ ID NO: 146912 - protein, 123 aa, Glycine max
  Coding DNA Sequence Number=SeqID_55227
MKRSIAGRKNSGQSSRWRQESEGSPPCHISRSFISAGLGDEGQVFAICEDDVPSTSDLVRPCPPDFQLGNWRVEERPGIYATSIIFDDVSPEGTNTWDPSINFEQEMNKRKMKEMRMWDFLRN

SEQ ID NO: 146913 - protein, 214 aa, Glycine max
  Coding DNA Sequence Number=SeqID_55228
  Homolog annotation: Hit_ID=UPI00006A2D9E; Match level="QueryCoverage =68%, HitCoverage=79%, E-value=2e-13, Identity=18%"; Hit description =UPI00006A2D9E related cluster
RLHALTFRGLHTLTFRGLHILTIRGLHALAIRGLHVLAIRGLHTLAFRGLYALAFKELHVFAIRGLHALTLRGLHALTFRGLHVLAIRGLHALAIGGLHVLTIRGLHVLAIGRLHALAFRGLHVLAFRGLHILTSKGLHVLAMRGLHPSPSEDYSSLPLEGCMPSPLEDYASTPSKGFTPSSLEDYLSSPSEGCTPSPSESCTPSPLEGSTSVP

SEQ ID NO: 146914 - protein, 303 aa, Glycine max
  Coding DNA Sequence Number=SeqID_55229
  Homolog annotation: Hit_ID=Q6WAY6; Match level="QueryCoverage=98%, HitCoverage=50%, E-value=3e-24, Identity=29%"; Hit description =Putative uncharacterized protein
KGEWAPFIDILALLIFRGVLFRNVDGLVDLAAIDAFLAYHNHKGSPVVAMLADLYDTFDRRCEKSSTRIVCCTPALYVWLVSHLFRQEVRHACPLESHRSCIEKEGTNWDQLLANKEGASINWFPRWKEGRIGVLISCGGFPNVPLMGTRGCISYNPVLAIRQLGYPMRGAPLEEEIASVISRGFNKTNMETFQKDKELRGSNNEPIGGYRKWLKAHVQGLDWIPSLRTAKREEVEAPEEDEEVQALRAELEQAQIVKERFKSAALKIRKENAELRDINVATTKALEQETRRARREEHGWNKF

SEQ ID NO: 146915 - protein, 113 aa, Glycine max
  Coding DNA Sequence Number=SeqID_55230
MFIRITTQTAKKNVYTDNHSGISARQRDSNVSMTDLVSAEDDTAKKNVYTDNHSGISARQRDSNVSMTDLVSAEDDVSLYVLSGVSSYRQQKSFESADNHLGISACHVTPGPA

SEQ ID NO: 146916 - protein, 146 aa, Glycine max
  Coding DNA Sequence Number=SeqID_55231
MPGWSGLVKLGFGNSTPPDVPKDYGVPITCGTRWRSGDGAQQAPSTPSQLSRIAAQQNNIQTAQVSQQQNRAKGGLHNVPAPFLSLVIDYTPLVIDYQKPLWLPDLVFKPGNRLHPMELACLGTSQVFTDRLCPGWVGIGQAWFGQ

SEQ ID NO: 146917 - protein, 121 aa, Glycine max
  Coding DNA Sequence Number=SeqID_55232
MPISTCGRIAPLVDPEKSNRVLGFLALITGLCQFYGVPVAPNKVIRPPINRTFIKKYCTPQAGAGQDTTTACGWPTVGNRRTAATSRAHKLIYKGWRVAYDPWPTSRRPSPKPKVSKVLGP

SEQ ID NO: 146918 - protein, 226 aa, Glycine max
  Coding DNA Sequence Number=SeqID_55233
  Homolog annotation: Hit_ID=A4PP05; Match level="QueryCoverage=58%, HitCoverage=46%, E-value=4e-15, Identity=32%"; Hit description=IMP dehydrogenase/GMP reductase, putative
AFRDLAQVGGFACGAAALVHMYDHLNDASLASTRQLGGYITLLHCWIYEHFPTVHTSVVHDAYDEGSPHACRWLTGKAHMMRIKGASYRRRLDALSVTDIVVYVRPERVLRQFGYLQTVPPPSVAPDYMEWFFRISHPFVTRTEETAVRRHPPPPHHEEFVEPPISEVSVATDLPTHSVVHCEGCQGMAQDLGAIAEDLERVINLRMVTEGTDLHDIMTRCLRRAR

SEQ ID NO: 146919 - protein, 55 aa, Glycine max
  Coding DNA Sequence Number=SeqID_55234
MTLQLADRSITRPYGVIEDVLVRVKHFIFPTDFVAIHANCKLHSGYGEKEAGAGL

SEQ ID NO: 146920 - protein, 192 aa, Glycine max
  Coding DNA Sequence Number=SeqID_55235
  Gene Ontology: Cellular component=mitochondrion
  Homolog annotation: Hit_ID=Q6R984; Match level="QueryCoverage=47%, HitCoverage=81%, E-value=8e-16, Identity=55%"; Hit description =Putative uncharacterized protein orf110-c
EANCLRAGSCMNGNVHVRLREKGGGQKWPCCTSLSSSMGSALFFLGEYANMILMRCGALHLTFVGLPSSGACVPAFLCNKPLRPKTSGRWSRGAFGEGSGDPFTLPRTDTCTECSYGERLTPGSGNEVSEKSFLSRPLRGGADTPARITGDGLQEWRGSEQYPTTFQGMDVDPSGRDNHSGPGKRWATILKN

SEQ ID NO: 146921 - protein, 45 aa, Glycine max
  Coding DNA Sequence Number=SeqID_55236
MASMDTSAMVNSKIFPEDPDRTPMRCICKRRNNMTIFTEHKQNGI

SEQ ID NO: 146922 - protein, 253 aa, Glycine max
  Coding DNA Sequence Number=SeqID_55237
  Gene Ontology: Biological process=transposition, DNA-mediated
  Homolog annotation: Hit_ID=Q6UUU1; Match level="QueryCoverage=23%, HitCoverage=40%, E-value=3e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPVTTFTLFQRGKQRIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 146923 - protein, 127 aa, Glycine max
  Coding DNA Sequence Number=SeqID_55238
  Subcellular localization annotation: CTP_CleavageSite=45; ConfidenceScore=5.01e-01
MVTGLCQPYRVPVPPASSCHHDIGIVLARQPSGPQRRPNRVLELSSSKYGSLSVQGSACCPQQGHQAPYQSSFHLEVLRPQAGAGRDTTAALGWTVAGNRHTAITTKVHLSSSIKRLERCLRHMADQ

SEQ ID NO: 146924 - protein, 165 aa, Glycine max
  Coding DNA Sequence Number=SeqID_55239
MKNTLEIGGFNWENTKYHISQSRGSALDGEEHIGEWRNPIGKITNITFPSQEGPLLTVKNTLENRGFNRENNKDHISQSRGSALDGEEHGPLLTMKNTLEIGGFNWENNKDHISQSRGSALDGEEHIGEWRNPIGKITNITFPSQEGPLLTVKNTLENGRIQSGN

SEQ ID NO: 146925 - protein, 103 aa, Glycine max
  Coding DNA Sequence Number=SeqID_55240
MSPPPLEPHNHSQTHLILSGWLSLLAQFSASGLVGAYVLSATLACLARISEFWLIAHLFAQRMDSSSALSGISPCSTNMHNSSFFQILPRAQPKECCAQRMTL

SEQ ID NO: 146926 - protein, 158 aa, Glycine max
  Coding DNA Sequence Number=SeqID_55241
RPGLDDTAEDTLTVYPAPLLSSQRRRGPDDQAETQNLVHSTPLVSSQRPAGPMIRGDTLRFIHTLCHPEAAGPMIRGDTLRLSAPFCHPEVAGPMTSRDQVWSFCTLVSSRGGGPDDTRRYLTVIRTLLSSRGGGPDDKQRPNLVILHPCIIQRRRAR

SEQ ID NO: 146927 - protein, 170 aa, Glycine max
  Coding DNA Sequence Number=SeqID_55242
  Homolog annotation: Hit_ID=Q6WAY6; Match level="QueryCoverage=65%, HitCoverage=19%, E-value=2e-09, Identity=31%"; Hit description =Putative uncharacterized protein
MGTNQTGKRFYQVKVKSPRYHQHQGIRAVDGTPPNAILPQDLQKDLRIDHSRVPTIEEFEEILGCPLGGRKPYLSSGCLPSLSRIATVVKDSARGLDRIKQTRNGIAGLPQKYLEDKARGMANQGDWVPFMDVLALLIFGVVLFPNVGGLVDLAAIDAFLAYHHSKESPV

SEQ ID NO: 146928 - protein, 294 aa, Glycine max
  Coding DNA Sequence Number=SeqID_55243
  Homolog annotation: Hit_ID=Q84VH5; Match level="QueryCoverage=100%, HitCoverage=44%, E-value=1e-121, Identity=77%"; Hit description =Envelope-like protein
KEESTEEEDQATKETPAPRAPEPAPGDLIDLEEVGSDEEPIANRLAPGIAERLQSRKGKTPIKRSGRIKTMAQKKSTPITPTTSRRSKVAIPSKKRKEISSSDSDDDVELDVPDIKRTKTSGKKVPGNVPDAPLDNISFHSIGNAERLALERELGKKCLGLQGDHGPHQAAGLLKTVTKLGDCYESLVREFIVNIPSDITNRKSDEYQKVFVRGKCVRFSPAVINKYLGRPTEGVVDIDVSEHQIAKEITAKRVQHWPKKGKLSAGKLSVKYAILHRIGAANWVPTNHTSTVAT

SEQ ID NO: 146929 - protein, 84 aa, Glycine max
  Coding DNA Sequence Number=SeqID_55244
  Subcellular localization annotation: CTP_CleavageSite=50; ConfidenceScore=5.47e-01
MVKSWNLLRADQRLIFAKSWAQGFPVSTGTPRIYFFLRSDPSVTSCPSCSATDGVGRNGKSTRRTSALASVAVPLRVTTTPRRA

SEQ ID NO: 146930 - protein, 77 aa, Glycine max
  Coding DNA Sequence Number=SeqID_55245
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=38%, HitCoverage=29%, E-value=1e-10, Identity=96%"; Hit description=LacZ protein
MSSWPRTSHPPFASWRNSEEARTDRPSQQLRSLNGEWDAPCSGALSAAGVVVTRSVTATLASADVRRCFCRYAPPRQ

SEQ ID NO: 146931 - protein, 100 aa, Glycine max
  Coding DNA Sequence Number=SeqID_55246
MASMMEAMLRMRQLIEKNMATAATVSSAAEADPTLLATAHHPPPNVIGRERSTLGHNSNPHLGYNRVAYPYGLPPNYTPPVMHDDAGHVSSPILEREPPR

SEQ ID NO: 146932 - protein, 312 aa, Glycine max
  Coding DNA Sequence Number=SeqID_55247
  Homolog annotation: Hit_ID=Q84VH5; Match level="QueryCoverage=100%, HitCoverage=57%, E-value=1e-130, Identity=66%"; Hit description =Envelope-like protein
MIPGPGPVPEKLAPKRQQGVKISENPSFATSPREVDTEMDKKIRFFGDGILKNASVPDADKDVPTSSTPNAEVLPSPKEVESDEEPITKKLAPGFVERLQSRKGKTPITRSGRIKTIAQKKSTPITPTTSRWSKVAIPSKKRKEISSSDSDDDVELDVLDIKRAKKIREKELGRDALACKEIMDLIKAAGLLKTVTKLGDCYESLVREFIVNIPSDITNRKSDDYQKVFVRGKCVRFSPAVINKYLGRPTEGVVDLAISEHQIAKEITAKQVQHWPKKGKLSAGKLSVKYAILHMIGAANWVPTNHTSTVAT

SEQ ID NO: 146933 - protein, 30 aa, Glycine max
  Coding DNA Sequence Number=SeqID_55248
MEDSSRDDTNPPFPIPYMATPQTRKQRDKQ

SEQ ID NO: 146934 - protein, 136 aa, Glycine max
  Coding DNA Sequence Number=SeqID_55249
MRIVASCLHWIQEHRVPTAAQVVEGSSMMDKRSSVTQDDLGRNISRDGGGDNIEVTFLSSTRAKGCDGNGLLVFHTTRSKGCDVDHDFKKYLIFIICMIPDKGFVGASKTWQQNSGCVWVSQLLLDISYILSRIRG

SEQ ID NO: 146935 - protein, 193 aa, Glycine max
  Coding DNA Sequence Number=SeqID_55250
MASMMEAMLGMRKLMEENVATVAAISSAAEANPTLLATAHHPPPNAIGRERSTLGHNSNPHLGYNRVAYPYGLPPNYTPPVMHYDVGHVSSLILEGEPPRQPDEPNLTAQPIFLYTEGPPSATEERRKLDLLEERLRVVEGFGDYPFADMTDLFLVPDVVIPPNSKCLISTSIKGRLVLRTISDVLSQDGGAL

SEQ ID NO: 146936 - protein, 225 aa, Glycine max
  Coding DNA Sequence Number=SeqID_55251
  Gene Ontology: Mol. function=motor activity; Cellular component=cell projection
  Homolog annotation: Hit_ID=UPI00016621D1; Match level="QueryCoverage =56%, HitCoverage=40%, E-value=8e-17, Identity=41%"; Hit description =UPI00016621D1 related cluster
  Subcellular localization annotation: CTP_CleavageSite=65; ConfidenceScore=5.52e-01
GGPLGTSTLTFRGLHALAFRGLHVLALRTTRPHLQRATRPRLQRTARPSLHRTARPCLQRTISPRLQKATCPRFQTTTRPQLQRTKHPHLQRTTRLHVLAFKGLHVLTFKGLHVLTFKGLHALTFSRLHVLPYRGLHVLTFKGLHALAFIGVNALTFRGLHVLAFRGLHAFTFRGLHVLTFKGLHVLAFRGLHVLTFKGLHVLTFKGLHALTFSGLHVLAFRGLH

SEQ ID NO: 146937 - protein, 78 aa, Glycine max
  Coding DNA Sequence Number=SeqID_55252
MPTQTLTPSSPPPTTIGGHHEPPLVATEPPHQEEHFNRSKILRIHLKDSVDSNPSNPFFHSFFENVEFGLTNVNEIGL

SEQ ID NO: 146938 - protein, 145 aa, Glycine max
  Coding DNA Sequence Number=SeqID_55253
  Homolog annotation: Hit_ID=A5C8I0; Match level="QueryCoverage=71%, HitCoverage=23%, E-value=1e-11, Identity=32%"; Hit description =Putative uncharacterized protein
MIAFFESTHIDMWDVVEKGNHIPLDARRNETPRDRWIDEHKSKFLLNSHARNALLCTLSQEEYSNVQNFRSVKQMWDTLAIIYEGSFEVKRNKLSLLILHGQELAQDEGTKKGKSLALMVKRPKHNSASKESLSKALAINDDSEV

SEQ ID NO: 146939 - protein, 101 aa, Glycine max
  Coding DNA Sequence Number=SeqID_55254
MTMIVDTLPVFYYGKWWATHLQSFADLVFASERIGVGLKKGKFSHPAWTNEKTGANEEGEDEGKTHAVTAIPIQPSFPPTQKCHYSTLLLTYRPFIHKGHP

SEQ ID NO: 146940 - protein, 180 aa, Glycine max
  Coding DNA Sequence Number=SeqID_55255
GSPLRLDHLLPLIPLHWVKGRLQHLERKMLEHLSQHQAQTLFGVEDVGTSFSASGTEAARVFSNLHSLWLFLVADEVLRVEHSCISFGEIAMEERERACEATRIAFVDERAINEGGFSTDLHPSLCESLSAIVPQCQHVGNGFFIRFDFFQSMSHLEQFWCPWCRSPLRLDHLLPLISSL

SEQ ID NO: 146941 - protein, 58 aa, Glycine max
  Coding DNA Sequence Number=SeqID_55256
MWYHGDQSGSQCFARMLQPYGINIGLKEHSNRVTPKAYTPKSPSGPLPPDSGPTPKII

SEQ ID NO: 146942 - protein, 112 aa, Glycine max
  Coding DNA Sequence Number=SeqID_55257
MPEISFLMVVVLEAGKSFSKNTLLRSSQLVMDLGARQYGIILDVYEGLHLQDHETWATRCSKLPTTKCSDSPITECSGCSKGSKDCKSPGLPQVMHYMQQFMCFSDRAKEVG

SEQ ID NO: 146943 - protein, 121 aa, Glycine max
  Coding DNA Sequence Number=SeqID_55258
  Subcellular localization annotation: CTP_CleavageSite=60; ConfidenceScore=5.52e-01
MHTQSFTIPQFFKIGLTHKKVPSGVANCRKVPFAGERGRGSRVRFPKKERCAESPPTFICGKRRKNRRKPVKMKILSSGVVFTLEEEVDKSGAHAPTYPPSKSKSYLRSSSLYVNQVILFT

SEQ ID NO: 146944 - protein, 51 aa, Glycine max
  Coding DNA Sequence Number=SeqID_55259
MTLLLSNILPNDRNADLTLWKYQLDRARKTPSGPGGAQQGLGVFNSGYGPL

SEQ ID NO: 146945 - protein, 107 aa, Glycine max
  Coding DNA Sequence Number=SeqID_55260
MASPMTCGDCESDDMRGYLMVIRIFCQPEASEPVDTQRLTSSSAPLSSRDSESDDMQGDDESDDMRGYLMVIRIFCQPEASEPIDTQRLTSSSTPLSSRDGESDDMR

SEQ ID NO: 146946 - protein, 76 aa, Glycine max
  Coding DNA Sequence Number=SeqID_55261
MVFHLRLVMSFKIKKGKHRLKGLSKELIQASTRIKPSLLCKQSMGQNTPNDYDDGSNSHKGKLITFKLSFQNYHDM

SEQ ID NO: 146947 - protein, 207 aa, Glycine max
  Coding DNA Sequence Number=SeqID_55262
MTPRKLASKRSRKDKGWSFLRERRVQLRDDEYTDFQEEIVRRWWASLVTPMAKFDPDIVLEFYVNAWPTEEGVRDMRSWVRGQWIPFNADALNQFLGYPLVLEEGQECEYGQRRNRADGFDEEAIAQLLCIPGQDFARTAAGRRVRIMRTNMTTLTQTWMTLLLSNILPSDHNSDLPLPKCHLVYAILTRMSVHVAQLIADAIYLFA

SEQ ID NO: 146948 - protein, 187 aa, Glycine max
  Coding DNA Sequence Number=SeqID_55263
LGFSEEFYANLYSSEGLSPKQSRVRGHLVKIDADSLNTFLETPVVVEPPGSIPSVEQFREMVAWPGTQPSFHMEDEGPIAQVPQHVEDESSEATIPDPFVIREETDETLVRQVVAATPERSLEATSEPPAPVVDLPSPQHTVDPSTPILEIPEDPTTPVLAMDTSLPATLVLHLTDEEDVQTQDTQD

SEQ ID NO: 146949 - protein, 190 aa, Glycine max
  Coding DNA Sequence Number=SeqID_55264
  Gene Ontology: Biological process=transposition, DNA-mediated
  Homolog annotation: Hit_ID=Q1J7G7; Match level="QueryCoverage=20%, HitCoverage=67%, E-value=1e-10, Identity=72%"; Hit description =Transposase
DLPSQWLLFLSAVPPVQLLTGWCVTAKAPPDISAGKCSGRVPFAIQAAQLLGRAIGAGLFAITPAGERGMCCKAIKLGWLMSLDSEVRFELRVCYSISLHQAYRYRRPRGGARYQLLFPLVRVNFELGVIMVIAVSFGKPVVPAALMNRPTRGERRFAYWALAECILAYYVGTDEGVSEVLHVAGEKRLH

SEQ ID NO: 146950 - protein, 203 aa, Glycine max
  Coding DNA Sequence Number=SeqID_55265
  Gene Ontology: Mol. function=RNA-directed DNA polymerase activity; Biological process=regulation of transcription, DNA-dependent
  Homolog annotation: Hit_ID=A5B383; Match level="QueryCoverage=72%, HitCoverage=24%, E-value=3e-16, Identity=36%"; Hit description =Putative uncharacterized protein
MDRNILDSLFLNIHFHGLDMKEGSIPAALIYRIQYKVMNTCASRVLLKPQKGETTLFITDMTKANVSFSRTIKWDEVTLPEKWVMDKATPSVPRPASTIEQIKQDNSSNVEITFNRINSFSSRIEASMSEYESTRRKDIDYPWKQDIIGDPTTNVITNWQTKDGELIQSEVPPTTQYQLPKLRDNNDRPVMASQFKTKDVNEE

SEQ ID NO: 146951 - protein, 269 aa, Glycine max
  Coding DNA Sequence Number=SeqID_55266
  Gene Ontology: Biological process=transposition, DNA-mediated
  Homolog annotation: Hit_ID=Q6UUU1; Match level="QueryCoverage=22%, HitCoverage=40%, E-value=3e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGIRSLHALSSKLSNLRAKYALCSNSIGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 146952 - protein, 35 aa, Glycine max
  Coding DNA Sequence Number=SeqID_55267
MLRESEQLGQKEGGRYPCRHFGARMGQAPADLSWN

SEQ ID NO: 146953 - protein, 163 aa, Glycine max
  Coding DNA Sequence Number=SeqID_55268
  Homolog annotation: Hit_ID=UPI00006A2D9E; Match level="QueryCoverage =93%, HitCoverage=97%, E-value=2e-08, Identity=19%"; Hit description =UPI00006A2D9E related cluster
MSKSCGFGMTGPLDESISCFLIRVDPWVLVPITFRGLHALAIRGLHVLTFVRLHALTFRGLHVLANRGLHALTFRGLHTLAIRGLHVLTFVGLHALTFRGPHVLTFRGLHALAIRGLHALAIRGPHVLTLRGLPALALGTSYPHLQRTTRLHLQRATRPRLGY

SEQ ID NO: 146954 - protein, 27 aa, Glycine max
  Coding DNA Sequence Number=SeqID_55269
MAATYAQGMNIKRMGKMWHAPLFQNAT

SEQ ID NO: 146955 - protein, 122 aa, Glycine max
  Coding DNA Sequence Number=SeqID_55270
MLQVDSRGSPVIRPPITQAFIEKYCMPRQAQGDAHQATGASPLPRQVDSAGWPTTMDRCRYMSVSTGSASVSRGRVSSLLYALPRSSLRLRSHGLETSPMPKQGRSLQDPPVRRMNPIWMRI

SEQ ID NO: 146956 - protein, 326 aa, Glycine max
  Coding DNA Sequence Number=SeqID_55271
  Gene Ontology: Mol. function=oxidoreductase activity, acting on the aldehyde or oxo group of donors, disulfide as acceptor; Cellular component=mitochondrial membrane; Biological process=metabolic process
  Homolog annotation: Hit_ID=Q6ADA5; Match level="QueryCoverage=100%, HitCoverage=25%, E-value=1e-150, Identity=80%"; Hit description=2 -oxoglutarate dehydrogenase
MKGQGCIIGAGALEYPAEFQGASEKTLKELAIGKTITLMSTYDHRVIQGAGSGEFLKKVHELLIGQRGLYDDIFAALRIPYAPIRWNPDIAVDLAERVDKQSRVQELINSFRVRGHLMADIDPLEYVQRSHPDLEIESHGLTFWDLDREFVTGGFGGRRVAKLRDILGVLRDSYCRTLGIEYMHIQDPEQRRWFQEKVEVKYQKPGHDEQLRVLRKLNEAEAFETFLQTKFVGQKRFSLEGGESLIPLLDEILQGAATAGLEGAAIGMAHRGRLNVLTNIAGKTYGQVFREFEGTQTPGNQRGSGDVKYHLGTEGTFVADDGSSLP

SEQ ID NO: 146957 - protein, 231 aa, Glycine max
  Coding DNA Sequence Number=SeqID_55272
  Gene Ontology: Biological process=transposition, DNA-mediated
  Homolog annotation: Hit_ID=Q6UUU1; Match level="QueryCoverage=25%, HitCoverage=40%, E-value=3e-18, Identity=78%"; Hit description =Putative uncharacterized protein
DLPSQWLLFLSAVPPVQLLTGWCVTAKAPPDISAGKCSGRVPFAIQAAQLLGRAIGAGLFAITPAGERGMCCKAIKLGNARVFPVTTLEKDQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 146958 - protein, 131 aa, Glycine max
  Coding DNA Sequence Number=SeqID_55273
  Gene Ontology: Mol. function=nucleoside-triphosphatase activity; Cellular component=chloroplast
  Homolog annotation: Hit_ID=Q2PMM5; Match level="QueryCoverage=48%, HitCoverage=2%, E-value=7e-27, Identity=93%"; Hit description =Protein ycf2
MVLRTWNEYEEINDTSLPLSCSAGSVAQDLWSLPGPDEKNGITSYGLVENNSDLVHGLLEVEGALVGSSRTEKDCSPMNWDFPIGPGHFGTSGSFMMKRMSFKRMIQSSCRVEPCSTRHEIDLPKNRAFFE

SEQ ID NO: 146959 - protein, 77 aa, Glycine max
  Coding DNA Sequence Number=SeqID_55274
MSSSHPGCLMSSSRNSRGADGTRVRGQVVRFDVEMINDFLDTLIVLADGEEYPTYSQYLRTPLDHDAILSALCTPGG

SEQ ID NO: 146960 - protein, 118 aa, Glycine max
  Coding DNA Sequence Number=SeqID_55275
MRILFYRPRFKKSKVVFQWGLLSWEPNLDIWGETNLGVKVSVSGRASILFHKARVTMMIRKQRAKLVMATARWALKHPVYGIVILQLGIYIDRPNVSKLCSFISSMNSSILISVHSGK

SEQ ID NO: 146961 - protein, 118 aa, Glycine max
  Coding DNA Sequence Number=SeqID_55276
  Subcellular localization annotation: CTP_CleavageSite=37; ConfidenceScore=5.37e-01
NLQDSGTLKRVAWGLDVGTRKSTLRFMRTLGPSLAALAQSSWSLLLMALVTGPFLGRITSRTKIDVYASTLSMEFGDIVIHFNILDAMKHLSEDHSVFRVEILDQIVDDYMFDFYSLH

SEQ ID NO: 146962 - protein, 122 aa, Glycine max
  Coding DNA Sequence Number=SeqID_55277
  Homolog annotation: Hit_ID=UPI00006A2D9E; Match level="QueryCoverage =93%, HitCoverage=77%, E-value=2e-09, Identity=16%"; Hit description =UPI00006A2D9E related cluster
MTHQLHVLAFKGLHALAFRGLHVLAFKGLHVLAFRGLHALTFRWLHALAFRGLYILAFRGLHILAFRGLHALAFRGLHTLFFKGLHVLALRGLHVLAFRVLHVLAFRGLHIYAFRELKVFRP

SEQ ID NO: 146963 - protein, 83 aa, Glycine max
  Coding DNA Sequence Number=SeqID_55278
MSLKPWGRHEIPHHNLADFEPWLEYATEGQAVGGMGKLDHLEERLRAIKGGEDYAFANLEELFLVPNIITPPKFKVLDFDKYN

SEQ ID NO: 146964 - protein, 180 aa, Glycine max
  Coding DNA Sequence Number=SeqID_55279
HEVATNPSASSETKKLEGKLDVLVNLVTQLALNQKSVPIARQQQQQPAPSFQNAAGPSRPYIPPPIQQQQQPQKQPIVEAPPQPSLEELVRQMTMQNMQFQQETRASIQSLTNQMGQLATQLNQQQSQNSDKLPSQAVQNPKNVSAISLRSGKQCQGPQPVAPSSSANEPAKLHSIPEKR

SEQ ID NO: 146965 - protein, 143 aa, Glycine max
  Coding DNA Sequence Number=SeqID_55280
MGDPISRLSFPGRRIVCHSKKAYAALISWKCYLFTKARSHFSEENIETISSLTSYPELRRSEFLIGGYVGAGASLLSTAPLFVTMTQKLVARRDTLRLSAPRHSVTPSVIDKRRPMWSSAPFPEVSAFFGGDFFKSHKLFRTT

SEQ ID NO: 146966 - protein, 85 aa, Glycine max
  Coding DNA Sequence Number=SeqID_55281
  Gene Ontology: Mol. function=homocysteine S-methyltransferase activity; Cellular component=intracellular; Biological process=folic acid and derivative biosynthetic process
  Homolog annotation: Hit_ID=Q6FDC4; Match level="QueryCoverage=41%, HitCoverage=2%, E-value=1e-08, Identity=80%"; Hit description =Methionine synthase
MTMITPSSKLTLTKGNKSWYRAPPRDYIKPSEQPEDYLGGFTVSIFGAEELANEYKAKGDIEFLQPGGSTSSRAAATAVELQFAL

SEQ ID NO: 146967 - protein, 86 aa, Glycine max
  Coding DNA Sequence Number=SeqID_55282
GTSFVVQVEGQLKWVDSKINQERTSQVNQFREGQFKSSSKNQEGYIPCEDSRRNAKSRIKIQGSRSQEIKIKIRLKVQGINERGTG

SEQ ID NO: 146968 - protein, 117 aa, Glycine max
  Coding DNA Sequence Number=SeqID_55283
MHKALRTNAPLPYPQLVTLFLHHFQIPLDDEPFVQVKRSFAIGAGAVTSFGYCKDRNGQWLKKDALPPQDERTPSPPPQRDDSALMTEEWISISHSLKKMWVIFVRALIFHHHILSV

SEQ ID NO: 146969 - protein, 138 aa, Glycine max
  Coding DNA Sequence Number=SeqID_55284
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=64%, HitCoverage=75%, E-value=1e-24, Identity=66%"; Hit description=LacZ protein
  Subcellular localization annotation: CTP_CleavageSite=32; ConfidenceScore=5.15e-01
MASNIKSDQLTHTSSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 146970 - protein, 118 aa, Glycine max
  Coding DNA Sequence Number=SeqID_55285
MGLGKNNGGRTSLISIRGNRGKFGLGYKPTQADIRKSVAGRKSGSQGSSDDESIEGINTWDLTIDFKQETDQTEGGEDEDVGLPPELEKIVAHEDQEMRPHQEETELVDLGTDSGKME

SEQ ID NO: 146971 - protein, 33 aa, Glycine max
  Coding DNA Sequence Number=SeqID_55286
MGLRKRFDGGGCTNSASARQSIRGASDSMVEDA

SEQ ID NO: 146972 - protein, 45 aa, Glycine max
  Coding DNA Sequence Number=SeqID_55287
MANQAYRYRRPRGGARCINESANARGEAVCVLGASGVYTGLLCWH

SEQ ID NO: 146973 - protein, 107 aa, Glycine max
  Coding DNA Sequence Number=SeqID_55288
MGGANSNFEILKLGLPEYFRSWIASGVINPARLGELGGNLLPFFPINRLKGAVLRVPDPPGDVFQLFWVKKIVFVKKIQAEIFLRYSPFFIRSSFFNGFFSSVFDEL

SEQ ID NO: 146974 - protein, 114 aa, Glycine max
  Coding DNA Sequence Number=SeqID_55289
  Subcellular localization annotation: CTP_CleavageSite=22; ConfidenceScore=5.00e-01
MSAQHTAPATPRPANNTTPGTKVESGGSLGNYPFSDLADLCLVPDIIIPAFKFKAASGRGKRLECSVSSGEYTRHGLPTEELQSMSKREHESIKEYAQRWTGPSSSKSSERDGK

SEQ ID NO: 146975 - protein, 71 aa, Glycine max
  Coding DNA Sequence Number=SeqID_55290
MVNLFQPDNTERSSECGSAFKNDGNMILENPCFLLQNPTEGMEEGECAASANQNYLWKKIHLHRNYEEGAT

SEQ ID NO: 146976 - protein, 305 aa, Glycine max
  Coding DNA Sequence Number=SeqID_55291
  Gene Ontology: Mol. function=transcription factor activity; Cellular component=intracellular; Biological process=regulation of transcription, DNA-dependent
  Homolog annotation: Hit_ID=A4AKF2; Match level="QueryCoverage=80%, HitCoverage=44%, E-value=2e-47, Identity=40%"; Hit description =Putative uncharacterized protein
  Pfam annotation: Domain name=Sigma70_ECF; Domain location=11-188; Score=-71.2; E_value=0.0052; Accession=PF07638.2; Description=ECF sigma factor
  Pfam annotation: Domain name=Sigma70_r2; Domain location=32-99; Score= 17.1; E_value=0.0086; Accession=PF04542.5; Description=Sigma-70 region 2
  Pfam annotation: Domain name=Sigma70_r4; Domain location=130-179; Score=39.6; E_value=1.1e-08; Accession=PF04545.7; Description=Sigma -70, region 4
  Pfam annotation: Domain name=Sigma70_r4_2; Domain location=124-177; Score=42.5; E_value=1.5e-09; Accession=PF08281.3; Description=Sigma -70, region 4
  Pfam module annotation: Pfam domain module=Sigma70_ECF::Sigma70 _r2::Sigma70_r4::Sigma70_r4_2; Domain location=11-188::32-99::130 -179::124-177
MDQERRTDVGQDREADLLARTRTGDEGAYAELWRRYAQIAKVVARTYWWSADSDDLVSESFTRIYQAIRAGKGPTSAFKPYLFATMRNLAVSWGRARRELPVEHIDAVEDPASTEAAADDRFDATLVSKALLTLPDRWQEVLWLAEVEDLSMQEIGERLDISEGAAGVLAFRAREGLRQAWIAAHLSDRPPSAKECRWTLGKLGGHARRRLTARDDRRVRAHLEQCPQCRASAEEARRASSRILSVLLPGAVALGAGVQKWQAFTAAATAVVASLMPVSVTLPVASLTTAKEGLVAATLVSTATL

SEQ ID NO: 146977 - protein, 26 aa, Glycine max
  Coding DNA Sequence Number=SeqID_55292
MNKKVKWWLDRNIEMAITEATGLQMR

SEQ ID NO: 146978 - protein, 83 aa, Glycine max
  Coding DNA Sequence Number=SeqID_55293
MGESASLTTSGGKNKAIKSLRNLKVNGKIPPQADNKKGMQNLRKLVGSEQSILLGNKLGSPTKAIGTLHEVLLSLAHQCERCA

SEQ ID NO: 146979 - protein, 131 aa, Glycine max
  Coding DNA Sequence Number=SeqID_55294
MGLSAAIDEGRRRRRQLCVLSGFSSYRQQKRMFIRITTRTAKKNVYTDNHSGISARQRDSNVSMTDLVSAEDDVNLRVSTGLSVRDSRRAQKTTFSLACYQAFRLTDSKKECLYGKPLGYLRTVSVTQMSV

SEQ ID NO: 146980 - protein, 214 aa, Glycine max
  Coding DNA Sequence Number=SeqID_55295
  Homolog annotation: Hit_ID=Q6WAY6; Match level="QueryCoverage=72%, HitCoverage=26%, E-value=2e-13, Identity=32%"; Hit description =Putative uncharacterized protein
MVPTIEEFEEILGCLLGGRKPYLFSGFLPSLSKIAAVVGDSAKEMDRMKQTRNGVVGLPWKYLEGKARDMASQEKWGPFADILALLIFGVVLFPNVDSLVDLAAIDAFLAYHHSKESPVVAILADLFDTFDRRCEKNSTRIVCCLPALCVWLVSHLFQQDTRHPCPLQSYRSCAEKGRVELGPTFGWDRGQRDQLVFSLEGRQGRSYFLVWGLP

SEQ ID NO: 146981 - protein, 81 aa, Glycine max
  Coding DNA Sequence Number=SeqID_55296
GQNRLRPQSEVETKLKAETNQEARVMTDKSSSLPSSGQAENATVRQPRDGLRPRVHPEAMGHATLPPLACYSCLNMRPPSA

SEQ ID NO: 146982 - protein, 410 aa, Glycine max
  Coding DNA Sequence Number=SeqID_55297
  Homolog annotation: Hit_ID=Q84VI1; Match level="QueryCoverage=100%, HitCoverage=63%, E-value=1e-172, Identity=74%"; Hit description =Envelope-like protein
MATSPKEISASGSPAVPSSPHQEQPEFNIQPIQVIPGQASVPEKLVPRRQQGVKIDENPSPATIPREVDTEMDKKIRGIVSSILKDASVPDAEKDVPTSSTPDVSVPDVNKDVPTSSAPNAEALPSPSEEESTEEEDQASEETPAPRAPEPAPGNLIDLEEVESDEEPIANRSGRIKTMAQKKSAPITPATSRRSKVAIPSKKRKEISSSDTDDDVELDVSTSKRAKTSGRKVPGNVPDAPLDNISFHSIGNVEKWKYVYQRRLALERELGRAAMDCKEIMDLIKAAGLLKTVSKLGDCYEGLVREFIVNIPSDISNRKNDDYQRVFVRGKCVRFSPAVINKYLGRPTDGVIDIDVSEHQIAKEITAKRVQHWPKKGKLSAGKLSVKYAILHRIGAANWVPTNHTSTVAT

SEQ ID NO: 146983 - protein, 116 aa, Glycine max
  Coding DNA Sequence Number=SeqID_55298
EQQAKWEQQAEWINAQRQILRPLSFRNDKLSGNNKLSGLDHFQRNAETNYGHSASLSTERNKFNSIRMMCRDHPLLGCEPHLTTSRYLAPIVRQFVKFCDMPEVKGKHCSTIREVP

SEQ ID NO: 146984 - protein, 179 aa, Glycine max
  Coding DNA Sequence Number=SeqID_55299
MASMMEAMLGMRQLMEKNAATAAAVSSAAEADPTLLATAHHPPSNIVGRGRDTLGHDGSPHLGYNRAAYPYGLPPNYSPPVLQDDAGHIASPVLEREPPQQPDEVHKDPQDYARRDVEFYPPILEGPAPSTLPQPNIATQPIVLSAEGPPPTTEEKRKLDLLEERLRAVEGFGDYSSQT

SEQ ID NO: 146985 - protein, 55 aa, Glycine max
  Coding DNA Sequence Number=SeqID_55300
MERAEKRFEYRFYYSSEENNGEEDNEGGIGAVDALISIGEIKINMNKKKIAIYGS

SEQ ID NO: 146986 - protein, 288 aa, Glycine max
  Coding DNA Sequence Number=SeqID_55301
  Homolog annotation: Hit_ID=Q6WAY4; Match level="QueryCoverage=82%, HitCoverage=40%, E-value=8e-24, Identity=31%"; Hit description =Putative uncharacterized protein
MPSWGKKTVSFLRVSSLFEQDCSCGWRFGERVGSYEANLKRRSEPMRKYLEGKARDMANQEEWVLFADILALLIFGVVLFPNVDGLVDLATIDAFLAYHHSKESPVVAILADLFDTFDRRCEKNSAQIVCCLPALGVWLVSHLFQQDIRHPCPLQSYRSCVKKRRVDWDQYLAGIGGSTINWFPRWKEGKEGVLFSCGDYPNVPLIGKKGCINYNPALAIRQLGYPLRGAPTEKSLSPFLVRDFGAQSLKIVQRVHKAWESTLRKDKELRDIRNGIIDGYHEWLRVHT

SEQ ID NO: 146987 - protein, 227 aa, Glycine max
  Coding DNA Sequence Number=SeqID_55302
  Gene Ontology: Mol. function=DNA-directed DNA polymerase activity; Cellular component=mitochondrion; Biological process=DNA replication
  Homolog annotation: Hit_ID=Q5U6B7; Match level="QueryCoverage=98%, HitCoverage=54%, E-value=2e-32, Identity=34%"; Hit description=DNA polymerase
MVSYLTNPGKGPSYWDPPKNSAVQLAAAITAGSRIYMYKYISREDCLYTDTDSIVLGNPLPEEDVSSKCYSYTTEESDGNKKVYKYKGPGRNVITPEWYKEQYADPSQSLIKKVTYQFRPDWKELSVKKKENPLDINDLSSLNYIGTKLLESFKRKTAILEKENSALSQKLQKLEQERGIIAQRRVEEGNNTEDNNTLEQNNAKRAEDNINGDLLDPDTMPRDKKPP

SEQ ID NO: 146988 - protein, 76 aa, Glycine max
  Coding DNA Sequence Number=SeqID_55303
MMQMMMMIKSLCKQRFKNFLKKRWKNLKEKLREKLKKAYITWDAQNDLESSDDSENARDPKSLGTLWQKVTKVMKR

SEQ ID NO: 146989 - protein, 201 aa, Glycine max
  Coding DNA Sequence Number=SeqID_55304
  Homolog annotation: Hit_ID=Q2HW90; Match level="QueryCoverage=55%, HitCoverage=22%, E-value=5e-09, Identity=35%"; Hit description =Putative uncharacterized protein
MKQTRNGVVGLARKYLEGKARDMASQEKWGPFADILSLLIFGVVLFPNVDGLVDLAAIDGFLAYHHTKESPVVAILANLFDTFDRRCEKNSARIVCCLPALCVWLVSHLFHQDTRYPCPFQSYRSYAEKEARGRVIDALHQEATMWMDRFALTLNGSQDLPRLLAKAKAMAEVCTAPEEIHGLINYCQHMIDLMAHIIRNH

SEQ ID NO: 146990 - protein, 77 aa, Glycine max
  Coding DNA Sequence Number=SeqID_55305
MNSARQSIHGSPNKIENGEWANSARQSIRGSRLDGGGHMNSARQSIHGSPNKIENGEWANSARQSICGVPDSMVVDA

SEQ ID NO: 146991 - protein, 266 aa, Glycine max
  Coding DNA Sequence Number=SeqID_55306
  Subcellular localization annotation: CTP_CleavageSite=80; ConfidenceScore=5.20e-01
MGLNQAHAFTKKVHQVKLKYGSNHLAKLGQKMDRVTSLLHLLPNTFRTVDVLVTSSFTLTKMSWTTKEHALRRPYRTRARVMGEVEEVQEQVKADTEALKEQMATMMEAMMSIKEIMEVNAVAIAATSTIAECKNKHAFPPYDLPPNYTPPNVAYTPSEDVNNSAPILFESRQPQTDHAHVSQTMGETHEIPHHNLADFEPCLGYATEGQAVGEERLKVVEESGGYAFANLEELFLVPNVVTPPKFKVSDFDKYKETTCPKNRLKD

SEQ ID NO: 146992 - protein, 82 aa, Glycine max
  Coding DNA Sequence Number=SeqID_55307
MQSDDKKPSKPKSLVIHFTRDVATQRPRGFQPVTIKKPTPFPYKSDKAVLWKYAAQGPDGRKDTFVIHVKDDLSSTKATNIS

SEQ ID NO: 146993 - protein, 223 aa, Glycine max
  Coding DNA Sequence Number=SeqID_55308
TERRRKDKALKNELGKAKLAKEKFKLATTHIRKECAGLREENATTAKALEQETKRARKEEYGRNKFRGALWGSNSELKLQREERDQSRAHSMVLKEELVACSRSKRSLSQRLCETETNMLAIIAKYQEELSLATAHEHRVADEYAQVYAEKEASGRVIDSLHQEATMWMDRFALTLNGSQELPRLLAKAKAMADTYSAPEEIHGLLGYCQHMIDLMAHIIRNR

SEQ ID NO: 146994 - protein, 161 aa, Glycine max
  Coding DNA Sequence Number=SeqID_55309
  Gene Ontology: Mol. function=cytochrome-c oxidase activity; Cellular component=mitochondrial respiratory chain; Biological process =aerobic respiration
  Homolog annotation: Hit_ID=Q09EM6; Match level="QueryCoverage=65%, HitCoverage=14%, E-value=2e-51, Identity=90%"; Hit description =Cytochrome c oxidase subunit I
FHYWVGKIFGRTYPETLGQIHFWITFFGVNLTLFPMHFLGLSGMPRRIPDYPDAYAGWNALSSFGSYISVVGIRRFFVVVTITSSSGNNITRANIPWAVEQNSTTLNGWYKVLQLFILLENFQLSRRRKAIMATYQQRIARYYKARVKFGNWIELSRSCSY

SEQ ID NO: 146995 - protein, 102 aa, Glycine max
  Coding DNA Sequence Number=SeqID_55310
  Subcellular localization annotation: CTP_CleavageSite=23; ConfidenceScore=5.04e-01
MQGLWLWAILWVPQSVWQGYATVATYPSAGGRRETRGMRVPRKEYARSRHQRLFEENVGKTGKDAIYELLSERFGSCIYARGRVLPFAPTYSSIGDEKIRPT

SEQ ID NO: 146996 - protein, 52 aa, Glycine max
  Coding DNA Sequence Number=SeqID_55311
LACGADSATVAITTTDLVSKSVAIESLVLWVMLGPAQRLIGPWTLSQLWGLI

SEQ ID NO: 146997 - protein, 431 aa, Glycine max
  Coding DNA Sequence Number=SeqID_55312
MTKVVDNHKVCPQATRPSGHDSRIETFSRSRPEDAAISGKGVDNHKVCPRATGPLGHDSRIDTFSRSRPEDADISGKGADDHIGLCVPLGHDSENETFSWSRPEDADISGKGTDDHIGLCVRLPLDDHKVQITIRCVHVLPDPCVMIAKLRLFHGLGRKMLTSPGRKTLTSLGRVQMTTLASSCQSDLGSPNDGVCLRATGPLGHDIEIEIFCGLGWKTLTSPGRVQMTTLASTCQSNLGSPNDGVRITVRCLRVPSDSWGEKVTSATNFGWQSKGENHFKSWFPFFPYLVVTILYCLDICLRVSSSTVSDSSFLGDPTIPFSEGKDGNSHPGSRFMQLRDKGNVPHYFHDTHATMMDYELWTRDGDLLITGPIPARICPGGWVSAGRPCIVGNALAFVDELRWILEVVAVRLPPAAGHPQAVVVLHPAPA

SEQ ID NO: 146998 - protein, 142 aa, Glycine max
  Coding DNA Sequence Number=SeqID_55313
KEHALRRPYRTRARARVMGEVEEVQEQMKADMEALKEQMATMMEAMMSIKEIMEVNAAAIAATNTIAKVDLTPPRPLFSAKNKHAFPPYGLPPNYTPPNVAYTPSEDVNNSAPIFIESRQPQTDQAHISQTIGRHMKFPTTI

SEQ ID NO: 146999 - protein, 137 aa, Glycine max
  Coding DNA Sequence Number=SeqID_55314
MDEDQWMYESIMFEEVNIDYENEEECGVNEPHVDYSDAFNTSQIIMFMILLCTIGRTPDDILNILEATMIPTHDALLYYNRRWNMSRQNEFVGYSFTAKDPKKFDIPFGCTMNELKDLIKQVAPYGIPPYGIYETQT

SEQ ID NO: 147000 - protein, 230 aa, Glycine max
  Coding DNA Sequence Number=SeqID_55315
GHALRRPYQTRARARVMGEVEEIQEKMKADMEAIKEKMATMMEAMMSVKKIMEANAVAIAATSVVAKVNPTSPSGLKQMNHPTSNMVGKDLGSTDDPMMCKFKTSTPSRHMVCLPNYTPPNVVYIPNEDETHEIPHHDLANFEPCLGYTAEGQAVGGIPLQNTLEGPQYHPQLHLLHSTADKKTLMTMVGMGKLDHLKERLRAIEGGEDYAFANLEKLFLIPKHGHSQVQ

SEQ ID NO: 147001 - protein, 158 aa, Glycine max
  Coding DNA Sequence Number=SeqID_55316
  Subcellular localization annotation: CTP_CleavageSite=22; ConfidenceScore=5.34e-01
MVKVGTSYVPINCLVFAKSWPRASRFQHGTPGFIIVSNSGSLGSSVTGLIRHTVRLEGDAAAVPSCSATDGELVIRVNSAQSTTAGSISAGKCKAWGCQLSGKGPDRCRAFAIKNRQRWRKGRCAAMARMEKAATAVRQLELVVPRAEQEIPIFLASR

SEQ ID NO: 147002 - protein, 259 aa, Glycine max
  Coding DNA Sequence Number=SeqID_55317
  Gene Ontology: Mol. function=iron-sulfur cluster binding; Cellular component=glycolate oxidase complex; Biological process=electron transport
  Homolog annotation: Hit_ID=A4W9P6; Match level="QueryCoverage=100%, HitCoverage=25%, E-value=1e-137, Identity=93%"; Hit description=FAD linked oxidase domain protein
  Pfam annotation: Domain name=FAD_binding_4; Domain location=52-193; Score=176.9; E_value=5.1e-50; Accession=PF01565.14; Description=FAD binding domain
MIPQISQAPGVVQLVLNFLQALEQQGFTGDTATNYADRLTMATDNSIYQLLPDAVVFPRSTADVALIARLATQERFASLVFTPRGGGTGTNGQALNQGIIIDMSRYMNRIIEINPEEGWVRVEAGVIKDQLNQYLKPYGYFFAPELSTSNRATLGGMINTDASGQGSLVYGKTSDHVLGVRAVLLGGDILDTQPMPVELAETLGKDNTTIGRVYRTVLERCRDNRQLILDKFPKLNRFLTGYDLRHVFNDDLTQFDLTR

SEQ ID NO: 147003 - protein, 155 aa, Glycine max
  Coding DNA Sequence Number=SeqID_55318
MSLMRLSFVIFHPEDDYCVQFLEYLDHHESEGPIIVLLSNARIKEGQGSYPCSVSNSLKASKLTIHEPVAPIEEFNQKLSKLGIEIRSVLTHRSQWSSQPLGSAQLSSREAFISKSEAKSISEINNICEEFVCVTVGTITRIVMDNHSWCYASCI

SEQ ID NO: 147004 - protein, 65 aa, Glycine max
  Coding DNA Sequence Number=SeqID_55319
  Subcellular localization annotation: CTP_CleavageSite=39; ConfidenceScore=5.69e-01
MNVIDKQRHRTQQHSKVPSGVANCRNLPFSGRATRRLTSASSKGGRRAESPPTFIRGKRQKNRNV

SEQ ID NO: 147005 - protein, 138 aa, Glycine max
  Coding DNA Sequence Number=SeqID_55320
MPISPCGRITPTKTPSGPREVQQGLGVSSSSYGPLLVLQGARSPQQGIAPARHPVDPKKSNRVLELPALITGLCQFYGVPVAPSKVIKPPTNRASIKKCCALRQAQGETPQQSGDGRQRATDALPPPLEFTSAHPEKG

SEQ ID NO: 147006 - protein, 143 aa, Glycine max
  Coding DNA Sequence Number=SeqID_55321
MKDKRDEKEKLENQKKKKDSKTFSSKAKRKKKEEKDSSKKIVKKENHFATKCDIKRALLLKQSFYLLLSRETSLSTAIPLGLEVIPQVKELLDEGLVRKSLNPCALLVPKISNMRHQIPMIGGMMNVLNGETLFSKLMHPTSS

SEQ ID NO: 147007 - protein, 151 aa, Glycine max
  Coding DNA Sequence Number=SeqID_55322
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=34%, HitCoverage=50%, E-value=4e-24, Identity=100%"; Hit description=LacZ protein
MKHFTDTLISANIQYNRLKLILYIEEGSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 147008 - protein, 121 aa, Glycine max
  Coding DNA Sequence Number=SeqID_55323
MLNIQNLIYGYEKISSAYSPSPVDALFFTQEAYAALNRSEFLIGGYVGARASLLSTTPPFVVMTQELVARGDTLRLSAPCHSVTPSVIDEQRPMWSSAPFPEMSASSGGDFFKSHKLSRTT

SEQ ID NO: 147009 - protein, 25 aa, Glycine max
  Coding DNA Sequence Number=SeqID_55324
MTVDTSFVQLTAAVPSLVMQCSRRG

SEQ ID NO: 147010 - protein, 76 aa, Glycine max
  Coding DNA Sequence Number=SeqID_55325
  Subcellular localization annotation: CTP_CleavageSite=52; ConfidenceScore=5.13e-01
MERELIGQASKGLDKGVEFGSFNHRFGAFTFFKTTRKNHNLGTNMSLYSSSSVNAEGSTPMDPLYKILDELRSLKL

SEQ ID NO: 147011 - protein, 87 aa, Glycine max
  Coding DNA Sequence Number=SeqID_55326
MSKCPRCGVSRYKVKDDEECSSDENSKKGPLAKMLWYLPIVPRPNTGWSEKALVHYFSSTSIASQENTLPKSYYQAKKILCPMSMEY

SEQ ID NO: 147012 - protein, 101 aa, Glycine max
  Coding DNA Sequence Number=SeqID_55327
  Subcellular localization annotation: CTP_CleavageSite=35; ConfidenceScore=5.30e-01
ASASRASRRVPVAGRIGNGPFAASSSGVEQSHQNCAMNVKVKKFNQARVNGGSNETPAKGTGLAESAGKEDPVELDFSPTLAPLFGPKVGFGRSIRAEDIV

SEQ ID NO: 147013 - protein, 170 aa, Glycine max
  Coding DNA Sequence Number=SeqID_55328
EELATQLAQASKVASSRSNSLLEEGSGRPKRTRESRVALPLKGSVARAKRRPHGLNAIRCGMHKAKLALLTKPLWHPGKGRALLLSHRLSMIPGDSNPWNIDNIMDRRILPERNVKIYHTEFDEFKEELERRNLHKCLTNLQEGSIDVAMVKEFYDKLYNSEDQVPKCAR

SEQ ID NO: 147014 - protein, 151 aa, Glycine max
  Coding DNA Sequence Number=SeqID_55329
MRGAPLEEELAPFISRGFSETNMETLWKVCKAWEVVQKKDKELRGSNNGPIGGYCKWLKAHVQGLDGLPSLRTAKREEVEASEEDEEVQALRTGLEQAQTVKERFKSVDLKIQKENAKLRDVNIATTKALEQETKKACREEHGRNKFRGAL

SEQ ID NO: 147015 - protein, 270 aa, Glycine max
  Coding DNA Sequence Number=SeqID_55330
  Gene Ontology: Biological process=transposition, DNA-mediated
  Homolog annotation: Hit_ID=Q6UUU1; Match level="QueryCoverage=22%, HitCoverage=40%, E-value=3e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPEGMPAAGRPCQAALFSVLMSRLTEPPGSLKIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 147016 - protein, 46 aa, Glycine max
  Coding DNA Sequence Number=SeqID_55331
TYQGNPCGVYPDLSSFTGSGVYPDLSSFTGSGVIQTFVAYIKRSAP

SEQ ID NO: 147017 - protein, 90 aa, Glycine max
  Coding DNA Sequence Number=SeqID_55332
MDPWVLVPSSPEDYTSSPSKGYTSSPSEDYMSSSSEDYMSSPLEGYTPSAPRTIRPHLQRTTCPHLQRATRPRLHRAARPHLPRTTCPHL

SEQ ID NO: 147018 - protein, 176 aa, Glycine max
  Coding DNA Sequence Number=SeqID_55333
MLWVGGDCCSGWCGCTSSEMDEDQWMYGSIMSDEVHMNDENKHEAGMNEEQHVDCSDAFNTSLVFTTRDDVLQWARSVAYEIGFVAVIMKSDTNTGVVSIGLGRKILLEEILAVRNVGVPSSFIGNQWLKGKVKKRLSFELQKVAVGLSAYPPLSIASARLAQRRIWQSINIKVVH

SEQ ID NO: 147019 - protein, 84 aa, Glycine max
  Coding DNA Sequence Number=SeqID_55334
MLILLLRGLWLSEVESLSPAVWFLYLQMASRKRARTDNIPSSSIPAPQSTAIEPDVQHLQILVPMLQSLFRGQHIIMHSLQELA

SEQ ID NO: 147020 - protein, 95 aa, Glycine max
  Coding DNA Sequence Number=SeqID_55335
MAEVSTEAIASLAQYYDQPFWCFTFGDFQLTPTVEEFEEILGCPLGGRKPYLFSSFYPSLARISKIVKISTQELDRGKQVENGVVGVPRKCLEAK

SEQ ID NO: 147021 - protein, 89 aa, Glycine max
  Coding DNA Sequence Number=SeqID_55336
QSTYIQTHEDDVEAKLHDESRLIQRCFDDNKGDDKKLKGQSKNEFKMFKIESRTLQDSRGKLISRITSRFKRKVDFKNQDSRFKNQEKT

SEQ ID NO: 147022 - protein, 156 aa, Glycine max
  Coding DNA Sequence Number=SeqID_55337
GSIDVAVVKEFYANLYDLEDTSPKQVRVRGHLIKFDVDALNTFFYISTVIEEGESLLAYSRFARLRLDLEELVVRVCIPGRGFELNADGLPLKILRKNLTTLAQTWSVLSFSNLAPTSHTSDITLDRARLIYGIIQKMDMNLGYLISSHIVEAKLP

SEQ ID NO: 147023 - protein, 57 aa, Glycine max
  Coding DNA Sequence Number=SeqID_55338
LTIGLLEEYTSLLVNNKDVRLKLNHLEKKNRDNILEFILQKDPHACLEETTALCNYL

SEQ ID NO: 147024 - protein, 85 aa, Glycine max
  Coding DNA Sequence Number=SeqID_55339
MYEYPRRTRVLMRKHSFQNSCAYSCFVGKREMAPKKLSTKRSRRDATGEGSSAALKFDSHLFWSVEHQQRFEAIRGWSFHRERRV

SEQ ID NO: 147025 - protein, 76 aa, Glycine max
  Coding DNA Sequence Number=SeqID_55340
MCDLPMSKLFLLCFRIQTKVRSRLSSSLSRIISLAPLVRAWVFHLALVDQPMRISLGFLNVAHLTTQYMDVTSLLA

SEQ ID NO: 147026 - protein, 166 aa, Glycine max
  Coding DNA Sequence Number=SeqID_55341
LDWLPNLETTKGVEVEAQEEDEEIQALKTELEKLNSQRKFKSAAVRIRKENAELRDVNIATTKALEQETKRACREEHGRNKFRGALWGSNSEFKLRREERDKSRVDSLILKDELRARGRVIDSLHQEATMWMDRFALTLNGSQELPRLLAKGKAMADAYSSAIVSI

SEQ ID NO: 147027 - protein, 148 aa, Glycine max
  Coding DNA Sequence Number=SeqID_55342
MAQLISDVIYQFVGITPPKHPVDPEKSNRALGFLALITSLCPFYRVSVTPTKLIRPPINRAFIEKYCMPRQARGQVQLNESFYRYTLHQQSQDPSLFPWTIPEEFGATIAWPGDRPDFQEGAGLAGTPEDEDGAQKDDDMADVMDYFL

SEQ ID NO: 147028 - protein, 183 aa, Glycine max
  Coding DNA Sequence Number=SeqID_55343
MEISMIDAASGGALGDITPAEAKNLIEKMASNSQQFSARNDVIVIRGVHEVATNSSSSDETKKLEGKLDALVNLQQQQQQQPQKQKTVEAPPQPSLEELVRQMTMQNMHFQQETRASIQSLTNQMGQLATQLNQQQSQNYDRLPFQSVQNSKNVSAITLRSGKQCQGPQPVASSSSANEPAQP

SEQ ID NO: 147029 - protein, 119 aa, Glycine max
  Coding DNA Sequence Number=SeqID_55344
MPSPWVLVTLTFRGLHVLALRGLHVLTIRGLHALTSRGLHVLALRGLPALALGLHALTFRGLHVLANRGLHALTFRGLHALAIRGLHVLTFVGLHTLTFRGLHVLANKGLHALTLKGLH

SEQ ID NO: 147030 - protein, 61 aa, Glycine max
  Coding DNA Sequence Number=SeqID_55345
DFPSAVSLVTVFQRNERGFEALVLTGRIILSYLLGWGPNMDSRNQSRYLGMDASRDGVTID

SEQ ID NO: 147031 - protein, 144 aa, Glycine max
  Coding DNA Sequence Number=SeqID_55346
MVKVGTSYVPDQLSFSLENPRACPGIEHGRRPACCFHLEVFLDHRSHQAYSAQYRAPRGGDAADQLTDSLVYDAVPPVQLLTGIGYPLTIRHTSIHAGSISAGKCKPGVPNDADANSPPAALNCVAATGLPHSPFRLRNCSGRA

SEQ ID NO: 147032 - protein, 69 aa, Glycine max
  Coding DNA Sequence Number=SeqID_55347
KSRIVSGHGQKSRQINGRNQPRYIGTDASGDGVMTDQSLPFPGAKRAENVAAKQPSILCGCSFFYYCLF

SEQ ID NO: 147033 - protein, 59 aa, Glycine max
  Coding DNA Sequence Number=SeqID_55348
MVLQGKTIGVNVEDDDSYMDTYDHSFSTWLASSSSSRPISFAVCREADTQRHTSMILVY

SEQ ID NO: 147034 - protein, 177 aa, Glycine max
  Coding DNA Sequence Number=SeqID_55349
MQRRSATGDLIPTDLEINATCRRRNAERIRKFLQDLEAEATPGEEPRSSEASSRCPILGQSHIDLIEEVIMAEEPRRVTLEDFSSLSVPQFFTSITQSEVQAQTITYPPSLVQLIQNNLFHGLSEDKGEEVRGSTIHKGISHGRRSFATKNVPWIRSLERMLQWRKRKRDKKREGGA

SEQ ID NO: 147035 - protein, 54 aa, Glycine max
  Coding DNA Sequence Number=SeqID_55350
MEDCLGGPHIKLIDTVDLKGGPAALMNRPTRGERQFAYWALAECILAYYVGTDE

SEQ ID NO: 147036 - protein, 78 aa, Glycine max
  Coding DNA Sequence Number=SeqID_55351
GECVNNVVWALEQFRGIFLRHDALPGVIVTDRNLTLMNAMKIVFPECTNLLCSLVDCPSEQQFDECLKKFEIACSPWP

SEQ ID NO: 147037 - protein, 190 aa, Glycine max
  Coding DNA Sequence Number=SeqID_55352
MNFDCLAAGERLRQRIRLSVYACAYAGVADMRYARHTRSRRGVLRHRQVSFDNTPFRRENAKSFYPGRADFTLSIKFKRATRTLLQLEQSSALPSAVRGFVPVVACFITSRASFVGAIRCACRVSPSPAESWSIRLRVRDTGFTVQQVTPCGADHRYANDDTPFAFGRRCNLLLSWQRLVEQLCICPVTR

SEQ ID NO: 147038 - protein, 306 aa, Glycine max
  Coding DNA Sequence Number=SeqID_55353
  Gene Ontology: Biological process=transposition, DNA-mediated
  Homolog annotation: Hit_ID=Q6UUU1; Match level="QueryCoverage=19%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPVTTLANWSSTAVAAALELVDPPGCRNSITPYYSAKSSSFTQRRSTFYQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 147039 - protein, 287 aa, Glycine max
  Coding DNA Sequence Number=SeqID_55354
  Gene Ontology: Biological process=transposition, DNA-mediated
  Homolog annotation: Hit_ID=Q6UUU1; Match level="QueryCoverage=20%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPVTTLANWSSTAVAAALELVDPPGCRNSISMHWFYYALRGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 147040 - protein, 373 aa, Glycine max
  Coding DNA Sequence Number=SeqID_55355
  Gene Ontology: Mol. function=transmembrane transporter activity; Cellular component=membrane; Biological process=transport
  Homolog annotation: Hit_ID=A7P636; Match level="QueryCoverage=98%, HitCoverage=95%, E-value=1e-139, Identity=68%"; Hit description =Chromosome chr4 scaffold_6, whole genome shotgun sequence
  Pfam annotation: Domain name=DUF6; Domain location=8-209; Score=-0.9; E_value=0.077; Accession=PF00892.11; Description=Integral membrane protein DUF6
MGWRYKAGLFLILTVVVIWVTSAEVTQPFAVTYLGASLMVVYLPVAFIKDWLCKLFEHRSSRSGKSAKVGDEFSVRCTSPLKGNGVQKNIEVELGGMTRKDSDANLSAHEEVKPLMAKYNDATAIKVEKEHTTREIATYGFYIAPIWFITEYLSNAALARTSVASTTVLSSTSGLFTLFIGVLMGQDTLNVSKVVAVLVSIAGVVMTTLGKTWAADDAISSASNGQRSLVGDLFGLLSAMSYGLFTVLLKKISGEEGERVDVQKLFGYVGLFTLVALWWLIWPLSALGIEPKFTIPHSARVDEVVLANGFVGSVLSDYFWALCVVWTTPLVATLGMSLTIPLAMMADMVIHGRHYSALYILGSIQLSYSVVGQ

SEQ ID NO: 147041 - protein, 157 aa, Glycine max
  Coding DNA Sequence Number=SeqID_55356
MEDKRTVITNNQARKKIHPLIRSLSIGGEGGIVWLVVFGGALAIAGFMEDVRIKAQASQKQNTAPHILSRGGYEYLEEKLMTEKTKKRLEEAAQSGSTKGIIDPPSPIKRHVKWKMARTKKTGQMTSEAAKEIADRIESLDEQASQGSFVPMDVRIS

SEQ ID NO: 147042 - protein, 94 aa, Glycine max
  Coding DNA Sequence Number=SeqID_55357
MFLIFNTSALKGLDDTPQPKSKTAAWWIVVKCNRQKGITECGYYVMHWMSTIILGSFRNNWETYFNEVRPLEVERFKALRIQWAQYYLKVKHQT

SEQ ID NO: 147043 - protein, 138 aa, Glycine max
  Coding DNA Sequence Number=SeqID_55358
  Gene Ontology: Mol. function=nucleic acid binding; Cellular component= chromatin; Biological process=chromatin assembly or disassembly
  Homolog annotation: Hit_ID=Q9LH10; Match level="QueryCoverage=46%, HitCoverage=7%, E-value=1e-07, Identity=46%"; Hit description =Retroelement pol polyprotein-like
  Pfam annotation: Domain name=PRA1; Domain location=24-137; Score= -38.9; E_value=0.026; Accession=PF03208.10; Description=PRA1 family protein
MRLQDRICVPNVLELRKMVLKEGHKSNLSIHPGATKIALGTKLRLSLAYHPQTDGQIEHTIQSLEELLRHPVSIIVYLVAWFFLYFFHDESMVVFGTRVDDGVVVVILVAATLMGLVLIGVWVNVVGSGIVGVEYTNI

SEQ ID NO: 147044 - protein, 159 aa, Glycine max
  Coding DNA Sequence Number=SeqID_55359
  Homolog annotation: Hit_ID=Q6WAY4; Match level="QueryCoverage=66%, HitCoverage=19%, E-value=5e-10, Identity=31%"; Hit description =Putative uncharacterized protein
MHVYSCRVITHASHLSRHLCHGKPEGPHRLLNCMHRAPCYRIPRSVYDQSLRCFTFGDFRLVPTIEEFEGILGCPLGERKPYLFSKFYPSMARVAKVVKISTQELDRVKQNRNGVIGIPRKCLEERVEALADQGEWTSFIDILALLVFGTILMHMTHST

SEQ ID NO: 147045 - protein, 258 aa, Glycine max
  Coding DNA Sequence Number=SeqID_55360
  Homolog annotation: Hit_ID=Q6WAY6; Match level="QueryCoverage=91%, HitCoverage=49%, E-value=6e-30, Identity=30%"; Hit description =Putative uncharacterized protein
MQAFHKAYGKILDLTIAEISTEAVVSLTQYYDQPLRCFTFGDFQLVPTIEEFEEILGCPLGGRKPYLFSGFLPSLSKIAVVVRDSTRELDRVKQTRNGVVDLPWKYLEGKARDMANQEEWVPFMDVLALLIFGVVLFPNMDGLVDLAAIDAFLAYHHSKESPVEAILADLFDTFDQRRQNNQLVSSMEGKEGVLFSCGEYPNIPLIGTRDCINYNPALAIRQLGYPMRGAPTEESLSPFLVRDFGAQSFKIIQRVHKA

SEQ ID NO: 147046 - protein, 239 aa, Glycine max
  Coding DNA Sequence Number=SeqID_55361
  Homolog annotation: Hit_ID=A5BEV8; Match level="QueryCoverage=23%, HitCoverage=7%, E-value=8e-07, Identity=47%"; Hit description =Putative uncharacterized protein
MDEDQWMHDSMMSEEVDMNVENEEDVGVKVEHVDCSDAFNTSQLFASSDEVIQWARSLAHDIIFVVVIMRSDTNIGVRGRASFLLIAYERSGKYRPKKHNLLICGVHNHEMAKSFVGHPYAGRLTKDEKIVVDDMTKSMRFQGLFMRVDALPGVIVTDRDLSLMNAVKNVFSDAKNLLCQFHIDKNVKAKCKTQVAQKNAWDYMIELEGVWLTVHAKPGQALKGLSLAYDESLRPESGL

SEQ ID NO: 147047 - protein, 178 aa, Glycine max
  Coding DNA Sequence Number=SeqID_55362
  Subcellular localization annotation: CTP_CleavageSite=36; ConfidenceScore=5.77e-01
MAASSSSSHHLLLPLPVTVGVGACSSSVHPSSSSVLVVVVVGGCWSLVFFSSSILLLVCWVIFFECWIYEHFSSVGSAVPVEDYDERRPRACRWTSSKALPISTYRRRLDRLTPDVVFWISYGDHCSFREFEFGEYIAPIRQLCVVPSHYSPDYIDWFYMISHPFMSLAQPGDPLEFR

SEQ ID NO: 147048 - protein, 154 aa, Glycine max
  Coding DNA Sequence Number=SeqID_55363
  Subcellular localization annotation: CTP_CleavageSite=44; ConfidenceScore=5.64e-01
MVRLLPPRDSLTLSTSSLSSVSIPVRPPDVAPTPSPPPTKARPSSSHVNGRGPSQVHASTPSLSYVDARGPSPVPTSTPFPSPPVGSMPTNEDTINLAMEDPSLNDRPMVTLINRAFHPSNVAAKAVTLSIRQQFGQPWPTWGTIPKDQNDFFF

SEQ ID NO: 147049 - protein, 100 aa, Glycine max
  Coding DNA Sequence Number=SeqID_55364
MNYKKNLRLDYLKLGPKHKGRLYGTGDLAHTYKCGNDSFMQHTQGSSSHAEDAAEINYQREELRQSKEEMRIFQSVVLQFLPPEAWNIIHQQQQPHQQQH

SEQ ID NO: 147050 - protein, 62 aa, Glycine max
  Coding DNA Sequence Number=SeqID_55365
MEKSEKKNLSEKKLKKAYITWDENDMESSEDSENEEINLCLMAKSYESDEEANKDVFLIRLD

SEQ ID NO: 147051 - protein, 138 aa, Glycine max
  Coding DNA Sequence Number=SeqID_55366
MKKILGLQAPMELTSCGIRASSSSELSLIPCSSYYSPCISSILHVYSLFFTFAFVNYTVIYKTKVERKDIELVDEEEAQIGADRSSATSNKSEIYKEEARNAAQKHKPKRVESVNADAEAFGDHWKIQIALCILKLKH

SEQ ID NO: 147052 - protein, 77 aa, Glycine max
  Coding DNA Sequence Number=SeqID_55367
SKTPCPQGVGASNHELKIRRRQKVSPSDKEPYAVAEDRVKETEPEVQAGGLFSLIPLEALVPQKPDILGTQHLTLTY

SEQ ID NO: 147053 - protein, 76 aa, Glycine max
  Coding DNA Sequence Number=SeqID_55368
MFGVASTMFSDEQPWLQRGVIEERSREERKGFGEKLRKENKAMGRKDLKHLKKGKREWLGGRGGGSRDITVACGPL

SEQ ID NO: 147054 - protein, 917 aa, Glycine max
  Coding DNA Sequence Number=SeqID_55369
  Gene Ontology: Mol. function=protein binding; Cellular component =mitochondrion
  Homolog annotation: Hit_ID=A7P5U3; Match level="QueryCoverage=32%, HitCoverage=81%, E-value=3e-96, Identity=58%"; Hit description =Chromosome chr4 scaffold_6, whole genome shotgun sequence
  Pfam annotation: Domain name=DUF266; Domain location=612-907; Score =467.5; E_value=1.7e-137; Accession=PF03267.5; Description =Arabidopsis protein of unknown function, DUF266
MVMEYWRPWFWGHTDKYYVVKLSQLRLEFGATLGAANDKIIAIQITGTATKKGKVSSSFSSSTRTQKLGSIHTTFPQRFINSKAPTIVWDARDFCGFHLLLKHRSLSGTCHMALHVLHGEGDVGEYKPEMVMGGEVSMSVTMAELMEGEEMKNESNCCQVQRTLPIQLKVHGVFMEATLLVSLSLLKLRNFHDDLPRAFVDKVTCLGEKNNGKVDDQVEQWSSYESDELSVCDSDDSSDESTTTTTSSSSSSSTSTAIHCNGSSVTRSERFVDSDTETFLDTMQRSWSMLPWNRSFEGWTFKRTSSSKREPLTSHSTHSMGPYFDHNKCTASGWENRELWSRDGKTKLKTNVFFASFDQRSKKACGESACTALAVCIAHWLHSNHNMPTRAQFDSLIKKGSSKWRKLSHSDHYLKLFPDKHFDLETILEANIRPLVVIPQNSYTGFFSPEKFKCLEGAMSFDDIWDEITRNDGVVDHEPRIYIVSWNDHFFVLKVEVDACYVIDTLGERLFEGCKKAFMLKFDGSSLMHAKGSKKGRGEIVCKGKECCKEFIKRFLAAIPLRQLEEEEQNKGTVYNPYFHRKLQIDFHYSLLSSLSSVSSIVPLSSPSPSMWQENRHDALFKAAMRVNAKPTRPKKVAFMFLTNKPLPFAPLWESYFNQTTTSKNLFNIYVHADPTFPYHAPFSGVFFNRVIRSQPTRRFSPTLTAAARRLLAHALLDDTSNSLFVLLSPSCIPLHSLNFTYHALLRRGKSFVEILANEAVAYDRWAARGPHVMLPEVRLEEFRVGSQFWALTRRHARLVVSDRVLWPKFNVPCVRFDTCYPEENYFPTLLSMWDPQGCVPATLTHVNWTGRVDGHPRTYEAWEVGPELIRRMREDRPRYGDGNGDGRRDPFLFARKFAADALEPLMRISNGVIFRD

SEQ ID NO: 147055 - protein, 102 aa, Glycine max
  Coding DNA Sequence Number=SeqID_55370
MKAQVEKDEGPEPETLSRLLIVAEGPSNPCGVYPDLSSFIGSGVYPDLSSLTKSGVYPDLSSFTGSGVYPDLSSFTGSGVIQISVACIKRSVPSQVHIIFLL

SEQ ID NO: 147056 - protein, 49 aa, Glycine max
  Coding DNA Sequence Number=SeqID_55371
MVVEKGREEGGDRDDGQSRGEGVEREIQLEGEKPPIMEVESPLMEGETS

SEQ ID NO: 147057 - protein, 178 aa, Glycine max
  Coding DNA Sequence Number=SeqID_55372
  Homolog annotation: Hit_ID=Q9LHJ8; Match level="QueryCoverage=17%, HitCoverage=19%, E-value=1e-07, Identity=83%"; Hit description=Zinc finger A20 and AN1 domain-containing stress-associated protein 5
MVVLVPNRQRRWYSFVKDLINLIDDIIENLVATEQRRRNKRWHSIIIIRDTLVRLLRIVVEREHEGIKPNSVGSAWGSLDSVAAVATSYVLFCVEHRYSDCRDCSYDYKAARREAIARENPVVKAAKIVKVKVFVGIRHFSCSEKLWGGGAEAPLLEKTGFYDDPLKPSMMVFNRLRK

SEQ ID NO: 147058 - protein, 38 aa, Glycine max
  Coding DNA Sequence Number=SeqID_55373
MAAQDVVRQPDFGRKVYDRESLFFQQCPLLSPPSIRPS

SEQ ID NO: 147059 - protein, 591 aa, Glycine max
  Coding DNA Sequence Number=SeqID_55374
  Gene Ontology: Mol. function=protein binding; Cellular component =nucleus; Biological process=negative regulation of ethylene mediated signaling pathway
  Homolog annotation: Hit_ID=A7P5T8; Match level="QueryCoverage=99%, HitCoverage=96%, E-value=0.0, Identity=63%"; Hit description =Chromosome chr4 scaffold_6, whole genome shotgun sequence
  Pfam annotation: Domain name=F-box; Domain location=62-110; Score =30.1; E_value=7.9e-06; Accession=PF00646.24; Description=F-box domain
  Pfam annotation: Domain name=LRR_1; Domain location=178-202; Score =4.7; E_value=41; Accession=PF00560.24; Description=Leucine Rich Repeat
  Pfam annotation: Domain name=LRR_1; Domain location=204-227; Score =8.2; E_value=9.1; Accession=PF00560.24; Description=Leucine Rich Repeat
  Pfam annotation: Domain name=LRR_1; Domain location=230-254; Score =3.1; E_value=81; Accession=PF00560.24; Description=Leucine Rich Repeat
  Pfam annotation: Domain name=LRR_1; Domain location=310-337; Score =2.1; E_value=1.2e+02; Accession=PF00560.24; Description=Leucine Rich Repeat
  Pfam annotation: Domain name=LRR_1; Domain location=362-383; Score =11.9; E_value=1.9; Accession=PF00560.24; Description=Leucine Rich Repeat
  Pfam annotation: Domain name=LRR_1; Domain location=389-411; Score =1.3; E_value=1.7e+02; Accession=PF00560.24; Description=Leucine Rich Repeat
  Pfam annotation: Domain name=LRR_1; Domain location=416-439; Score =10.1; E_value=4; Accession=PF00560.24; Description=Leucine Rich Repeat
  Pfam annotation: Domain name=LRR_1; Domain location=442-463; Score =0.8; E_value=2.2e+02; Accession=PF00560.24; Description=Leucine Rich Repeat
  Pfam annotation: Domain name=LRR_1; Domain location=469-492; Score =9.6; E_value=5.2; Accession=PF00560.24; Description=Leucine Rich Repeat
  Pfam annotation: Domain name=LRR_1; Domain location=496-523; Score =8.3; E_value=8.9; Accession=PF00560.24; Description=Leucine Rich Repeat
  Pfam annotation: Domain name=LRR_1; Domain location=548-571; Score =9.3; E_value=5.7; Accession=PF00560.24; Description=Leucine Rich Repeat
  Pfam module annotation: Pfam domain module=F-box::LRR_1::LRR_1::LRR _1::LRR_1::LRR_1::LRR_1::LRR_1::LRR_1::LRR_1::LRR_1::LRR_1; Domain location=62-110::178-202::204-227::230-254::310-337::362-383::389 -411::416-439::...
  Pfam module annotation: Domain location=442-463::469-492::496 -523::548-571
MFGFSGVDDFCPMGSIYANPKEASFFLPLGPQVDVYFPPRKRSRVNTPFVFDGEWFEQKPKTSVEALPDECLFEIFRRLPSGEDRSACACVSKRWLMLLSSICKNEICPTNKATGYLSRSLEGKKATDVRLAAIAVGTSSRGGLGKLSIRGSNMALSLWNVATVGDEGLIEIANGCHQLEKLDLCKCPAITDKALVAIAKNCQNLTELSFESCPNIGNEGLRAIGKLCSNLKSISIKDCTGVSDHGIAGLLSSTSLVLSKVKLQALTVSDLSLAVIGHYGKSVTDLVLNCLPNVSERGFWVMGNGNGLQKLKSLTVASCKGVTDIGLEAVGKGCPNLKIAHLHKCAFLSDNGLMSFAKAASSLESLRLEECHRITQLGFFGVLFNCGAKLKAISLVSCYGIKDLNLVLPTVSPCESLRSLSISNCSGFGNASLSVLGKLCPQLQHVELSGLEGVTDAGLLPLLESSEAGLVKVNLSGCTNITDKVVSSLANLHGWTLENLNLDGCKNISDASLMAIAENCALLCDLDVSKCTITDAGIAVLAHAEQINLQILSLSGCTLVSDRSLTALRKLGHTLFGTKHPTLQCNQQQHG

SEQ ID NO: 147060 - protein, 269 aa, Glycine max
  Coding DNA Sequence Number=SeqID_55375
  Subcellular localization annotation: CTP_CleavageSite=51; ConfidenceScore=5.90e-01
MATPSSSPPPPQSTTHSSSTSKKTRKVTWLRSLATRPTARKARMIKYVKSKASTRRSETNFVRVIKTEVQKKAQAIQKQNTAPRVLSLGGYEYLEENLMEDKKKKRLEETAKSGSTKTIIDPPSPIGRHNSLEEQVSQGSLVAHERQDVLIVVIGQPEHSGRVHAAGVSVMIKQYFGTTSRTSDTSSSMAPEDMYRRCNHRDLHCLLGLRDLEKSGLYVNENPPRLVTLRKLYEGSTTVHNIPLGNDQVKVNVEEVRDVDAHILVPTQE

SEQ ID NO: 147061 - protein, 101 aa, Glycine max
  Coding DNA Sequence Number=SeqID_55376
  Homolog annotation: Hit_ID=Q84JY4; Match level="QueryCoverage=71%, HitCoverage=40%, E-value=3e-10, Identity=51%"; Hit description =Putative uncharacterized protein At5g25360
MDEASKGLRTQGQTVSKVDGSEDFWSSSTFELDHSAAHSQRSISSIGMPNNPSDSQCSGGSQSGAPEFVNHGKFAVMCSLSVDSLVWKRSCLIVDRAIQDL

SEQ ID NO: 147062 - protein, 190 aa, Glycine max
  Coding DNA Sequence Number=SeqID_55377
MLGVGRKSLMGKVYCFVPFVGVVATCSKYIEIVFSSSGFTFTSCWIVTEAMDEILGSMLVIECWVKDGSGKGSVKVGIGSRMRTRGLLEVATVSDETGSSEGGETSNAATAKTDIVVVATGTIGKGLGKDNGNVGGSGRGWRINMLEVSGRDLPWVFAVVTMVALRAIVLAIVEEEKGFRRVTHERGAPG

SEQ ID NO: 147063 - protein, 64 aa, Glycine max
  Coding DNA Sequence Number=SeqID_55378
MSGSRVSQQPSNFPMHSVACQRSYNAQWNALKLLYDKHMLRSGCILEKMEVEEPWLGLRLPLHY

SEQ ID NO: 147064 - protein, 233 aa, Glycine max
  Coding DNA Sequence Number=SeqID_55379
  Gene Ontology: Mol. function=nucleotide binding; Cellular component =integral to membrane; Biological process=regulation of transcription, DNA-dependent
  Homolog annotation: Hit_ID=A9PGB8; Match level="QueryCoverage=64%, HitCoverage=29%, E-value=4e-53, Identity=70%"; Hit description =Putative uncharacterized protein
  Pfam annotation: Domain name=DUF246; Domain location=115-233; Score= -157.6; E_value=1.9e-05; Accession=PF03138.5; Description=Plant protein family
MLRNANTKSTLKSTEVPLSCAKNNAHLERTARVRNGRLSHNSIGQGWRIEKMGFSWGKRGHFSDPKTRSSTHHDEARPTSQLSELWSPLESQGWKPYVESNKPTALLEKLEGYIQVFLDGGLNQQKLGICDAVVVAKILNATPVIPYLELNPVWRDSSSFMDIFDVDHFIDVLKNDISIVKELPKELLMFDCSSFMYYGLAIRETKIKAAPVHASAYWYLDNVLHVLQILVST

SEQ ID NO: 147065 - protein, 46 aa, Glycine max
  Coding DNA Sequence Number=SeqID_55380
  Pfam annotation: Domain name=COX5C; Domain location=2-45; Score=22.5; E_value=4.5e-05; Accession=PF05799.3; Description=Cytochrome c oxidase subunit Vc (COX5C)
MAGPRIAHATLKGPSVVKDIIIGITLGLAAGDQLQVLPSSSSIAVQ

SEQ ID NO: 147066 - protein, 38 aa, Glycine max
  Coding DNA Sequence Number=SeqID_55381
MVAIFSSSLFVSSPIPESIKLHNFSGLAPRSFRIKRKK

SEQ ID NO: 147067 - protein, 209 aa, Glycine max
  Coding DNA Sequence Number=SeqID_55382
  Gene Ontology: Mol. function=hydrolase activity, acting on glycosyl bonds; Cellular component=cellulose and pectin-containing cell wall; Biological process=cell wall organization and biogenesis
  Homolog annotation: Hit_ID=Q9ZPI8; Match level="QueryCoverage=77%, HitCoverage=45%, E-value=1e-35, Identity=45%"; Hit description =Polygalacturonase
  Pfam annotation: Domain name=Glyco_hydro_28; Domain location=16-209; Score=-38.5; E_value=3.1e-07; Accession=PF00295.8; Description =Glycosyl hydrolases family 28
MALRHLWCQLGIHFLCAKQDSEVPANLKNLIFSKFNCLRMQIMGNLLAPTKDAWKKCSGPWLYFLDVRGMTVHGSGVINGQGRDWWGKPYGTGACSHMPTALLFQRCDGLQISGLTHINGPGSHIFVVHSQDITISNIDIYSPLESHNTDGIDLTNSVRVNIRDSIIRTGDDCIAMKGGSKFININNVTCGPGHGIRYSSKCELYKYSQ

SEQ ID NO: 147068 - protein, 81 aa, Glycine max
  Coding DNA Sequence Number=SeqID_55383
MVATRSLWGFRLIKEVATRVWVCGGVWVGDGSNVVAGWGRGGSDVVGRFGFMVTMRSLTTKLREKLEILRFCKARAKRSSN

SEQ ID NO: 147069 - protein, 242 aa, Glycine max
  Coding DNA Sequence Number=SeqID_55384
MRSLTQILAAVARLSGLLPAKPIMRNFHKRLTNLVDGSIDLALVKEFYANLYSSEGPSPKQARVKGHLVKIDVDSLNTFLETPVVLAEGPPGRILRKDLTTLAQVWSVLSYSNMAPTSHTSDLIVDRARLIFGLVSRMDMNIGALISGQMTSIAQSNTSRLGFPALITALCRARGVVSNSLTFERLSPVINLAYIRKNCWNPEDLTVSIRGDMSTRARPAELPSTSTAPTPAPTSTTPSIPP

SEQ ID NO: 147070 - protein, 25 aa, Glycine max
  Coding DNA Sequence Number=SeqID_55385
MVPKTCSSSVCKLTMKKENHVSNDA

SEQ ID NO: 147071 - protein, 91 aa, Glycine max
  Coding DNA Sequence Number=SeqID_55386
  Subcellular localization annotation: CTP_CleavageSite=58; ConfidenceScore=5.39e-01
MGQVTTPENPGGYHSKSNKKDAYCSNNREATKVKTKVMSTVATRWRQFKSTLTSKFVFAKSEGQQTQDVVTKYGLDPEAWKQFEETRLTPN

SEQ ID NO: 147072 - protein, 198 aa, Glycine max
  Coding DNA Sequence Number=SeqID_55387
HSVTGIDEGHQLSGVFQCQGSDGEGPSHKEPFEACKHGWGTKGQPCQEVAPSCNHGMSRYNMWKLSLGRRDAIGSCKAGDCIKGFEHGGTEAKAVVIAVRSAQELDMIVIQQLIIVNILPQTRLRLKAEFGPKMHESSSGHELSEQIRNLIIGRNVVSDKMAKGNSFANIVIAQFNVLAAGMKYWIDGHVKSTKIITV

SEQ ID NO: 147073 - protein, 161 aa, Glycine max
  Coding DNA Sequence Number=SeqID_55388
  Homolog annotation: Hit_ID=A7QL86; Match level="QueryCoverage=21%, HitCoverage=6%, E-value=9e-08, Identity=74%"; Hit description =Chromosome chr3 scaffold_117, whole genome shotgun sequence
MDVWSFADDKFIADVIFAIVAASLVAIVESTGTFIAAWRLSKATPIPPSVLGRGVGWLVKKKKLKEENKRKALEAERAKEEQLLRKRQREERRDKYRKEDKQNKKIRRAESEGWNGNMSLFGKSEGIEFDLIPRNPKYEITYDQCLQLFTSLKHSGVLVHQ

SEQ ID NO: 147074 - protein, 114 aa, Glycine max
  Coding DNA Sequence Number=SeqID_55389
MGKAKEAAVVAGALAFTWLLIELAFKPFLTKARASIDNSDPSRDPDDDALPKTTINDVPNVADSKPAGDVPTAVDTITTDPDVPSNVLRQRSQAVKPLILCEWGYKRILRRLNI

SEQ ID NO: 147075 - protein, 97 aa, Glycine max
  Coding DNA Sequence Number=SeqID_55390
  Gene Ontology: Mol. function=ubiquitin-protein ligase activity; Cellular component=ubiquitin ligase complex; Biological process =protein ubiquitination
  Homolog annotation: Hit_ID=A7PI07; Match level="QueryCoverage=75%, HitCoverage=11%, E-value=3e-24, Identity=76%"; Hit description =Chromosome chr13 scaffold_17, whole genome shotgun sequence
PIHIVVEVIQTGSPRNRENVAAVLWSLCTGDPLQLKLAKEHGAEAALQELSENGTDRAKIKAGSILELLQRMEGGPAIKSAATTEPGSQNGKKLEGG

SEQ ID NO: 147076 - protein, 92 aa, Glycine max
  Coding DNA Sequence Number=SeqID_55391
  Homolog annotation: Hit_ID=UPI0000ECBAF8; Match level="QueryCoverage =44%, HitCoverage=48%, E-value=1e-16, Identity=100%"; Hit description= UPI0000ECBAF8 related cluster
MLIDVGNALSCACCVCSWGAKCTDLSGSLALALSQSRPAGMQAWHWPSFYNVVTGKTLALPNLIALQHIPLSPAGVIAKRPAPIALPNSCAA

SEQ ID NO: 147077 - protein, 39 aa, Glycine max
  Coding DNA Sequence Number=SeqID_55392
MKAITNTSKGMLDEVAPRWIETKWFSDTTSLDVEAIRTL

SEQ ID NO: 147078 - protein, 66 aa, Glycine max
  Coding DNA Sequence Number=SeqID_55393
MRKYERVASAFVRRLLVVREDLFLEDVGDLPKSEYVECASNVDDEKSTVPLGIGFSDMAFENCGMA

SEQ ID NO: 147079 - protein, 705 aa, Glycine max
  Coding DNA Sequence Number=SeqID_55394
  Gene Ontology: Mol. function=spermidine synthase activity; Cellular component=cytosol; Biological process=spermidine biosynthetic process
  Homolog annotation: Hit_ID=A3BIV6; Match level="QueryCoverage=13%, HitCoverage=35%, E-value=3e-31, Identity=73%"; Hit description =Putative uncharacterized protein
  Pfam annotation: Domain name=RCC1; Domain location=287-339; Score =9.8; E_value=0.065; Accession=PF00415.9; Description=Regulator of chromosome condensation (RCC1)
  Pfam annotation: Domain name=Spermine_synth; Domain location=1-176; Score=18.3; E_value=1e-09; Accession=PF01564.8; Description =Sperminespermidine synthase
  Pfam module annotation: Pfam domain module=RCC1::Spermine_synth; Domain location=287-339::1-176
MGNWVKSLLQHLCLFLTARNVLVIGGGDGGVLREVPRHASVEKIDICEIDKMVVEVFKQFFPYIAVGFEDPRVTLTVGDGVAFLKNVPEGTYDAVIVDSSDPIGEGCTLTPMKENVLPLMTVNFQQGLGQKFKQPAGTGIDFSTFEESELLKVGDMDVYPVAIKADASSSDHDESKSNETPSSGTSNSQITQAVFEKEKGQFVSCKTEVLDIDISSAVGKSSLSLFPFLTWVLEEMVDKKNGDGGRVCLCLFVLFCVCEWFGKLVGKGAVLAGVYARKRKTFVLVNSGLVYGFGFIGFGILGFLDRKVSDKVLKPRILDTLRAHHVCQISTGLYHTVVITSRGQIFGFGDNERAQLDHDTSPNMGQKGSMNPICAKVQNLQTKTVNKTIKNGAREWDSVMYRSFLRCDDPKGVVECGTIKKYRTRSHKVKDKTRIQKTGENLETSLSLMNKRYKEENKVPKGCDGNLIDPSSYRDIMCDEKSEDIAEDRIEAKIIGRTHANPFGEQSNPKGFQRPQPSAGGCLSNCQEELKKVIKESLVTQNMFPKTSERLNYGSKTFSTSTSQYSVVRTNNLFDPSFSAIAPKMERPPSLIFKLMGLEEAPSKSFPAIKQKQLDRELDMSKESFVKEPKLHVHHFNDTNSKQFRDLSHIALMKPQCTLYQESFHKHGKEMEKGICKRVNKEEGPKFLKEVMKLDAKGINPVEES

SEQ ID NO: 147080 - protein, 229 aa, Glycine max
  Coding DNA Sequence Number=SeqID_55395
  Homolog annotation: Hit_ID=Q9LU25; Match level="QueryCoverage=13%, HitCoverage=6%, E-value=2e-07, Identity=76%"; Hit description =Arabidopsis thaliana genomic DNA, chromosome 3, P1 clone: MYA6
MLKNGRESSRNYSRKRYGSASAWIFFTEIIFLNNFERERSAKKAKPFSSSLLPLFIAKIGEELATQLSQASKVASFRSNSFLEEGSRRPNFRRSYGNSRIAQKHIFLISATSRNFTDRASLLPFDFCHVSGLHLLCNKGRQFGQLVMIMSRIEQALKARIRSRRKKFWEKAVDIEELCGPDKAWWGEYEDRLTVVKIDHDVNPQLQIQHNVVKEGCAKGFLLGAGIQSF

SEQ ID NO: 147081 - protein, 81 aa, Glycine max
  Coding DNA Sequence Number=SeqID_55396
MVATRSLWGFRLIKEVATRVWVCGGVWVGDGSNVVAGWGRGGSDVVGRFGFMVTMRSLTTKLREKLEILRFCEARAKRSSN

SEQ ID NO: 147082 - protein, 319 aa, Glycine max
  Coding DNA Sequence Number=SeqID_55397
  Gene Ontology: Mol. function=serine O-acetyltransferase activity; Cellular component=cytoplasm; Biological process=cysteine biosynthetic process from serine
  Homolog annotation: Hit_ID=Q5MYA1; Match level="QueryCoverage=33%, HitCoverage=29%, E-value=2e-51, Identity=92%"; Hit description =Serine O-acetyltransferase 1
  Pfam annotation: Domain name=Hexapep; Domain location=215-232; Score =17.9; E_value=0.039; Accession=PF00132.15; Description=Bacterial transferase hexapeptide (three rep
  Pfam annotation: Domain name=Hexapep; Domain location=241-258; Score =14.7; E_value=0.35; Accession=PF00132.15; Description=Bacterial transferase hexapeptide (three rep
  Pfam annotation: Domain name=Hexapep; Domain location=259-276; Score =7.9; E_value=17; Accession=PF00132.15; Description=Bacterial transferase hexapeptide (three rep
  Pfam module annotation: Pfam domain module=Hexapep::Hexapep::Hexapep; Domain location=215-232::241-258::259-276
MANHSTSLINGIPINEASNLGWQQPQSLPQSEGKLVMFKFEWLFGTPKVELVKHVTGIDGSRVQKVLESVHIAANKNTVPGDVSAMAPGGIRMARLRQVNCKPVAMGENYFCSSPPPPRVRTQLVHLPIQLEPKIGSSPMEVQQRKPAVAAATIQLEHKVFGSKFECVCMENEDDNNGVQVGLKNEALAIGPPSPSKGSLPLFLVLSSSHGEGETTLIGNNVSILHNVTLGGTSKASGDRHLKIGDGVLIGPGTCILGNIKIGDGAKIGACFVVLKEVPPRTTIVGNPARVVGGKDNPIKLDKMPSFTMDHTSWSDYVI

SEQ ID NO: 147083 - protein, 281 aa, Glycine max
  Coding DNA Sequence Number=SeqID_55398
MGGPVLRETRIWATWEYVSSVGGGQQGMGETSCFYSLTTEWYLEICRGEPVMYLNMRAPGSQQIKGTKTTKQGGLWWLASCEFCVIYGLWPLVIDYQGLENEASGNRLPACVIDYTEGWVTGNRLPESTPFFSFLLIVMAAQLIRDRVEMECLEGAWETLEGNTRCRFQGTIRFTATSLVHPDEPARMLQRTVEWILPTPTPYRLVEPVQVIEVTSSEEDPEEDLEELPPEPAVDALDFLEGDEDPLLEVDSPEEVMSASEADSTEDSGPGEMAISGGSSS

SEQ ID NO: 147084 - protein, 30 aa, Glycine max
  Coding DNA Sequence Number=SeqID_55399
MGVVVSLVDNSRLIDKSWELKDNVRDKHLN

SEQ ID NO: 147085 - protein, 47 aa, Glycine max
  Coding DNA Sequence Number=SeqID_55400
MARDKLQSSAVCDLKLKLISDRQLDGRLYNLPNTAEVAALIIGDEHT

SEQ ID NO: 147086 - protein, 358 aa, Glycine max
  Coding DNA Sequence Number=SeqID_55401
  Pfam annotation: Domain name=DUF223; Domain location=13-109; Score= -8.3; E_value=0.018; Accession=PF02721.5; Description=Domain of unknown function DUF223
MWHVNKHNGRQEIEMVFMDQTGAKIGATLWQELFPEFEVMLHCGSAYVIQNIKVVENHSKYKVSRIPFLVYLVKTTSVKEAKHPMIPTNVHVITPFVDIIDGVAPRDTLVNVVGVVVEVIEHKTVNPTYRVTVKLRDNRYLPFEEAYALQLNDAIEKNYFDRKPLVVMLTLAEIKDPKGMSFYVGGLSDQGSVSQSQYSQYSQRSSVDKFLHNAQMMTLGEISRLRQDCYCLTIGTVDEVMIDTPWSYNSCPYCTTTFDPLKFGSTCRSCQNEVADTVPRMGRRPTSISGMKHSGDDIKVSPPCVDELLGKTWVVRFKYRVQMRQSSVLDVTKDEYLIQTMTSTIALHVDEPSKYREG

SEQ ID NO: 147087 - protein, 175 aa, Glycine max
  Coding DNA Sequence Number=SeqID_55402
  Homolog annotation: Hit_ID=A7QJJ3; Match level="QueryCoverage=94%, HitCoverage=25%, E-value=3e-34, Identity=43%"; Hit description =Chromosome chr8 scaffold_106, whole genome shotgun sequence
MGPLLPFEELVNEDVSVDEPFKQEEDNKDDTNKDCNLPNPCALLHVTNRKKAPSLKKSLSMRTISEIQIESLRKQLIEETSLQCLHSKESIDSLNYAHSGSLNADKNVNFRESDAILVIKRLQDQIKVLEMENLSSQKSLDNVVGLATKQNICAREKYEEKTLELQTTSISDGPR

SEQ ID NO: 147088 - protein, 75 aa, Glycine max
  Coding DNA Sequence Number=SeqID_55403
MSDMDGNIRGCPEKICQQWAVEQSRRESVDTRGCLVVTGRCDVVSSAGAGGTSEAIDYYALHTTQFNMIGINTQR

SEQ ID NO: 147089 - protein, 149 aa, Glycine max
  Coding DNA Sequence Number=SeqID_55404
  Subcellular localization annotation: CTP_CleavageSite=41; ConfidenceScore=5.35e-01
MVGLSSRKPSSSSAIKRKALEAHLWPRWNFSSQLKQRSCSRCKANSSRDNHLIGREGSVFEGVGSKGEEDDARENEGGDNVLEDGIGAEFSQASRLYQHQWLQGLNFKANLQGQAGNEAAQEELRCETDDSVCQDLELRKVCLDSAVLR

SEQ ID NO: 147090 - protein, 85 aa, Glycine max
  Coding DNA Sequence Number=SeqID_55405
MEHGAGYGSYKWARRCISTHKRTFNFKMYLVWGRNSHGTNLMGQQRAGWTDFLYVMNGFGNGKDHCPVMLKSLELLTGDPDLSRF

SEQ ID NO: 147091 - protein, 146 aa, Glycine max
  Coding DNA Sequence Number=SeqID_55406
  Homolog annotation: Hit_ID=A2E5Y7; Match level="QueryCoverage=95%, HitCoverage=2%, E-value=5e-07, Identity=27%"; Hit description =Putative uncharacterized protein
MAIEGRPLETNLSEEDFPPSTESDEQSRRDTEERRTEGQNRNKEPQVNNQESLTRVQEWVTSDSCSGQKQVDRSKQKPDKSEKTQAQRTTIEPNHDPISRKEKEIKSNKIWSEKESIKVIQNLAAEITEKEHAQEQENSREDKDKE

SEQ ID NO: 147092 - protein, 190 aa, Glycine max
  Coding DNA Sequence Number=SeqID_55407
MTGRLLAGSLAFESCILHYLIVRILLPRSSNLAQVFEEDFIVMWAFHKGLQIDWAHLVRYHMHKALRLNAPLLYPHLVTLFLQHFNIPLDSEPYVPIKRSFLIGASVIASFGYIKVHDGSWVKKGARNVGEEGHEGEDSSLLSKIMERFDTLELQVDIRFNEMESRMTKVEDVSYIRSSFDLPPPSPPSS

SEQ ID NO: 147093 - protein, 128 aa, Glycine max
  Coding DNA Sequence Number=SeqID_55408
  Subcellular localization annotation: CTP_CleavageSite=33; ConfidenceScore=5.26e-01
MKDCKNTSGEDVSFTSRISQSLTNSSQALKPVPASSSGGLVHARALSALMDRLAHYGVGCETLEVKGTRESVFEEETLEVEGGLDDKERGGVDAEEEDGYGDDPKRVEGGKEGGGDQEEEGQLGESRM

SEQ ID NO: 147094 - protein, 142 aa, Glycine max
  Coding DNA Sequence Number=SeqID_55409
  Gene Ontology: Mol. function=protein domain specific binding; Cellular component=cytoplasm; Biological process=response to stress
  Homolog annotation: Hit_ID=Q39558; Match level="QueryCoverage=88%, HitCoverage=59%, E-value=5e-34, Identity=50%"; Hit description=14-3 -3 protein 32kDa endonuclease
  Pfam annotation: Domain name=14-3-3; Domain location=8-142; Score= -5.8; E_value=0.0053; Accession=PF00244.11; Description=14-3-3 protein
MASAPTPCEEFVYMAKLVEQVKHYEEMVEFMEKVFASTESEELTEDHLVVIRNYRSKIKVELSNIYDKILKLLDTHLVPSLTSGDSKVFYLKMKGAYHRYFTEFKIDANRKEAVESPLSTYKAAQICFFFFSFDFLDFYFVM

SEQ ID NO: 147095 - protein, 334 aa, Glycine max
  Coding DNA Sequence Number=SeqID_55410
  Gene Ontology: Mol. function=inorganic anion exchanger activity; Cellular component=integral to membrane; Biological process=anion transport
  Homolog annotation: Hit_ID=A5APS8; Match level="QueryCoverage=77%, HitCoverage=40%, E-value=7e-87, Identity=61%"; Hit description =Putative uncharacterized protein
  Pfam annotation: Domain name=HCO3_cotransp; Domain location=2-209; Score=-405.5; E_value=0.084; Accession=PF00955.12; Description=HCO3- transporter family
MVIRAKVTSLIPSEEIAEGEIVCRVVISIIPWQRPGWINFLSNPNLQLIRKKVVKSVKQQGSNSELYGKMQVVFVEMDTTPTTKELENLKEAVMKSNEKNAAKENFDPDKHIDAYLPVRVNEQRMSNLLQSLLIGLSIFSVNIIKMIPTSVLWGYFAYMAIDSLPGNQFWERISLLFIPPSRRYKILEGYHASFVESVPFKTIAVFTILQFVYFLICFGVTWIPVGGILFPLPFFLLITIREHLLPKIFKPNHLQELDASGYEEIVGAPHITHNIPPREKESNDPDSDDMSSEDYYDAEILDKMTTNRGELKLRTVSRNNSKSFSYSSSEDMQH

SEQ ID NO: 147096 - protein, 171 aa, Glycine max
  Coding DNA Sequence Number=SeqID_55411
  Gene Ontology: Mol. function=molecular_function; Cellular component =membrane; Biological process=auxin mediated signaling pathway
  Homolog annotation: Hit_ID=A7NVB2; Match level="QueryCoverage=76%, HitCoverage=34%, E-value=2e-30, Identity=51%"; Hit description =Chromosome chr18 scaffold_1, whole genome shotgun sequence
  Pfam annotation: Domain name=DUF6; Domain location=41-167; Score=7.7; E_value=0.025; Accession=PF00892.11; Description=Integral membrane protein DUF6
MLIERVRVRKYVFFVITKQGLTILAPVDSPNTDGIDPVQFGSAGMFIFGMDSIKKGMSHYVFIVYRNAIASVSLAPFAFVLERKVRPKMTFWVFSEIMALAFFEIMLDQCFALLGMKFTSASFLSAVMNSAHSVTFVMAVILRVETYYPVHDKGMGLECSGSSLTGGGLVK

SEQ ID NO: 147097 - protein, 75 aa, Glycine max
  Coding DNA Sequence Number=SeqID_55412
MEKSKTCGKREGSRTLPDSTGARKEKGEELQQLAQKEERGLLNTNLQRRMKPCKWTEVSKEGVNRTEFRYQPLFV

SEQ ID NO: 147098 - protein, 93 aa, Glycine max
  Coding DNA Sequence Number=SeqID_55413
MSMNHDRSTHVVYPDNETREFAEAIRSHLDPSLTSSNSIQGGVGMKRFKGLMSDLIKEHDTLKEVGVFNMASARGENAFRNCVIESDLLDIGY

SEQ ID NO: 147099 - protein, 295 aa, Glycine max
  Coding DNA Sequence Number=SeqID_55414
  Homolog annotation: Hit_ID=A7PN77; Match level="QueryCoverage=36%, HitCoverage=52%, E-value=1e-26, Identity=56%"; Hit description =Chromosome chr1 scaffold_22, whole genome shotgun sequence
  Pfam annotation: Domain name=WD40; Domain location=196-236; Score =22.1; E_value=0.0021; Accession=PF00400.23; Description=WD domain, G- beta repeat
MSIYHFPHHDRVPRLPPHIPRPPLFSLLTFHGDSLVQSNADHDLLTAFEIGDAELLYEIRLLSALQHVAATSFLIENRCDGKATQELAHAMKAFPNKGGFGIGAGAGRGGDEGGDECDFGGGGCGACSGGEAEDWGGGGGEFGGVVAGLRDGGEGDFGGMQNKVLLIWDYMHLQTRKLEVLIKNGSRLYDLRLLQRGVVQCYEGHVNSHTHMQISVDPSERFVMSGGEDCKLKLWSIKSGELLFEDKFSDSVISIVCYKTYGHSFKAEEENQYKHDSSQGAWLGSLEGLFYMCWL

SEQ ID NO: 147100 - protein, 61 aa, Glycine max
  Coding DNA Sequence Number=SeqID_55415
MEISSSLISNIVVVGTTSDNVSSKRKTLDEASLLSSESETQHDHRSTSTSYVSTDPGAMCA

SEQ ID NO: 147101 - protein, 171 aa, Glycine max
  Coding DNA Sequence Number=SeqID_55416
MVTIRADEISKIICEHFEQYNTELKGPSGKEAEVPEESEEVQALKAKLERTRVVKKKLKTIVTKVKKECDELRDVNMTMVEALEWETKRAQKEEWRRHKFRGAPWGSNNELKLRRAEKDVSRVENMVLKDKLKACQSVDFHALAKPTCRLSEPSAERNTPRLSARKNMEEG

SEQ ID NO: 147102 - protein, 164 aa, Glycine max
  Coding DNA Sequence Number=SeqID_55417
MGFDGPRFRSEEHQNRFKVIKGWFFHKERRVQLREGEYTKFQEEVARRQWTQLTGPMAKYDPEIVMEFYANAWPTEEGVRDKSSWVWGQWVPYDEDAINQFLGHPLVLEEGQRYEFSEMRSQASGFYKEAIDQLLCIPGQDFARSVTGRWVRIMRTSMNTLTQI

SEQ ID NO: 147103 - protein, 52 aa, Glycine max
  Coding DNA Sequence Number=SeqID_55418
MNLKPPQESQVDIVGSANVDATDEYAWQGKVAATAEDDVELVAEVGDALVRP

SEQ ID NO: 147104 - protein, 252 aa, Glycine max
  Coding DNA Sequence Number=SeqID_55419
  Gene Ontology: Mol. function=protein binding; Biological process =protein modification process
  Homolog annotation: Hit_ID=A7QVK4; Match level="QueryCoverage=69%, HitCoverage=47%, E-value=5e-26, Identity=42%"; Hit description =Chromosome chr16 scaffold_189, whole genome shotgun sequence
MQSKLLASPILDGKALLYSFVSTPEVRIGVAFGSDGSQSLPATEWPGVSSWLLVPGDAGELKKMLTEPTGLHVQDRKLIYKKKERDSKSYLDVERVKDGSKLVLLVDIESRERRLLEMLKIAKKEKTLKSLTEIKVEVDKLAKKVAALEAATSTGGVIAELDIETLTENLMRTLIALDEIYYEGELKLQRREQGTTIVGGCRYRRAIPVGLRGLLNIDANYGIRKAFLPQMLRQRLLLEINQQLIKQLARTA

SEQ ID NO: 147105 - protein, 160 aa, Glycine max
  Coding DNA Sequence Number=SeqID_55420
  Homolog annotation: Hit_ID=A5AV98; Match level="QueryCoverage=61%, HitCoverage=13%, E-value=5e-16, Identity=49%"; Hit description =Putative uncharacterized protein
MKIVETGNARFIENSEINESIVPREVETKEVRVLVPLACASSGKVIAPLVIVTNNNEEAQHNNEPMIHNEPIVEESQEVALRRSQREIRPAILNDYVNYQRVVRELVVSGSSRLNVTLMATLNVTRLDLLLRGLLRKMTLIIKRRFHRSHGRILLGLSWY

SEQ ID NO: 147106 - protein, 61 aa, Glycine max
  Coding DNA Sequence Number=SeqID_55421
MECKCASPETKGHLPGPRCYKTNKNEYCDKHMCEERERESMSGCEDIEAVVVATLSVAAMK

SEQ ID NO: 147107 - protein, 111 aa, Glycine max
  Coding DNA Sequence Number=SeqID_55422
  Gene Ontology: Mol. function=structural constituent of ribosome; Cellular component=ribonucleoprotein complex; Biological process =translation
  Homolog annotation: Hit_ID=A7NWA5; Match level="QueryCoverage=39%, HitCoverage=77%, E-value=3e-11, Identity=76%"; Hit description=50S ribosomal protein L33
MGDKKKKAQMFVKLVSAAGTGFFYVKRKPRQFTEKLEFRKYDPRRLKCRWVGVLTQEFFAPRGYGSRMGEGAKVEESGGDGEAIDDDGVVQVCLRVCVRVVFSVRVGVSAS

SEQ ID NO: 147108 - protein, 87 aa, Glycine max
  Coding DNA Sequence Number=SeqID_55423
MEDIIETDPGVPRLYLKPVSEVNKKEMDVVLTQEMDKDKFTRMEDAYGVPKSKSIASMAKRLEKKKKIDDVAELVGLFCWIKWPRNN

SEQ ID NO: 147109 - protein, 168 aa, Glycine max
  Coding DNA Sequence Number=SeqID_55424
MSPKMCPLGPAPSIEQAPMAKDLVQWVMDHDGPRGGGNEKHYEVGLRLVGEGGPKLDIDPLSNVISDIFSLGIYTSLHGILDLEQPALKGNVNDMPGLYYRIHGLDVGRACYVLRLRMGESTKILLQDPIHNFGLVVSFWMVCRTHTQAGATEAKKFLPKRADEYRVA

SEQ ID NO: 147110 - protein, 347 aa, Glycine max
  Coding DNA Sequence Number=SeqID_55425
MGAVGSGKECGIWLAELQWLEKGCGGGAGGSGFIMGNKQRSVAGHMWVQSRIDPLQTKTHNGEVMAVAKEMKGIGGEGGKQGFGEGSEGLLSAIKRRMCPLQRWVQEKVRVMEMKMGKFEADGNGHQNWLQGQYLTTNVWLEVEDEVADKAIWWKPDDTEGEKLEPRACKNLDQEVMNPLRNIHWYQLKAGSSRSTLDGARTGSGRRGVKGKMIEAVEDGIDFIHKVGVFVSEGGLVDRKMGNSLLEAIGSGFARGVFGHGRQSVLEEVQHSEVLHLCKPRQRLESVVRKIESKLSLSALTCSRSLVTLNQVQCEAEEFHERALVGPVTEAWKVSSTPSEKEVAWSN

SEQ ID NO: 147111 - protein, 772 aa, Glycine max
  Coding DNA Sequence Number=SeqID_55426
  Gene Ontology: Mol. function=nucleoside-triphosphatase activity; Cellular component=integral to membrane; Biological process=defense response
  Homolog annotation: Hit_ID=A7P5L1; Match level="QueryCoverage=100%, HitCoverage=88%, E-value=0.0, Identity=47%"; Hit description =Chromosome chr4 scaffold_6, whole genome shotgun sequence
  Pfam annotation: Domain name=ABC2_membrane; Domain location=500-714; Score=238.0; E_value=2e-68; Accession=PF01061.15; Description=ABC-2 type transporter
  Pfam annotation: Domain name=ABC_tran; Domain location=241-428; Score= 88.4; E_value=2.4e-23; Accession=PF00005.18; Description=ABC transporter
  Pfam annotation: Domain name=PDR_assoc; Domain location=73-137; Score= 136.9; E_value=5.8e-38; Accession=PF08370.2; Description=Plant PDR ABC transporter associated
  Pfam module annotation: Pfam domain module=ABC2_membrane::ABC _tran::PDR_assoc; Domain location=500-714::241-428::73-137
MASSLFRLMAAFGRDVIVANTVGSFALLIVLVLGGFVISRENVHKWFVWGYWSSPLMYGQNAIAVNEFLGHSWRKVTPNSNETLGVLILKTRGFFPEAYWYWIGVGALIGYVFLYNFLFTLALQYLSPFRKDQAGLSQEKLIERNASTAEELIQLPNGKISSETKIVEEANLPSRSFSGRLSDDKANRSGRKGMVLPFQPLSLTFDEIKYSVDMPQEMKKQGVFEERLELLKGVSGVFRPGVLTALMGVSGAGKTTLMDVLAGRKTGGYIEGGITISGYPKRQETFARISGYCEQFDIHSPNVTVYESLLYSAWLRLPREVDHATRKMFIEEVMELVELNSIREALVGLPGENGLSTEQRKRLTIAVELVANPSIIFMDEPTSGLDARAAAIVMRTVRNTVNTGRTVVCTIHQPSIDIFDAFDEAIQGVPKIKEGYNPATWMLEVTSAGTEASLKVNFTNVYRNSELYRRNKQLIKELSIPPEGSRDLHFDSQYSQTLVTQCKVCLWKQHLSYWRNTSYTAVRLLFTMLIALLFGIIFWDIGLKRRKEQDLFNAMGSMYAAVTFIGVQNGASVQPIIAVERTVFYRERAAGMYSALPYALAQVIIELPHILVQTLMYGIIVYAMMGFDWTTSKFLWYLFFMYFTFLYFTFYGMMTLAITPNAHVAAILSSAFYAIWSLFSGFIIPLSRIPIWWKWYYWICPVAWTLNGLVASQYGDNRDKLENGQRVEEFVKSYFGFEHEFLGVVAIVVAGFSVLFALIFAFGIKVFNFQKR

SEQ ID NO: 147112 - protein, 78 aa, Glycine max
  Coding DNA Sequence Number=SeqID_55427
MPLLSLIFVFSPSPLKIFSFFRSPPNPSQKNEDLGLIHRWIVMKFEHHVRNPIPSILTAGNFDIMFCWLILKIEIILG

SEQ ID NO: 147113 - protein, 355 aa, Glycine max
  Coding DNA Sequence Number=SeqID_55428
RCDQERVRPRFCRGSPRVDLGFDEPPWVFLALLFLEKQPPCRRFPDLDKDHDICVGYKSKRNFVGFKDDLVSYLRLTVGLGVFDRGYEMLDTQTVPRGAHAMEIIRRGAWNVCEFLASSAPLCEIEDLFMKFSHDIVWLLAVQAFKQGLECSLNDGLEMPSLFGASQLGEQSNIYWQLALGQAGSFDVELESLLQSEIVKPFKDDACSTSLHIGHFVHVEVPPVWGGLVIASKVCHELGLHGVVQFILEAPSRGNKFQRYLLNHLVPLLGIMEDVAGEIDGKLMFHVFLYEGQEGLVGFYFPMCDHEPQELSSAYPKNAFFQVEAHIVLMDFSEYLFQVCHVLGYAMGLDGPSVF

SEQ ID NO: 147114 - protein, 1177 aa, Glycine max
  Coding DNA Sequence Number=SeqID_55429
  Gene Ontology: Mol. function=nucleoside-triphosphatase activity; Cellular component=integral to membrane; Biological process=transport
  Homolog annotation: Hit_ID=A7P5L1; Match level="QueryCoverage=100%, HitCoverage=95%, E-value=0.0, Identity=52%"; Hit description =Chromosome chr4 scaffold_6, whole genome shotgun sequence
  Pfam annotation: Domain name=ABC2_membrane; Domain location=503-701; Score=139.8; E_value=7.7e-39; Accession=PF01061.15; Description=ABC -2 type transporter
  Pfam annotation: Domain name=ABC_tran; Domain location=178-401; Score= 44.2; E_value=1.8e-10; Accession=PF00005.18; Description=ABC transporter
  Pfam annotation: Domain name=ABC_tran; Domain location=863-1050; Score=82.5; E_value=1.4e-21; Accession=PF00005.18; Description=ABC transporter
  Pfam annotation: Domain name=PDR_assoc; Domain location=706-770; Score=130.4; E_value=5.2e-36; Accession=PF08370.2; Description=Plant PDR ABC transporter associated
  Pfam module annotation: Pfam domain module=ABC2_membrane::ABC _tran::ABC_tran::PDR_assoc; Domain location=503-701::178-401::863 -1050::706-770
MEGSDTPRVDAQRVSSGFNMWRSHCMGVFSTSEREEDEETLKCVAIERLLAKARIIRRRDLNQVEGKGEEVDIKQLELSERKSLLERLVKIPEEENERFLLKLKERMDRVGLEIPTIEVRFEHLNVEAQVYAGSRAFPTLINFFVNLLEGFLNSLHTIRSPKKPLHILQNVSGIIKPRRMTLLLGPPSSGKTTLLLALAGRLGKDLKHSGRVTYNGHGLEEFVPQRTSAYVSQRDNHIGEMTVRETLAFSARCQGIGQNYEILTDLLRREKEANIEPDPDIDAYMKAAALEGKQTSVVIDYILKVLGLEVCADIMVGDEMIRGISGGQKKRLTTGEMLVGPIRVFFMDEISTGLDSSTTFQIINSIQQSIHILNGTALVSLLQPAPETYELFDDIILLTDGQIVYQGPRENVLEFFESTGFKCPERKGVADFLQEVTSRKDQWQYWAHKEEPYSFVTVKNFAEAFQSFHIGQQLGDELANPFDKSKCHPYALTTKNYGVKKKELLKACASREFLLMKRNSFVYIFKATQLTYLAILTTTLFLRTKMSRNTLADAEAYMGALFFTVTVALFNGISELNMAVMKLPVFYKQRDQLFYPSWAYSFPPWILKIPITLVEVFIWELLKQYLVIFCINLMASGLFRMMAALGRNIVVANTAGTFALLAVTAFGGFVISRKDVHKWLLWGYFSSPLMYGQAAIAVNEFLGHSWRKVSPNSNETLGVLILRSHGFFPEAYWYWIGIGALIGYAFLFNFLFTLALQYLNPFRNYQSGLPQEKLLERNASTAEEFNQLQARKSSSDTKMEEVGENNKATDRGKRGMVLPFQPLSLTFDEIRYSVDMPQEMKSEGISEDRLELLKGISGAFRPGVLTALMGISGAGKTTLLDVLAGRKTSGYIEGSITISGYPKNQETFARIAGYCEQFDIHSPNVTVYESLLYSAWLRLSPKVDKATRKMFIEEVMELVELNSLREALVGLPGETGLSTEQRKRLTIAVELVANPSIIFMDEPTSGLDARAAAIVMRTVRNTVDTGRTVVCTIHQPSIDIFDAFDEASDSQWCDSPKIYDGPIGNNSSNLIQYFEAIQGIPQIKDGYNPATWMLEVTSAAKEANLKVDFTEVYKNSELHRRKEQDVFNAMGSMYAAVTSIGVINGASVQPIVAIERNVFYRERAAGMYSALPYALAQ

SEQ ID NO: 147115 - protein, 49 aa, Glycine max
  Coding DNA Sequence Number=SeqID_55430
MDEEEKKPEENKGEEKKANEEGKKEEEKKPEESKDDKEFKEESAPPEIV

SEQ ID NO: 147116 - protein, 362 aa, Glycine max
  Coding DNA Sequence Number=SeqID_55431
  Gene Ontology: Cellular component=chloroplast; Biological process =mitochondrion organization and biogenesis
  Homolog annotation: Hit_ID=A7NTC6; Match level="QueryCoverage=42%, HitCoverage=25%, E-value=2e-43, Identity=62%"; Hit description =Chromosome chr18 scaffold_1, whole genome shotgun sequence
  Pfam annotation: Domain name=DUF21; Domain location=169-307; Score= -35.8; E_value=0.00093; Accession=PF01595.11; Description=Domain of unknown function DUF21
MKRAIAVVLRVFDKYPDAVRVCFKHLDDYKAYKEAKLAQMKLLNYASCSPVDQNVPVAEPEFNRGGEEVAEAEPELNVDERVEPKNPRWAVYGRGLEENTRLGSCYFKRERMMIKDKWLPQHTLAACGEFYLLDYLLKHNVDINVLKNEESGPLKESTSLIEHRKQHGLYYLPSEKSEIVSDEYPPANDPKSNNNIKFYFDDLYQALPIFLNSLVHPAAAILILVILIFMFGEILPQAICTRYGLTVGATLAPLVCVLLIVFFLFSYPIRKVLDWMLGKGHAALLKTAELKTFVNFHGNEVLLLVFQFFQYDSGLCSDAGKGGDLTHEETTIITGALELTEKTAKDAMTPISKAFPLIWMQL

SEQ ID NO: 147117 - protein, 208 aa, Glycine max
  Coding DNA Sequence Number=SeqID_55432
MVFLDALHDLTQSASYAWGAVALVHMYDNLNDVSKSTAKQLVGYITLLQRITTKGDHVHVVGPLMGPVHGDSPAEEGCTTVRLFRHTLLLLCCHMLKIMIDGCGLPGDPPRVPPLQEEEQFVEPHMYEQPMATAAPNEADIDQHDLRLAVYDFATIADRLDRLLNLRILTEGKEAYVVVEECVGIARRYTGDPPVAYKSRRRRRTDGH

SEQ ID NO: 147118 - protein, 81 aa, Glycine max
  Coding DNA Sequence Number=SeqID_55433
MNVENDEYGGVKVDCFDAFNTFELFGSRDEVLQWTRSLAHDIGFVAVIMRSDTNTGVRGRASFLLIACERSGEYRPKKHNL

SEQ ID NO: 147119 - protein, 133 aa, Glycine max
  Coding DNA Sequence Number=SeqID_55434
  Gene Ontology: Mol. function=prephenate dehydratase activity; Biological process=L-phenylalanine biosynthetic process
  Homolog annotation: Hit_ID=A9PHG2; Match level="QueryCoverage=78%, HitCoverage=20%, E-value=6e-21, Identity=56%"; Hit description =Putative uncharacterized protein
MAELYGLNMMADGIQDDPSNVTRFVMLLACGASMEAGSLSFNEPNLLGVFYPMPLRDRIASGTSVLFKVLSVFTFRNFSLTKTESRPHQNRPIRLVDDANASVAKVKTVEKCEMKRVVGREEGKTLGGELERL

SEQ ID NO: 147120 - protein, 454 aa, Glycine max
  Coding DNA Sequence Number=SeqID_55435
MDSLEEQVTQGEFVPQGRHDILNTAIGRPDHGGRVRATGSGVTISQYYGRMSRASSSSSIAFTKEQLAEIVVTVREQVMKELEEEKKQSLQAWKKELKDAIITDLFNGDKDSALTNFDLNVLGACVSTKESNAEIAVNPSGEVHVGRVTPPMGLYVQSQNCTKQVALAKIHDGPSTIHCVAYADDVVRVSVEQVIDGEAEVPLPTSEIKYVRDVVNTFIAWPLPLHSGITPDKVANAAELNNDVPKQDPLRELIKTLVDIYDKPVEFVWDLTEFGIPNVNSSLFLTYTDVSEITSGDKCLNIAILQLWTMYMNEWSNGLGYRSVYGFLEPQSTHNAKDRHGQCEEYIEKWLKESQRQLYIGAYLNDAHWQMVVLCPKDNVVVWFCSVRRRPDVHIKTAINNAYKKLNTTADGKVPKIGPQWLELKTHVQHRGYECGYYVMHEMWNIIGVELKSD

SEQ ID NO: 147121 - protein, 133 aa, Glycine max
  Coding DNA Sequence Number=SeqID_55436
  Subcellular localization annotation: CTP_CleavageSite=30; ConfidenceScore=5.36e-01
MQSTAVSSVKRHSSHAFHDVPLPDTTSRPCIQRRSSPGNDVASRPYLSSIDCYTLRRCRHSPTLKAYLSTSFLVPATPSKANLQLRASSHPSRRNRVFLKRWKETFVNWPEAYDDVSFKDGRAPSLNSDKHRC

SEQ ID NO: 147122 - protein, 295 aa, Glycine max
  Coding DNA Sequence Number=SeqID_55437
MEAFGLLAGNGKKMKKNYFRICRACSAVQSCSVTVEATDSASHQSRTRMHVRCESDAGHAAEVSHPCFLALDIEQMKSSSANLIKQMDFIEDTKGRLCVPKEEVKIEVPPELVEDNLLPLRYRPFNYGDYFQYFVSTLKENALDVFVVATCTQQYCWGTQQIVNGQFCPFAKAVSGRSFFRKHSGRPFLWKILEEPFFGRRRCDSGRTPEYVMEEPKCFRKKGLPEDNFLLLEEVVLVVALPISSENVGFPEVLLSEVTKVNFGRSGPGSRPTPLGNIIMVILSISVYNSTYSTT

SEQ ID NO: 147123 - protein, 133 aa, Glycine max
  Coding DNA Sequence Number=SeqID_55438
MNTCASRVLLKPQRGETTSFITDMIKANVSLLRTIKWDEVTLPEKWVMDKATLSVPKPVPTIEQIKQDNSGKVEITFNRRNSFSSRIEASRSEYELAIRSFLLTYFLTNYIPTSPSGSDIRDQRKEIKQTDER

SEQ ID NO: 147124 - protein, 469 aa, Glycine max
  Coding DNA Sequence Number=SeqID_55439
MPGWILDMSDGCQANKSVFLCSMSVMHLCLWLLDELFNGFWASVKGVIVRIYVKFIVQACLVDGQGSNWRPFIHAHDLSTFSHYKVSLGRLSGKRIGCYLQALYIALSCLLLVFLNGYNFPDQGREFHFQMRCEDYGLKLIKCLHADQIHVAFGLYSLAYKVEEWIDIRDVSGASLVNENLGHHEVDNDDRDDHGVVLVNRVDTLEVPIYERDRRETSLYWCVKKIYVDDPNGVPILVVAATLAFVASVSIFLDLPFYPFFCLHCDSSTAHLGVFLILLLLGGVCNARIWALLEEADTCLARASCSTCNEEHGMQCYLWVKISDLGGSAHKYVQEFSKGLVVYFSQTGQGDLGYAVRFAGCVLHTEVFDEGVKVVYGSRKASRCSSGFVVPSYCSRLSRFHLKAPPHVVAPSPQCDFGVVEEPDRVLTMDEQEIVDKRLQDMFYHGSTVGAKCTYQNLELAHVKVDITK

SEQ ID NO: 147125 - protein, 93 aa, Glycine max
  Coding DNA Sequence Number=SeqID_55440
MVSRYVLNEIAAEFERVHYAGKNPSSCGCVMRTTHSLPCACELSRYVVDNIPLDSIHMFWRRLSFSDQGLCEAKVTIKEETMLKRDYVDLNED

SEQ ID NO: 147126 - protein, 254 aa, Glycine max
  Coding DNA Sequence Number=SeqID_55441
  Gene Ontology: Cellular component=nucleus
  Homolog annotation: Hit_ID=A7P5M8; Match level="QueryCoverage=97%, HitCoverage=88%, E-value=7e-40, Identity=41%"; Hit description =Chromosome chr4 scaffold_6, whole genome shotgun sequence
  Subcellular localization annotation: CTP_CleavageSite=62; ConfidenceScore=5.18e-01
MAQHNNANINNIVSQQQQLVKPMFHDFLGIKNKNPIDSNVLYAPNLHVTSSSSSLSSTTVSRGGATSDLASGLVGNKRNNSDSTFIGSSRDSFQMVPDSLQNSHLIKMLRNAAGTDCLRCPNDDEVLLGMQSLKPASGFQILQPPTGTKNDVNKWEQSILMNVGHSMQYLPHGGQILLFMDQITSSKMRDTNAGSSFISQLAADEGSRTGIKGTGILSSISTINAVTEKTSSILGGIRPKPVTNIDPESSTPLK

SEQ ID NO: 147127 - protein, 97 aa, Glycine max
  Coding DNA Sequence Number=SeqID_55442
  Subcellular localization annotation: CTP_CleavageSite=33; ConfidenceScore=5.32e-01
MSHFRVSDIIVTRRIVTPPSFPLPPPKSAAPLLSMLKKTRKATGLVSLATRLVGAEGPMIHVDPVTGKADGPHIKKLRTYLGIVAQDKVDVTIDNWK

SEQ ID NO: 147128 - protein, 23 aa, Glycine max
  Coding DNA Sequence Number=SeqID_55443
MSHFIVLKEKARAKKAIKKKAEG

SEQ ID NO: 147129 - protein, 61 aa, Glycine max
  Coding DNA Sequence Number=SeqID_55444
MYPSLQPFPPRKVDMLHTVTTILVKSQKRQHLSHLYELSYWKLKVKEKWKLEVEKEVTGLS

SEQ ID NO: 147130 - protein, 231 aa, Glycine max
  Coding DNA Sequence Number=SeqID_55445
VGAGEITGEKRGVVEWWLEALLRMRKMKHEEVVQCDWLLSEGTTGVSLKPLWMVEETGTSFVVQVEGTSTWVVVTENKKGYISCGSVQVEGTSTWLFKENKGGYIPCGSFLAFGQMYIKAQINLKVLDNFPKVWEPKTIVIQEARDLKNLVWDKRLGILRVREESDELDNSDGSIDDEMALVSRKFKQMMKKKGKFQHSFRRKESRFKKKKREENNEIICFECRKPRHKKA

SEQ ID NO: 147131 - protein, 157 aa, Glycine max
  Coding DNA Sequence Number=SeqID_55446
  Subcellular localization annotation: CTP_CleavageSite=34; ConfidenceScore=5.02e-01
MQSSDRSPSKPKPLVIHFTRDISTQIPRGFRPSVAKTPAPFPYKSDKAVPWRYDIQGSDERQDASVMRVGTGMPAAKIMNISGTSGMTRSGRIFAPPELPAKLKDKGKAKADIGEREKTGLTANNEALVGKFEEEKDDLSKREISAEEATKFLRIIQ

SEQ ID NO: 147132 - protein, 79 aa, Glycine max
  Coding DNA Sequence Number=SeqID_55447
MEWIRREKGASLWRAEWKGFGSKFECIWMENDDDNDGVQLGFKGWKGPVTRGMSKRLQEDWARAAEEGPRVLTNLRVDF

SEQ ID NO: 147133 - protein, 211 aa, Glycine max
  Coding DNA Sequence Number=SeqID_55448
MQGITWLQKLKGMNREEAEVPEVQDLKDELEKTRVAKEKLKVEVTRVRKECNELKDINMTAAKVLEREMKKARKEEWSRNKFRGALLGSSIELKLRKAERDKSRMESMMLEDKEGELVASYGQILEDERAKVSALRVEREAREGVIELLHKEAMKWMDRFSLTLNESQELPRLLARAKAVADTYSAPDEVQSLFNYCQHMVELMTHIIRNH

SEQ ID NO: 147134 - protein, 77 aa, Glycine max
  Coding DNA Sequence Number=SeqID_55449
MATISEVTHRESIHKVDSDTWIVTLVAGFQGSGVERIERKEGEREKKEEEMKPRHYRITTVIIPYIVLLFCVPHATV

SEQ ID NO: 147135 - protein, 92 aa, Glycine max
  Coding DNA Sequence Number=SeqID_55450
MEKQLHFFHQLVDVLPWIQKPSQLTLIVGQMFQNHTRMVALICVYDTSLSREQLIANVPNGIHKDQWSSFIDYHLRPEYKELCKKNTEVRKK

SEQ ID NO: 147136 - protein, 1602 aa, Glycine max
  Coding DNA Sequence Number=SeqID_55451
  Gene Ontology: Mol. function=nucleic acid binding
  Homolog annotation: Hit_ID=O65537; Match level="QueryCoverage=99%, HitCoverage=98%, E-value=0.0, Identity=35%"; Hit description =Putative uncharacterized protein F4D11.180
MEGRAQNSNDTTIPKKSRSLDLKSLYKSKLTENTAKKNLKRIGNSSGGGDEKRKKKKARKEVSLSSLENGDGSSELKLGVSQKLSSSSSTLNRVSFSVGDDDVQIPKRKRSFVGRKKSELGLASKVVEQSGLKIGYNDQVPKLGSDDLGSGVESFKIKRKKEFDEFKENRNSDSNSVQHAKENGDCASHSVVNSGDSSLSKSRRQHRKRKASAIDSTKVSKEAEPLVSSSKISDDLQDEEENLEENAARMLSSRFDPSCTGFSMKGSNGLSFFQSSSQSIVNHSLKSPLGSESTSADTAGRVLRPRKQYKNKSNSRKRRHFYEILLGDVDAYWVLNRRIKIFWPLDQSWYYGLVDNYDEGSKLYHIKYDDRDVEWVNLQTERFKLLLLRSEVPGNAKGERALMKRSSFDHQKGSKSRKERQRTEENAGDDRCGESSMDSEPIISWLARSSHRLRSIQGIKKQKTSVTVPSTTSSFLYDEPVTAKGHLAKSSVRDVEKNFSTGSVSQDKFSEDFKDKSSLQSVTCAKDGKQPIVYFRRRWVHKPAPISPHISEENHAIISASGSVALDHMFGGVENVKNPIDSRVEVGGPLFFTYKAGVPKVFWDMKSASFKFGLNFPMRLVLNDFFQSENLWLLYTVLLLRFGTVMAKWPRVYLEMLFVDNVVGLRFLLFEGCLNTAAAFVFFVLRVFHQPDCQGKYVDLQFPCTSIGFKFSSVHVIKKPLVFEFYNFSEVKNSKWMHLDSKLKEHCLLSKQLHLSECTYDNIQALQNGSRRFSITSISGSSSVKVTQKSRPGINIMGVSEVSTQAVQCSDAGERKLPPFALSFAAAPTFFLCLHLKLLMEQSAAHIRYCDQTPIFDQEDPGLMTNGCTSTDNCSNRNSEVILRKGMETLSIGTPGDGGSCADSDHPSTCNDRILIQNYQNIGLNGASTSISHDSEKLCKAHLPEWQSHHLEQELGSLSSSSLKHLDKANDGSHSFIGDLSIQIPAVDQFEKPDEDGDLCDAEHSPDISWNINGCGIPSSNPTARRSSWYRNRNNSLSLGFQSHVWSDGKVDSLCNDLSNGPKKPRTQVSYSVPSAGYEFSSRQRNHHQKGLSHKRVRKAKEKKSSDVDRVPEKNIKCLSCGANVLITLGDKGWRESGAHVVLELFDHNEWRLSVKLLGITRYSYKAHQFLQLGSTNRYTHAMMWKGGKDWILEFPDRSQWALFKEMHEECYNRNIRSASVRNIPIPGVHFIEENDANGSEETFVRSCMYFQQVETDVEMALDPSCVLYDLDSEDEQWISNAQNSLKDNSEFCWISEEMFEKTIDVFEKAAYAKKRDHFTPDEIEELMVNVGPLCVVKIIYDHWQQKRQKKGMALIRHFQPPLWERYQKQVREWELAMTKNNAPSNGCLDKVTTLEKPAMFAFCLKPRGLESLNKGLKHRSQKKISVSGHANSNLDQDGFHTFRRRQNALPFADEKFLYQGHNYDSFDDSSLALTSPRVFLPRDAGSLKYYLTSNGAGYRNHIPKFHKSRYDSPGSRHHILAGPKRQGIEQLDASVLEELRQRDAMAEARFKRHVAMLKRDRAKRLLYKVDVAIHKAMAALMTAEAMKASEDSLVEMKAYED

SEQ ID NO: 147137 - protein, 107 aa, Glycine max
  Coding DNA Sequence Number=SeqID_55452
  Subcellular localization annotation: CTP_CleavageSite=60; ConfidenceScore=5.47e-01
MHTQSFTIPHFPKIGLTHKNSPQWSHQLSQPTLLRVSEARLTGASSKGGKCAESPPTFICGKRRKNRRKPVMKNIPDSGVVFTFEEGRQKRGSCSYVPSIEEEIRPT

SEQ ID NO: 147138 - protein, 42 aa, Glycine max
  Coding DNA Sequence Number=SeqID_55453
MDKSLKVGEDEWREKERRSTKFYASNKPNNPRSSPRFSTKCA

SEQ ID NO: 147139 - protein, 94 aa, Glycine max
  Coding DNA Sequence Number=SeqID_55454
MDEDSWSLVRNHLLKELSKWSDEYVNLFGGIDRFEELKRSLLVDGLFMVTMDKWMDITDMGYVIASRYNVYLRDRCPLPPLALLWSRNCHSQAK

SEQ ID NO: 147140 - protein, 97 aa, Glycine max
  Coding DNA Sequence Number=SeqID_55455
MSKLREREDPKFQKTKMDIESGERFAKKQYERKKCLAVTQKRQTGIEKKLFAGQGKAKFQISFHCTEAGWKSSRDVEFHRASLIHRFLAACDRVPEV

SEQ ID NO: 147141 - protein, 63 aa, Glycine max
  Coding DNA Sequence Number=SeqID_55456
MVVDEVKTKRCNELHTTNTCQVRLMQSYPARALDRRLQVDWARDPREGPRVLMSLRVDFEPMG

SEQ ID NO: 147142 - protein, 308 aa, Glycine max
  Coding DNA Sequence Number=SeqID_55457
MAKFDPKIVLEFYANAWPIEEGVRDMRSWVRGQWIPFDANALSQFLGGPLVLEEGQQCEFNQRRNRVWIMRTSMTTLTQTWMILLLSNVLPSDNNSDLPLPKCQLVYAILTRMSVHVAQVIADAIYLFAGMPPTRHPLDPDKSNRALGFPGLITGLCQSFGVPVTPSKVIRPPITRAFIEKYCTPRQAQGDAHQAADALPPPHQTDPVGSLGMERYLQHLVRQQAANHWGQVQIHECLYRFSLSQQGQGFAPFACPTPKQFGAEVAWPGDWPEAQAGEEPAGSPGEAEEARMDEEMTDLLGFLGGSGA

SEQ ID NO: 147143 - protein, 590 aa, Glycine max
  Coding DNA Sequence Number=SeqID_55458
  Homolog annotation: Hit_ID=A7P5H4; Match level="QueryCoverage=77%, HitCoverage=23%, E-value=1e-70, Identity=37%"; Hit description =Chromosome chr4 scaffold_6, whole genome shotgun sequence
QSVSTFSVTCVWQGSADFAVEHHVESCSFGPHKEEFSCGEAPTVKLRLRPFVSLRRGKLVIDAVLLHPSFLVVQRKDFTWLGIPFNEGGRERSFSAEEGIDYRTRTRRLAREEAFAQWERERDGAAREAAEVGYFVSERSCGLSKGDDGLKEIETRSLESTESAPFFCMNDGKHDHWLMDKGVNYDTKHTALEKSFGVRFPGLGLRFWSRVISGLRKHKLNRKANGSNIFASGGAIKKIILERSASAAHAYFCDQPQWKFEEPSSPSESYGFMSHDMHLVKSEVDRNTISVIVSDENRSDDNQSGTQFKDLGFQSPLVNENVSSQSDYLKFVCDSTLRTRESEIENLQSSDDVAKPANPNSSTVKNEEFVPYVAENQIDDNDSSSGGQQGLPSEDLGIVKPEPQLATYFQNPFEHLLSDVGLKVEDIVSEHVDGVDFVQSEGVTKTLPVTLDSVHFRGATLMLLAYGDKEVSKLKAVAGKHAEKGSGRIGATTISKSAVETTAKRALSCTKNKENHARKGGCMHWHALGIGPVWLKIARQKSSLCGCVRALMDMWWPDLGRSALGAPDPGCRKMGDEQKGPRGCGKKDDK

SEQ ID NO: 147144 - protein, 87 aa, Glycine max
  Coding DNA Sequence Number=SeqID_55459
  Gene Ontology: Mol. function=nucleoside-triphosphatase activity
  Homolog annotation: Hit_ID=A7QBP6; Match level="QueryCoverage=91%, HitCoverage=11%, E-value=5e-25, Identity=70%"; Hit description =Chromosome chr1 scaffold_75, whole genome shotgun sequence
MKRQTEALMDANNYGCLYEALTVAAMLSTETTLLLGQRKIESKRKHTISNLPDGFGLGDHIQLLQIYECWDQTDFDIGWCKDNGLKV

SEQ ID NO: 147145 - protein, 159 aa, Glycine max
  Coding DNA Sequence Number=SeqID_55460
  Gene Ontology: Mol. function=aspartic-type endopeptidase activity; Cellular component=small subunit processome; Biological process=DNA integration
  Homolog annotation: Hit_ID=Q0KIN0; Match level="QueryCoverage=69%, HitCoverage=6%, E-value=4e-15, Identity=36%"; Hit description =Integrase core domain containing protein
  Subcellular localization annotation: CTP_CleavageSite=40; ConfidenceScore=5.20e-01
MASVGPAFSFFGTPTITTAKLNWKNYLSWSFKTCHSFSKKAQEIFANDIQSLFDAIMKVTTLKQTSHDMIAHVGKTRVVMEELRKFLVVDSLEEVNRKLDKFYMVLILRSLHSDFDHVRDQVLAGDQVPSMDSFITRLLRVPHVLKDENPADVVETSAM

SEQ ID NO: 147146 - protein, 63 aa, Glycine max
  Coding DNA Sequence Number=SeqID_55461
MNLMKLLQEHNRTFINWFNETIISDDNASKTLRLLTIGPNLNVPTWKRLMEIPVFIEIKWDSL

SEQ ID NO: 147147 - protein, 742 aa, Glycine max
  Coding DNA Sequence Number=SeqID_55462
VDMTELGSWTSHVGFERTNVEGGHMSQSAMAPLQLLQVIEESVSLYKWSGRLISGHCSFSKFPYFLAYGHRAGLVGALLALAVRPSFIVGEPVPINVILLLLLVKLASPEDSCKLVVQASGSDDFPFLRAASGSPPFFFMYRDKEPRFSFYWSDLIRFKLFDEDLLTLVERVDKAILEQLPTSLEAIPSLPSASDPLAALDGIMGDFAWRPLVKQVRPTGGIIPLFVAVSTVRERGQHVGEVGPISIVAKVDPSAHSSILAKWKWDDGAGPSGCRVDAQCGSPYDHVGYASGSPAIEASALSPRLAVAVQEANPAIAECATTNAPMVLPSMVPPPSTVLVAMPPFLSSRPRVSLDHLYTSSDIDSLWDATYKPKQNAPVGFVLGCDKNFIRSAGENEQRHQEVLHKVASLEAEVTKWRAIARTIWRVKCLKVANAIIAFPEAIRSNHLLSSKVGVMLAKLLRTRLDGDELFKRCKDLQVEKKDLVGKVENIATEKGKLAKVVANLEARLKDSESRLKESELRATKEREANKELEEELLIYKKEDVKDGVLLDEEKIPPKEEAVDEEQGATKFDFNLVKDLAIHLVGLPSALRSFSPNACEESMFDLPLVEGLANQSGGRSLDLQSFSSDGYDEADLRFCKNVSKGGPWVFDRLVFLHRYKRNGVLLHTCFLQVARIGAMVPFGGSTRELFDLSFGRRAVAYMSLAMGCTYWRRGDLVLEGRLIKGDPWVLRALELRLWMLLS

SEQ ID NO: 147148 - protein, 293 aa, Glycine max
  Coding DNA Sequence Number=SeqID_55463
  Homolog annotation: Hit_ID=Q6WAY3; Match level="QueryCoverage=83%, HitCoverage=11%, E-value=9e-07, Identity=24%"; Hit description =Gag/pol polyprotein
MPYADLLPSLITNQMAVVNPWEDLPISLPSMDNPNVRMNPLVSHWGSTVNAAEECGPRGPKRMEDVLTFRRFILEALLEAGMVCLDGDMGDSCLVHPGASHDVEACSMVEDLLQRIMDKGLIKVCGSRKGGGDVCMQSVDKSPSKPKPLVIHFTRDVAAQKPRGFQPVPVEKPAPFPYKSDKAVPWRYASQGLDRRKYASVVHVKGDLSSAKVTNISGTSDMTHSGRIFTTLESPVQSNDPKGKAKAGMEESNNMGPIPDEEVSTGRFAKEEVDFSRKGIYAEEAIEFPRIIQ

SEQ ID NO: 147149 - protein, 76 aa, Glycine max
  Coding DNA Sequence Number=SeqID_55464
MAKYDPKIVMEFYANALPTEEGVRDKRSWVRGQWIPFDEDAINQFPGHPLVLEEGQRCEFSQRRSQASGFDKEAIS

SEQ ID NO: 147150 - protein, 203 aa, Glycine max
  Coding DNA Sequence Number=SeqID_55465
MESANSKKQLMYTKIQTYRGMLLNPTMNLRNRLGVSGLIAKDKMLVYLITYILTPRSSNHAQSHHLVDYEFPYVMLASRFIDYFNVNVSNEIVDFTKASSEITERHLKMFGIRFVDHEWIMAGEPAAGNLEQMDEEVEAPQEPAHQWIPFKSLIIQKMDTMFHLHQEHSAEVHSSLENITTWLENIETRLTLGNLLNPNEDEA

SEQ ID NO: 147151 - protein, 92 aa, Glycine max
  Coding DNA Sequence Number=SeqID_55466
MALARRNWHSFVRPVETPRGRMCRKGTGHPDAKHRPPRVVSWGTEAVIDPPSPIRRHVKWKMARTKKTGQMTTKAAKEIDEKIDSLEEQASQ

SEQ ID NO: 147152 - protein, 182 aa, Glycine max
  Coding DNA Sequence Number=SeqID_55467
MSSKHKPKYIYFVVPSYSVFFYSDLQDPPMLFAFGMTYQFKVVFHVDRNIIEVPSVYHKQWAPDYLDYVVLDYNGKKHHIRVRKFSNRVYIADGLKHFRRDMRIYEGDDYVTVLGVRGHHHFWKLSMHNGLKCFAEPWFQFLTENDLMASDEVVFYFKPNQLLWEVIARKQTVWDEDEDDSP

SEQ ID NO: 147153 - protein, 141 aa, Glycine max
  Coding DNA Sequence Number=SeqID_55468
  Homolog annotation: Hit_ID=Q2HSY3; Match level="QueryCoverage=90%, HitCoverage=58%, E-value=1e-09, Identity=26%"; Hit description =Nucleic acid-binding, OB-fold, subgroup
  Pfam annotation: Domain name=DUF223; Domain location=44-140; Score =3.5; E_value=0.0014; Accession=PF02721.5; Description=Domain of unknown function DUF223
MKPKVMSRKQNLLCELHTKKGTWKIVVRITDMWRLNKHNGRQSIEMVLMDHTGTKIGATLWQELFPEFEPKLRCGGAYVIQNMKVVDTHSDYKVNAIKYLVYFVKTTSVKEVDRPEIPPNVHAITSFADIISGVAKPDTLV

SEQ ID NO: 147154 - protein, 52 aa, Glycine max
  Coding DNA Sequence Number=SeqID_55469
MKVTTKVAWIMKILSSNYALLSSNALCTCDAFLNSHAVAKGYTYLDCPNGHL

SEQ ID NO: 147155 - protein, 158 aa, Glycine max
  Coding DNA Sequence Number=SeqID_55470
MGKGTTGVYDMKTEAMEKMLLDCYLLDVGFQGYPHTLKRGDLEQSLDRVVINMQWRMLFPDAIIFHLSQFKYDHRLPLVELDGIWEFLRGKKGLIRKLNNLNRRLGSSRNPQVMQEMERIWKEYEEALVQEELLWFQKSRSKWLSLEIATRDSSMVPL

SEQ ID NO: 147156 - protein, 59 aa, Glycine max
  Coding DNA Sequence Number=SeqID_55471
MIAAWNHNLMLMSLVLSEMLLWFDRCNKLLMRQYTSKVAKVSSSLLKMFWGINDIVNSL

SEQ ID NO: 147157 - protein, 108 aa, Glycine max
  Coding DNA Sequence Number=SeqID_55472
  Gene Ontology: Biological process=primary shoot apical meristem specification
  Homolog annotation: Hit_ID=A7P624; Match level="QueryCoverage=58%, HitCoverage=6%, E-value=4e-13, Identity=53%"; Hit description =Chromosome chr4 scaffold_6, whole genome shotgun sequence
  Pfam annotation: Domain name=LisH; Domain location=6-32; Score=23.9; E_value=0.0006; Accession=PF08513.2; Description=LisH
MAHLDKDLTLLVLQYFNEENLKEAARSLGHESGLYFDLKYFEDIVLEGRWDETENYLSVFTNKNDDLGHVHRWIVVKFDHYVRSPISSILTVGNSDIVFELREIPFAL

SEQ ID NO: 147158 - protein, 377 aa, Glycine max
  Coding DNA Sequence Number=SeqID_55473
  Homolog annotation: Hit_ID=A7PM85; Match level="QueryCoverage=72%, HitCoverage=33%, E-value=5e-30, Identity=31%"; Hit description =Chromosome chr14 scaffold_21, whole genome shotgun sequence
MVNAIGLNVGKKRKGSEDDGMALKRVQKKKELLVETDGDVLSAKNDGKGGEENSNIGSLLQSIEKNIGAFDEGKSEERNGKGNLSRERKRSNSNYQPQDDGETIIDPKKIQAPVKEVLSQVLDAATSPLIRREGTSLDQFVDFTYAFRSSLYSQGSLCELYKKNQPGRKRKMLESEEDGMLKELNLSTDEHLSSLKQNYGPKKRRKETASGKKGNEENAAGFSMPSRSDLVSVFSKFGALNEAETNMFRTNYTARVSFLRTSDAQKAYNHSQNNNPFGSPVDVTFQLLHSSDVCCCSYSGFVLTEGIIGLLFSRSPATLSSGVLFEGGLLFLNSFSMKSTKRNINPIANMVGIPIPKSVQMGQDKISVDDTKRNNSA

SEQ ID NO: 147159 - protein, 170 aa, Glycine max
  Coding DNA Sequence Number=SeqID_55474
  Gene Ontology: Mol. function=sequence-specific DNA binding; Cellular component=nucleus; Biological process=regulation of transcription, DNA-dependent
  Homolog annotation: Hit_ID=Q2PF41; Match level="QueryCoverage=27%, HitCoverage=7%, E-value=2e-11, Identity=68%"; Hit description=BEL1 -like homeodomain transcription factor
MYLEEMKEQELNGSEEKSSNSGEDLATMFSGRNGVSLTVGVPHCDTLKGIHQSFVANQKIQLARGLDVGEPNQFGAQFQFQVDTIPVVTTNHRRHAMLCCAPEQKLKDIFEFTTAWSVVHFARSWLYWSACLSLSLSLSLSHNSKLQLMSNKYGIWPLNQVGFYPALIYP

SEQ ID NO: 147160 - protein, 70 aa, Glycine max
  Coding DNA Sequence Number=SeqID_55475
MVKPQSLPSLKEAVKSKPKKKKRTNIRCSFLWSLSMTAKWRWRKGDWRCHFKEKMSQEQAHHHRKPWIRA

SEQ ID NO: 147161 - protein, 272 aa, Glycine max
  Coding DNA Sequence Number=SeqID_55476
MARTNKTGQMTSEAAKEIAEKIASQGSFVPHGRQDVLTVSIGRPEHSGRVHAILRIDSTNLPQFFLHGLALPPEPEVGPSGARASTKESCVDPSGNDPKTGDSDKCGLYIEENHSRLVVLGRLYEGSTTALNTFFAWPTHLVKHLSEQVVVFPKKPPESPDPEVDDPLYLMTLTIPQLFLKPLQVMWDATVFRVFNQNFPLYIKHENLSEIAHGGQCLNISVIQLWILALKGLDDTPQPKSKAVARWIVVKTIGSREIEGASHPVGTVLSKS

SEQ ID NO: 147162 - protein, 88 aa, Glycine max
  Coding DNA Sequence Number=SeqID_55477
  Subcellular localization annotation: CTP_CleavageSite=52; ConfidenceScore=5.14e-01
KVTLFCENAPTMWDRHRLKGAFKPSVFTPKAYTSKSPSGPLPPDSGESDKASASRPRAKREISALSTAGVFSQAQCKIGAKPKPTYLR

SEQ ID NO: 147163 - protein, 107 aa, Glycine max
  Coding DNA Sequence Number=SeqID_55478
  Subcellular localization annotation: CTP_CleavageSite=30; ConfidenceScore=5.66e-01
MASPPALPPPHPPAPPAPPPHPFDTSASPSAVKRTQKASCLQSLSTRSIDAERPVVHIDPATGKADGPHRKKLRTYFGIVVRDKVDVMYENWKEVPTTQKDLIWEDI

SEQ ID NO: 147164 - protein, 388 aa, Glycine max
  Coding DNA Sequence Number=SeqID_55479
  Gene Ontology: Mol. function=methyltransferase activity; Biological process=metabolic process
  Homolog annotation: Hit_ID=A7P603; Match level="QueryCoverage=100%, HitCoverage=100%, E-value=1e-170, Identity=76%"; Hit description =Chromosome chr4 scaffold_6, whole genome shotgun sequence
MGCGNLFFTILITFSVALITYNIIISANAPLKQDFPGPSRPSIKVDPLIKMPLHRKSSSSEESKKRLLFHTAVTASDSVYNTWQCRVMYYWFKKVRDEGGDESGMGGFTRILHSGKPDQFMDEIPTFVAQPLPAGMDQVEALNPNYKISKGGKMAIGNGYIVLNRPWAFVQWLQQADIKEEYDLYILMSEPDHIIVKPIPNLARDGLGAAFPFFYIEPKKYETVLRKYFPKEKGPISNIDPIGNSPVIVGKEFLKKIAPTWMNVSLAMKKDPETDKAFGWVLEMYAYAVASALHGVRNILHKDFMIQPPWDKEIGKTYIIHYTYGCDYTMKGELTYGKIGEWRFDKRSYDKVAPPKNLTLPPPGVPESVVTLVKMVNEATANIPNWWS

SEQ ID NO: 147165 - protein, 120 aa, Glycine max
  Coding DNA Sequence Number=SeqID_55480
MVVTMLICLSHHGQNGGVPDCTEEKEKRLRKMMARLIGSHILRNNPTACDLGNTKTKIRERGTGHRVLCLAPLTLWDLAIGAHNYEGMGWFIDEVTNLFSGDCCYATPFHYASCLDFLFA

SEQ ID NO: 147166 - protein, 905 aa, Glycine max
  Coding DNA Sequence Number=SeqID_55481
  Homolog annotation: Hit_ID=A9RXF6; Match level="QueryCoverage=10%, HitCoverage=3%, E-value=3e-13, Identity=45%"; Hit description =Histone-lysine N-methyltransferase-like protein
MESAWKRKCDSPFQPSTSAAVPSAPVPEPEPEINTSHCLYPQFPHGLRSKFVGGKQCPVYQSFPHSITHGSGQADTGSSFLSLLYAPPSLLQHESWDLSNRKLCISSCDCTAAIGNSVVGSIESGTFRTSGVGLMTENLINRNLQSWVTTFPEISSRAMVGLKNSSSFVFHDIQSSNTATQPTIPGGEKARESFSSSGQCQGTSPACSLNVCWSDVQTTPTVALEQSSSKYATPFMSGCPRVFCMGKNNSHFHCQFKGGHLLLSNTGLLGIVCSCHCCHMSVAKFCEHSGLYGVDPGEAVRMESGETISQWQKQYFLKFGRNACIPSQSFYLRGFQMSSDESFECGCFPIRSLGNENEWDWPEVLSTTGSLMRSNASAFDMSKTNLSHMLSSSAVMSRSAKSSDYAVFPKNAHADNNLFIDALSGKQATTIQDGCNIPLKGFTGISQNSLYDQLKNQLTVSNLAMYTTAPNFVGTQLDDGCQPIPPFFDSQKRKGNLSSAHSPLQIPASLLKDHDCIKKKNANDGLVGKDAASSNIDLRLGQPPQTGNLLPSFAEPLLFNALASPPKSQPLKQMINNADLSREEELQNNFSYAAGSIKMVQEMPQLKLNNYMSAVGNASARARSETKNVAEGLSFSPFLQFDNQSGGKTKASENLWNDESSIMPKKLYSDYGHTGRQSNNSGIRTNKSLNNDKGVNFAKDSGVKINSGFGIGQLMEYPSSIKRAVSASDILVVNGKIHESSLPSDTSVCADILHGSNNVSFLGQENHTPQRSIPFKGILKGLPHHVSSSVSNQTPILPQQQQGINMDAYLLDENMRLLALSQILELSKQQHALYLKYINQKQGRSSCISKVQHYRCEASTSEQGTSGATLKLSQNRGIWGNHESTVGLEKLASLTGKHIAFFIFL

SEQ ID NO: 147167 - protein, 126 aa, Glycine max
  Coding DNA Sequence Number=SeqID_55482
MSVVHSDLTFVAQGSHSLTSCTLAQLSILTLTEWFKKIVDARKVFDEMPERTFISWNSIMTACVGSLSLGDGIEYVFGCGVVGLIPKQPTVLEISNNLVKSFTSKDPQGIYPPLFSLNNQVDAPST

SEQ ID NO: 147168 - protein, 248 aa, Glycine max
  Coding DNA Sequence Number=SeqID_55483
  Homolog annotation: Hit_ID=Q9FYR2; Match level="QueryCoverage=36%, HitCoverage=64%, E-value=3e-08, Identity=41%"; Hit description =Genomic DNA, chromosome 5, BAC clone:T13C12
MQNGINRQKSLKEKLKSSLCCFSGTVHSDPLERGEGGFFYDKLRIPKTPISPQGSTSSSWFKIMSPTSTNFGDPHPRVRGRSLKSRMGRKLLHHRQSQSADFSYDPSSYALNFEDDSPQEFPFRNFSSRLPSSPSPVDYSTGGKEIVGYAPFLCSPNSNNGTTSLTPMTSPPHVPLPDSGDQIPTTSALTFASTSWSDSSNDTAFSRANCYLMGVVVIKGGRKERPKEVKSYFSPLSRKSKCIGEKFI

SEQ ID NO: 147169 - protein, 76 aa, Glycine max
  Coding DNA Sequence Number=SeqID_55484
MELLVGEEAGGGGGGRGCGCVQKWEIGCECVKDERAVPRERLGEHAKIEGIESVNEKGKCEVFDGVRSPHVGGKRN

SEQ ID NO: 147170 - protein, 339 aa, Glycine max
  Coding DNA Sequence Number=SeqID_55485
  Gene Ontology: Mol. function=DNA-dependent ATPase activity; Cellular component=nucleus; Biological process=DNA replication initiation
  Homolog annotation: Hit_ID=A7QTA7; Match level="QueryCoverage=90%, HitCoverage=74%, E-value=1e-48, Identity=54%"; Hit description =Chromosome chr1 scaffold_166, whole genome shotgun sequence
  Pfam annotation: Domain name=MCM; Domain location=90-284; Score= -67.2; E_value=1.6e-12; Accession=PF00493.14; Description=MCM235 family
MVSVSIVFFHRLSHCCRLMQLQVKYDYNKCRPILGPFSQNSYLGVKVGYCPACQSKGPFSINIDQTTYRNFHKLTLQEGPRIVPAGRVPRNKEVILVNDRIDYARIGKKLYHGEHKTVYASGKGASVMGPTDAVHKDLVITVDKHQGDLHNTLIQNLKDSDPIISRFDIVCVVKDVVEPNTVEMLATFVVDNHFKSQDVHILPQELPKKYITYAKLNISPRLDDLKMVKDELSETYVELQRKSSYGQGVHIAIRHLESMIRMSEAHARMHLKQHSFRKYVTFKKNYNDFLLYILCELVQNAFLSEEIVTGFASGLTYLDVEVDNLCNKLISDNFKTVRK

SEQ ID NO: 147171 - protein, 129 aa, Glycine max
  Coding DNA Sequence Number=SeqID_55486
MCPKHVPQVSIIECILHLNSLMYSNQTISIHQFTNKRGKHHHGHGEAGEAFFYDWKQHDHCERQAQSPQHFVLVGCKNDGREAFYIGSNGLSTSIMTRGGNTVSLNTDIGWRTVFEGRPFYIGCVTQPM

SEQ ID NO: 147172 - protein, 22 aa, Glycine max
  Coding DNA Sequence Number=SeqID_55487
MEDAAELSFGANTQFHQSPEFG

SEQ ID NO: 147173 - protein, 170 aa, Glycine max
  Coding DNA Sequence Number=SeqID_55488
  Homolog annotation: Hit_ID=A7PVI8; Match level="QueryCoverage=25%, HitCoverage=14%, E-value=2e-08, Identity=68%"; Hit description =Chromosome chr9 scaffold_33, whole genome shotgun sequence
MFKSQVLDKEVFQKQMLEKLIWICSVMLDGAPHGGVLVGVADKEFCTEAQRGSSFFTLIMSFKCCINYCACERERERGIRTVKAPEQPRATTSHHSVPLSSSVNQQPTQPPKTTANHQHSHRKPPTQPPPTTVQTNHKKNQQNQNPKHIQTTNHTIRTPIIAQTTETEPA

SEQ ID NO: 147174 - protein, 75 aa, Glycine max
  Coding DNA Sequence Number=SeqID_55489
MEAVVGVGVDAFREGKGCECGKDERAMSRERLGEHAKIEGIESVDEKGTKPALHRNSYKTHANHFQKFYCKKERF

SEQ ID NO: 147175 - protein, 201 aa, Glycine max
  Coding DNA Sequence Number=SeqID_55490
  Gene Ontology: Biological process=primary shoot apical meristem specification
  Homolog annotation: Hit_ID=A7P624; Match level="QueryCoverage=69%, HitCoverage=14%, E-value=2e-36, Identity=54%"; Hit description =Chromosome chr4 scaffold_6, whole genome shotgun sequence
  Pfam annotation: Domain name=LisH; Domain location=6-32; Score=24.2; E_value=0.0005; Accession=PF08513.2; Description=LisH
MAHLDKDLTLLVLQYFNEENLKEAARTLGHESGLYFDLKYFEDIVLEGKWDETENYLSAFTKVMDNKFSIKMYFELRKQKYFEALEVNDHHKALDILLKDLKVFANGNEALFKDLSYFLIVDNIRNLKPSYGDVNSARKDLMWLQNPNQEPDLLMDYCNSEASTSAPKNSGTTMEWKPSTNGRPINMDLDEVERYLGYACM

SEQ ID NO: 147176 - protein, 67 aa, Glycine max
  Coding DNA Sequence Number=SeqID_55491
MEMIQRPKSTLIALKRKSSQGENTHQVMRILKLAKYRLKAQVKKDEGPSGEGKSPRVEKDEGPSGEG

SEQ ID NO: 147177 - protein, 179 aa, Glycine max
  Coding DNA Sequence Number=SeqID_55492
  Homolog annotation: Hit_ID=A7NW91; Match level="QueryCoverage=60%, HitCoverage=34%, E-value=1e-18, Identity=44%"; Hit description =Chromosome chr5 scaffold_2, whole genome shotgun sequence
MLQAGKLLMTMKWKSLRIPERDMHVYSESPMTDALQLVCYNTCKKPIKDSQFAAHAELCRSLQLTKQTMLELDDNIGNRKPPRKEKKKLGASSANQASARREQRRSESLDNIDFALSQSYLNSQVRVVPFPNEVTGKLFSSNTSFEYKTVFYMSSEGKNLLHEVGEMHYMEGATREGIH

SEQ ID NO: 147178 - protein, 106 aa, Glycine max
  Coding DNA Sequence Number=SeqID_55493
MRRVHPRRIDSGCQRSLFADRLKRDADEKAKLLLHAEERRNDALLKSESCKGDKVTLLARIGELDDKLRLKTQEIEEAEMKRVDPRRFHSFFSDGGVLSPLYPFIH

SEQ ID NO: 147179 - protein, 76 aa, Glycine max
  Coding DNA Sequence Number=SeqID_55494
  Subcellular localization annotation: CTP_CleavageSite=58; ConfidenceScore=5.31e-01
MAGLCMGCIAGANGGMGLYGSLLASGRSKIVFSLVGAARQRPRQLSRQSAWRHPLSCLATANGGTIFSSVLLAGSS

SEQ ID NO: 147180 - protein, 165 aa, Glycine max
  Coding DNA Sequence Number=SeqID_55495
  Gene Ontology: Mol. function=transcription regulator activity; Cellular component=nucleus; Biological process=regulation of transcription
  Homolog annotation: Hit_ID=A7Q2M2; Match level="QueryCoverage=60%, HitCoverage=54%, E-value=9e-27, Identity=66%"; Hit description =Chromosome chr1 scaffold_46, whole genome shotgun sequence
  Pfam annotation: Domain name=HLH; Domain location=66-116; Score=15.6; E_value=0.0034; Accession=PF00010.17; Description=Helix-loop-helix DNA-binding domain
MAASAALDDAKHGFSRSKMYKENLAGTLDAYDRHVFLCYKSHLSWPPRLEASDADPLPMRVTTVWRARKNDITVKARRKKISERMKILQDLFPGFNKVIGKSLVLDEIINYIQSLQRQVEFLSMKLEVVNSRLNSGIEAFPPKDMSFMSSECFICKYFTISMIIL

SEQ ID NO: 147181 - protein, 126 aa, Glycine max
  Coding DNA Sequence Number=SeqID_55496
MGQNRYKISYITDVENCFCSSDCILRIEALDKSVKAIDRPWRKSTISGTQAMCEWSIGRPKVVSHEPLADCVFDMAAGSGLKLSKEVLHLSLNRVLTMGEREISRDREVLVDSGFYGDVIVLADNY

SEQ ID NO: 147182 - protein, 46 aa, Glycine max
  Coding DNA Sequence Number=SeqID_55497
MHYDKNKRWVEKATVGEVSYPNFVWGPLLDDMRPFFGPCEVLGIHH

SEQ ID NO: 147183 - protein, 135 aa, Glycine max
  Coding DNA Sequence Number=SeqID_55498
  Gene Ontology: Mol. function=nucleic acid binding; Cellular component= cytoplasm; Biological process=multicellular organismal development
  Homolog annotation: Hit_ID=A5ARQ9; Match level="QueryCoverage=31%, HitCoverage=4%, E-value=2e-11, Identity=69%"; Hit description =Putative uncharacterized protein
MYTSGTTRDPKGVIMFNEAFMAEVLSVDHILMSESQSGYTTTNTPSCQAGDLLHHQGLINRILARRCSLPGWPGVTKYVGLVCAQPHREELNQDLFKCWKDPHHGIIYGGMIRNENSSMSEDQTSDHVMETLVVV

SEQ ID NO: 147184 - protein, 127 aa, Glycine max
  Coding DNA Sequence Number=SeqID_55499
  Homolog annotation: Hit_ID=Q69F85; Match level="QueryCoverage=61%, HitCoverage=4%, E-value=3e-08, Identity=36%"; Hit description=Gag -pol polyprotein
MSRFRNKVRQDGQKCNKREGSTKTYSHKLDKRHKSDKHQPLLKRPWYECYTPLTTNHTTILEEAFNLEVPIRLPPMHPPRFHRSIGHNTKECWTLKDKIEELIHVRYLAQFIKRLDNHQARARHRGH

SEQ ID NO: 147185 - protein, 135 aa, Glycine max
  Coding DNA Sequence Number=SeqID_55500
  Homolog annotation: Hit_ID=A6FJQ2; Match level="QueryCoverage=28%, HitCoverage=84%, E-value=1e-10, Identity=89%"; Hit description=50S ribosomal protein L5
MRKEKIPHQAPFAIQPAQLLGRAIGAGLFAITPAGERGMCCKAIKLGNARVFPVTTLSTLEDPPREPISLLLFIECKTDLPWKAGEIKRIKFWRLVPSIILLNSRKRLLVVAGSGKCQKMTMFVILGLQVVISYS

SEQ ID NO: 147186 - protein, 32 aa, Glycine max
  Coding DNA Sequence Number=SeqID_55501
MEANVTKVLTAVGNHKDERKKTFTQNTKTTQV

SEQ ID NO: 147187 - protein, 32 aa, Glycine max
  Coding DNA Sequence Number=SeqID_55502
MEVMVAVRQRTQRDGGGRSLICGVVQTPLGRL

SEQ ID NO: 147188 - protein, 103 aa, Glycine max
  Coding DNA Sequence Number=SeqID_55503
  Gene Ontology: Cellular component=membrane; Biological process =intracellular signaling cascade
  Homolog annotation: Hit_ID=A7QYS5; Match level="QueryCoverage=60%, HitCoverage=44%, E-value=6e-24, Identity=80%"; Hit description =Chromosome undetermined scaffold_254, whole genome shotgun sequence
  Pfam annotation: Domain name=Cornichon; Domain location=3-102; Score =24.8; E_value=2e-07; Accession=PF03311.5; Description=Cornichon protein
MADLFAWLISFFILIALIVLVIYQLMCLADLEFDYINPYDSSSRINKVILPEYIIVGVLFGFYLVTGHWIMSLICAPYLYYNVRFSVTTQEKSNLLMAQDKAT

SEQ ID NO: 147189 - protein, 120 aa, Glycine max
  Coding DNA Sequence Number=SeqID_55504
MMTTKDDDKGDEQKAQRSKNNSSESRTSQEFKNQEEFKTQEESLQSKIKIQDLKNQDQDSRMKKRLKQDKGYIYLGLTENKRGYISCGSVLVEGTSTRFKENKRGYIPCGSLLVNGFLQG

SEQ ID NO: 147190 - protein, 757 aa, Glycine max
  Coding DNA Sequence Number=SeqID_55505
  Gene Ontology: Mol. function=protein binding; Cellular component =Golgi apparatus; Biological process=steroid metabolic process
  Homolog annotation: Hit_ID=Q9SU36; Match level="QueryCoverage=89%, HitCoverage=91%, E-value=0.0, Identity=65%"; Hit description =Putative SWH1 protein
  Pfam annotation: Domain name=Oxysterol_BP; Domain location=343-744; Score=193.5; E_value=5.1e-55; Accession=PF01237.9; Description =Oxysterol-binding protein
  Pfam annotation: Domain name=PH; Domain location=52-184; Score=44.4; E_value=4.1e-10; Accession=PF00169.20; Description=PH domain
  Pfam module annotation: Pfam domain module=Oxysterol_BP::PH; Domain location=343-744::52-184
MRVKEMHPLCCISLESPGIGSDSPEPEAAALSRTRSLPAGGSDVIARRGSEATVAGVLYKWTNYGKGWRSRWFLLRNGVLSYAKIRWPENLNLLSPVDDVRLIGEVTANRLAREAASATVRRKNHKPPSSSSSSVVHLKISSFRESKSDDRRFYIFTATKTLHLRTDSRKDRVAWIQALVSTRGLYPLRPLSDHLSLAPNHISVSTEGLKKRLLEEGSSESLAKDCEQIMLAEFSELQEQLQILCQERMNLLDTIRQLEAANIEPEATALHDSEYQLTKNEFSSLGRGKYSECSTTESSDDIEKQEMEEVSDEDEISYYDTKEYFTEHGFRCGSTGGLDPMNMSGEVNTQCIDLENSLVGQTINEFRYPLIARRKKLPDPVEKEKGVSLWSIIKDNVGKDLTRVCLPVYFNEPISSLQKCFEDLEYSFLLDRAYEYGKSGNSLLRALNVAAFAISGYASSEGRHCKPFNPLLGETYEADFPDKGVRFFSEKVSHHPTVVACHCQGRGWKFWADSNIRSKFWGRSIQLDPVGVLTLEFDDGEIFQWSKVTTTIYNLILGKIYCDHHGNMDVRGNRQYSCRLKFKEQAILDRNPHQVHGFVEDVTGKKVATLFGKWDDSIYYVNGEVNVKPKDFTMSSVTNLLWKRTMPPSNLTRYNLTSFAITLNELTPGLKEKLPPTDSRLRPDQRHLENGEYEKANMEKQSQGKCKKMDGSLGGSTEKMKMERSDILAGIGKPEPKEDGLDAQISLVKFMKAILIL

SEQ ID NO: 147191 - protein, 105 aa, Glycine max
  Coding DNA Sequence Number=SeqID_55506
MAGKVKTNKRHFTCFNWQRSHLGSLKLEQLSEADNDYLVAPFLEVEIMETMCDTVVRDLRIKDRMVKFKSIYYHLKVKEGGGKVVGAVVGGVSEVEARDKGAKGT

SEQ ID NO: 147192 - protein, 109 aa, Glycine max
  Coding DNA Sequence Number=SeqID_55507
MIGVVTLDLHRQLSSFPIRVAQHLAVTIHAQSQRIHGHGLSEITSDDNKFQNSNQVTDCTERVTESLSKSEKPLRKLQKLQLPLSLALSLRRSLGGWMFYVHAAMCNIY

SEQ ID NO: 147193 - protein, 269 aa, Glycine max
  Coding DNA Sequence Number=SeqID_55508
  Homolog annotation: Hit_ID=A7QKC0; Match level="QueryCoverage=76%, HitCoverage=86%, E-value=1e-37, Identity=46%"; Hit description =Chromosome chr2 scaffold_112, whole genome shotgun sequence
MGSSEEVVGKEEVIAKLKDDGDFDRLRLKIVRKLKDNEELRQHITSIVKQSVALNRAGAENMKPRQLSDAIHEEVGDKVMSQISDSLWQIIRSGDDMKSEIMETVQSVYDKLANPKGKDEVMMSMSDVMPIHRQGETASATEIDDTLHENEPDEPPGFTLLHNHLNNNYHEEQDKGKVQVQKQGFTAEQKEDSHPSQDTLGEDDVNSNAPPPGFSMDVEQKPSSDCSDEDPDPLLAFDVTGVLFSVFDHDEPAKNKRQSGGLLTSPFPI

SEQ ID NO: 147194 - protein, 93 aa, Glycine max
  Coding DNA Sequence Number=SeqID_55509
  Homolog annotation: Hit_ID=A5AZ88; Match level="QueryCoverage=87%, HitCoverage=7%, E-value=9e-09, Identity=35%"; Hit description =Putative uncharacterized protein
MIEDVLVREKHFIILADFVVMNISEDIDILVILGRPFMLTTSYIVDMGKRKLELGFEDQKIDFDLFVEDKPAPEHNVCLQVMGEGQEVLKELA

SEQ ID NO: 147195 - protein, 164 aa, Glycine max
  Coding DNA Sequence Number=SeqID_55510
MTPVNRKAGTGERTREPPGGNAWGAEPMEKRLCRGPLTSLLSTSVKITGKFHRKFRARWGKPLVLSVAASNDRAVASSVSEEFAEYLFYNVVPHGKHFTDSVHSQHSNRLCSTSALAPAGVIAQEARTRSPGLADSLMQLARQVPDGESGQPCSGNALTRRVVS

SEQ ID NO: 147196 - protein, 74 aa, Glycine max
  Coding DNA Sequence Number=SeqID_55511
MTMLIGWTSQKSGADIEEEELTDLRSNPLQGGGDDAILPRKGPVTRSMSKRHQEDWARAAEEGPRVLMNLRIDF

SEQ ID NO: 147197 - protein, 246 aa, Glycine max
  Coding DNA Sequence Number=SeqID_55512
  Homolog annotation: Hit_ID=A1FR08; Match level="QueryCoverage=91%, HitCoverage=52%, E-value=2e-69, Identity=62%"; Hit description =Putative uncharacterized protein precursor
MLLTSICANWPSSWRATLSILAGSFCCAGCRSNAGLMRISDHLELGTQGAGLLQGFQDRDEIAWCCAHGVHRVHDLVQSGAAAELEHAAAVVGGGDGRLRAGHGAAAGQRIGLTDVGVFLDGHGQRTMRDRSRSHAHLLADDHGAGARIDHHLGRRAAGGQFQVLDARQQADACARIGRRGDRHGHAVDRTRGTFAKGVVERGDHARDRGEVVVVQVQGDVAAIGQRIGQGTFHGGTVGNAADAGH

SEQ ID NO: 147198 - protein, 107 aa, Glycine max
  Coding DNA Sequence Number=SeqID_55513
MWNYLDFVEAWEDLWGPDVERNEDKGYVGVRELSWRWATGDGGLYVICGCGESFCTIARPPPSTTCDGVVPWRYVAGVRRPWGCQVGCYCPKTKLDQSRPNPGIVGQ

SEQ ID NO: 147199 - protein, 433 aa, Glycine max
  Coding DNA Sequence Number=SeqID_55514
  Gene Ontology: Mol. function=homoserine dehydrogenase activity; Cellular component=chloroplast; Biological process=aspartate family amino acid biosynthetic process
  Homolog annotation: Hit_ID=P27725; Match level="QueryCoverage=100%, HitCoverage=52%, E-value=0.0, Identity=80%"; Hit description =Bifunctional aspartokinase/homoserine dehydrogenase 1 (Aspartokinase I/homoserine ...
  Homolog annotation: Hit description=dehydrogenase I) (AKI-HDI) [Includes: Aspartokinase (EC 2.7.2.4); Homoserine dehydrogenase (EC 1.1.1.3)]
  Pfam annotation: Domain name=ACT; Domain location=43-103; Score=29.1; E_value=1.6e-05; Accession=PF01842.16; Description=ACT domain
  Pfam annotation: Domain name=Homoserine_dh; Domain location=257-433; Score=259.4; E_value=7.7e-75; Accession=PF00742.10; Description =Homoserine dehydrogenase
  Pfam annotation: Domain name=NAD_binding_3; Domain location=115-249; Score=161.1; E_value=2.9e-45; Accession=PF03447.7; Description =Homoserine dehydrogenase, NAD binding domain
  Pfam module annotation: Pfam domain module=ACT::Homoserine_dh::NAD _binding_3; Domain location=43-103::257-433::115-249
ISFCVPQSEQARARRVLEEEFYLELKDGLLDPLDVLEQLAVISVVGDGMRTLRGISAKFFSALARANINIVAIAQGSSERSISVVVSNDDVTTGVRVVHQMLFATDQVIEVFVVGVGGVGGALLEQLHRQQAWLKGKHIDLRVCGIANSHALLTNVHGIDLSNWKAALAEAKEPFNLGRLIRLVKEYHLLNPVIVDCTSSQAVADQYADFLAEGFHVVTPNKKANTSSWNYYQQMRAAAAKSRRKFLYDTNVGAGLPVIENLQNLLNAGDELIKFSGILSGSLSFIFGKLDEGVTLSEATRMARELGFTEPDPRDDLSGTDVARKLLILAREAGHQLELSDIDIEPLLPASLTDIADVDQFMARLPELDSAFAARVAKARDEGKVLRFVGAIEEGGACKVKIDAVDGNDPLYKVKNGENALAFYSRYYQPIPL

SEQ ID NO: 147200 - protein, 149 aa, Glycine max
  Coding DNA Sequence Number=SeqID_55515
  Homolog annotation: Hit_ID=Q6UUU1; Match level="QueryCoverage=40%, HitCoverage=40%, E-value=9e-19, Identity=78%"; Hit description =Putative uncharacterized protein
SEVGCFFGFLGWFESLGSDGGGVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTGKQFAPSWTVCTNPPFSPTAAPYP

SEQ ID NO: 147201 - protein, 174 aa, Glycine max
  Coding DNA Sequence Number=SeqID_55516
NAELRDVNIATTKALEQETKKARKEEHGRNKFRGALWGSNSELKLQREERDQSRVDGLILKDELKACLRSKRSLSQRLCETETNMLAIINKYQEELNLATVHEHKVADKYAQVYTEKEARGRVIDSLHQEATMWMDRFALTLNGSQEFPRLLAKAKAMADAYSAPEENHGLLSY

SEQ ID NO: 147202 - protein, 83 aa, Glycine max
  Coding DNA Sequence Number=SeqID_55517
MWTTTGEELATQLAQASKVASSGSNSLLEEGSGRPNFRRSYRNSRIVQKHIFSISDKSRDFIYCATKDAKYLKSANQRLHVIK

SEQ ID NO: 147203 - protein, 165 aa, Glycine max
  Coding DNA Sequence Number=SeqID_55518
  Gene Ontology: Biological process=transposition, DNA-mediated
  Homolog annotation: Hit_ID=Q1J7G7; Match level="QueryCoverage=23%, HitCoverage=67%, E-value=9e-11, Identity=72%"; Hit description =Transposase
DLPSQWLLFLSAVPPVQLLTGWCVTAKAPPDISAGKCSGRVPFAIQAAQLLGRAIGAGLFAITPAGERGMCCKAIKLGGARYQLLFPLVRVNFELGVIMVIAVSFGKPVVPAALMNRPTRGERRFAYWALAECILAYYVGTDEGVSEVLHVAGEKKAAPVRQQNM

SEQ ID NO: 147204 - protein, 186 aa, Glycine max
  Coding DNA Sequence Number=SeqID_55519
  Homolog annotation: Hit_ID=UPI00016621D1; Match level="QueryCoverage =82%, HitCoverage=40%, E-value=2e-12, Identity=32%"; Hit description =UPI00016621D1 related cluster
MSKSCEFGMTGPLDESISCFLIRLDPWVLVPITFRGLYALTVRGLHVLAFRGLHVLTFRGLHAFAFIGLDVLKFRGLHVLAIRGLHVLAFKGLYALTFRGLHVLTFRGLHALTFRGLHPLIFRGLHVLTLRGLHALAFRGPNILIFRGPNILIFRGLHVLIFTGLRVLAIRGLHIHTIRELKVLRP

SEQ ID NO: 147205 - protein, 291 aa, Glycine max
  Coding DNA Sequence Number=SeqID_55520
  Gene Ontology: Mol. function=motor activity; Cellular component=cell projection
  Homolog annotation: Hit_ID=UPI00016621D1; Match level="QueryCoverage =71%, HitCoverage=39%, E-value=2e-26, Identity=38%"; Hit description =UPI00016621D1 related cluster
GLHVLTFRGLHVLTFRGLHVLDFRGLHVLTFKGLHVLTFKGPHALAFRGLHVLTFRKLHALTFRGLHVLTFRGLHALNFRGLHALAFKGLHVLTFRGLHALTFRGLHILIFRGLHALTYRGLHVLTFRGLHALAFRGLDVLTFRGLHALAFRGLDVLTFRGLHALAFRGLHVLTLRGLHVLTFRGLCVLPFRGLHVLAFRGLRVPTFSGLDVRALREFKDRAHKTPSGPGEVQQGPGVSNSGYGPLSVLQGARSPQQGIVPARHPADPKKSNRVLRFPALITSLCQFYGVP

SEQ ID NO: 147206 - protein, 109 aa, Glycine max
  Coding DNA Sequence Number=SeqID_55521
  Homolog annotation: Hit_ID=A5C7Q9; Match level="QueryCoverage=80%, HitCoverage=9%, E-value=4e-07, Identity=41%"; Hit description =Putative uncharacterized protein
MGNARFLEEVEFGKEENIKNVVFKEKPVIYSDQVLIPITVQDTTPVIEDNVQTIDIVPKQDNNEVPPQIPLEQPQQSQEVSLRRSIRERRMQSQMIILYFSKNIRMVLV

SEQ ID NO: 147207 - protein, 80 aa, Glycine max
  Coding DNA Sequence Number=SeqID_55522
MARACSPLKVRTCSPLKVRACSPLLARTCSPLKTRIDCPFEKGDNSCNLILSFCKSLRELPQSVHLRLMHDAPHCPSVRL

SEQ ID NO: 147208 - protein, 55 aa, Glycine max
  Coding DNA Sequence Number=SeqID_55523
MTKFGLFLSSGPPPPDDKRVRITGQYDKDYGAADKSKALAPTYPPMRNSDLRSSG

SEQ ID NO: 147209 - protein, 237 aa, Glycine max
  Coding DNA Sequence Number=SeqID_55524
RDLRANGVFAEGAGAHVVINRLAIVRETGGTVRHQPFPLGGANCLAEVGLTGFTELTFAAFRRVQRDHVIAWFQAGHALAHFHHNPAPFMAEHRREHAFRIVTGQRKRIGVAYAGMGDFDQHFAFFWRRDVDFNDFERLAGSKCNCSARFHIISAQQMADFRHAYGSLIRRGFPRHQLIFEVNFDHFAHQAIGSPAHGGNLLQNGQTGVARLQRAFKGLNLAPNATDAGKNTFFIFG

SEQ ID NO: 147210 - protein, 52 aa, Glycine max
  Coding DNA Sequence Number=SeqID_55525
MGESKKEREFSIKDRKRKEEICRKEMICKIKSWHIYGSELGRNTYLCEINTL

SEQ ID NO: 147211 - protein, 77 aa, Glycine max
  Coding DNA Sequence Number=SeqID_55526
MASYGVASPLSLPFSIPLPFIFQEAKESIDEEDPRPTSSNGAYIRWVKPSLRLPYWSVLVLHDDLMHAIGRTNSLEV

SEQ ID NO: 147212 - protein, 85 aa, Glycine max
  Coding DNA Sequence Number=SeqID_55527
  Subcellular localization annotation: CTP_CleavageSite=45; ConfidenceScore=5.18e-01
IFSEEDRSPPAQAVAAQKRKLLYNHGGCTSSVPSPGSKSYFRDVVTSGTTSVPWYQNFTLGHGNTAHTPYIFSKIPTVRSWTSVL

SEQ ID NO: 147213 - protein, 114 aa, Glycine max
  Coding DNA Sequence Number=SeqID_55528
LFVLQIAKRNVYTDNHSGISARQHDSKVSMTDLVSAEDDIAKTNVYTDNHSGISARQRDSKVSMTDLLSAEDDAFRLTDSKKVLKVRTTTWVADKSEALAPAYPPMRNSDLRSS

SEQ ID NO: 147214 - protein, 324 aa, Glycine max
  Coding DNA Sequence Number=SeqID_55529
DARQAGQELVGDVLAQAFLAEHAAGDFQGLGLEQALARLAAAVEPLEFETGHVDVMDLAHVVRQARHFEPVAVRVDHAPPGQVVERGAPQHGLLAAGVHGDVAAHARGLGRGRVHGEHETGSLGRLRHPLGHHAGAGMDDGHGLGEPGQDTGLDLAQLVEFLGVDDGRLPGQRNRAAGVAGAAAARHDGQAQLDTGGDQRGDLVFRIRRQHHEGVLHAPVGGVGHVRYARQAVELDVVARGDAAQHLLRLLAQHGGLVELALEGGNGGTRPTQQAQHFLVAMRIVAGLGRRAGFTAAVDLAQPMVQRVDQLLAALGIVQTGRPA

SEQ ID NO: 147215 - protein, 131 aa, Glycine max
  Coding DNA Sequence Number=SeqID_55530
MGDQEETQEQMKADMKEQMASMMEAMLGMRQLMEKNVATTAAVSLAAEADPTLLAIAHHPPPNAVGLERSTPGHSNKPHLGYNRVAYPYGLSPNYTPPVMHDDAGHASSPILEGEPPRQPDEVHEDHRGYA

SEQ ID NO: 147216 - protein, 203 aa, Glycine max
  Coding DNA Sequence Number=SeqID_55531
MHDDRWLVSTNQADMIGRLLANSLALESRILHYLIVCILLPRSSNLAQAHLVRYLMHKALRLNAPLPYPHLVTLFLQHFNIPLDFEPYVPIKRSFLIGAVGVASFGYRRERDGSWVKKGAQPNNNEGHLPVEGDSSLLQSILDSFDRLQTYVGERFDSLEHQVDTRFEEMNSRITKVEEDVTIIRDCLDLPPPPPSCRSKASW

SEQ ID NO: 147217 - protein, 67 aa, Glycine max
  Coding DNA Sequence Number=SeqID_55532
MAALEREGSSGLVSTEAQLTTSKDWKAVSKDSFAASTYDVEEGQLTNISSSPDTITKSPPTANFNFW

SEQ ID NO: 147218 - protein, 123 aa, Glycine max
  Coding DNA Sequence Number=SeqID_55533
  Homolog annotation: Hit_ID=Q84VH5; Match level="QueryCoverage=64%, HitCoverage=11%, E-value=6e-35, Identity=97%"; Hit description =Envelope-like protein
MKRESPLSLHYKLFEGTHVPDIVSTSGKAASGAVSKDALIAELKDTCKVLEATIKATTEKKMELERLIKRLSESGIDDGEAAEEEEEAEEEEEAAEEEEEAAEEEEDAAEETESDDEDSEATP

SEQ ID NO: 147219 - protein, 344 aa, Glycine max
  Coding DNA Sequence Number=SeqID_55534
  Gene Ontology: Mol. function=transmembrane receptor activity; Cellular component=intrinsic to membrane; Biological process=innate immune response
  Homolog annotation: Hit_ID=A1W966; Match level="QueryCoverage=59%, HitCoverage=55%, E-value=2e-40, Identity=45%"; Hit description =Putative uncharacterized protein
PERQLSHEVWQQLCNSDVLLMLDTPAGLERRWTSAEFGRVLAKGISVMSVHWAGATMSPRIVTASCVQLSERAVNPQSGQLEEDSLQGICLKLEELLSQNHAVRSVNLKSKVRIAAEANGGRLLGVGAHQVAYIQLPNRRPLKVSLTLGTHAQTASWQNESRALIYDHIGLNTSCLERAVSADQQSYPWVKATEADVHFAYWKEDYAVRELVIAVLHKYKIVWGGHPAITPMLWSICEDLNIDYSEAVVLYQSRFFEDYFPEENRRFKNVIFTNAVDGDRESSLLLMRKEMLSRPDLVGAVFIGGMEGVEVEYEIFKHYHPGASILPVPSPGGASLNLAIDYGY

SEQ ID NO: 147220 - protein, 155 aa, Glycine max
  Coding DNA Sequence Number=SeqID_55535
MASRKRKSIDNVLGRNILPVRKVELYHTELDDFKAELESCNFHKRLTNLADGSIDLALVKDFYANLYSSEDRPPKQFRVKSHLVKIDANSLNAFLETPVVLADGETLPAYSRYCWLPTDFKEIEASLCIPGRGFILNSEGHPGKILRKDLTTLAQ

SEQ ID NO: 147221 - protein, 419 aa, Glycine max
  Coding DNA Sequence Number=SeqID_55536
  Gene Ontology: Mol. function=catalytic activity; Biological process =metabolic process
  Homolog annotation: Hit_ID=Q08QZ3; Match level="QueryCoverage=41%, HitCoverage=36%, E-value=2e-30, Identity=43%"; Hit description =Coronafacic acid synthetase, ligase component
SLTPVLLRQLNAWETTLPPGLKKLTIGGDLAAPKEVEAFLLRQPWLELYLTYGISEAGPRVSTCPAHLLGRGYYASAGRPIDQTEVRILPGADGQDGQGELLICSDTLLVKRIGRGNRQTFIELDGKRWLRTGDIFFQDADGFLFFKGRISDFIVIRDEKVNIGAVKQLCREIKGESDVFETWPADIVRLKFPEEHWDYYISRYEHFRDEVIRNLTPQDYLREMLKQTQRLPCFCSEMADVAAILYSQIINKPNERIRYFDISAYAQVLDRKRRKVVKPAELDGFDATDITFDFIEGKMMTTTTYVADVDGMGWTTASGDRIEDVFQTLLEKQTGIAPAPSDRGLRTDLAAMLPGEWPAEMREKLIALTKRTARQALEDSGAAEPVPEERRFLIVGTSLGFRLDSEAYCREPLDGWVNE

SEQ ID NO: 147222 - protein, 188 aa, Glycine max
  Coding DNA Sequence Number=SeqID_55537
  Gene Ontology: Mol. function=translation elongation factor activity; Cellular component=cytoplasm; Biological process=translational elongation
  Homolog annotation: Hit_ID=Q6D025; Match level="QueryCoverage=100%, HitCoverage=100%, E-value=3e-97, Identity=90%"; Hit description =Elongation factor P
  Pfam annotation: Domain name=EFP; Domain location=69-123; Score=95.7; E_value=1.5e-25; Accession=PF01132.11; Description=Elongation factor P (EF-P)
  Pfam annotation: Domain name=EFP_N; Domain location=5-62; Score =116.0; E_value=1.1e-31; Accession=PF08207.3; Description=Elongation factor P (EF-P) KOW-like do
  Pfam annotation: Domain name=Elong-fact-P_C; Domain location=131-186; Score=120.8; E_value=4.1e-33; Accession=PF09285.2; Description =Elongation factor P, C-terminal
  Pfam module annotation: Pfam domain module=EFP::EFP_N::Elong-fact-P _C; Domain location=69-123::5-62::131-186
MATYSSNDFRPGLKIMFEGEPYAVEASEFVKPGKGQAFARVKMRRLLTGTRVEKTFKSTDSCEGADVMDTNMNYLYSDGEFYHFMHPESFEQHQVDGKTVGDAAKWLQDNAECIITLWDGRPIAVQPPNFIEAEITDTDPGLKGDTAGTGGKPATLSTGAVVKVPLFVQIGEVIKVDTRSGEYVSRVK

SEQ ID NO: 147223 - protein, 377 aa, Glycine max
  Coding DNA Sequence Number=SeqID_55538
  Gene Ontology: Mol. function=nucleoside-triphosphatase activity; Cellular component=cytoplasm; Biological process=ATP-dependent proteolysis
  Homolog annotation: Hit_ID=Q1H1F8; Match level="QueryCoverage=100%, HitCoverage=46%, E-value=1e-180, Identity=83%"; Hit description=ATP -dependent protease La
  Pfam annotation: Domain name=AAA; Domain location=165-359; Score =162.7; E_value=9.7e-46; Accession=PF00004.20; Description=ATPase family associated with various cellular activities (AAA)
  Pfam annotation: Domain name=AAA_3; Domain location=166-301; Score= -4.4; E_value=0.001; Accession=PF07726.2; Description=ATPase family associated with various
  Pfam annotation: Domain name=AAA_5; Domain location=165-307; Score =24.6; E_value=3.9e-05; Accession=PF07728.5; Description=ATPase family associated with various
  Pfam module annotation: Pfam domain module=AAA::AAA_3::AAA_5; Domain location=165-359::166-301::165-307
MLSVIDRLEHLLYLMESEIDILQVEKRIRGRVKRQMEKSQREYYLNEQVKAIQKELGEQDENAEMEELEQRIKNAAMPKEALAKVTAEFKKLKLMSPMSAEASVVRNYIDTLLNLPWKKKTKISKDLQAAEAILDADHYGLDKVKERIVEYLAVQQRVGKLKAPILCLVGPPGVGKTSLGQSIAKAVNRKFVRMALGGVRDEAEIRGHRRTYIGSMPGKVLQSMTKVGVKNPLFLLDEVDKMGQDMRGDPSSALLEVLDPEQNHTFADHYVEVDYDLSDVMFVATANSMNIPEPLLDRMEIIRLSGYTEDEKINIAQRYLLPKQLKAHALKTTDISVAESVLRDIVRYYTREAGVRRLEQEVAKICRKAVKEQLLAK

SEQ ID NO: 147224 - protein, 201 aa, Glycine max
  Coding DNA Sequence Number=SeqID_55539
  Homolog annotation: Hit_ID=UPI00016621D1; Match level="QueryCoverage =84%, HitCoverage=33%, E-value=9e-08, Identity=27%"; Hit description =UPI00016621D1 related cluster
LLHVLTIEGLHVLAVRGLHVLTFRGLHIQTFKGLQALAFIGLHAPTFRGLHALTFSGLHVLAFRSYMSSPLRGLHVLPFRGQQALTFVELHDLAFRGLHVLAFRGSTPLPSEDYTATRPHFRGLHLLAFRGLFVHAFRGLHILAFRGLHVLPFRGLHIHIFRGLHALTFIRLCRNLPFGGRATRDSRDACSTKGIRAESPP

SEQ ID NO: 147225 - protein, 53 aa, Glycine max
  Coding DNA Sequence Number=SeqID_55540
MRWKVGDGEKIRFWKDKWINQQESLAEREVEGQSIQQQQTDIWEWLGDPSGNY

SEQ ID NO: 147226 - protein, 145 aa, Glycine max
  Coding DNA Sequence Number=SeqID_55541
  Gene Ontology: Mol. function=signal transducer activity; Cellular component=membrane; Biological process=signal transduction
  Homolog annotation: Hit_ID=A4WED7; Match level="QueryCoverage=84%, HitCoverage=22%, E-value=2e-43, Identity=79%"; Hit description =Methyl-accepting chemotaxis sensory transducer precursor
  Pfam annotation: Domain name=MCPsignal; Domain location=1-144; Score =118.4; E_value=2.1e-32; Accession=PF00015.12; Description=Methyl -accepting chemotaxis protein (MCP) signaling domain
TNILALNAAVEAARAGEQGRGFAVVAGEVRNLASRSANAAKEIEGLIADSVNRVEQGAQLVGDTGTTMDAILRDVTEVTTIMKQIASASEEQSKGISQVGIAITQMDGVTQQNASLVEEVSAAAAALERQTEELQRSVQKFRLTA

SEQ ID NO: 147227 - protein, 131 aa, Glycine max
  Coding DNA Sequence Number=SeqID_55542
MRIKRSIKVVMGPRTRYGEIWNKWLNPKGIEEQRGITFEKQHFIQHVQPFNQYTMYIRYGPKYIMKHSQQNKLSNETKTPHTYSQNNSKAPKFLKDMDASTRIKPRLLCKQSMGQNTPNDYNDGWLKFSQR

SEQ ID NO: 147228 - protein, 109 aa, Glycine max
  Coding DNA Sequence Number=SeqID_55543
MERSHSPSHPAHDGEGDDHNYGLNPDYEKGKFEYASNVAPNNNRRAPVVGARKKEGDAHAVTIAPTIIWWWPYTEGSSSDPTPGGMTRVPNVSTIVELPDTTLTPASRS

SEQ ID NO: 147229 - protein, 16 aa, Glycine max
  Coding DNA Sequence Number=SeqID_55544
MENCTKQSLRIAPNSK

SEQ ID NO: 147230 - protein, 234 aa, Glycine max
  Coding DNA Sequence Number=SeqID_55545
  Homolog annotation: Hit_ID=Q2HW90; Match level="QueryCoverage=60%, HitCoverage=31%, E-value=9e-09, Identity=29%"; Hit description =Putative uncharacterized protein
MPTGRKEAISFLWVLSLHDKSFQGSENLSTRVGPCKAKQKWSSRSTKEVFGGKGQRPWQNQGEWASFIDILALLIFGVVLFPNMEGLVDLAVIDAFLAYHNHKESPVVAILAMYDTFNRGCRAVYPLQGHRSCVEKGKANWDQLLASMERRLLIGSLAGRKEELGFYLHAKDVQMSLDGTRGCINYNPVLVIRQLGYPMRGVPSDESITPFIAWGFSDHNARVFQGVRKAWDAA

SEQ ID NO: 147231 - protein, 204 aa, Glycine max
  Coding DNA Sequence Number=SeqID_55546
EVQDQMKADMEAMMSMRKMMEVNTATVVAASTTTEVDPTHPSGINQASHPVPDMHSFPPYGLPPNYTPPNVAHTPDENVDNSAPMPIESQQPQSGHAQVPQPMGETYEAPRDHTLADSEPHLGYATEGQAFGGIPLPNTLGGPSVSATTTTLTFCGGKTTSYHGRNYAFADMVELCLVPDVVIPLKFKVPDFDKYTGLLAPRIT

SEQ ID NO: 147232 - protein, 155 aa, Glycine max
  Coding DNA Sequence Number=SeqID_55547
  Homolog annotation: Hit_ID=Q6UUU1; Match level="QueryCoverage=75%, HitCoverage=97%, E-value=6e-37, Identity=60%"; Hit description =Putative uncharacterized protein
GKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTGNGGETRQDYKDTRRFPLAAPSCALLYLPFGLPVSFRCYGRVMSHSTPDTQFR

SEQ ID NO: 147233 - protein, 21 aa, Glycine max
  Coding DNA Sequence Number=SeqID_55548
MDTRLRVIGDPMNEVQRGWGS

SEQ ID NO: 147234 - protein, 76 aa, Glycine max
  Coding DNA Sequence Number=SeqID_55549
MWTDRFALTLNRSQELPPLLAKAKAVADTYSAPEEIHGLLSYCCWSSSFVTGSRKVHITLLIVHMGHCAQCASKKI

SEQ ID NO: 147235 - protein, 146 aa, Glycine max
  Coding DNA Sequence Number=SeqID_55550
MIRGDTLRLSAPFCHPEAAGPMTSRDQIWSFCTLVSSRGGGPDDTRRYLTVIRTLLSSRGGGPDDKRRRKFEAAGPMTSRDKIWSFCTLVSSRGGGPDDDVLTSRDKIWSFCTLVSSRGGGPDDTRRYLTVIRTLLSSRGGGPDDK

SEQ ID NO: 147236 - protein, 78 aa, Glycine max
  Coding DNA Sequence Number=SeqID_55551
MGVQIATRPTWALQKIPPEGCCFWRKQPCSPGRAGWQKIQAEALPKRFRNVSVRNFVKVSTVLRRSSFVLHRSSIFNG

SEQ ID NO: 147237 - protein, 188 aa, Glycine max
  Coding DNA Sequence Number=SeqID_55552
  Homolog annotation: Hit_ID=Q2HW90; Match level="QueryCoverage=95%, HitCoverage=40%, E-value=2e-20, Identity=33%"; Hit description =Putative uncharacterized protein
MDQLQQQAFRKAYGKIWDLARVEVSMEPIASLSQYYDQPLRCFTFEDFQLVPTVKEFEEILGCPLGGRKPYLFSRFYPSTTRVAKYQGSVWRKGQRPWKIIANGLSSIDILALLIFGVVLFSNVDGLVDLAAIDAFLAYHNHKESLVVAMLADLYDTFDRRCEKNNTRIVCCTPALYVLLVSHLFRQE

SEQ ID NO: 147238 - protein, 195 aa, Glycine max
  Coding DNA Sequence Number=SeqID_55553
  Gene Ontology: Mol. function=sequence-specific DNA binding; Cellular component=nucleus; Biological process=regulation of transcription, DNA-dependent
  Homolog annotation: Hit_ID=A8NF35; Match level="QueryCoverage=23%, HitCoverage=83%, E-value=1e-16, Identity=89%"; Hit description =Transcription factor, putative
LPTLETAQPEVGSSGWKSTARRVVSGAPPAALENPEDRVPPTPGRTHNRIRSPRQGKSAKWIRNLGKRIGSEGWARGSQSRTRRLSVDCSSCFRGESGSSRAGRGTDWERALRGLFPGRRTVNSELPNASSSNSDAHEWINEIPTVPVYYPAKPQPRERARRNQRGKKTLLSLTLVRLCEMTERCRISGSWKQRK

SEQ ID NO: 147239 - protein, 100 aa, Glycine max
  Coding DNA Sequence Number=SeqID_55554
  Subcellular localization annotation: CTP_CleavageSite=60; ConfidenceScore=5.61e-01
MHTQSFTIPQFPKIGLTHKNSPQWSRQLSQPTLLRASEARLTGASSKGGKCAESPPTFICGKRRKNRRKPVMKNNPDLGVVFTFEEGISTSHVCPKGQQP

SEQ ID NO: 147240 - protein, 111 aa, Glycine max
  Coding DNA Sequence Number=SeqID_55555
MGEVEEAQEQMKADMEAMREQMATMMGAMMSMKKIIQLQLPLPVLLLRQRFGKYEWPHDVQIQNEHAFPPYGLPLNYTPPNVAYTSNENVNNSTPIPIESQQPQTDHAHVS

SEQ ID NO: 147241 - protein, 123 aa, Glycine max
  Coding DNA Sequence Number=SeqID_55556
MRTRSPLKVRACSPLQARMCSPLMARTYSPLKIDCPFEKGDNSCNLVLSFVNLSGNSLRVDGVATYPSAGGRRVTRGMRVPRKEYARSRHQRLFEENVEKTGKDAIYELVLAPHTSVPRDGSL

SEQ ID NO: 147242 - protein, 105 aa, Glycine max
  Coding DNA Sequence Number=SeqID_55557
ESHPQRHPVDPEKSNRALGFPALVTGLYSPTGCPFPSARSRHHDIGLCQFYGVPVAPSKIIRPPTNRAFIKKYCVPRQAQGETPQQPGDGRQRATDAPPSPLEFT

SEQ ID NO: 147243 - protein, 163 aa, Glycine max
  Coding DNA Sequence Number=SeqID_55558
MGDQEETQEQMKADMSALKEQMASMMEAMLGMRQLKEKNAATAATVSSAAEADPTLLATAHHPPSNIVGRGRDTLGHDGSPHLGYNRAVYPYGLPANYSPPVLQDDAGHIASPVLEREPPQQPEEVHKDPQDYARRDVEFYPPIPEGPAPSTLPQPNIATQPI

SEQ ID NO: 147244 - protein, 92 aa, Glycine max
  Coding DNA Sequence Number=SeqID_55559
MPQNVLYDAIGIYQRCCSLLFSTERGGVSAQFGTQALQPDIALASVKPGCLRRCSVTHHPAALNCLPLRAAAFPFGTMSAAQLLNESANAGR

SEQ ID NO: 147245 - protein, 187 aa, Glycine max
  Coding DNA Sequence Number=SeqID_55560
  Subcellular localization annotation: CTP_CleavageSite=61; ConfidenceScore=5.67e-01
MVKVGTSYVPINVSFSPKVGPWAVFPCSSGVSWFLSAVPSCSVLTGIVIRSQFGTQALRPEASAGKCKAWGLPAFHSKPCRLRNCLNRPTRGRSRRAFAYYQLALKGGCVHTGDYYVGYTEPGCSQSECVRGRKKGCTGASVRICEYRTHYQGEFRSLSSYRSVSTAASAQNSGYNGRGIPGYSMLP

SEQ ID NO: 147246 - protein, 266 aa, Glycine max
  Coding DNA Sequence Number=SeqID_55561
  Gene Ontology: Biological process=transposition, DNA-mediated
  Homolog annotation: Hit_ID=Q6UUU1; Match level="QueryCoverage=22%, HitCoverage=40%, E-value=3e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPVTTFLIDQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 147247 - protein, 101 aa, Glycine max
  Coding DNA Sequence Number=SeqID_55562
MDLKENCTYVMHNFKVLKNNGQYRVCDHQFKLVFIEVTVVRQCALDDLPFRKYRFAEFGDVVARQFELGLLVDVIGVVDEVVFRHVSGKGRRVVFKLKDLR

SEQ ID NO: 147248 - protein, 97 aa, Glycine max
  Coding DNA Sequence Number=SeqID_55563
MVTRSVKFRNVAETKRKNCYAIRSLVPSSFFHQKVVASRGSNLARLGELGGKLLPYFAINRGRDEEGRGSAFLALRILLKLLRKIVSVKKIQAEALP

SEQ ID NO: 147249 - protein, 90 aa, Glycine max
  Coding DNA Sequence Number=SeqID_55564
MTQPPPCERTLREMAAPDFTYESLCIQYPNENVPYVLKTGLIHLLPKFHGLAGLSNMERSMIDVASGGALGDITPAEARNLIEKMASNSQ

SEQ ID NO: 147250 - protein, 137 aa, Glycine max
  Coding DNA Sequence Number=SeqID_55565
  Gene Ontology: Mol. function=chloramphenicol O-acetyltransferase activity; Biological process=response to antibiotic
  Homolog annotation: Hit_ID=P62577; Match level="QueryCoverage=21%, HitCoverage=13%, E-value=2e-10, Identity=100%"; Hit description =Chloramphenicol acetyltransferase
  Subcellular localization annotation: CTP_CleavageSite=46; ConfidenceScore=5.17e-01
MVKVGTSYVPINVSFSPKVGPGLPAVPPVQLLTGWCVTAKAPPDISAGKCSGHAARRVPFAIQAAQLLGRAIGAGLFAITPAGERGMCCKAIKLGNARVFPVTTLNSMEFRMAMKDGELVIWDSVHPCYTVFHEQTE

SEQ ID NO: 147251 - protein, 119 aa, Glycine max
  Coding DNA Sequence Number=SeqID_55566
MAQLISDAIHYLQGSRPQDTQWTRRSPIGPWGFQLWLWASVSPTGCPFPPARDHARKTPVDLKKSNRVLGFPALITGLCQFYGVPVAPSKIIMPPINRTFIEKYYAPGKRRARHHSSGQ

SEQ ID NO: 147252 - protein, 154 aa, Glycine max
  Coding DNA Sequence Number=SeqID_55567
  Gene Ontology: Cellular component=mitochondrion
  Homolog annotation: Hit_ID=A7QD24; Match level="QueryCoverage=70%, HitCoverage=80%, E-value=1e-28, Identity=59%"; Hit description =Chromosome undetermined scaffold_79, whole genome shotgun sequence
MGLTLYLGMKRGKIACHKSEARFVTLLREGRLASRASRDEAFWRSQVNFGPPNPATDEKAYGVKGSVYVVTLPAFKRGTGDGHLEAHHDLQARPARPGKATRLGVRGSIVPAAPRTSSSSFLKAGGKDLLSATEKNGAYLTQHNQTGYESNQSG

SEQ ID NO: 147253 - protein, 255 aa, Glycine max
  Coding DNA Sequence Number=SeqID_55568
VDPWVHALAFRGLHVLTFRGLHVLTFRGLRILTFRGLHILHFRGLHVLAFRGLHALVFIPWPPPDIGGRPTVRAQPEREAITLLLYIPGQDFTRAAAKRRVRIVCTNMTTLTQIQMTLLLRNILPNDHNADLPRDRAHKTPSGPGGAQQGPGVSNSGYGPLSVIQGITPARHPVDPEKSNGVLELPALITGLCQFYGVPVTPSKVIRPPTNRAFIKKYCSPRQVQGETPQQPGDGRQRATNAPPPPLEFTSAHPQ

SEQ ID NO: 147254 - protein, 66 aa, Glycine max
  Coding DNA Sequence Number=SeqID_55569
MLLSNNVIYICVRVVMLVRMVRTRLFAAARLAILEDQRVTQELIKGNYWPLNQECKSRLSIRGRGP

SEQ ID NO: 147255 - protein, 222 aa, Glycine max
  Coding DNA Sequence Number=SeqID_55570
MLESLKQQQEMSVLELYIEKDVAGGSMFQSANSLTSCGNYLSNNETQPPTNMSNLHLDEDDDHNDDDYLVSKSNVEESLDEDDNVDGISDTDNEVPDMIPPVRIVHPAEGVQEIQNPFWNDALHYNNINWSHPDEEDICGLEMPSSFNVGQELYVGMEFDSKDAVKNAVKQYAMKVHQSFKVVESKWDKYVVCCLNKNADCPCPFYMRAILSKKTDSWKVTQ

SEQ ID NO: 147256 - protein, 92 aa, Glycine max
  Coding DNA Sequence Number=SeqID_55571
MAQERTRMSCVLLEQVRNQPNTEGGYFRGRPAMPFRVCFMRSKPLAESLTTVAILLKEGRHPEERYGFLPPRGHPRISSILQWLVLIGSLRM

SEQ ID NO: 147257 - protein, 77 aa, Glycine max
  Coding DNA Sequence Number=SeqID_55572
EEIYPQEEGQPLVVKDKCKETLASIATPLGLEFIPQVKKLLDEGLPMDPERIKVIPEWPTPPCVEERIHEFQEPLDL

SEQ ID NO: 147258 - protein, 93 aa, Glycine max
  Coding DNA Sequence Number=SeqID_55573
MGSYGGHSSIREGDTPIWVSADYMEWFFQISHPFMIPTQAGDQPRHAPAPNHEDYMQPDIPQVPVAFDPPRHAVMITKAMRRSKAKVGAFAQP

SEQ ID NO: 147259 - protein, 179 aa, Glycine max
  Coding DNA Sequence Number=SeqID_55574
MPSASILRKIRFDSESPPRIGSYQPCRVSKGRGAPAARQYRSTLSPAALEGEGQERIQAEVRAQQLRCFSNRISGLPPGGEKTGFVMKADFQSQKRAEYLENLFRLFLFTGELPRGQRPAQSYRQLALRAFDAAVQHELRLVVANDPTGLQAAKGAAVAERIHRFQHAGLAAAVGADQE

SEQ ID NO: 147260 - protein, 29 aa, Glycine max
  Coding DNA Sequence Number=SeqID_55575
MQSSSRPPGCARNCPSIDDQPGAKRSSLP

SEQ ID NO: 147261 - protein, 122 aa, Glycine max
  Coding DNA Sequence Number=SeqID_55576
MLGFTRDSPQISASPHQLDLAPYALRSYSAQWNAPGILHDKHTLRSSRILGKMEVEETLQGLWLPLHYRVDMGASQHRTPELGWVLWFDVGMVYVDNWVVGKEMGCYWLSNDIVGLLGNSAI

SEQ ID NO: 147262 - protein, 18 aa, Glycine max
  Coding DNA Sequence Number=SeqID_55577
MDTRLRVIGDPMNGVQRY

SEQ ID NO: 147263 - protein, 116 aa, Glycine max
  Coding DNA Sequence Number=SeqID_55578
PPESILSVEQFIEKVSWPGTLLSTVGEGEGPQCSGVEMRPEGATFSEPIVPAIHETIEADPPTPVHERPIDLPTPIMEMPEDPTTPVLRQSSTPPATPVLHLTDKEDMQDQDTQGT

SEQ ID NO: 147264 - protein, 208 aa, Glycine max
  Coding DNA Sequence Number=SeqID_55579
  Homolog annotation: Hit_ID=Q6WAY6; Match level="QueryCoverage=25%, HitCoverage=9%, E-value=8e-10, Identity=53%"; Hit description =Putative uncharacterized protein
ELDRQRQVENGVVGIPRKYLEGVLFPNVDGLVDLAAIDVFLAYHNHKESPLSMWGWFHTFFSKKVGPSIRYKEGRIRILSSCEGCPNVPLMGTRGCINYNPVLTIRQLGYPMRGAPLDESITPFIARGFSDHNARDRELRGSSNGIIGGYHKWLRVRTQGLDWLPNLKTVRDDEVKASEESDEVQALKAELERARVVEEKFKSIAIKV

SEQ ID NO: 147265 - protein, 168 aa, Glycine max
  Coding DNA Sequence Number=SeqID_55580
  Gene Ontology: Mol. function=2-polyprenyl-6-methoxy-1,4-benzoquinone methyltransferase activity; Cellular component=mitochondrial matrix; Biological process=ubiquinone biosynthetic process
  Homolog annotation: Hit_ID=Q1R9I4; Match level="QueryCoverage=99%, HitCoverage=69%, E-value=8e-76, Identity=78%"; Hit description=3 -demethylubiquinone-9 3-methyltransferase
  Pfam annotation: Domain name=Methyltransf_11; Domain location=1-84; Score=47.1; E_value=6.3e-11; Accession=PF08241.3; Description =Methyltransferase domain
  Pfam annotation: Domain name=Methyltransf_12; Domain location=1-82; Score=19.4; E_value=0.008; Accession=PF08242.3; Description =Methyltransferase domain
  Pfam module annotation: Pfam domain module=Methyltransf _11::Methyltransf_12; Domain location=1-84::1-82
MAREGAEVTGLDMGAEPLEIARLHALESGVSVNYVQQTVEAHAASHAGQYDVVTCMEMLEHVPDPRSVVLACAQLVKPGGEVFFSTINRNPKAWLLAVFGAEYVLRMVPRGTHDVKKFIRPAELLNWVDETALRERNMTGLHYNPLTNQFRLGRRVDVNYMVHTHRQA

SEQ ID NO: 147266 - protein, 110 aa, Glycine max
  Coding DNA Sequence Number=SeqID_55581
RFQGKHPVLNSASNSSCNFLIQIAIAQISEWTVARGIHTHRNFPLAYLSQKQKAVQENDEDLEFEDIELESEEEEIMDNFEASDGEEGEGDAPLPYDNNEEDYVGIEEDD

SEQ ID NO: 147267 - protein, 62 aa, Glycine max
  Coding DNA Sequence Number=SeqID_55582
  Subcellular localization annotation: CTP_CleavageSite=23; ConfidenceScore=5.21e-01
LTGSGVYPDLSSLTGSGVYPDLSSFTGSGVYLDLSSFTGSGVIQTFVACIKRSSLLFEFCLG

SEQ ID NO: 147268 - protein, 149 aa, Glycine max
  Coding DNA Sequence Number=SeqID_55583
MGKDCTPQRHPSGPEEVQTGPWGFQLWLRASVGPTGRPFPPASSCRRGIGIVPARHPVDPKKSNRVLELSSSNYGSLSSCPPTNRAFIKKYCVSRQAQGETPQQPGDGRQRRTDAPPSPLEFTSAHPRKGLSIAYTTWPTNRRPSPKPK

SEQ ID NO: 147269 - protein, 98 aa, Glycine max
  Coding DNA Sequence Number=SeqID_55584
  Homolog annotation: Hit_ID=Q6UUU1; Match level="QueryCoverage=81%, HitCoverage=54%, E-value=5e-33, Identity=86%"; Hit description =Putative uncharacterized protein
MAYERGGNFLEDARKILNREVRGPRQSRFSIGSAPLTSITKSDAQISGGETRQDYKDTRRFPLAAPSCALLFLPFGLPVSFRCYGRVCLIPRLTLSSG

SEQ ID NO: 147270 - protein, 133 aa, Glycine max
  Coding DNA Sequence Number=SeqID_55585
  Gene Ontology: Mol. function=structural constituent of ribosome; Cellular component=ribonucleoprotein complex; Biological process =translation
  Homolog annotation: Hit_ID=Q6D138; Match level="QueryCoverage=100%, HitCoverage=88%, E-value=1e-46, Identity=75%"; Hit description=50S ribosomal protein L9
  Pfam annotation: Domain name=Ribosomal_L9_C; Domain location=62-133; Score=93.7; E_value=6e-25; Accession=PF03948.5; Description =Ribosomal protein L9, C-terminal domain
  Pfam annotation: Domain name=Ribosomal_L9_N; Domain location=1-48; Score=102.3; E_value=1.5e-27; Accession=PF01281.10; Description =Ribosomal protein L9, N-terminal domain
  Pfam module annotation: Pfam domain module=Ribosomal_L9_C::Ribosomal _L9_N; Domain location=62-133::1-48
MQVILLDKVANLGSLGDQVNVKAGYARNFLVPQGKAVPATKKNVEFFEARRAELEAKLADVLAAAEARATKINELGSVTIASKSGDEGKLFGSIGTRDIADAVTAAGVEVAKSEVRLPNGVLRTTGEHEVHFQ

SEQ ID NO: 147271 - protein, 141 aa, Glycine max
  Coding DNA Sequence Number=SeqID_55586
MHKALWANAPLPYPHLITLFLRHFQIPLHDEPFVQVKRSFAIGAGAMTSFGYRKDRNGQWLKKDALPPQDERTPSPLPQRDDSALMNEVLSELQGLRSYVGDRSDSLDTRFAGMDILLTQLEEDVGYIRQSFDLPPLPPPS

SEQ ID NO: 147272 - protein, 369 aa, Glycine max
  Coding DNA Sequence Number=SeqID_55587
  Homolog annotation: Hit_ID=Q84VH5; Match level="QueryCoverage=100%, HitCoverage=55%, E-value=1e-151, Identity=75%"; Hit description =Envelope-like protein
MATSPKETSAPGSPSAPSNQERPEFNIQPIQMIPGQAPVPEKLVPKRQQGVKISENPSIATSPREVDPEMDKKIRSIVSSILKDASVPDAGEDVPTSSTPNVSVPDVDKDVPTSSAPNAEALPSPSEEESTEEEDQASEETPAPRAPEPAPGDLIDLEEVESDEEPIANRLAPGIAQRLQSRKGKTPIKRSGRIKTMAQKKSTPITPTTSRRSKVAIPSKKRKEISSSDSDDDVELDVSTSKRAKKSGRKVPGNVPDAPLDNISFHSIGNVEKWKYVYQRRLAVERELGRDALDCKEIMDLIKAAGLLKTVTKLGDCYESLVKEFIVNIPSDITNRKSDEYQRVFVRGKCVRFSPAVINKYLDRPTDGV

SEQ ID NO: 147273 - protein, 266 aa, Glycine max
  Coding DNA Sequence Number=SeqID_55588
  Gene Ontology: Biological process=transposition, DNA-mediated
  Homolog annotation: Hit_ID=Q6UUU1; Match level="QueryCoverage=22%, HitCoverage=40%, E-value=3e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGIRSTPCLRRHLTSLKWNLAHAKQCIRETLVWREEVYIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 147274 - protein, 281 aa, Glycine max
  Coding DNA Sequence Number=SeqID_55589
  Pfam annotation: Domain name=Transposase_23; Domain location=47-117; Score=5.8; E_value=0.00027; Accession=PF03017.5; Description =TNP1ENSPM transposase
HGILQPASVANAISGTCSASEPLVGPSGPQVSTKGSCVDPSGNDIETGDSDRCSLYIEADPARLVAIGRVYEGSTVVHNTPLLPGQVKVSVEEVTDADAPVPVPTDEVSLVGQTLHTFLTWPTHLVKSLSQQVVVSPAKPPPKLDPEVRWDATVFGVFNLDFPLYIKHEDLSEIAHGGQCLSILVLQLWILHFTETCMRVGNSDIYGFLEPQSIQRSGQSQFESESYIKSWMQSSQCDVYLGAYLNGPDNYLKGIINSAIKGLDDAPQPKSKASARWIVIK

SEQ ID NO: 147275 - protein, 67 aa, Glycine max
  Coding DNA Sequence Number=SeqID_55590
THLLLEVASPLSLPFSIPLSFIFQEAKESIDEEDPRPTSSNGAYTIRGLFKALDLKMIHFYLVRKTE

SEQ ID NO: 147276 - protein, 112 aa, Glycine max
  Coding DNA Sequence Number=SeqID_55591
MFLLVFYMHRSTTGNLVPLDLEIEATLRRNRAKRRRKLLQDKTVASILEEETHFSDSTSSDSPSSRESATYLPEAVSMADEHQQRVTLKHYSSSLVPQFFTNIAYPEVHAHN

SEQ ID NO: 147277 - protein, 159 aa, Glycine max
  Coding DNA Sequence Number=SeqID_55592
  Pfam annotation: Domain name=G-patch; Domain location=2-41; Score =16.6; E_value=0.0019; Accession=PF01585.14; Description=G-patch domain
MARVMLGNGYEPGMVLGKDNGGITSLIKTQGNRGKYGLGYKPTQADMKRSIAGRKNSGQSSRWKQESEGNLPCHISRSFISAGLGDEGQVVAICEDDVPSTLDLVRPCPPDFQLGNWRVEERPGIYATSIIFDDESPEGTNTWDPSINFEQEMNQTEDE

SEQ ID NO: 147278 - protein, 106 aa, Glycine max
  Coding DNA Sequence Number=SeqID_55593
  Subcellular localization annotation: CTP_CleavageSite=27; ConfidenceScore=5.16e-01
MVKVHWNLLRADQRLIFAKSFGPRACPVSTGSGQTGFWRKVRRVMPTYDSLVYDGVISRCSSGVSVVYQLFPPVSTESGWYPLTIPHKHTRRNISAGKCKAWGAKT

SEQ ID NO: 147279 - protein, 108 aa, Glycine max
  Coding DNA Sequence Number=SeqID_55594
MDNHLGISACHLTSRVKIAKGGAVDKREAFAPTYPQFVMRNSDLRVSACYQTLGSLDSKRCVRVTIECLRMPPDSWVTVTKGGVVDKSMAFAPTYPQFVMRNSYLRSS

SEQ ID NO: 147280 - protein, 133 aa, Glycine max
  Coding DNA Sequence Number=SeqID_55595
  Subcellular localization annotation: CTP_CleavageSite=52; ConfidenceScore=5.01e-01
MYPSLFSLNLVDPPLELIHKRCTLSCSQSTTQVDVPSTCTTKDVPSNVLRQRSQAVKPLILCEWGYKRIIKREKGDTKEFRLLVLDEFILAKGEENEKMNSTSFQGLENQKTSESFWYKEEEEVQRDSRLVKD

SEQ ID NO: 147281 - protein, 93 aa, Glycine max
  Coding DNA Sequence Number=SeqID_55596
  Homolog annotation: Hit_ID=Q2A9Z4; Match level="QueryCoverage=91%, HitCoverage=14%, E-value=5e-07, Identity=38%"; Hit description=Zinc knuckle family protein
MTIEESIHDSFDESNAILPRKDFLDDISDSLEDTHIHGNDSKEKDEGSNEDSQDNGARGNNELPREWKASRDHPLDNIIGDISKGKNLKIILS

SEQ ID NO: 147282 - protein, 51 aa, Glycine max
  Coding DNA Sequence Number=SeqID_55597
  Homolog annotation: Hit_ID=A5BTM4; Match level="QueryCoverage=96%, HitCoverage=35%, E-value=1e-21, Identity=95%"; Hit description =Putative uncharacterized protein
MGRSRIGGQPPGESDVHGPGGGITPFSKEPYVRLSRHTAPSRNKDLPFPFL

SEQ ID NO: 147283 - protein, 287 aa, Glycine max
  Coding DNA Sequence Number=SeqID_55598
  Homolog annotation: Hit_ID=Q6WAY6; Match level="QueryCoverage=63%, HitCoverage=30%, E-value=1e-16, Identity=32%"; Hit description =Putative uncharacterized protein
AIDAFLAYHHSKESPVVAILADLFDTFDRRCEKISALIVCCLPALCVWLVSHLFQQDIRHPCPLQSYRSCVEKRRVDWDQYLARVGGSTINWFPRWKEGKEGVLFSCGDYPNVPLIGTRGCINYNPTLAIRQLGYPMRGAPMEESLSPFLVKDFGAQSLKIVQRVHKAWESPLRKDKELRGIRNGIIDGYHDWLRVHTRGLDWLSKLKIINEENFEAPEEDEETSGKSVPNYERKMWLPQEPSNEKPRGLAKKSMAEINSEELCRAATMSSSSGERKETSHEYMAWS

SEQ ID NO: 147284 - protein, 167 aa, Glycine max
  Coding DNA Sequence Number=SeqID_55599
  Homolog annotation: Hit_ID=Q5NRP4; Match level="QueryCoverage=37%, HitCoverage=4%, E-value=8e-07, Identity=42%"; Hit description =Putative gag-pol polyprotein, identical
  Pfam annotation: Domain name=zf-CCHC; Domain location=97-114; Score =21.9; E_value=0.00072; Accession=PF00098.14; Description=Zinc knuckle
MKREKHASYSSHNSCKSLSEELHDYYEGRHRSHLRPHSHRRERKESLKRLTLTSHTSMKDQGQGMLGVTPSKPKDDKGKIIEKQAPKASMQEKTSSIRCFKCLGRGHITSQCPTTKTMIMRGQDIYSSQDEASTSPSFSESEEAKGEESSEEIYPQEEGQPLVVKEK

SEQ ID NO: 147285 - protein, 53 aa, Glycine max
  Coding DNA Sequence Number=SeqID_55600
MWYYVSEKPRRAPRSTLQDKPHTSKSGLKEHSNRVTPKAYTPKSPSGPLPSDT

SEQ ID NO: 147286 - protein, 215 aa, Glycine max
  Coding DNA Sequence Number=SeqID_55601
NHPASIKLWTLLFKAKHCSTEWPGVPPWYVQVALGWQEFPIRYWDRAENLSLPLLEVPRRVGACPKVSIVGRVRPGWSRSLKSPPPCGGVGVLGWASAVSEEAPARAEKLGDGMGISLFLFCPIYSGPPTDGTYRGEVIKLSPLQTHLDPFSGENQVREAGGHVPLTLSVFFKGLMFPLNHVLQLSPVGSHVRVVLILPKEGCNQILPGVDAGSF

SEQ ID NO: 147287 - protein, 138 aa, Glycine max
  Coding DNA Sequence Number=SeqID_55602
MRFWMYSISLLNDHLEETLGSTKIEENHSKCINLTRCEANKSPTHRILVGNQRERTTSGQGLTFSPWVKVYGKLGFWLKACRTAGHDMRQGLVWFRDKGDVPHYFHDINATMMIWKFYAKLVMHAPMGTLKHQVFMVM

SEQ ID NO: 147288 - protein, 285 aa, Glycine max
  Coding DNA Sequence Number=SeqID_55603
  Homolog annotation: Hit_ID=Q6WAY6; Match level="QueryCoverage=64%, HitCoverage=30%, E-value=2e-17, Identity=32%"; Hit description =Putative uncharacterized protein
MLADLYDTFNRRCEKSSTRIVCCTPALYVWLVSHLFRQEVRHACPLESHCSCTEKGGENWGQLLANKEGASVNWFPRWKEGRTRVLISCGVFLNVPLMGTRGCVSYNPILAIRQLGYPMRGAPLEEKIAPVISRGFNKTNVEKLQKVRKAWEVVRKKDKELRGSNNGPIGGYRKWLKAHVQGLDWLPSLRTAKREEVEAPKEDEEVQALRTELKQARTVKERFKSETLKIRKENAELRDINIPPRPWNKRPRGLVGKSTAGTSSEGLCGAVTASLSSRERKGTNH

SEQ ID NO: 147289 - protein, 32 aa, Glycine max
  Coding DNA Sequence Number=SeqID_55604
MADGKMIKMKGRINLGLKRLWESLGCAKEENE

SEQ ID NO: 147290 - protein, 63 aa, Glycine max
  Coding DNA Sequence Number=SeqID_55605
MKQVIALSASTMVLQSPLEKEHDHVTDYLACDEELDDPKDNSVGHVLLAEERRGSTGADSKKP

SEQ ID NO: 147291 - protein, 102 aa, Glycine max
  Coding DNA Sequence Number=SeqID_55606
MEIYPSCFGERAATEVDSLSAKLTNITDLSGVTRSGQVFAPPHLAELPSKGKAPMTQESLGAATPSKEVDPPIVKGAEKKEDLQGRAMTLQEAHEFLRLIQQ

SEQ ID NO: 147292 - protein, 143 aa, Glycine max
  Coding DNA Sequence Number=SeqID_55607
MASRKRKSTASQSWEPYDTTRFISEVAWERYSQNVHSRNILLERNVILYVNDYDEFHRELERRCWHKALTRQLDGHIDVALVKEFYSNLYDPKDKSLKQVRVRGKLIKFDVESLNTFLKTPVILEPGELYTTYTRFCHSRPDP

SEQ ID NO: 147293 - protein, 105 aa, Glycine max
  Coding DNA Sequence Number=SeqID_55608
MSGFTRDSPQISASPHQLDLAPYASEPYNAQWNAPGLLRDSTRCVRVLFSEKWRLSRCKFFLGGALGCAKVMSSWSAETDFVVFRMACDTGVVESCMLYACGVEL

SEQ ID NO: 147294 - protein, 238 aa, Glycine max
  Coding DNA Sequence Number=SeqID_55609
  Gene Ontology: Biological process=transposition, DNA-mediated
  Homolog annotation: Hit_ID=Q6UUU1; Match level="QueryCoverage=25%, HitCoverage=40%, E-value=3e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGKMVPAIPSIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 147295 - protein, 218 aa, Glycine max
  Coding DNA Sequence Number=SeqID_55610
MAPKKLPAKRSRRDAAAEGTSAAPEFDSHHFRSAEHHQRFEAIKGWSFHRERRVQLREDEYTYFQEEIARRHWTSLVTPMAKFDPEVVLEFYANAWPTKEGVRDMRSWVRGQWILFDADALSQFRGDPQVSEEGQECEFSQRRNRADGFDKEAIAQLLCTPGQDFSRTAAGRRVRIMRTSMTTLTQTWMTLLLSNVLPSDHNVDLPLRMYQLVCAVMT

SEQ ID NO: 147296 - protein, 64 aa, Glycine max
  Coding DNA Sequence Number=SeqID_55611
MATIALSSRYGSKLVYDTGIWGEPYRLFAAKFISWLEWQSQHGFLPHPHPLYLPQFSHSSKQDD

SEQ ID NO: 147297 - protein, 127 aa, Glycine max
  Coding DNA Sequence Number=SeqID_55612
MTRGNPSDLQPFDLEIDRTFHRLVRHHFIPFDHLEHSITGESVHSVIGDFEHPDLEHYNFEHSDSEHSDFEHSENMAQPPPRERTLREMVAPDFTYESLCIQYPDEDVPYVLKTGLIHLLPKFHGLA

SEQ ID NO: 147298 - protein, 72 aa, Glycine max
  Coding DNA Sequence Number=SeqID_55613
MDNEEGVQEQMKADLSALKDQMTSITEAMLKLQKTIEDNATAAASNTAREAEPVLQPSINLGRDRNTTVFGR

SEQ ID NO: 147299 - protein, 163 aa, Glycine max
  Coding DNA Sequence Number=SeqID_55614
IPLDSIHMFWRRLSFSDQGLCEAEVTIKEEIETISKIFEELDVYGKVTLKNKLREIAYPDQNSMCPPPSKVNTKVKHSTSSSNQPKPTRIIPMLDQFEPFIQGFIDNIVDVKADGMGEDSWSLVRNQLVKELGKWSDDYINLFGGTDRFDELRRSLLVDGFSK

SEQ ID NO: 147300 - protein, 154 aa, Glycine max
  Coding DNA Sequence Number=SeqID_55615
MTSSKVYASFMAHLSAYIADNKKQANTMAVKIEKAAIAVVEKGKNDKCNCRNQKNDYYDRRKRKIVATSVEKKVMATDVIKEKGKVMDNATIKEKEKVMDIDAIKEEKEIRDDKEKSKDVFQQKCFEKPMPLGFKMMESQDPLEEINMGTEIEL

SEQ ID NO: 147301 - protein, 43 aa, Glycine max
  Coding DNA Sequence Number=SeqID_55616
GQDRLGLPFGVLKDERKRGWGHDRPIVTLLCAKQAGNVAARQP

SEQ ID NO: 147302 - protein, 290 aa, Glycine max
  Coding DNA Sequence Number=SeqID_55617
  Homolog annotation: Hit_ID=Q6WAY6; Match level="QueryCoverage=96%, HitCoverage=46%, E-value=3e-30, Identity=32%"; Hit description =Putative uncharacterized protein
MVEEFEEILGCLLGGRKPYLFSGFYPSLARISKIVQISAQELDHRKQVENGVAGIPRKYLEAKARILAGKGEWAPFIDILALLIFGGVLFPNVDGLVDLAAIDAFLAYHNHKESPVVTMLADLYDTFVRRCEKSNTRIVCCTPTLYVWLVLHLFRQEVSHACPLESHRSCTEKGGPNWDQLLVSKERASVNWFPRWKEGRTGVLISYGGFPNVPLMGTRGCISYNPVLAIRQLGYPMRGAPLEDELAPVISRGFNKTNVETLQKVRKAWEVLQKKDKELRGSNNGPIGGY

SEQ ID NO: 147303 - protein, 95 aa, Glycine max
  Coding DNA Sequence Number=SeqID_55618
  Subcellular localization annotation: CTP_CleavageSite=64; ConfidenceScore=5.43e-01
MTGNGVIRSNSAHKHTDRNISAASVAWGALRLTLTLTPAALNAAATGRCPSPSVRNVGKDLSVRAFRIKNANAARGMCASLRNWVTLRSVPITAY

SEQ ID NO: 147304 - protein, 107 aa, Glycine max
  Coding DNA Sequence Number=SeqID_55619
CERQPGGTAVLIGIWDGGRCFPFEESEWAQTRYDQLNLIEGKRLTAHESWALIPAKNEECIRQERLFPGGALVLTDMDGEELPSPGQDHLGLPSGVKTKHEWQKPVK

SEQ ID NO: 147305 - protein, 249 aa, Glycine max
  Coding DNA Sequence Number=SeqID_55620
  Homolog annotation: Hit_ID=Q2HW90; Match level="QueryCoverage=49%, HitCoverage=29%, E-value=9e-13, Identity=35%"; Hit description =Putative uncharacterized protein
MEPIASLSQYYDQPLRCFTFEDFQLVPTVKEFEEILGCPLGGRKPYLFSGFYPSTTRVAKVVKISAQELDHANGLSFIDILALLIFGVVLFPNMEGLVDLAAIDAFLAFHHGKESPVVAILAMYDTFDRGCEKSGTRIEGRIRILSSCEGCPMRGVPSDESITPFIARGFSDHNARDRELRGSSNGIIDGYHKWLRVRTQGLDWLPNLKTVRDDEVKALEEIDEVQALKAELERAWVVEEKFKSIAIKV

SEQ ID NO: 147306 - protein, 280 aa, Glycine max
  Coding DNA Sequence Number=SeqID_55621
  Gene Ontology: Biological process=transposition, DNA-mediated
  Homolog annotation: Hit_ID=Q6UUU1; Match level="QueryCoverage=21%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGFHHVGQTDLELLTSGDLPALAFHQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 147307 - protein, 264 aa, Glycine max
  Coding DNA Sequence Number=SeqID_55622
  Gene Ontology: Mol. function=helicase activity; Biological process =protein amino acid phosphorylation
  Homolog annotation: Hit_ID=A2Q378; Match level="QueryCoverage=32%, HitCoverage=5%, E-value=2e-14, Identity=41%"; Hit description =Putative uncharacterized protein
  Pfam annotation: Domain name=DUF889; Domain location=1-159; Score= -84.2; E_value=9.1e-06; Accession=PF05970.5; Description=Eukaryotic protein of unknown function (DUF889)
MLPNNEELKQFSHWLLDIGDGKIGQYNDGFSEITIPDEFLIKNYDDPIHAIVEATYPSLIDNYSDTNYLQKRVVLASKKEIVDKITTFSKFLSPITDNGCATTPNMFYSTMMARYISLGRAHNLNESVILRLVAGDKNTTFTVHIDGPAHHHSSLKPIIYRRRYIFIVDITDDMLQQNLPLTLPAAASKFVYGSKKSITIHHGLSKSTKWPLTIQHDIPAITQPWFNLIHEKNLRPGDEVVFYYRFHDHAWELLIRKAIEWTIL

SEQ ID NO: 147308 - protein, 104 aa, Glycine max
  Coding DNA Sequence Number=SeqID_55623
MGIAPTKTPSGPKEVQQALGFPALVTGLCRPYRAPVPPSSLCHHDLGIVPTKHSVDPKKANRFYGVPVAPNKVIRSRINRAFIKKYCAPRQAQGETPHQHWDGR

SEQ ID NO: 147309 - protein, 78 aa, Glycine max
  Coding DNA Sequence Number=SeqID_55624
MDLSPAPSTRSMENSTSLSGGKPDMLMLLHVELMPLQGEDESRTSSPPQKAMDKSLKIGEDEWREKERRSTKFYASNE

SEQ ID NO: 147310 - protein, 260 aa, Glycine max
  Coding DNA Sequence Number=SeqID_55625
  Gene Ontology: Biological process=transposition, DNA-mediated
  Homolog annotation: Hit_ID=Q6UUU1; Match level="QueryCoverage=23%, HitCoverage=40%, E-value=3e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGIRYKARQPPALLEFGFRGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 147311 - protein, 174 aa, Glycine max
  Coding DNA Sequence Number=SeqID_55626
MAPTRHPLDPDKSNRALGFPALITGLCQSFGVPVAPTKVIQSPITRAFIEKYCTQRQAQGDAPQAADAPPPYQAGQAGSFDTERYLRHLVREQAANHRAHVQTHDCLYQLSLSMQSQGFASFSCPTPDQFRAEVAWPEAQAGEAPPEAPGDGEEAHEDEEMADLLDFLGGSGAT

SEQ ID NO: 147312 - protein, 215 aa, Glycine max
  Coding DNA Sequence Number=SeqID_55627
MEGGAVNAIKVSGSHGPKLLEDVKTPRRFIYKALQEVGMIPSGERREDSCLMHPGVLHDMETCSAVRDLLQWMIDQGRLEVGSEREEEQHVCMQSADEEGPKKPKPLVIHFTRNTATQRPQHPSAVLGGRSISFPYKNSHAVPWRYAPPGGRKEEATDISSLSAKVTNITELSSITRSGRVFAPPSLPIQPVNTKGKARMTEGQNVKEIPTPDED

SEQ ID NO: 147313 - protein, 232 aa, Glycine max
  Coding DNA Sequence Number=SeqID_55628
  Homolog annotation: Hit_ID=Q2HW90; Match level="QueryCoverage=90%, HitCoverage=40%, E-value=1e-23, Identity=34%"; Hit description =Putative uncharacterized protein
MASQRSGPVCGYTSFVIFGVVLFPNVDGLVDLAAIDAFLAYHHSKESPVVAILADLFDTFDRRCEKNSAWIVYCLPALCVWIVSHLFQQDTRHPCSLQSYRSCAEKGRVDWDQHLAAIGGNAINWFPRWKEGKEGVLFSCGDYPNVPLIGTRGCINYNPALAIRQLGYPMRGAPTEESLSPFLMRDLGAKSLKVIQRVHKAWRSPLKKDKELRGIRNGVIGGYHGWLRVHTR

SEQ ID NO: 147314 - protein, 78 aa, Glycine max
  Coding DNA Sequence Number=SeqID_55629
MCPFAGERRGGSRVRFPKEERCAEPPPTVICGKRRENRREPVKMKILSSGVVFTFEEGRQKRGFCSYVPSIEEEIRPT

SEQ ID NO: 147315 - protein, 53 aa, Glycine max
  Coding DNA Sequence Number=SeqID_55630
MTKARQKGYGKGKEVVVAAQLAEASWVASTRRHRLLWEDPGRPKWAWLLILFS

SEQ ID NO: 147316 - protein, 283 aa, Glycine max
  Coding DNA Sequence Number=SeqID_55631
  Gene Ontology: Biological process=transposition, DNA-mediated
  Homolog annotation: Hit_ID=Q6UUU1; Match level="QueryCoverage=21%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPEFDHSDDSDESSDDDDEEEEEEEDDANPNWEALKSSLSIPSTSRGGPVPAFVPFSEVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 147317 - protein, 143 aa, Glycine max
  Coding DNA Sequence Number=SeqID_55632
MAAQFIHDRVEMECLEGVWETLEGNARCRFCGTIRLTATSLVHPEEPARTLQRTVEWILPTPTSYLLVEPVQVIEVTSSKEDHEEDLEELPPEPAVDALDFLEGDEDPLPEVDSPEDVMSASGADSTEESGPGGIATSGGSSS

SEQ ID NO: 147318 - protein, 167 aa, Glycine max
  Coding DNA Sequence Number=SeqID_55633
MGDQEETQEQMKADMSALKEQMASMMEAMLGMRQLMENNVATVAADEKGAHWGTPATPIWDTTGWLTLMDYHLITRHQSCVMTRVMSLPPSLKGSLLDSPPRFTRIIESMPKGMSISTPWSPSRGGTQCIASAQPHSTTNILVHRGTTLGGGRKKETQSHRGEIESC

SEQ ID NO: 147319 - protein, 106 aa, Glycine max
  Coding DNA Sequence Number=SeqID_55634
MGGTKRLLVIIPKVVISLLMVSRGIIPFEKHIAAVGTTSNNMLSKRKTLDEGLTLSKQSPVESPTVATYPSTGGQGETQGCVFQERKMRGVATNVYSRKTLEKPEK

SEQ ID NO: 147320 - protein, 43 aa, Glycine max
  Coding DNA Sequence Number=SeqID_55635
MSYFGVIEKIWELDYSQFRVPVFKYLNKVAYKDESFIMAEQAR

SEQ ID NO: 147321 - protein, 162 aa, Glycine max
  Coding DNA Sequence Number=SeqID_55636
MAPTRHPLDPDKSNRALGFPALITGLCQSFGVPVAPTKRQAQGDAPQAAGVPPPPHQAGQAGAFDIEQYLRHLVRQQAANHRAHVWTHDCLYQMSLSMQSQGFAPFSCPTPDQFRAEVAWPGDWPEAQAGEAPPEAPGDGEEAHEDEEMADLLDFLGGSGDT

SEQ ID NO: 147322 - protein, 171 aa, Glycine max
  Coding DNA Sequence Number=SeqID_55637
  Subcellular localization annotation: CTP_CleavageSite=50; ConfidenceScore=5.23e-01
MTSLLLISIDLSVKQGTYRSSTLYKASCNVSFTVAELWISTTYISSTLARVQVVSEDVALLSAGIVVAAFVAVVISMRPLRQRAGQLRAEHQVSQSDNIQFEKDTQHDRHSQECRHLSLSAAGGGTLLFRTDQAAICRSADGPARQDGHAALSQAAPEAGHMLGSIRMGER

SEQ ID NO: 147323 - protein, 213 aa, Glycine max
  Coding DNA Sequence Number=SeqID_55638
  Homolog annotation: Hit_ID=Q84VH5; Match level="QueryCoverage=100%, HitCoverage=35%, E-value=2e-98, Identity=79%"; Hit description =Envelope-like protein
MDLITAAGLLKTVTKLGDCYESLVREFIVNIPSDITNRKSDEYQRVFVRGKCVRFSPAVINKYLGRPTDGVVDITVSEHQIAKEITAKQVQHWPKKGKLFCREAECEIMQSCTRIGAANWVPTNHTSTVATESFAVKLPIAFPTVLCGIMLSQHPNILNNIDSVMKRESALSLHYKLFEGTHVPDIVSTSGKAAASGAVYKDALIAELKDTCK

SEQ ID NO: 147324 - protein, 65 aa, Glycine max
  Coding DNA Sequence Number=SeqID_55639
WDIIHERFDLYNQRLDGDGWVYFDNWLDDLCNNVFVELPMILSEHWRKTSVMTSGTLDNPFLMPL

SEQ ID NO: 147325 - protein, 25 aa, Glycine max
  Coding DNA Sequence Number=SeqID_55640
MGAKHLTRTKERSHVIKQRSPDEIR

SEQ ID NO: 147326 - protein, 144 aa, Glycine max
  Coding DNA Sequence Number=SeqID_55641
MEFVHYCTHDRYRGDTLRLSAPFCHPEAAGPMTSRDQVWSFCTHDTRRYLMVIRTPLPFRHSRVRWHAETKFGHSAPMIRGDTLRLSAPFCHPEAAGPMTSRDQVWSFCTHDTRRYLMVIRTLLSSRGGGPDDKQRPSLVILHP

SEQ ID NO: 147327 - protein, 108 aa, Glycine max
  Coding DNA Sequence Number=SeqID_55642
MELSQVQVQDISEEDYNEQMKVVYPQAEEDLIDFLNRCKLENKIVMLCPRCSAVCDREATEGLKKYQIVNKGAKQNQRFDKGKRVMVQSNTNQKSGRKNTFASSYFSA

SEQ ID NO: 147328 - protein, 280 aa, Glycine max
  Coding DNA Sequence Number=SeqID_55643
  Homolog annotation: Hit_ID=A5AZ88; Match level="QueryCoverage=28%, HitCoverage=9%, E-value=6e-08, Identity=33%"; Hit description =Putative uncharacterized protein
VVIHLANRIVAYPAGFIEDVLVRVGRPFMKTARTKIDVYAGTLSMEFGEIVVHFNILDAMKHPSEDHSIFCAEIIDQIVDDYMFDFDFVLHDRKYPFLSDLHTCHSLCIESESEFEFDLTSDFYAESEFEFQFDVVPLDVDFLESECTNHVAGSTYTSDLLYEIRDRSGAQNLMADHLSRIEHASEDSPIWDDFLDDHLLLGDAFQTTRLTRSFNSVILPHQVAILAYRGQLARWLTVVSIGPPSSRMRGESVALVSLVREQASLLHRDNKCLNNPCYSV

SEQ ID NO: 147329 - protein, 202 aa, Glycine max
  Coding DNA Sequence Number=SeqID_55644
  Homolog annotation: Hit_ID=Q5CDC4; Match level="QueryCoverage=20%, HitCoverage=32%, E-value=2e-15, Identity=100%"; Hit description =LacOPZ-alpha peptide from pUC9
  Subcellular localization annotation: CTP_CleavageSite=84; ConfidenceScore=5.08e-01
MVKVGTSYVPINVSFSPKVGPGLPGINRDTRIYLFCEHRRTSALASVAVTLRVTTTPAALNAPLQGASHSPFRLRNCWEGRSVRASSLLRQLAKGGCAARRLSWASRGTLTVTTAVVEKVAARVAAQSEGFGAPTSSFFGSGSRADQAYRYRRPRGGARYQLLFPLVRVNFELGVIMVIAVSCVKLLSAHNSTQHTSRKHKV

SEQ ID NO: 147330 - protein, 231 aa, Glycine max
  Coding DNA Sequence Number=SeqID_55645
MAPRKLASKRSRKDKAAEGTSSTPDASRPSRDDHFSGSDASSSGTMIIPISRKNRSPAVGITGYPHGQWIPFDADAIGQLLGYPLVLEEGQECEYGQRRNRSDGFDEEAIAQLLCIPGQDFARTAARRRVRIMRTNMTTLTQIWMTLLLSNILPTDHNSDLPLPKYQLVYAILTRMSIHVAHLIADAIYIFAGMAPTRHPLDPDKSNRALGFPALITGLCQSFGVPVAPTK

SEQ ID NO: 147331 - protein, 120 aa, Glycine max
  Coding DNA Sequence Number=SeqID_55646
GKGLFSAGALTRTSVFPLLVGGPVVPMPPRFPYIGILKHHHERYRAFACGAVRHHPVVPAANSGVSMKKGEVSGFFRRTGSEALCRGGGTGKETAPKKEMEVPNASPRPTRCANLGMLYS

SEQ ID NO: 147332 - protein, 45 aa, Glycine max
  Coding DNA Sequence Number=SeqID_55647
AHENPMAFSCISGPIFLESSIQCPYGVGLHHSLPLEKDLASNLEK

SEQ ID NO: 147333 - protein, 124 aa, Glycine max
  Coding DNA Sequence Number=SeqID_55648
MVGYAPSSFADLVFAGERVEADLKSRKFNHPAWTNEKTGANEEGEDEGETHDVTAIPIRPSFPPTQQCHYSANNNPSPYPPPIYPQRSSLNQPQSLSTTLPITNTTFSTNQNTNQGRNFASKSL

SEQ ID NO: 147334 - protein, 119 aa, Glycine max
  Coding DNA Sequence Number=SeqID_55649
GPAAGRAPHVAWCPVRPRRPLKIRRTECLPRPVVLITASGLQGETASVPEPVGCRWTARAASAARAGRRVPVGGRIGNGPFGASSPGVEQSTQNCALNVKVKKFNQARVNGGSNYDSLK

SEQ ID NO: 147335 - protein, 70 aa, Glycine max
  Coding DNA Sequence Number=SeqID_55650
MTRGNPVRHSVNPDHSVHFEHCEHCEHSVEGDSEYFDFEHSTTNFHTKNMAQTPPCGRTLREMAAPDFTY

SEQ ID NO: 147336 - protein, 93 aa, Glycine max
  Coding DNA Sequence Number=SeqID_55651
MSGFTRNSPQISASPHQLDLAPYASEPYNAQWNAPGLLRDKHTLRSSRILGEMEVDEPWLGLWLPLNYHVDMGARFVLKVVFVIGSAVDRLCG

SEQ ID NO: 147337 - protein, 150 aa, Glycine max
  Coding DNA Sequence Number=SeqID_55652
  Gene Ontology: Mol. function=tetracycline:hydrogen antiporter activity; Cellular component=integral to membrane; Biological process=response to antibiotic
  Homolog annotation: Hit_ID=Q8GEG0; Match level="QueryCoverage=73%, HitCoverage=96%, E-value=1e-24, Identity=56%"; Hit description =Putative uncharacterized protein
  Subcellular localization annotation: CTP_CleavageSite=44; ConfidenceScore=5.19e-01
MTMITPSSKLTLTKGNKSWYRAPPRESNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 147338 - protein, 107 aa, Glycine max
  Coding DNA Sequence Number=SeqID_55653
  Subcellular localization annotation: CTP_CleavageSite=47; ConfidenceScore=5.17e-01
MSRGSGDLGDARWGAIAQNQVTAGNRLPFMCNRLHSVKFKFQFVMAVVNRVWPLIAMAAQLIRDRVVMECLEGIWETLEGNERCQFRGTVRLTTTSLVHPEQPARTL

SEQ ID NO: 147339 - protein, 241 aa, Glycine max
  Coding DNA Sequence Number=SeqID_55654
  Gene Ontology: Biological process=transposition, DNA-mediated
  Homolog annotation: Hit_ID=Q6UUU1; Match level="QueryCoverage=24%, HitCoverage=40%, E-value=3e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLEYVYYANQIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 147340 - protein, 178 aa, Glycine max
  Coding DNA Sequence Number=SeqID_55655
  Gene Ontology: Biological process=transposition, DNA-mediated
  Homolog annotation: Hit_ID=Q1J7G7; Match level="QueryCoverage=18%, HitCoverage=47%, E-value=1e-11, Identity=100%"; Hit description =Transposase
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPVTTLANWSSTAVAAALELVDPPGCRNSIPSRHSISTRLVIDYQRPPQHATFIPKP

SEQ ID NO: 147341 - protein, 71 aa, Glycine max
  Coding DNA Sequence Number=SeqID_55656
MHERQSIHGAPNKSGEWRIALGNTSHGSRLIGGGCMNDNQFTGTPNKSREWRIALGNHFPRGSRLIDGEDA

SEQ ID NO: 147342 - protein, 287 aa, Glycine max
  Coding DNA Sequence Number=SeqID_55657
  Gene Ontology: Mol. function=drug transporter activity; Cellular component=integral to membrane; Biological process=pathogenesis
  Homolog annotation: Hit_ID=Q66AV4; Match level="QueryCoverage=100%, HitCoverage=65%, E-value=1e-131, Identity=75%"; Hit description =Virulence factor mviN, possible MOP Superfamliy efflux pump precursor
  Pfam annotation: Domain name=MVIN; Domain location=1-287; Score =227.2; E_value=3.6e-65; Accession=PF03023.5; Description=MviN-like protein
MATDAFFVAFKLPNLLRRIFAEGAFSQAFVPILAEYKSKQGEDATRVSLLRVTFPYILLISLASLAGAILNTWNRFSVPAFAPTLLNISMIGFALFAAPHFHPPVMALAWAVVVGGLLQLFYQLPHLKKIGMLVLPRVNLRDAGVWRVMRQMGPAILGVSVSQISLIINTIFASFLVSGSVSWMYYADRLMEFPSGVLGVALGTILLPSLAKSFASGNHDEYSRLMDWGLRLCFLLALPSAVALGILSGPLTVALFQYGKFTAFDAAMTQRALIAYSVGLMGLIVVK

SEQ ID NO: 147343 - protein, 238 aa, Glycine max
  Coding DNA Sequence Number=SeqID_55658
  Gene Ontology: Mol. function=transferase activity, transferring groups other than amino-acyl groups; Cellular component=1-2nm peptidoglycan-based cell wall; Biological process=lipopolysaccharide core region biosynthetic process
  Homolog annotation: Hit_ID=Q2NU53; Match level="QueryCoverage=100%, HitCoverage=77%, E-value=1e-104, Identity=72%"; Hit description =Lipid A biosynthesis lauroyl acyltransferase
  Pfam annotation: Domain name=Lip_A_acyltrans; Domain location=1-229; Score=224.5; E_value=2.4e-64; Accession=PF03279.4; Description =Bacterial lipid A biosynthesis acyltransferase
MPTSEREAMVKHNFESVGMGLIETGMAWFWPDWRIRKWVSTSGLEHVTEALAQKRGILLIGMHFLTLELGARVFGMYNPGIGVYRPNDNKLLDWLQTWGRMRSNKSMLDRKDLKGMIRAMKNNDIIWYAPDHDYGPRSSVFAPFFAVQEAATTTGTHMLIRLANPSVVPFLARRLPHGRGYELKMMPDIRHKFSLESELDTAIVMNKVVEETVLLAPEQYMWLHRRFKTRPEGQPSRY

SEQ ID NO: 147344 - protein, 523 aa, Glycine max
  Coding DNA Sequence Number=SeqID_55659
  Gene Ontology: Mol. function=transferase activity, transferring glycosyl groups; Cellular component=integral to membrane; Biological process=glucan biosynthetic process
  Homolog annotation: Hit_ID=Q6D6A7; Match level="QueryCoverage=97%, HitCoverage=62%, E-value=1e-99, Identity=74%"; Hit description =Glucans biosynthesis glucosyltransferase H
MELVRDVGGAGKIFYRRRRRRVKRKSGNIDDFCRRWGSNYSYMVVLDADSVMSGECLTGLVRMMEANPNAGIIQSSPKASGMDTLYARCQQFATRVYGPLFTAGLHFWQLGESHYWGHNAIIRVQPFIEHCALAPLPGEGSFAGSILSHDFVEAALMRRAGWGVWIAYDLPGSYEELPPNLLDELKRDRRWHAPGAPRGVPDRRDVLPVGTAVVYVPCVVDRPAGGAYADGTDLLPAATSAVPGVAAVASGFGHCAVFHHAGAAVPAKTAQRGAKPYGGAFRLFLSLLLEMLFSVLLAPVRMLFHTVFVVSAFLGWEVVWNSPQRDDDATPWSEAFRRHGSQMLLGIVWAVGMGVLDLNFLWWLAPIVFSLILSPFVSVMSSRATVGLKSKRAKLFLIPEEYEPPKELVDTDHYLQLNRERALKHGFMHALFNPAFNALATAMATSRHKQSALLDHARDRRVDQALSDAPEKLNREQRLQLISDPVVLARVHTRLWESADKYHQWVESYQKLTLNPQALPQRA

SEQ ID NO: 147345 - protein, 486 aa, Glycine max
  Coding DNA Sequence Number=SeqID_55660
  Gene Ontology: Mol. function=transferase activity; Cellular component= integral to membrane; Biological process=metabolic process
  Homolog annotation: Hit_ID=A9N5R6; Match level="QueryCoverage=91%, HitCoverage=75%, E-value=1e-172, Identity=67%"; Hit description =Putative uncharacterized protein
  Pfam annotation: Domain name=PLDc; Domain location=138-165; Score =21.4; E_value=0.0035; Accession=PF00614.13; Description =Phospholipase D. Active site motif
  Pfam annotation: Domain name=PLDc; Domain location=376-403; Score =24.7; E_value=0.00033; Accession=PF00614.13; Description =Phospholipase D. Active site motif
  Pfam module annotation: Pfam domain module=PLDc::PLDc; Domain location=138-165::376-403
MSEAALRSSRERPGDGLREHAQQQCARHPGLSGIHPLNDGLDAFAARYLLMGMAQHTIDVQYYIWHNDMSGRLLFSALLDAAERGVQVRLLLDDNNTPGLDETLAELDRHPNIAVRLFNPFSFRTLRALGYLTDFARLNRRMHNKSLTVDGAVTLVGGRNIGDEYFGTGNEPLFTDLDVLALGPAVDEVAEDFARYWHSKAVSPLRSVVDTGAPPHEAVRLPPEWQQSEAVQRYLARLEKSSFVSQLEQGSLSMTWAHTRLLSDDPRKGLGKAKRSSLLPQRMLEVIGTPQQQFDIISAYFVPTRAGVAQLLALKRRGVKIAILTNSLAANDVTVVHAGYARWRKKLLRHGIALYELKPQANAADAPHDRGLTGNSGSSLHAKTFTVDNRKVFIGSFNFDPRSAVLNTEMGLVIESEALAQQTHQRFSSGMRDRAWALRLDKWGRVNWVEYSGEAREVVHKHEPQCTLLQRLLVRLVWRLPVEWLL

SEQ ID NO: 147346 - protein, 125 aa, Glycine max
  Coding DNA Sequence Number=SeqID_55661
MEGLVDLAAIDAFLAFHHGKESPVVAILAMYDTFDRGCKKSSARIVCCALALYVWLVSHLFFSKKVGPSIRYKVTARASKRERESRTSPIASQGQSSGGHLLRPRGDPWTSQLLSAYDRLNGPYD

SEQ ID NO: 147347 - protein, 105 aa, Glycine max
  Coding DNA Sequence Number=SeqID_55662
MLPLQGASAFQSGKPAATVRANARAIECGPFAIAALKGDVCKAITMLALISQGVPSECVREKRRPVRICEYDSYGPRIPRPELATLGRSGERELVDPLQRGRNSD

SEQ ID NO: 147348 - protein, 84 aa, Glycine max
  Coding DNA Sequence Number=SeqID_55663
  Homolog annotation: Hit_ID=UPI0000ECBAF8; Match level="QueryCoverage =51%, HitCoverage=50%, E-value=1e-17, Identity=100%"; Hit description= UPI0000ECBAF8 related cluster
MPGVALSALVALSLNYSLGRHRGGAPIRPIVSRITIHWPSFYNVVTGKTLALPNLIALQHIPLSPAGVIAKRPAPIALPNSCAA

SEQ ID NO: 147349 - protein, 68 aa, Glycine max
  Coding DNA Sequence Number=SeqID_55664
MTEARQKGVRKEVLAPRFTFVFKGQQLFLAIVENSCYLKALYFFYFLRLTKAGLLLLRTLAIEEEIET

SEQ ID NO: 147350 - protein, 42 aa, Glycine max
  Coding DNA Sequence Number=SeqID_55665
KELHRSDFLITIGEYVGAKVSYPNFVRGPLLDDMRPFFGPCE

SEQ ID NO: 147351 - protein, 44 aa, Glycine max
  Coding DNA Sequence Number=SeqID_55666
SHEEEYLYLGACHSVWNSLKTQADHHGGGRELPVHDRVTSTLTA

SEQ ID NO: 147352 - protein, 145 aa, Glycine max
  Coding DNA Sequence Number=SeqID_55667
MDGLTNEITVTHLGTKFVLHPQTPSRAKGKEKEEKDSSKKIVKKENHFATKGDIKRALILKQSFYLFLSRETSLSTTIPLELKLKSLCFVGAQNRYYESPNPYDRVGLLGVLTDPKRIKVILEWPSPPTPLIELVRNHDLSWEDA

SEQ ID NO: 147353 - protein, 104 aa, Glycine max
  Coding DNA Sequence Number=SeqID_55668
MNILTAHDQGWNQELSPYNQYEEERTPNLESVFEEFIAYHANSKANQNSMKNHEIHFGKSYPIENVHRGPKLQPYYQNEAERGSNLDKLLMQFMETTKLTQRAL

SEQ ID NO: 147354 - protein, 188 aa, Glycine max
  Coding DNA Sequence Number=SeqID_55669
  Homolog annotation: Hit_ID=UPI00006A2D9E; Match level="QueryCoverage =95%, HitCoverage=97%, E-value=7e-11, Identity=18%"; Hit description =UPI00006A2D9E related cluster
MSKSCGFGMTGPLDESISCFLIRVDPWVLVPITFRGLHVLALRGLHVLTFVGLHALTFRGLHVLANRGLHALTLKRTNTLHALTFRGPHVLTFRGLHALAIRGPHVLTFRGLHALAIKGLHVLTFRGLHALAIKGLHVLTFVGLHALTFRGLHVLANKGLYALTFRGLHVLANRGLHTLTSRGLHILA

SEQ ID NO: 147355 - protein, 192 aa, Glycine max
  Coding DNA Sequence Number=SeqID_55670
  Gene Ontology: Mol. function=tetracycline:hydrogen antiporter activity; Cellular component=integral to membrane; Biological process=response to antibiotic
  Homolog annotation: Hit_ID=P0AEL2; Match level="QueryCoverage=35%, HitCoverage=32%, E-value=2e-32, Identity=92%"; Hit description =Formate dehydrogenase, cytochrome b556(fdo) subunit
MLAAISGLGFFFPSFNWLMQVLGTPQLARILHPFVGVVMFASFIIMFFRYWHHNLINRDDIFWAKNIRSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 147356 - protein, 19 aa, Glycine max
  Coding DNA Sequence Number=SeqID_55671
MSASSPSQAKEQDDDTKPM

SEQ ID NO: 147357 - protein, 71 aa, Glycine max
  Coding DNA Sequence Number=SeqID_55672
  Gene Ontology: Mol. function=hydrolase activity, acting on glycosyl bonds; Cellular component=extracellular region; Biological process =cell wall organization and biogenesis
  Homolog annotation: Hit_ID=A8U8B3; Match level="QueryCoverage=81%, HitCoverage=14%, E-value=2e-10, Identity=55%"; Hit description =Dehiscence polygalacturonase
MKHFTDTLISANIISGTLEASDDPSDYSGDNRHWLVFDNIQKLFVYGGGTINGNGNISWQNSCKRNKKLKC

SEQ ID NO: 147358 - protein, 96 aa, Glycine max
  Coding DNA Sequence Number=SeqID_55673
  Subcellular localization annotation: CTP_CleavageSite=59; ConfidenceScore=5.65e-01
MFAHSIKGLPSLGMDVWGANTFPVRKYNSRTFHLKVRRSRLFRFFPTFSSNKRWWRLPRVFLSWNTHPASLASPSHRTVGCDNNIVAVWNTSDNTL

SEQ ID NO: 147359 - protein, 117 aa, Glycine max
  Coding DNA Sequence Number=SeqID_55674
  Gene Ontology: Biological process=transposition, DNA-mediated
  Homolog annotation: Hit_ID=Q1J7G7; Match level="QueryCoverage=32%, HitCoverage=67%, E-value=7e-11, Identity=72%"; Hit description =Transposase
GHQDLFILRSDLPSQWLLFLSAVPPVQLLTGWCVTAKAPPDISAGKCSGRVPFAIQAAQLLGRAIGAGLFAITPAGERGMCCKAIKLGNARVFPVTTLNSMKAFGTKKKKKFKEIQG

SEQ ID NO: 147360 - protein, 130 aa, Glycine max
  Coding DNA Sequence Number=SeqID_55675
MERSMIDAASGGALRDITPAEARNLIEKMASNSQQFSARIDAIVIRGVHKVATNSSGETKKLEGKLDALVNLQQQQPYFQNAAGPSRPYFPPPIQQQQQQQPQKQQIVEAPPQPSLEELVRKMTMQNMQF

SEQ ID NO: 147361 - protein, 210 aa, Glycine max
  Coding DNA Sequence Number=SeqID_55676
MAPKKLPAKRSRRDAAAEGTSAAPEFDSHHFRSAEHHQRFEAIKGWSFHRERRVQLREDEYTYFQEEIARRHWTSLVTPMAKFDPEVVLEFYANAWPTKEGVRDMRSWVRGQWILFDADALSQFRGDPQVSEEGQECEFSQRRNRADGFDKEAIAQLLCTPGQDFSRTAAGRRVRIMRTSMTTLTQTWMTLLLSNVLPSDHNSDLPLPKC

SEQ ID NO: 147362 - protein, 144 aa, Glycine max
  Coding DNA Sequence Number=SeqID_55677
DAHAKVEYVKRLYDQVKVQIAKKNDNYAKQANKKRKEVVLEPGDDPGHLRANVFQEGGNDENPETSQIQAKGPSNPWGVYPDLSSFTGSGVYLTYLPSPKVASTLIYLSSPEVASSKTSTACIKRSAPTQVHITMRLNWTSERK

SEQ ID NO: 147363 - protein, 91 aa, Glycine max
  Coding DNA Sequence Number=SeqID_55678
MGKLVRLGEQPLHQNIKNEGGERFSAPKNSFPPPPSFKRRELTGLTVFAPPSHLWFHIAFIFHTPTHSNKDSIEDSKWVPKCNSKLRNPSS

SEQ ID NO: 147364 - protein, 290 aa, Glycine max
  Coding DNA Sequence Number=SeqID_55679
  Gene Ontology: Biological process=transposition, DNA-mediated
  Homolog annotation: Hit_ID=Q6UUU1; Match level="QueryCoverage=20%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPVTTLNSIAIKENIAVVVVVVVVVVVVGYAEVVEMVPELLGGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 147365 - protein, 53 aa, Glycine max
  Coding DNA Sequence Number=SeqID_55680
MFIGCELGLKLHFTKDVIQRQKYFNDPRPLEPERLKALRIQWAQYYLRVRDQT

SEQ ID NO: 147366 - protein, 268 aa, Glycine max
  Coding DNA Sequence Number=SeqID_55681
RHRSHLRPHSHRRENERKPQEVNIKLPYFHGKDNVEANLDWEIRVEQQLKRKSTSKSYGSHSYPKKDQGQGILGVRPSKPKDDKGKTIEKQPLKAIKVKKQKGKNLVKRSTPQEEGQPLMVKEECKEVSVSSKRLAKKERHFEIKTNIKEISLLRQPPHFLLCKKTLVSIATSLRLEFIPQVKELLDEGLVRKRLNPCALLVPKIGIIRHQIPKIGGVMNALGGATLVCKITHAPNIFMICVHRDSLGRVPMNPKRIKVIPEWLAPPS

SEQ ID NO: 147367 - protein, 42 aa, Glycine max
  Coding DNA Sequence Number=SeqID_55682
MDKSLKVGEDEWREKERRSTKFQASNEPTNPRSSPGFSTKCA

SEQ ID NO: 147368 - protein, 48 aa, Glycine max
  Coding DNA Sequence Number=SeqID_55683
MDLYHFFTGSTLDNGAGKEIGEGVMVVPKGSSMSKIVSGGGKWWLVSK

SEQ ID NO: 147369 - protein, 140 aa, Glycine max
  Coding DNA Sequence Number=SeqID_55684
MACPSFYKIGTCLTQQQTPVATLLNVLLSLSEIPGRSTVLSGAIVETWAHRWLMHQPFDNLFLRYKWWQPAQKPVSNLYLANLKMNSLIIRGYKDCPYSVAQSIRCPIEANNPFVYVLVRPFLFKQAVISSSGNSGCIGR

SEQ ID NO: 147370 - protein, 129 aa, Glycine max
  Coding DNA Sequence Number=SeqID_55685
  Subcellular localization annotation: CTP_CleavageSite=6; ConfidenceScore=5.04e-01
MVLISRCSSGVSWFLSAVPPVQLLTGMCYPLTIRHTSIPSRKHSGQVAAPFVHSGNLSCQLHYESANARAIECGPLAYSPAALKGGCVHTGDYYVGTKVAYPNGAEFGKHDTTCTYRDSERAAVKAVFP

SEQ ID NO: 147371 - protein, 342 aa, Glycine max
  Coding DNA Sequence Number=SeqID_55686
  Homolog annotation: Hit_ID=Q6WAY6; Match level="QueryCoverage=90%, HitCoverage=57%, E-value=4e-27, Identity=30%"; Hit description =Putative uncharacterized protein
MSESWLKNRLYQVKIKSLGVASLKELGQLMVQLQRQAFRKAYGKIWDITMAEVSTEAIASLVQYYDQPLRDPGMPSGRKEVVSFLRELDRGKQVENGVVGVPRKCLEAKARVLASQDEWAPFVDILALLIFGVVLFPNVDGLVDRATIDAFLAFYDRKESPVVAILADLYDTFDRRCEKNNTRIVCCTPTLYVWLVSYFFRQEMRHVCPLEGHRSCTKKKEANWDRLLVSKEGASVNWFPRWKERRTEILISCGKFPNVPLMGTRGCINYNPVLAIRQLGYPMRGAPSEEGLTPFITRGFNSTNVGVLQRVHKAWEMSQRKDKELRGSGNGPIGGYHRWLKA

SEQ ID NO: 147372 - protein, 237 aa, Glycine max
  Coding DNA Sequence Number=SeqID_55687
  Gene Ontology: Mol. function=oxidoreductase activity; Cellular component=cytoplasm; Biological process=metabolic process
  Homolog annotation: Hit_ID=Q3KCP9; Match level="QueryCoverage=100%, HitCoverage=93%, E-value=2e-81, Identity=65%"; Hit description=Short- chain dehydrogenase/reductase SDR precursor
  Pfam annotation: Domain name=Epimerase; Domain location=8-236; Score=- 60.3; E_value=0.011; Accession=PF01370.12; Description=NAD dependent epimerasedehydratase family
  Pfam annotation: Domain name=KR; Domain location=6-186; Score=-34.4; E_value=2.4e-05; Accession=PF08659.1; Description=KR domain
  Pfam annotation: Domain name=adh_short; Domain location=6-170; Score =80.4; E_value=5.8e-21; Accession=PF00106.16; Description=short chain dehydrogenase
  Pfam module annotation: Pfam domain module=Epimerase::KR::adh_short; Domain location=8-236::6-186::6-170
MKLTDNTIFITGGTSGIGRAMAEKFHQLGNQVIISGRREALLQEVTAASPGMDYVVLDVTRADSIQAAAQSVLERYPALNVVINNAGIMPFDNAAGELDDAQAVTLLNTNILGPVRVSAAFIEHLKQQPDPVLINNSSVLAFLPLATNALYSATKAAIHSYTLSQRFLLRDTGVQVIEISPPWVDTDLIYKSGDPRAMPLDAFISETFEKLGTDTIEAIVDRVLPVRDNPGANELTL

SEQ ID NO: 147373 - protein, 64 aa, Glycine max
  Coding DNA Sequence Number=SeqID_55688
MLKKLAYTPCKHIFDQNLEKFRELSPAIATWIDRISKEKWTMAYDREGRRYGPQRTSQNVSIRF

SEQ ID NO: 147374 - protein, 198 aa, Glycine max
  Coding DNA Sequence Number=SeqID_55689
  Subcellular localization annotation: CTP_CleavageSite=55; ConfidenceScore=5.53e-01
VWNLAMPSRRSYFHAPSRRGCPQHRATSSLSIPSTSRFLGKARVMLQLLIPFSVRVNFEAPWRNHGFYQLSSCSATDGVKLLSASQFGTQAYRAGSISAASGCPLSQFRETVVPAALRIGQRAGDRVRLFAITPAGVKGGCAAYWRLYVGNCHEGVSEVFPSPTAVAAALELVAYEPPGCRNSSADLAMPRKINFNQR

SEQ ID NO: 147375 - protein, 166 aa, Glycine max
  Coding DNA Sequence Number=SeqID_55690
  Gene Ontology: Mol. function=nucleotide binding; Cellular component =plasma membrane; Biological process=intracellular protein transport across a membrane
  Homolog annotation: Hit_ID=A4W6K1; Match level="QueryCoverage=100%, HitCoverage=18%, E-value=1e-88, Identity=96%"; Hit description =Protein translocase subunit secA
  Pfam annotation: Domain name=SecA_SW; Domain location=112-166; Score=- 58.1; E_value=1.1e-05; Accession=PF07516.4; Description=SecA Wing and Scaffold domain
MAGRGTDIMLGGSWQAEVAELENPTPEQIAQIKADWQVRHDAVLASGGLHIIGTERHESRRIDNQLRGRAGRQGDAGSSRFYLSMEDALMRIFASDRVSGMMRKLGMKPGEAIEHPWVTKAIANAQRKVESRNFDIRKQLLEYDDVANDQRRAIYTQRNELLDVSD

SEQ ID NO: 147376 - protein, 187 aa, Glycine max
  Coding DNA Sequence Number=SeqID_55691
  Homolog annotation: Hit_ID=A0ST23; Match level="QueryCoverage=14%, HitCoverage=55%, E-value=3e-08, Identity=100%"; Hit description =Putative reverse transcriptase
VPPVQLLTGWCVTAKAPPDISAGKCSGHAARRVPFAIQAAQLLGRAIGAGLFAITPAGERGMCCKAIKLGNARVFPVTTLIVIIKKGEIVEAKISKIILMMPKNQELSKFQRIRLQESSLIKLIDTVDLEGGPVGKPVVPAALMNRPTRGERRFAYWALAECILAYYVGTDEGVSEVLHVAGEKRLH

SEQ ID NO: 147377 - protein, 169 aa, Glycine max
  Coding DNA Sequence Number=SeqID_55692
  Gene Ontology: Mol. function=DNA binding; Biological process =regulation of transcription, DNA-dependent
  Homolog annotation: Hit_ID=A4W8J5; Match level="QueryCoverage=100%, HitCoverage=100%, E-value=3e-49, Identity=54%"; Hit description =Phage regulatory CII family protein
  Pfam annotation: Domain name=Phage_CP76; Domain location=3-162; Score= 199.1; E_value=1.1e-56; Accession=PF06892.2; Description=Phage regulatory protein CII (CP76)
MFDFRVSTHSHFEEACRKFALAHNISDLAPRSGMKVQTLRNKLNPDQAHKLTVEEMLQLTDLTEDATLIDGALAQLQCLPCVPMNEHVAEKFPAYVLNASAQVGTLAASAANQGNISASCRRGIVEAANTGIRCMMLAALAVQNRIHSNPTLASTVDAISGLSASIGMS

SEQ ID NO: 147378 - protein, 370 aa, Glycine max
  Coding DNA Sequence Number=SeqID_55693
  Homolog annotation: Hit_ID=Q6WAY6; Match level="QueryCoverage=88%, HitCoverage=52%, E-value=4e-18, Identity=26%"; Hit description =Putative uncharacterized protein
ESPVVAMLADLYDTFDRRCEKSSTRIVCCIPALYVWLVSHFFRQEVRQACPLESHRSCTEKGGTNWDRLLANKERASVNWFPRWKEGRTGVLISCKGFPNVPLMGTRGCISYNPVLAIRQLGYPMRGAPLEEELAPIISRGFNKTNVETLQKVRKAWEVVQKKDKELSGSNNGPIGGYRRWLKAHVQGLDWLPSLRTTKREEVEAPEEDEKVQTLRAELEQAQTVKERPRGLVGKSTAGTSSEGFCGAATTSLSSGERKRDQSRVHGMVLKEELAACSRSKKSLAQHLEATEQSMLAIIRQYKEDLNQSLTHEQKLVEDFAQAYAEKEARGRVTDALHPEAPMWMDRFALTLNGSQDLPRQLAKARVMAE

SEQ ID NO: 147379 - protein, 168 aa, Glycine max
  Coding DNA Sequence Number=SeqID_55694
TNVVICTLCQPAASESVDTQRLMSSSAPLSSRDGESDDLRRYPSGYPYKMIYVNPDPRSQVAGEDNQVVIRASEPVDTQRLTSSSAPLSSKDGESDDMQRYPSGYLYKTISVNPDSRSQVVGGDTQVVIHINTLLLSVRLRVRDGESDDMRRYPSGYPYKPTSVNLDP

SEQ ID NO: 147380 - protein, 171 aa, Glycine max
  Coding DNA Sequence Number=SeqID_55695
MVILRLSSSRGSKPDDMRRQIMVIRPFKRTPFCHPETIVSDGTQRQIMVILRLLSSRGGEPDDMRRQIMVIPHLFAIRRRSCLMARRDKLWSFCTFCHPEAASPMTCGEPYGHPCLLSTERNEFGSSAGGEIDRVRMVFRSNENYGLIFTSLLSPDATCPIRQVKRATVIP

SEQ ID NO: 147381 - protein, 60 aa, Glycine max
  Coding DNA Sequence Number=SeqID_55696
MDKFDIFVPYPLVITSLLPLECGCKPLFLPCYKVMTKDKVDPSKSYTGAMTGTVMSLKQT

SEQ ID NO: 147382 - protein, 65 aa, Glycine max
  Coding DNA Sequence Number=SeqID_55697
MRLGAEFNVESLTCRDWNTSSKVSQKECVRFCARKKRTTYISMKFSRFKKLGLGFDMLMKDRDTG

SEQ ID NO: 147383 - protein, 173 aa, Glycine max
  Coding DNA Sequence Number=SeqID_55698
MVKVGTSYVPIKAGVLIGQEVAQGFPLFLLFSLKLLSVNSTQAYRAGHRASVKPGVPNDVTRNSPLNPCRCASLRRFPSGNAVVPFAALMNRRQLLREGRSVRLCVLRQGAKADDYYSRANSSLTELLPLGRRCGERSELVVIPNGRGIRSAPQSRQVLNREVKQGRGKAVFP

SEQ ID NO: 147384 - protein, 286 aa, Glycine max
  Coding DNA Sequence Number=SeqID_55699
  Gene Ontology: Biological process=transposition, DNA-mediated
  Homolog annotation: Hit_ID=Q6UUU1; Match level="QueryCoverage=20%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPVTTLNSISTPACSASESLGPPTFPWPYPNPQLRTPCTWFLPPQPPVIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 147385 - protein, 119 aa, Glycine max
  Coding DNA Sequence Number=SeqID_55700
MVSISCPSCSATERGGIRVIGKSIHAGTSGAGRVSGHLSVARNHHTRRAYGRSGKRVVPFAHSRAAQLLGRAIGAGLSLLRQRRKGDVCKAITMLADTPGCSQSECVHVAGEKGCTVRQ

SEQ ID NO: 147386 - protein, 50 aa, Glycine max
  Coding DNA Sequence Number=SeqID_55701
MWMLVFERAFDLIIRIEINKQGLSQMARTLIPSDHVIVRLRLRLRLLNQA

SEQ ID NO: 147387 - protein, 81 aa, Glycine max
  Coding DNA Sequence Number=SeqID_55702
MDNRSKEQLCAFISSLSISVKQFYFLQISNHVNTLPAQCYEDQDEGELALTKKIMAAMTTTMMEQETPMMAVREARGRNKK

SEQ ID NO: 147388 - protein, 238 aa, Glycine max
  Coding DNA Sequence Number=SeqID_55703
  Homolog annotation: Hit_ID=A7P781; Match level="QueryCoverage=88%, HitCoverage=63%, E-value=1e-49, Identity=52%"; Hit description =Chromosome chr9 scaffold_7, whole genome shotgun sequence
  Subcellular localization annotation: CTP_CleavageSite=32; ConfidenceScore=5.39e-01
MALSLFQNPTFLKLKPQPSTATTPRWGYVRVRCGGPRSHRTPLVKGRILSIEAIQAIQTLKRLHRTNPPELTSLVSNTLTRLIKSDLLATLRELLRQQHCTIALRVFSTLRSEYGADLSLYAEMAQTLAANDMTDHLDRLILDLASENEIKCGDDHKGLASLIKAVVAARSRESTVRIYGLMNKSGYGSVTEPDEYVVEVLVSGLKSFGEEALAKELQHEYKIALAKFSTPQLNTLRF

SEQ ID NO: 147389 - protein, 221 aa, Glycine max
  Coding DNA Sequence Number=SeqID_55704
  Gene Ontology: Mol. function=protein dimerization activity; Biological process=DNA integration
  Homolog annotation: Hit_ID=Q2R1C3; Match level="QueryCoverage=90%, HitCoverage=25%, E-value=3e-37, Identity=42%"; Hit description=HAT family dimerisation domain containing protein
MSSPPFSRAEMSASSPSQAKEQDDDTKPLWTYVTKIKSVGGGENYEIKCNICDVTFNEFYTRVRTHLLKIIGKRVRGCQKITNAKLIDLKKIDNEATLRVEKSKTKFVSLPPVSTQHQMDTNTLGVDPKKRKTSTVESTFNLQARETLDHEIARMFYSLGLPFHLARNPHYRKTFAYAANNYISGYQPPGYNKLRTTLLQNEKRHVENLLQPIKNAWSQKG

SEQ ID NO: 147390 - protein, 94 aa, Glycine max
  Coding DNA Sequence Number=SeqID_55705
MIVFLIPPPPLLYQQPLPKQQLPLLLLLPPPPPHFHPRSIRAQRPRPETEQEAQGLQQAPGVPRRAEAQLGQMGVRNPRATQEVPNLARNIRHS

SEQ ID NO: 147391 - protein, 39 aa, Glycine max
  Coding DNA Sequence Number=SeqID_55706
MLSSNFELVDSDKYKNIKHILRDSLAKGVKNIKKESILD

SEQ ID NO: 147392 - protein, 56 aa, Glycine max
  Coding DNA Sequence Number=SeqID_55707
  Gene Ontology: Cellular component=chloroplast
  Homolog annotation: Hit_ID=A9PHK7; Match level="QueryCoverage=89%, HitCoverage=34%, E-value=9e-14, Identity=68%"; Hit description =Putative uncharacterized protein
MQAIDKLPVFPTVLELIGIFYSVWFTYRYLIFKPDREELFQILNKSASDILGHQSL

SEQ ID NO: 147393 - protein, 47 aa, Glycine max
  Coding DNA Sequence Number=SeqID_55708
MSMYVGHGISDEVWMTGWWLLWWVDWGMDCEGGREEGDGGDTIGGAR

SEQ ID NO: 147394 - protein, 190 aa, Glycine max
  Coding DNA Sequence Number=SeqID_55709
MLPPFGAFSDRATCPFVKRNWIRELIGVPAFLLAHPPNFLNVKNTLMDGMEAYLFSGSVRALMNEDQWMYDSMMSQEVEMNIENEEDASVKVDCSNAFNTSELFGSRDEVLQWTQSLAHDIGFVVVIIRSYINTGVQGRILFLLIACERSGEYRPKKHKLLKKDEKIVVADMTKFHGEAKKYFVDVEGAQ

SEQ ID NO: 147395 - protein, 168 aa, Glycine max
  Coding DNA Sequence Number=SeqID_55710
METISKRFEQLNVYGKIHLKSKLREIAYSDMNSMCPPPEKMKTKGGPKKPFTKQQKSTKRDPSYWEYVDALHSVHLKRTQRRIVKCWVRHWEAEQQEHQILQLYSCVPKNIPLMEFASLDDNSKSSKICTALLAFVIFLKRSHQGILTGGERGFVVVFEGAFALGSRD

SEQ ID NO: 147396 - protein, 201 aa, Glycine max
  Coding DNA Sequence Number=SeqID_55711
  Homolog annotation: Hit_ID=A7P7B9; Match level="QueryCoverage=28%, HitCoverage=47%, E-value=2e-13, Identity=67%"; Hit description =Chromosome chr9 scaffold_7, whole genome shotgun sequence
MGEKLMVYLAVNDEVVSSILIKEGTEDQLLIYFISKPLQGAEVRYQKLEKADMAMALVSLSTILTPPSSSSSSFSSPKPSSSSIVRFRPLTPLPRFRRHLVRMAPDEEKMTRRSPLDFPIVESVHNLVDLTVSSDFGDEWERPKPGRRPDIFPQFSPMKTPLPPPLPADPPEEDEEEEEKKEEEEEPEKEEPDKPDKPEKQ

SEQ ID NO: 147397 - protein, 136 aa, Glycine max
  Coding DNA Sequence Number=SeqID_55712
MLADIDRFLFENFKSLFLNDLEEPANRVEKSPELGPMPSGSSSATSESEIAEEQTVIPGNCVVVLANSVNPSKDFQRSMESVVEASGLGLHAGAFVLSHEPEQQEVVAQVNSQRLRRRCHRHAQPLGYCSGEASNG

SEQ ID NO: 147398 - protein, 680 aa, Glycine max
  Coding DNA Sequence Number=SeqID_55713
  Gene Ontology: Mol. function=protein transporter activity; Cellular component=cytoplasmic vesicle; Biological process=intracellular protein transport
  Homolog annotation: Hit_ID=A7P7E9; Match level="QueryCoverage=99%, HitCoverage=70%, E-value=0.0, Identity=85%"; Hit description =Chromosome chr9 scaffold_7, whole genome shotgun sequence
  Pfam annotation: Domain name=Coatomer_WDAD; Domain location=319-678; Score=511.8; E_value=8.1e-151; Accession=PF04053.5; Description =Coatomer WD associated region
  Pfam annotation: Domain name=WD40; Domain location=132-171; Score =49.4; E_value=1.3e-11; Accession=PF00400.23; Description=WD domain, G-beta repeat
  Pfam annotation: Domain name=WD40; Domain location=175-215; Score =38.7; E_value=2e-08; Accession=PF00400.23; Description=WD domain, G -beta repeat
  Pfam annotation: Domain name=WD40; Domain location=219-257; Score =57.1; E_value=6.1e-14; Accession=PF00400.23; Description=WD domain, G-beta repeat
  Pfam annotation: Domain name=WD40; Domain location=47-85; Score=11.3; E_value=1.3; Accession=PF00400.23; Description=WD domain, G-beta repeat
  Pfam annotation: Domain name=WD40; Domain location=5-43; Score=18.0; E_value=0.035; Accession=PF00400.23; Description=WD domain, G-beta repeat
  Pfam annotation: Domain name=WD40; Domain location=89-127; Score =47.2; E_value=6e-11; Accession=PF00400.23; Description=WD domain, G -beta repeat
  Pfam module annotation: Pfam domain module=Coatomer_WDAD::WD40::WD40:: WD40::WD40::WD40::WD40; Domain location=319-678::132-171::175 -215::219-257::47-85::5-43::89-127
MPLRLEIKRKLAQRSERVKSVDLHPTEPWILASLYSGTVCIWNYQSQTMAKSFEVTELPVRSAKFIARKQWVVAGADDMFIRVYNYNTMDKVKVFEAHTDYIRCVAVHPTLPYVLSSSDDMLIKLWDWEKGWICTQIFEGHSHYVMQVTFNPKDTNTFASASLDRTIKIWNLGSPDPNFTLDAHQKGVNCVDYFTGGDKPYLITGSDDHTAKVWDYQTKSCVQTLEGHTHNVSAVCFHPELPIIITGSEDGTVRIWHSTTYRLENTLNYSLERVWAIGYLKGSRRVVIGYDEGTIMVKLGREEPVASMDNSGKIIWAKHNEIQTVNIRSVGADVEIADGERLPLAVKELGTCDLYPQSLRHNPNGRFVVVCGDGEYIIYTALAWRNRSFGSALEFVWSSDGEYAVRESTSKEKKSIRPTFSAERIFGGTVLAMCSNDFICFYDWVECRLIRRIDVNVKNLYWADSGDLVTIASDTSFYILKYNRDVVASYLDSGSPVDEQGVEDAFELLHEMNERVRTGIWVGDCFIYNNSSWRLNYCVGGEVTTMFHLDRPMYLLGYLASQSKVYLMDKEFNVMGYTLLLSLIEYKTLVMRGDLERANEILPSIPKEHHNSVAHFLESRGMIEDALEVATDPDYRFDLAIQLGRLEVAKGIATEVHSESKWKQLGELAMSTGKVFFSIK

SEQ ID NO: 147399 - protein, 266 aa, Glycine max
  Coding DNA Sequence Number=SeqID_55714
  Homolog annotation: Hit_ID=Q5BPW9; Match level="QueryCoverage=54%, HitCoverage=63%, E-value=5e-14, Identity=32%"; Hit description =Putative uncharacterized protein
  Pfam annotation: Domain name=Hin1; Domain location=34-165; Score= -14.0; E_value=0.024; Accession=PF07320.4; Description=Harpin-induced protein 1 (Hin1)
MEKALWRSKYVVSGGGLKWMVFVVVCVACVVGIWPWYPELKIERMEVKRVKVRPVPPVGADVSISMSVRVRNRDIYWMEMREVDVGMKYRRKKMGHVELKGWQVKGWSSTHVEAEVVFAELPSSQVPYLLEDVAKGKVYFRTVVELSGQFGILSFRTPLPLEFKRIGYDPIVCVNELVTRLKMGSWKALWRKIKRERRRFFRPSPVFHVQYDPTSYLQNFDDGYSTDPDNVSRSFSARFAAPSKIFGKIEVMDDGELEINHKSNML

SEQ ID NO: 147400 - protein, 70 aa, Glycine max
  Coding DNA Sequence Number=SeqID_55715
MALNIMGRLCDQGHTARCLSGDYCHTFTSGNNLSEINKSDLPIAISCASLSLADEGIMLYDLVAVVSVDA

SEQ ID NO: 147401 - protein, 567 aa, Glycine max
  Coding DNA Sequence Number=SeqID_55716
  Gene Ontology: Mol. function=transferase activity; Cellular component= transcription factor complex; Biological process=positive regulation of transcription, DNA-dependent
  Homolog annotation: Hit_ID=A7P7G9; Match level="QueryCoverage=93%, HitCoverage=57%, E-value=0.0, Identity=84%"; Hit description =Chromosome chr9 scaffold_7, whole genome shotgun sequence
  Pfam annotation: Domain name=TPR_1; Domain location=30-63; Score =30.0; E_value=8.9e-06; Accession=PF00515.19; Description =Tetratricopeptide repeat
  Pfam annotation: Domain name=TPR_1; Domain location=341-374; Score =1.1; E_value=4; Accession=PF00515.19; Description=Tetratricopeptide repeat
  Pfam annotation: Domain name=TPR_2; Domain location=184-217; Score =2.8; E_value=13; Accession=PF07719.8; Description=Tetratricopeptide repeat
  Pfam annotation: Domain name=TPR_2; Domain location=30-63; Score =32.8; E_value=1.2e-06; Accession=PF07719.8; Description =Tetratricopeptide repeat
  Pfam annotation: Domain name=TPR_2; Domain location=341-374; Score =18.4; E_value=0.027; Accession=PF07719.8; Description=Tetratricopepti de repeat
  Pfam annotation: Domain name=TPR_2; Domain location=451-484; Score =5.3; E_value=6.6; Accession=PF07719.8; Description=Tetratricopeptide repeat
  Pfam module annotation: Pfam domain module=TPR_1::TPR_1::TPR_2::TPR _2::TPR_2::TPR_2; Domain location=30-63::341-374::184-217::30-63::341- 374::451-484
MKGLTLNCMDRKSEAYELVRQGLKNDLKSHVCWHVYGLLYRSDREYREAIKCYRNALRIDPDNIEILRDLSLLQAQMRDLSGFVETRQQLLTLKPNHRMNWIGFSVAHHLNSNASKAVEILEAYEGTLEEDHPPENERCEHGEMLLYKVDLWVVFMISLLEECGFLERALEELHKKESKIVDKLVYKEQEVSLLVKLGHLEEGEALYQALLSMNPDNYRYYEGLQKCVGLYLEDGQYSPDQIDRLDSLYKTLVQQYKWSSAVKRIPLDFLQGDKFREAADNYIRPLLTKGVPSLFSDLSSLYNHPGKADILEQLILELERSIRMSGQYPGRMDKEPPSTLMWTLFLLAQHYDRRGQYEVALSKIDEAIEHTPTVIDLYSVKSRILKHAGDLVAAAAFADEARCMDLADRYVNSECVKRMLQADQVALAEKTAVLFTKDGDQHNNLHDMQCMWYELASGESYFRQGDLGRALKKFLAVEKHYADITEDQFDFHSYCLRKMTLCTYVEMLKFQDQLHSHAYFHKAAAGAISCQNWSGPVQLGTGLVIGPVTLKKQMISDPVRTGQEPVK

SEQ ID NO: 147402 - protein, 216 aa, Glycine max
  Coding DNA Sequence Number=SeqID_55717
MPYVFMGYMDRISHPELALVVISVISALVCFELGWSMWSILRGGWDNQKLHVSLLNDVWITISTLVPPVISNTSDMSAWKHKPDGTFSVSSTNISISSPPMANDPSFNLICLTLPTPCQVLNPNLFIFWEAPLTCLYKLNCDVVVALVAKLMYGRVLKDHFGTIVFAFSSKIGTCSINIAELWAIAIRIKIASLRPMSLIKSVANSSGISSWILVY

SEQ ID NO: 147403 - protein, 644 aa, Glycine max
  Coding DNA Sequence Number=SeqID_55718
  Gene Ontology: Mol. function=transferase activity; Cellular component= integral to membrane; Biological process=glycolysis
  Homolog annotation: Hit_ID=Q9FVD3; Match level="QueryCoverage=72%, HitCoverage=94%, E-value=0.0, Identity=71%"; Hit description =Hexokinase
  Pfam annotation: Domain name=Hexokinase_1; Domain location=184-391; Score=237.3; E_value=3.5e-68; Accession=PF00349.12; Description =Hexokinase
  Pfam annotation: Domain name=Hexokinase_2; Domain location=398-640; Score=254.8; E_value=1.8e-73; Accession=PF03727.7; Description =Hexokinase
  Pfam module annotation: Pfam domain module=Hexokinase_1::Hexokinase _2; Domain location=184-391::398-640
MGNDSVTLVKNIVASGNEVFQHELQQQLQPNAMLGMVLDSAEKVLSEAVQEPEIESTIDSLDISGNVWKWQLFKWRKKRASNLGLLDRSSMQIGTDLHQAEEAREIPGGWWRVWVVFYSSRGGLVSSNIINTDIVVLPLRGYKLDSVRESKRMRKVVVCATVIGACTVVAVVVHRYARKCRRWAKAIEILKELEEKCATPTWKLKLVADAMNVEMHAGLASEGGSKLKMLITYVDKLPTGNEEGLYYALDLGGTNFRVLRVQLGGKYGGIISQEFTEVSIPPNLMVGTSDELFDYIAAELAKFVAQENQDFQVSPGRQRELGFTFSFPVMQTSLASGNLVKWTKGFNIDGTVGQDVVAELTKAIRRQGLDMRVNALVNDTVGTLAGGRYTNSNVIAAIILGTGTNAAYVERVQAIPKWHGPLPDSGDMAINMEWGNFRSSHLPLTEYDCALDAESFSPGDQIFEKMTSGLYLGEIVRRVLCKIAEEAFFFADNVPPKLKIPFILSTPDMCAMHHDSSTDLNVVGSKLKNILEISDTSLEVRKVVVEICNIIATRGARLSAAGILGILKKLGKDTKSEVEGQKNVIAMDGGLYEHYTEYSKCLENTLKELVGEDISESIIIEHFNDGSGVGAALLAASHSQYLDA

SEQ ID NO: 147404 - protein, 99 aa, Glycine max
  Coding DNA Sequence Number=SeqID_55719
MDEDQKNWNEMAKTMMKISRKSNIIFNTVHIKDQTVMTTCICYVQQDLVNPTILAAGWTELKDFYELTGNHQVIMTHFRHNVFFLTIFKSNSKLKAYPK

SEQ ID NO: 147405 - protein, 94 aa, Glycine max
  Coding DNA Sequence Number=SeqID_55720
MDSIGDYFTWSNKQNVGTIYSRIDRVLGNVQWFQDRLDYHLKILPPSISDHALLCVEETYDMVDWGALEGVLTEFGLPKKFIGWVMKVITTVNY

SEQ ID NO: 147406 - protein, 138 aa, Glycine max
  Coding DNA Sequence Number=SeqID_55721
MAPAVAGAVLRLPGQPAVVDQAFNQHQRVRVALKIIDDAHIQLVAAKTRRAYREHHAAVREAVVEKDAKALLLNITHILLAAVNRRFQQIPAPAGWPTAGSVAVARRFPSYGQDYRVFGVNMREKFARRQYHAIFAPP

SEQ ID NO: 147407 - protein, 133 aa, Glycine max
  Coding DNA Sequence Number=SeqID_55722
MKKRVGMKKKEKRGKKKLQIRVWKCHIPWKHKYIHQENIVVEGNYSAVIQKILRPEHKDPGSVTIPCSIGDQSTVGRVGRVARIMPTRIDFTEQILLIENPSQGLNECKLICSDKKLGSLDGLQLIVDEMLLL

SEQ ID NO: 147408 - protein, 34 aa, Glycine max; identical to SEQ ID NO: 108849
  Coding DNA Sequence Number=SeqID_55723

SEQ ID NO: 147409 - protein, 150 aa, Glycine max
  Coding DNA Sequence Number=SeqID_55724
  Homolog annotation: Hit_ID=Q2HW90; Match level="QueryCoverage=61%, HitCoverage=19%, E-value=6e-07, Identity=34%"; Hit description =Putative uncharacterized protein
MVITRTKGKDSHKLGALSADSAEVSWERNQTMCTNLIPNGYLSSTIPPSSLPIPFDTKEEFHEQLTKERQEKETWKRRCQELEQENETLKGKIAQQSRELFIQNQRMIEKDDLLRQKDALLHRDARRKRRFMDLFSRAHSDSEDPSTPGV

SEQ ID NO: 147410 - protein, 132 aa, Glycine max
  Coding DNA Sequence Number=SeqID_55725
MLKNVENLRVITHGNVTETLRKCLGLDFLHGNNLLSNFERREVPRRLNPFLFTPPPIYSKIGEELATQLAQASKVASSRSNSLLEEGFGRPKWARLLILSKKLRKLTDCEKTPLFDFRHITEFHGLRKPASF

SEQ ID NO: 147411 - protein, 33 aa, Glycine max
  Coding DNA Sequence Number=SeqID_55726
MDKSLKVGEDEWRERERRPTNPRSSPRFSTNYD

SEQ ID NO: 147412 - protein, 91 aa, Glycine max
  Coding DNA Sequence Number=SeqID_55727
RTTERSESVSEWKRNIPRVSTILAAATAVQLFSCHYSERITSLTPSFTTFPEQLRTEGEWDAAERNAIKRGGCEWLAHSLGTPGFTLYASG

SEQ ID NO: 147413 - protein, 151 aa, Glycine max
  Coding DNA Sequence Number=SeqID_55728
SLPNRPTYKSNPQETQRKDAHAKVEYVKRLYDQVKVQIAKKNESYAKQDNKKRKEVVLEPGDDPGHLRTNVFQEGGNDENHETGQIQAKGPSGEGRRPKWRRTKPPSNPCGVYLDLSSFTGSGVYPDLSSFTGSGVIQTSVACIKRSVPTQ

SEQ ID NO: 147414 - protein, 32 aa, Glycine max
  Coding DNA Sequence Number=SeqID_55729
MEGTNYMNWMEKQFQEHGGTELEFVIMVIAVS

SEQ ID NO: 147415 - protein, 108 aa, Glycine max
  Coding DNA Sequence Number=SeqID_55730
MLDKHGVMGLAKPADRSDHEVDDPLYLMTLIIPQLFLKPLQVMWDATLFDLFNEDLPLYIKYEDLFEIAHGGQCVSISVIQLWILHMTGTSMRAGNTDVYGFLEPQSI

SEQ ID NO: 147416 - protein, 77 aa, Glycine max
  Coding DNA Sequence Number=SeqID_55731
QPGPLGPSRFFLQKPVASGGSNLARLADLGAKLLPYFAINGGRSEEEKGSAFLALRIHLKLLRKIVSVKKIQAEALP

SEQ ID NO: 147417 - protein, 74 aa, Glycine max
  Coding DNA Sequence Number=SeqID_55732
MPSPSEDYTSSPSEDYTALHVFAIRGLHALTFRGLHVLAIRGLHALTFRGLHVLAIRGLDVLTYRGLHVLAIKE

SEQ ID NO: 147418 - protein, 25 aa, Glycine max
  Coding DNA Sequence Number=SeqID_55733
MDTRLRVIGDPMNGVQRGWGSQLPL

SEQ ID NO: 147419 - protein, 126 aa, Glycine max
  Coding DNA Sequence Number=SeqID_55734
  Homolog annotation: Hit_ID=UPI0000ECBAF8; Match level="QueryCoverage =32%, HitCoverage=48%, E-value=1e-16, Identity=100%"; Hit description= UPI0000ECBAF8 related cluster
MVEKGLVRFGDLQTMRRVKTWKRLLMKKMRMAAAKEAEKSLPVSPGGGAQTLPHSIYNSLKTFANPCGDAWHEGMQAWHWPSFYNVVTGKTLALPNLIALQHIPLSPAGVIAKRPAPIALPNSCAA

SEQ ID NO: 147420 - protein, 134 aa, Glycine max
  Coding DNA Sequence Number=SeqID_55735
ATLPEGRKPDRYPVSGRFGTGERTRELPGGNACLWKNASNAAFLRFLAFCWPFAHMFFPALSPDSVDNRITAFEKRKSAQYANRLSPRVGRFINAAGTTGFPTGKRAVSATQLIYDHDYEFELGTPPEKAIIGR

SEQ ID NO: 147421 - protein, 180 aa, Glycine max
  Coding DNA Sequence Number=SeqID_55736
MTLTYKNRRITRPFRLARFGDDADAGSRQARQGASAGVGGCRGWLNYAASEQIVLRVHHMRCEIPHRCVRRKYRIRRHSPFRLRNCWEGRSVRASSLLRQLAKGGCAARRLSWVTPGFSQSRRCKTTASAKLACLQVDSRGSQVHIASGVYFVACKAKEWTGVKVDSVKGDLEPLESFLI

SEQ ID NO: 147422 - protein, 88 aa, Glycine max
  Coding DNA Sequence Number=SeqID_55737
MARFSNIEIAFFQRYILCGTSRGYIYLGCYTENKKGYISCGSIQVEGTSTWLFKENKGGYIPCESLACKGFYKVERNLKDRWLLGDWM

SEQ ID NO: 147423 - protein, 155 aa, Glycine max
  Coding DNA Sequence Number=SeqID_55738
MTRGNPSNLQPFDPEIDRTFHRLVRHHFIPFDHPEHSITGESVHSVIGDFEHPDLEHYNFEHSDFAHSENMAQPPPRERTLREMAAPDFTYESLCIQYPDKDVPYVLKTGLIHLLPKFHGLAGFSSFSGGSGKGLAVLPCSKGPSRAGMTSREYS

SEQ ID NO: 147424 - protein, 141 aa, Glycine max
  Coding DNA Sequence Number=SeqID_55739
MDRSMIDASNGAALGDMTPAEARNLIKKMASNSQQFSARNDAIVIRGVHQVATNSSSAAETKKLEGKLDALLNLVTQLALHQKFVPVARVCGLCSSSDHHTDLCPSKAINIPCLKKKSLVLAAWTYKLVKITENWLLRILS

SEQ ID NO: 147425 - protein, 322 aa, Glycine max
  Coding DNA Sequence Number=SeqID_55740
  Homolog annotation: Hit_ID=Q84VH5; Match level="QueryCoverage=100%, HitCoverage=52%, E-value=1e-118, Identity=67%"; Hit description =Envelope-like protein
  Subcellular localization annotation: CTP_CleavageSite=21; ConfidenceScore=5.24e-01
MATSPKDTSSPGSPSVPSSPSSTKAPSNQEQPEFHIQPIQMIPGQAPVPEKLVPKRQQGVKISENPSLATSPREVDPEMDKKIRSIVSSILKNASVPDADKDVQHLPPQMLKSSLHPVKRNQQRKRIKPQRRPLHQGHQNLLQLAPGIAERLQSRKGKTPITRSGRIKTIAQKKSTPITPTTSRWSKVAIPSKKRKEISSSDSDDDVELDVPDIKRVKKSGKKVPGNVPDAPLDNISFHSIGNVERWKFVYQRRLALERELGRDALDCKEIMDLIKAAGLLKTVTKLGDCYESLVREFIVNIPFDITNRKSDEYQTVFVRGK

SEQ ID NO: 147426 - protein, 153 aa, Glycine max
  Coding DNA Sequence Number=SeqID_55741
MKREKHASYSSHNSCKSLSEELRDYYEGRHKSHLRPQSHRREDERKPQEANINLPYFHGKDNVEAYLDWEIRIEQKLKRKFTLKSYGSHSYPKKDQDDTLLLNAPTKKTIIMRSQDIYSSQDEATTSPSSSESEEAKREESSEEIYPKKKDNL

SEQ ID NO: 147427 - protein, 130 aa, Glycine max
  Coding DNA Sequence Number=SeqID_55742
GYVGKLPLLGTICRGSGGIIGNNFPILRGGTVMSPEWVWARTATGMPMWLTLGVTRTNMGWGMSPGNLEEGMHHQDSGQIGHGPEKKLHKIRQVSCDRAIPIFNWGIGICEDQSFEDPNHEGLIIDFDQE

SEQ ID NO: 147428 - protein, 158 aa, Glycine max
  Coding DNA Sequence Number=SeqID_55743
  Gene Ontology: Mol. function=chloramphenicol O-acetyltransferase activity; Biological process=response to antibiotic
  Homolog annotation: Hit_ID=P62577; Match level="QueryCoverage=100%, HitCoverage=97%, E-value=9e-36, Identity=45%"; Hit description =Chloramphenicol acetyltransferase
  Pfam annotation: Domain name=CAT; Domain location=6-146; Score=35.3; E_value=9.3e-16; Accession=PF00302.9; Description=Chloramphenicol acetyltransferase
MEKKITGYTTVDISQWHRKEHFEAFQSVAQLFTLVTPFSMSKLKRFHRSGVNTTTISGSFYTYIRKMWACYGENLAYFPKGFIENMFFVSANPWVSFTSFDLNVAIWTTSFAPVFTMGKYYTQGDKVLDAAGDQVHYVRLLMASFAGEIFMELQQYCE

SEQ ID NO: 147429 - protein, 37 aa, Glycine max
  Coding DNA Sequence Number=SeqID_55744
MEKNEETTMEEKLLCSDYHLMEACLWGFYGGWIFELK

SEQ ID NO: 147430 - protein, 44 aa, Glycine max
  Coding DNA Sequence Number=SeqID_55745
MFPHGKMSMKGVFRPYPTLTYPTPLIQDSKRLGLELLKKALGFS

SEQ ID NO: 147431 - protein, 263 aa, Glycine max
  Coding DNA Sequence Number=SeqID_55746
  Subcellular localization annotation: CTP_CleavageSite=48; ConfidenceScore=5.22e-01
PGTTGALTLSGRPVPRGLGPGPPLRTLLQTTIRTPRATDFHGGLFPVRSPLLRESFYPEGNFGGNQLLRVRLVFRPYTSQTRLHVSIASVASTSFLTGEVRLNRSDSSPSFGSRQVCSGSHQPFSAATLLHVCVRRKRCVTTHRRPTLIRLPGRNLRFKDSMRSRDSRIHMSVSLSRSSSDGEPTGRAEISVAESHLYVQCCARAAIHRGTSPGRESHYNSPFESWTHRNPRRFVFVAESIGRLSRRSTSDRAPGPSPSLPTR

SEQ ID NO: 147432 - protein, 127 aa, Glycine max
  Coding DNA Sequence Number=SeqID_55747
MSHESVVLCSSADHHTDLCPSMQEPGAIELLEAYAANIYNIPPQPQQQNQPQQNNYDLSSNIYNLDGGITLISDGLALNNNNSSLILPSKMLLAQADHTFPHQSNNSNSPINNKQLRLLRNLPSMNL

SEQ ID NO: 147433 - protein, 177 aa, Glycine max
  Coding DNA Sequence Number=SeqID_55748
  Homolog annotation: Hit_ID=Q51617; Match level="QueryCoverage=23%, HitCoverage=59%, E-value=2e-14, Identity=95%"; Hit description =Putative uncharacterized protein
  Subcellular localization annotation: CTP_CleavageSite=77; ConfidenceScore=5.19e-01
MTVKTSDTCSSRRRSQLVCKRMPGADKPVRARQRVLAGVGAGLTMRHQSRLCVRRKYRIRRHSPFRLRNCWEGRSVRASSLLRQLAKGGCAARRLSWVTPGFSQSRRCKTTASAKLACLQVDSRGSPCPPHVGPLLNFAGERVETRGYMDLMTTFDQGKLSKSFTIRYLLGVPSSNS

SEQ ID NO: 147434 - protein, 52 aa, Glycine max
  Coding DNA Sequence Number=SeqID_55749
MKSALDKEGQDHLELPSGVGTKHEQQKPTKVLRNGCNWGWGHDRLIVAPSLR

SEQ ID NO: 147435 - protein, 52 aa, Glycine max
  Coding DNA Sequence Number=SeqID_55750
MGAKYLEVVKQRLHAIKQWSPDEIRRFLERERSKFQRVLIAFAVRRLAENRE

SEQ ID NO: 147436 - protein, 219 aa, Glycine max
  Coding DNA Sequence Number=SeqID_55751
  Homolog annotation: Hit_ID=A5C4I3; Match level="QueryCoverage=26%, HitCoverage=22%, E-value=5e-15, Identity=71%"; Hit description =Putative uncharacterized protein
MAARALGVPRHLRAPGVGLWAPHSARLETRTKESDMCASQRASKPVRRKEADWWDPPVAGRSQRKLWWRPAAILTIAGARGRVLSGTVRLLCEPRHGIESSKWAIFGKQNWRCGMNRKLGYGAQLRANLDPTKGVGRLRQQDGGHGSRNPLRRRGGRCKTQGASPGGAVVGADLGGTGEARLIALCARTPKGNRPAHPGNGSAGGRVQRLEEHRTSRGV

SEQ ID NO: 147437 - protein, 79 aa, Glycine max
  Coding DNA Sequence Number=SeqID_55752
MPSRKNSGKLFSTRSQEAEGEGISGFEAEEHYWPQYQDARNEEDLCAQFENGLRLEIQQAVSYMQITDFNQLVTKCRIL

SEQ ID NO: 147438 - protein, 206 aa, Glycine max
  Coding DNA Sequence Number=SeqID_55753
  Homolog annotation: Hit_ID=UPI0000ECBAF8; Match level="QueryCoverage =19%, HitCoverage=48%, E-value=3e-16, Identity=100%"; Hit description= UPI0000ECBAF8 related cluster
EKAGTGIPVSGRVGTGERTRELPGGNACLWKNASNAAFLRFLAFCWPFAHMFFPALSPDSVDNRITAFEKRKSAQYANRLSPRVGRFINAAGTTGFPTGKRAVSATQLIYDHDYEFELGTRKTSFELVTLPWILVICAGPVIVIGDLAKLDGKRMQAWHWPSFYNVVTGKTLALPNLIALQHIPLSPAGVIAKRPAPIALPNSCAA

SEQ ID NO: 147439 - protein, 63 aa, Glycine max
  Coding DNA Sequence Number=SeqID_55754
MKMLLIPHDVIRMKKEERERRCHFKEKMSLEEAHHHRRPWIRAWRKKEMNEGRGREEHEIFVL

SEQ ID NO: 147440 - protein, 62 aa, Glycine max
  Coding DNA Sequence Number=SeqID_55755
MACKPRQDFSVSKPYIFRQLSLSLSLTLLFFLLHSPLKLQTKLQPLAIISAPSHERRAFSES

SEQ ID NO: 147441 - protein, 109 aa, Glycine max
  Coding DNA Sequence Number=SeqID_55756
MKSWMQSSNRDVYLVAYLNGAHWKMVVILPMENLVVWFCSLHNRPDNYLKGIINSALKGLDDTPQPKSKAAARWIVVKYFNDARLLEAERLKALRIQWAQYYLKVKNQT

SEQ ID NO: 147442 - protein, 28 aa, Glycine max
  Coding DNA Sequence Number=SeqID_55757
MRHVGRSWLRNTTGFRAFSLLVIDYRLL

SEQ ID NO: 147443 - protein, 170 aa, Glycine max
  Coding DNA Sequence Number=SeqID_55758
MRSWVRGQWIPFDADALSQFLGDPLVLEEGQQCEFSPEEEQGRRDFSRTAAGRRVRIMRTSMTTLTQTWMTLLLNNVLPSDHNSDLPLPKCQLVYAILTRMSVHVAQGQGSAPFACPTLEQFGAEVAWLGDWPDAQVGEEPAGSPSEPDESHMDEDMTDLLGFLGGSGAT

SEQ ID NO: 147444 - protein, 55 aa, Glycine max
  Coding DNA Sequence Number=SeqID_55759
EWTKGERERRRHFKEKMSLEEAHHHRRPWIRAWRKKEMNEGRGRGREEQEILCSK

SEQ ID NO: 147445 - protein, 222 aa, Glycine max
  Coding DNA Sequence Number=SeqID_55760
MRSWVRVLEEGQECEYGQRRNRSDGFDEEAIAQLLCIPGQDFARTAAGRRVWIMRTKMTTLTQIWMTLLLSNILPSDHNSELPLPKCQLVYAILTRMSIHVAQLIADAIYIFAGMAPTRHPLDPDKSNRALGFPALITGLYQSFGVPVAPSKVIRPPITRAFIEKYCTQRQVQGDAPQAADAPPPHQAGPVGSFDTEQYLRHLVHQQAANHRAHVQTHDCLY

SEQ ID NO: 147446 - protein, 92 aa, Glycine max
  Coding DNA Sequence Number=SeqID_55761
MGAKHLTRTKEWSHVIKQRSPDEIRVTGCTIWGGAHESGHCIPFEEKTQKVSYMGNQQRQGYNQGGLSGFQQGPYNQQGQWRSHPSNQFNKD

SEQ ID NO: 147447 - protein, 160 aa, Glycine max
  Coding DNA Sequence Number=SeqID_55762
  Gene Ontology: Biological process=transposition, DNA-mediated
  Homolog annotation: Hit_ID=Q1J7G7; Match level="QueryCoverage=20%, HitCoverage=47%, E-value=2e-11, Identity=96%"; Hit description =Transposase
MKTFQFAHGKRCNKGEHYPISPSSPSFIAHTKFPDEHSSGGQESERSGYRYIEQLTEMPQNVLYDAIGIYQRCWNLLRADQRLIFAKSWPRASRYQQGHQDLFILRSDLPSQVLQWLLFLSAVPPVQLLTGWCVTAKAPPDISAGKCSGHAARNHHTRRA

SEQ ID NO: 147448 - protein, 118 aa, Glycine max
  Coding DNA Sequence Number=SeqID_55763
  Homolog annotation: Hit_ID=A6FJQ2; Match level="QueryCoverage=32%, HitCoverage=84%, E-value=3e-11, Identity=92%"; Hit description=50S ribosomal protein L5
MRKEKIPHQAPFAIQAAQLLGRAIGAGLFAITPAGERGMCCKAIKLGNARGYPKNIIRGRILFKEEGMIEDYPTELEFVIMVIAVSFGKPVVPAALLNRPTRGERRFAYWALFRFLAH

SEQ ID NO: 147449 - protein, 65 aa, Glycine max
  Coding DNA Sequence Number=SeqID_55764
GGGFRPARPGELGCFHQKAPPSVGTPWKAQNIADLYGLCNNACFDFRHVAELHGLPNDGCQVPQG

SEQ ID NO: 147450 - protein, 71 aa, Glycine max
  Coding DNA Sequence Number=SeqID_55765
MSSSKGPRTKLGYDRSDDESLKGTNTWDPIIDFKQEAGQTESEEDEDVGLPPELEKIVAHEDQEMSLIKKR

SEQ ID NO: 147451 - protein, 322 aa, Glycine max
  Coding DNA Sequence Number=SeqID_55766
  Gene Ontology: Mol. function=unspecific monooxygenase activity
  Homolog annotation: Hit_ID=Q5CEG7; Match level="QueryCoverage=32%, HitCoverage=99%, E-value=1e-43, Identity=83%"; Hit description =Senescence-associated protein
  Subcellular localization annotation: CTP_CleavageSite=52; ConfidenceScore=5.26e-01
MIGRADIEGSKSNVAMNAWLPQASYPCGNFSDTSSFKFRRTKGSIGHAFTVRIRTGNQNQTSFYPFVPHKISVLVELILGHLRYLLTDVPPQPNSPPDNVFRPDRPAEADLGSKKRGSAPLPIHGITPTYPTPLKSFHKVGLESSSTGSSFPADSAKPVPLAVVSLDSRQGHRIPLVRTSSEFDCSTPGEEAPKGPFPIRPRTARDDPLSPRKQLEQSHRQPTGSGLGPPCPALRANPFPEGYGSILPTSLAYIVPSTRGCSPWRPDAVMSTTGRGRHSVLRIFKGRRGRTGHHATCGALPAAGPYLRLSRFQGGQAVKQKR

SEQ ID NO: 147452 - protein, 209 aa, Glycine max
  Coding DNA Sequence Number=SeqID_55767
  Gene Ontology: Mol. function=helicase activity; Biological process =viral genome replication
  Homolog annotation: Hit_ID=A2Q378; Match level="QueryCoverage=98%, HitCoverage=13%, E-value=1e-46, Identity=45%"; Hit description =Putative uncharacterized protein
  Pfam annotation: Domain name=DUF889; Domain location=1-208; Score =211.6; E_value=1.9e-60; Accession=PF05970.5; Description=Eukaryotic protein of unknown function (DUF889)
MRLLSNAPLQPNNEELKQFSHCLLDIGDGKIGQYNDGFSEITIPDEFLIKNYDDPIHAIVEATYHSLINNYSDTDYLQKRVVLASKKEIVDKINYYVLLLIPNHEKEYCSADSIDKSDELLNPAFALLPPEFLYSLQTSGIPNHKLKLKVGTPIMLLRNLDQTDGLCNRTRLIITKLGSNVIEAKVITGPNSGNRTYIPRINMSPSESP

SEQ ID NO: 147453 - protein, 241 aa, Glycine max
  Coding DNA Sequence Number=SeqID_55768
  Homolog annotation: Hit_ID=A9Z738; Match level="QueryCoverage=94%, HitCoverage=61%, E-value=7e-81, Identity=66%"; Hit description=Type VI secretion protein, family
  Pfam annotation: Domain name=DUF876; Domain location=1-241; Score= -49.3; E_value=3e-13; Accession=PF05936.3; Description=Bacterial protein of unknown function (DUF876)
DNADALPEVMVLPQAESRELTVVLALPHEHENGGNCLQMEQRAERPVRWRLAWREVRNRYGEDSRQIAVMLAQLTLRTADDNNGDYQTVAVARLRRDSQDCWSLDEDFIPPLLKVLASRWLHEQTEQLTNQLGTRLQRLMAMRRESNARMADFAVADVSLFWLLNALNSAEPVLNHFLRHPQVHPERLYEALASLAGSLLTFSLDHTTADIPPYRHQALTEVFPPLFQLLGVLLEARLPSR

SEQ ID NO: 147454 - protein, 107 aa, Glycine max
  Coding DNA Sequence Number=SeqID_55769
MVSRGIIPFEKHIAIVGTTSNNTLSKRKTLDEGSLLSSKSETQHDHRFTSTPYVPMDPVPSGVTNCRNLPFGGRAKRAHGCVFQGRKTCGVATNVYSRKMSEKTKKV

SEQ ID NO: 147455 - protein, 135 aa, Glycine max
  Coding DNA Sequence Number=SeqID_55770
  Homolog annotation: Hit_ID=A6BLN7; Match level="QueryCoverage=72%, HitCoverage=18%, E-value=6e-08, Identity=32%"; Hit description =Putative transposase
MDNHSWCYPACVQCHRKTDIQTGPFTCRCDKDNDQPVLRYRVEVMVTQNNESSKFLLWDHECAELIGEIADDVNRVKIENGDLDLNASPQALDKLLGHVLAFKACSKIDPSNVDCNNTTHAECFMLYATISVCHS

SEQ ID NO: 147456 - protein, 135 aa, Glycine max
  Coding DNA Sequence Number=SeqID_55771
  Gene Ontology: Mol. function=N-acetyltransferase activity; Biological process=metabolic process
  Homolog annotation: Hit_ID=A7PQC8; Match level="QueryCoverage=54%, HitCoverage=28%, E-value=2e-12, Identity=47%"; Hit description =Chromosome chr18 scaffold_24, whole genome shotgun sequence
  Subcellular localization annotation: CTP_CleavageSite=51; ConfidenceScore=5.47e-01
MAHLLASNPNASQKLTFSNLGYYGVRRGSRTKGSCYRVGRKRRGGLVLQCSSTTDQDVRLQIESGSIGKLKQHFEYLVCEYGWRVRRLFENADEIKKASHVQAEAFHVPVSLFNELFFQFFQKRQVFLRVPSSNS

SEQ ID NO: 147457 - protein, 161 aa, Glycine max
  Coding DNA Sequence Number=SeqID_55772
  Gene Ontology: Mol. function=binding; Cellular component=integral to membrane; Biological process=cell adhesion
  Homolog annotation: Hit_ID=A6T837; Match level="QueryCoverage=100%, HitCoverage=28%, E-value=5e-51, Identity=63%"; Hit description =Putative outer membrane protein
  Pfam annotation: Domain name=OmpA; Domain location=79-161; Score =35.3; E_value=2.1e-07; Accession=PF00691.11; Description=OmpA family
MDDHAAKARAVQILRQDAAQLDAFARDGAPLALGLGLYRGERLRQPVLAAIRSYVPPPPPPKAVEKIVPKIVRLDSMSLFDTGKWTLKPGSTKLLVNSLVGIKARPGWLIVIAGHTDSVGDDKSNQTLSLKRAESVRNWMRDTGDVPESCFAVQGYGESRP

SEQ ID NO: 147458 - protein, 219 aa, Glycine max
  Coding DNA Sequence Number=SeqID_55773
MGEVEKVQEQMKADMEAMKGQMATMMEAIISMKKIMEANAVIVAATSVVAKVNPMLPSGLKQMNHPTSNMVGKDLGSTDDPMMCKFKTSTPSRHMACLPNYTPPNVAYIPNEDVNNSTSILIKSQQPQSDHAHVSRPMEETHGMPHHNLADFEPCLGYATEGQAVGGIPLQNTLEGPQCHPQPQPSHSTAVKNPHAMAEMGKRKGSGPLKEVKIMPLLT

SEQ ID NO: 147459 - protein, 211 aa, Glycine max
  Coding DNA Sequence Number=SeqID_55774
  Homolog annotation: Hit_ID=Q2HW90; Match level="QueryCoverage=35%, HitCoverage=14%, E-value=1e-09, Identity=48%"; Hit description =Putative uncharacterized protein
  Subcellular localization annotation: CTP_CleavageSite=62; ConfidenceScore=5.39e-01
MASSGGLSWSAKNSTRGSRLCSQGLKGPLGGRKPYLFSGFLPSLSRNSEAVWGQQQDGAQVRSKLGTTSGLASKILGRKEGTSRASQKKWGSFADILALLIFGVVLFPNVDGLVDLAAIDAFLAYHHSKESPVVAILADLFDTFDQRCEKNSVRIVCCLPTLCVWLISHLFRQTRDTRVHFKAIAHAPKKEDLIGTTFGWDRGQRDQLFPR

SEQ ID NO: 147460 - protein, 69 aa, Glycine max
  Coding DNA Sequence Number=SeqID_55775
GVQIAIMPTWAFQILPPEGCCFWRKQPCSPGRAGEKGFNLLGTSHSVEIAEENHFREENPSRGASVTFP

SEQ ID NO: 147461 - protein, 160 aa, Glycine max
  Coding DNA Sequence Number=SeqID_55776
MSDGFCGTHLQIMVRTRGLGRALGQVTGRGVGRGDRDDSDDAPQRRRPTASAWRQRVAVTADHVDEPVIPAPDVQDDPMEAPATVEDIPTDTGAEAAEDEHQGFPGGPSDPSVLTLYADHVACSVWTGDERPELKLSSHGRKVHSLGRPVPAIEGLIVGT

SEQ ID NO: 147462 - protein, 109 aa, Glycine max
  Coding DNA Sequence Number=SeqID_55777
DLAISAKSLLDYGCLESISIPPSDRFEGFNPSINEAINLIKAEIMDYIAIKITTCPSNFGAQNYPCHVMKLLPENHRNYPCMFSDEYESWDVQGNTQYQYSLMRAQNTR

SEQ ID NO: 147463 - protein, 57 aa, Glycine max
  Coding DNA Sequence Number=SeqID_55778
MARSVRSYQHYCTRSHQNSAIKRAWARVVLGWVTSLKVLVLNLFFVFFPSSKYFSLK

SEQ ID NO: 147464 - protein, 269 aa, Glycine max
  Coding DNA Sequence Number=SeqID_55779
MAKFDPDIVLEFYANAWPTEEGVRDMRSWVRGQWITFDADAIGQLLGYPLVLEEGQECEYGQRRNRSDGLDEEAIAQLLCIPGQDFARTAAGRRVRIMRTNMTTLTQIWMTLLLSNIQPNDHNSDLPLPKCQLVYAILTRMSIHVAQLIADAIYIFAGMAPTRHPLDPDKSNRALGFPALITGLCQSFGVPVAPSKMSLSLQSQGFTSFSCPTLDQFRVEVAWPGDWPEAWAGETPVRAPAEAPDEADEAHEDEEMTDSLDFLGGSGAT

SEQ ID NO: 147465 - protein, 157 aa, Glycine max
  Coding DNA Sequence Number=SeqID_55780
MRGLHVLTIRGLHALTSRGLHVLALRGGLHVLALRGLHVLTIRGLHALTSRGLHVLALRGLHALTLGTSYPHRQRTTRPRLERTTRPHHQRAARPHLQRTISPRLERATRPHLGGLHVLAVKGSCAFTFVGLHVLTFRGLHVLTFRGLPRPRHQRTT

SEQ ID NO: 147466 - protein, 64 aa, Glycine max
  Coding DNA Sequence Number=SeqID_55781
  Homolog annotation: Hit_ID=A7QGE6; Match level="QueryCoverage=57%, HitCoverage=5%, E-value=8e-13, Identity=91%"; Hit description =Chromosome undetermined scaffold_91, whole genome shotgun sequence
  Subcellular localization annotation: CTP_CleavageSite=37; ConfidenceScore=5.04e-01
MSAGLQITGWPAHDSSISSILFGPDETSIFSLGSDGKASSKRSFICCLSSSVTTSMQHQGIQCI

SEQ ID NO: 147467 - protein, 59 aa, Glycine max
  Coding DNA Sequence Number=SeqID_55782
  Gene Ontology: Cellular component=integral to membrane; Biological process=photosynthesis
  Homolog annotation: Hit_ID=P49179; Match level="QueryCoverage=64%, HitCoverage=18%, E-value=2e-13, Identity=92%"; Hit description =Photosystem I assembly protein ycf4
  Pfam annotation: Domain name=Ycf4; Domain location=1-58; Score= -124.3; E_value=0.082; Accession=PF02392.7; Description=Ycf4
MAFYGIAGLFSSFYSGSIILWDIGGGFDIFNKKGKKMRRYLISKSDYYIPNPKCSLVYS

SEQ ID NO: 147468 - protein, 118 aa, Glycine max
  Coding DNA Sequence Number=SeqID_55783
LGGRRRYPSGYPYKTISVNPDPRSQLAGGDTQVVIQTNVVICTLRQPRASEPVDTQRLTSSSTPLSSRDGESDHMQRYPSGYPYKTISVNPNPRSGRRRYPTGYPDKHSFAIRQTQSQ

SEQ ID NO: 147469 - protein, 99 aa, Glycine max
  Coding DNA Sequence Number=SeqID_55784
ERHEPKLVSHGRKVALIGRPVPEIEGLVAATGLSPLIGCSVATGRSPTLFEVSFVMWFPGSFPFTGYPKFVNINQCTLRVRLIASEPNLRSCLMDEGLT

SEQ ID NO: 147470 - protein, 108 aa, Glycine max
  Coding DNA Sequence Number=SeqID_55785
MTSFSQMQSQLQSQMQSQGLALPPEPEVKVGVEEVKDAEVPVPIPTNEVQLMGQALNTFLAWSTHLVKRVSEQAAVSPAKPSDKPNPEVDDPLYLMTLIIPQLFLKPL

SEQ ID NO: 147471 - protein, 193 aa, Glycine max
  Coding DNA Sequence Number=SeqID_55786
MDFFSNESFECFQAFENSIPIPFMSLKLPVYSNLVKAFYSNFEIHEGTLMSEVYGIKMVIDQSLFYDLTQLPSEGVPFEGALIDDWKFDFSIHDARWLVCTNQADMTEGYLPVVATCPFAGERRRGSRVRFPKEKRCAESPPTFICGKRRKNQRKPVKIKILSSGVIFKFEEGRQKRGFCSYVPSIKEEIRPT

SEQ ID NO: 147472 - protein, 136 aa, Glycine max
  Coding DNA Sequence Number=SeqID_55787
ETKFGHSAPLYHPEAAGPMIRGDTLWLSAPFLSSRGGGPDDTQETKFGHSDLVSSRGGGPDDTRRYLTVIRTLLSSRGGGPDDKQRPKAAGPMTSRDQVWSFCTLVSSRGGGPDDTRRYLMVIRTLLSSRGGGPDD

SEQ ID NO: 147473 - protein, 167 aa, Glycine max
  Coding DNA Sequence Number=SeqID_55788
SEQESARGSFQGETPGIFIVLSGFATSDLSVDFCDARQGAGAYGKTPATRPFYADTARRSRTTERSESVSEEAEERPIRKPPLPAPDNNFTQETAMTMITNSSSVPLFFLFIMPGAVRVLVLQERGEAVEEVLGRSALHEALQRWKLPAHRSPEPQQLRQEPKAGIL

SEQ ID NO: 147474 - protein, 73 aa, Glycine max
  Coding DNA Sequence Number=SeqID_55789
MGDHLEDMIRDLGQESFQEAHAPVYEGLQSDGTELEFVIMAVCVLGALPLPRSLTRCARSFGCGERVSAHSKA

SEQ ID NO: 147475 - protein, 41 aa, Glycine max
  Coding DNA Sequence Number=SeqID_55790
MTHPPFHPPSKIHPIDEDLNRTVIKSTLESQSSGQAKGRTG

SEQ ID NO: 147476 - protein, 83 aa, Glycine max
  Coding DNA Sequence Number=SeqID_55791
PLGPSRIFLQNAVASGGSNLARLGELGGKHLLYFAINRGGSEKEKAEALPKRFRNVFREEFRKGFDRSSTFFIRSSSFFDLQR

SEQ ID NO: 147477 - protein, 70 aa, Glycine max
  Coding DNA Sequence Number=SeqID_55792
MAPRKISAKRSRKDIVVEGTSSAPEFDSHRFRSAEHQQRFEAIKGWSFHRERRVQLRDDEYTDFQEEIAR

SEQ ID NO: 147478 - protein, 170 aa, Glycine max
  Coding DNA Sequence Number=SeqID_55793
  Homolog annotation: Hit_ID=A6FJQ2; Match level="QueryCoverage=22%, HitCoverage=84%, E-value=3e-11, Identity=92%"; Hit description=50S ribosomal protein L5
MTVKTSDTCSSRRRSQLVCKRMPGADKPVRARQRMRKEKIPHQAPFAIQAAQLLGRAIGAGLFAITPAGERGMCCKAIKLGNARVFPVTTFRETCRASCINESANARGEAVCVLGALPLPRSLTRCARSFGCGERYQLTQRRNRKKAALLAFFHRLRPPDEHLKIDAQVR

SEQ ID NO: 147479 - protein, 155 aa, Glycine max
  Coding DNA Sequence Number=SeqID_55794
MTLTYKNRRITRPFRLARFGDDADAGSRQARQGASAGVGGCRGWLNYAASEQIVLRVHHMRCEIPHRCVRRKYRIRRHSPFRLRNCWEGRSVRASSLLRQLAKGGCAARRLSWVTPGFSQSRRCKTTASAKLACLQVDSRGSRKDLFEDNIGCRI

SEQ ID NO: 147480 - protein, 41 aa, Glycine max
  Coding DNA Sequence Number=SeqID_55795
MHPPPSSPEPSVRGKYEKEEGETRVTYFKSFWVGTIVIEIN

SEQ ID NO: 147481 - protein, 231 aa, Glycine max
  Coding DNA Sequence Number=SeqID_55796
  Gene Ontology: Mol. function=chloramphenicol O-acetyltransferase activity; Biological process=response to antibiotic
  Homolog annotation: Hit_ID=P62577; Match level="QueryCoverage=83%, HitCoverage=84%, E-value=7e-99, Identity=90%"; Hit description =Chloramphenicol acetyltransferase
  Pfam annotation: Domain name=CAT; Domain location=6-201; Score=340.2; E_value=3.6e-99; Accession=PF00302.9; Description=Chloramphenicol acetyltransferase
MEKKITGYTTVDISQWHRKEHFEAFQSVAQCTYNQTVQLDITAFLKTVKKNKHKFYPAFIHILARLMNAHPEFRMAMKDGELVIWDSVHPCYTVFHEQTETFSSLWSEYHDDFRQFLHIYSQDVACYGENLAYFPKGFIENMFFVSANPWVSFTSFDLNVANMDNFFAPFSPWANIYARRQGADAAGDSVVLLHVFPGWTQDDSYRIRRSGRTERGVRAYSPAWSELPTRN

SEQ ID NO: 147482 - protein, 44 aa, Glycine max
  Coding DNA Sequence Number=SeqID_55797
MNSGRFQISIPGDGCPRINEALGLGLNPELGLDLTRAYYFIIQN

SEQ ID NO: 147483 - protein, 121 aa, Glycine max
  Coding DNA Sequence Number=SeqID_55798
MMVARVMLGHGYEPRMGLGKDNGWQGRPSYRPTQADVRKNISERKNKGQSPRSGQQAKEVPPCHISRSFVSAGLRRKGQVVAIYDEDSPRRSNLVQPCPPSFQLGNWRVEERPEVYTTSIM

SEQ ID NO: 147484 - protein, 112 aa, Glycine max
  Coding DNA Sequence Number=SeqID_55799
  Homolog annotation: Hit_ID=A6FJQ2; Match level="QueryCoverage=33%, HitCoverage=84%, E-value=3e-11, Identity=92%"; Hit description=50S ribosomal protein L5
MTVKTSDTCSSRRRSQLVCKRMPGADKPVRARQRMRKEKIPHQAPFAIQAAQLLGRAIGAGLFAITPAGERGMCCKAIKLGNARVFPVTTLMGHVSSSTGMAGYKGVPSSNS

SEQ ID NO: 147485 - protein, 121 aa, Glycine max
  Coding DNA Sequence Number=SeqID_55800
  Gene Ontology: Mol. function=ATP binding; Cellular component=nucleus; Biological process=regulation of transcription, DNA-dependent
  Homolog annotation: Hit_ID=A7PBE8; Match level="QueryCoverage=49%, HitCoverage=7%, E-value=9e-17, Identity=68%"; Hit description =Chromosome chr16 scaffold_10, whole genome shotgun sequence
EGDGVFGLGLVDCDVGSIVWVRRRNGSWWPSQILGLDHLSTSNLTSPRSGTPVKLLRKEDPNMAESTQGECAYCNFLADEESEYAFMDVVEYDSLEIGSTNVDSDSSEMELDMGDEMTTLS

SEQ ID NO: 147486 - protein, 111 aa, Glycine max
  Coding DNA Sequence Number=SeqID_55801
MRKQEVILHGIWKWNVYWLMYLEIKGIWATRVTEVGKGQHLNVAATVLSTSFNVNVTSDNVKNRIKLWRSCHINRLNHVRFKVLQNLDDIVDCVLKIEPPVMELKLLWMLD

SEQ ID NO: 147487 - protein, 149 aa, Glycine max
  Coding DNA Sequence Number=SeqID_55802
LGHHFKNSVAPPTYLALLILLPVAAASGDKSCLTGATLPEGRKADRYPVSGRVGTGERTRELPGGNACLWKNASNAAFLRFLAFCWPFAHMFFPALSPDSVDNRITAFEKRKSAQYANRLSPRVGRFINAAGTTGFPTGKRAVRRNAIN

SEQ ID NO: 147488 - protein, 76 aa, Glycine max
  Coding DNA Sequence Number=SeqID_55803
MGEVEEIQEKMKADMEAMKERMATMMAMMSMRKIMEANAVTIAATSTVAKVKPDAPIWPQPNESSNLRYGRQRFGK

SEQ ID NO: 147489 - protein, 78 aa, Glycine max
  Coding DNA Sequence Number=SeqID_55804
MRVQIATRPTWAFQDVPPEGGSNLARLGELGGKHLLPFPINRGRREEQKCSTLLVSEIHLKLGRKIVSVKKIQAETLS

SEQ ID NO: 147490 - protein, 49 aa, Glycine max
  Coding DNA Sequence Number=SeqID_55805
ELVTMVVVATYPSAGGRRGAHGCVSQERNTRGVATKVYLRKMSEKPEKT

SEQ ID NO: 147491 - protein, 31 aa, Glycine max
  Coding DNA Sequence Number=SeqID_55806
MAPNSLGGGRMNENAIHEGSEKRARMEDCTR

SEQ ID NO: 147492 - protein, 54 aa, Glycine max
  Coding DNA Sequence Number=SeqID_55807
MDKSLKVGEDEWREKERRSKKCCVSNELWFIPLIQNQAEDSPLSVLKCHEACKA

SEQ ID NO: 147493 - protein, 234 aa, Glycine max
  Coding DNA Sequence Number=SeqID_55808
  Homolog annotation: Hit_ID=Q6UUU1; Match level="QueryCoverage=25%, HitCoverage=40%, E-value=3e-18, Identity=78%"; Hit description =Putative uncharacterized protein
LAQGFPVSTGTPGFIFCEVISVTAVPPVQLLTGWCVTAKAPPDISAGKCSGRVPFAIQAAQLLGRAIGAGLFAITPAGERGMCCKAIKLGNARVFPVTTLMPPTNNIEKYPATFMFSIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 147494 - protein, 57 aa, Glycine max
  Coding DNA Sequence Number=SeqID_55809
  Subcellular localization annotation: CTP_CleavageSite=37; ConfidenceScore=5.22e-01
MPQNVLYDANWDISTVLSLPVQPTDGGGGVTAKSPPRTSALASVAVPLRVTTTPRRA

SEQ ID NO: 147495 - protein, 101 aa, Glycine max
  Coding DNA Sequence Number=SeqID_55810
MYPPLELIHKRCTLSCSQSNPSRCTTKDVPSNVLRQRFQGKGRIKRILRLCRFEFFDKGEGRHKRIQAVSPSFFWKREKRDTKRIQAVSPWRILFGKGRRE

SEQ ID NO: 147496 - protein, 162 aa, Glycine max
  Coding DNA Sequence Number=SeqID_55811
MSKQLETLTETLRCTICGGAHESGCCIPNEKKIAHEVNYIGNQPRGNFNTSGFPRFLNNQQYQQQRQWQNHPGNQFNRDQGGSSTRPQQQMPSLYDRTIKLEETLAQFMQVSMSNQKSTESTIKNLEVQVGQLAKQLAERSSNSFIGNIEKNPERRVQSCDD

SEQ ID NO: 147497 - protein, 161 aa, Glycine max
  Coding DNA Sequence Number=SeqID_55812
IAAADLANQRPARGVHHRKSDEAAHGIVQPDAVPDSVPYVISGTCTASRASADPACLVALGRVYEGFTVVHNTPLLLGQVKVSVEEVTDADGSFLYPDETVLGRAIELLAEKPYQEELEEATQGSFVPHGRQDVLTAAIGRPEHPGRVHVAGASVTIRHYF

SEQ ID NO: 147498 - protein, 70 aa, Glycine max
  Coding DNA Sequence Number=SeqID_55813
MDFKDYLMKIPTHTWQHILRFATLLRLSVYQMKLSDSAFSHFRWQERPRGGSTHSKDAVLKPGKKLWKST

SEQ ID NO: 147499 - protein, 155 aa, Glycine max
  Coding DNA Sequence Number=SeqID_55814
MKERSRRRKQEPRMSVEEEVAEQSTQLVALGKVYDTLATIHNVPYADDVVRAIGTFVGWPTHLVKPIFDEDSQKRLRIPVKSAEMDNVVATIDLLGELVKNLFEIYQKLIELAWDGAKFGIANVKDGFFITHAYVSEIILGDKCLNISILQLWLM

SEQ ID NO: 147500 - protein, 82 aa, Glycine max
  Coding DNA Sequence Number=SeqID_55815
GLHALAIRGLRVLTFRGLRALAIRGLHVLTFRGLHALAIRGLHVLTFVGLHALTFRGPTRQRAACLQRATRPRQQRATCPHL

SEQ ID NO: 147501 - protein, 177 aa, Glycine max
  Coding DNA Sequence Number=SeqID_55816
  Gene Ontology: Mol. function=1-deoxy-D-xylulose-5-phosphate synthase activity; Biological process=terpenoid biosynthetic process
  Homolog annotation: Hit_ID=Q6EJC9; Match level="QueryCoverage=68%, HitCoverage=16%, E-value=1e-58, Identity=90%"; Hit description=1 -deoxy-D-xylulose 5-phosphate synthase
MRKEKIPHQAPFAIQAAQLLGRAIGAGLFAITPAGERGMCCKAIKLGNARMKKRPCGVYASLSESGEYYSHRPPTPLLDTVNYPIHMKNLSAKELKQLADELRSDVIFSVSRTGGHLGSSLGVVELTVALHYVFNAPQDKILWDVGHQSYPHKILTGRRDQMHTMRQTNGWVPSSNS

SEQ ID NO: 147502 - protein, 176 aa, Glycine max
  Coding DNA Sequence Number=SeqID_55817
KNPFQEGKSDEDTTKDKDHEALEGPMTRGRLKQAQHSDEDITKLNQSQTYQGNPYGVYPDLSSFTGSCVIQISVACIKRSAPSQDHIRGVLGVAVASADEDFDVGIEVLVLETCDVFRGNLGEVPRESKEAVGGDGVVVIVSAKEWRRRKGDWRHNFKEKMSQEQAHNHRRPWIRA

SEQ ID NO: 147503 - protein, 196 aa, Glycine max
  Coding DNA Sequence Number=SeqID_55818
MGEAEEVQEQMKADKEAMKKKMATMMEAMMSMKKIMEANAIAVTATNAVAKKYEGPHDVKIQNEHAFPPYGLPPNYTPPNVAYTPNEDVNNSATILIESLQPHHVHVPQPMGETHEIPHHNLADFEPCLGYATEGQEVGGIPLQNTLEGPQYLPQPHPSHSTAVKNPYAMAEMRKLDHLEERLRAIEGAKIMPLLT

SEQ ID NO: 147504 - protein, 224 aa, Glycine max
  Coding DNA Sequence Number=SeqID_55819
  Gene Ontology: Mol. function=nucleotide binding; Cellular component =intrinsic to membrane; Biological process=defense response
  Homolog annotation: Hit_ID=Q2YE87; Match level="QueryCoverage=100%, HitCoverage=17%, E-value=1e-117, Identity=93%"; Hit description=NBS -LRR type disease resistance protein Rps1-k-2
MLRRKHDIGDWNNILNSDIWELSESECKVIPALRRSYHYLPPHLKRCFVYCSLYPQDYEFEKNELILLWMAEDLLKKPRNGRTLEEVGHEYFDDLVSRSFFQRSSTNRSSWSDRKWFVMHDLMHDLATSLGGDFYFRSEELGKETKINTKTRHLSFAKFNSSFLDNPDVVGRVKFLRTFLSIINFEAAPFNNEEAPCIIMSKLMYLRVLSFRDFKSLDSLPDSI

SEQ ID NO: 147505 - protein, 16 aa, Glycine max
  Coding DNA Sequence Number=SeqID_55820
MEGPTPISALIHAATM

SEQ ID NO: 147506 - protein, 102 aa, Glycine max
  Coding DNA Sequence Number=SeqID_55821
MASMMDAMLGMRQLMENNVATAATVSSAAEANPTLLATTHHPIPNVVMSLPPSLKGSLLDSRTRFTRIVESMHKETSIPTPRSPSRGRHPTHYLSPISWENL

SEQ ID NO: 147507 - protein, 49 aa, Glycine max
  Coding DNA Sequence Number=SeqID_55822
MVNNTSEFNIHRKVERNRKGGLVPSLEEFESRSKRPTTLRAIGLRSTSN

SEQ ID NO: 147508 - protein, 232 aa, Glycine max
  Coding DNA Sequence Number=SeqID_55823
MAEIISEESFEAPEEDEEVQALKSELGKAKLAKEKFKLAATHIRKECAGLQEENATTARALEQEAKKARKEEYGRNKFRGALWGSNNELKLRREEKDQSRAHSMVLKEELVACSRSKRSLSQRLCETEINMLAIIAKYQEELGLATAHEHRVADEYAQVYAEKEARGRVIDSLHQEATMWMDRFALTLNGSQELPRLLAKAKAMADTSLRPRRNSWTSRLLSAYDRLNGPYN

SEQ ID NO: 147509 - protein, 359 aa, Glycine max
  Coding DNA Sequence Number=SeqID_55824
  Homolog annotation: Hit_ID=Q6WAY6; Match level="QueryCoverage=74%, HitCoverage=47%, E-value=6e-12, Identity=24%"; Hit description =Putative uncharacterized protein
MSAPEPSLGTEKRRIDWDQLLAGIGGRTINWFPRWKEGKEGVLFSCGGYPNILLVGMRGCINYNPALAIRQLGYPMRGAPTEESMSPFLVRDFGAQNFKAIQRIHKAWETPLRKDQELRGIRNGIIGGYHGWLKVHIREDEEVQALKSESGKAKLAKEKFKLAATHVRKECAGLREENTITARALEQETKRARKEEYGRNKFRGALWGSNSELKLRREERDQSRAHSMVLKEELIACSRSKRSLSQRLCETETNMLVIIAKYEEELGLATAHEHRIADEYAQVYAEKEARGRVIDSLHQEATMWMDRFALTLNGSQELPRLLAKAKAMADTYSAPEEIHGLLGCCQHMIDLMAHIIRNR

SEQ ID NO: 147510 - protein, 160 aa, Glycine max
  Coding DNA Sequence Number=SeqID_55825
PTQLNIFIDGLRPQSKQLLDASVGGKIKLETPEEATELIENRSASDHAILCDRVHQPTKKSLLELSTLDAVLAQNKLLSRQLEILTETLSKLPTNLSNGQPLQPSVLQVTGCTIRGGTHESDLCIPFEEKMQEVSYMGNQQRQGGGFLGFHQGPYNQQGQ

SEQ ID NO: 147511 - protein, 83 aa, Glycine max
  Coding DNA Sequence Number=SeqID_55826
MEAKNESLFLDDGDLSWPTAAWVVAKIRRYMISTTTLFCRMQKWSLSPSQNTIHNKTPKTETGEALNRKTETGEALNRKQNTH

SEQ ID NO: 147512 - protein, 51 aa, Glycine max
  Coding DNA Sequence Number=SeqID_55827
MDPKRIKVILEWPTPPSVEERIHEFQEPLDLRSNPFQRGGNDAILPPKGIG

SEQ ID NO: 147513 - protein, 69 aa, Glycine max
  Coding DNA Sequence Number=SeqID_55828
MGLKSRTHMSNQFNFKICTNSKTKGENLYDDKGDDKKLKDQSKNNSSESRTIQEFKIRIKKNSRLKKKV

SEQ ID NO: 147514 - protein, 140 aa, Glycine max
  Coding DNA Sequence Number=SeqID_55829
MTGRLLAGSLAFESRILHYLIVRILLPRSSNLAQRSFLIGAAVIASFGYRKERDGSWVKKGAQPVDEEGNLPVEDNSTLLRRLMDKFDGLQTFVGDKFDAMELQVDMGFDAMESRITKVEEDVSFIRTCFDPPPPPPSSS

SEQ ID NO: 147515 - protein, 74 aa, Glycine max
  Coding DNA Sequence Number=SeqID_55830
MDQVWGWLSCLQGKNLLEHEEAGHLFFHCKMTKGLWWESMRWIRGIGALPADPASHFIQFCHYYCGVLGELLTS

SEQ ID NO: 147516 - protein, 186 aa, Glycine max
  Coding DNA Sequence Number=SeqID_55831
MGEYAKDEELLIHSFQESLTRTTVAWMQLQNICKKGDGSFKEHAQKVEGSGGPGATPNDGKGDDDRDGRHIIRYSTMKRWWATHPQSFADLVFASERIDVGPKRGKFDHPTRTTEKTGANEEGEKEGETHAVTAIPIRPSFPPTQQCHYSVNNKPPPYPPPSYPQRPSLNLTTKSVYRTSNDEHHL

SEQ ID NO: 147517 - protein, 142 aa, Glycine max
  Coding DNA Sequence Number=SeqID_55832
VVGCTICGRAHESGCCIPIEEHPTHEVNYMGNQPKNNFNVGRFSGFQHGQQYNQQQGQWRNHPRNQFNRDQGGPSIRPQQQGPSLYDRTTKLEETLTQFMQEHKQLLEPKPTLEPVSDFVELEEINEETEDDKEEKRKKKKE

SEQ ID NO: 147518 - protein, 147 aa, Glycine max
  Coding DNA Sequence Number=SeqID_55833
  Gene Ontology: Mol. function=helicase activity; Biological process =viral genome replication
  Homolog annotation: Hit_ID=Q9C7W5; Match level="QueryCoverage=70%, HitCoverage=18%, E-value=4e-21, Identity=37%"; Hit description =Putative uncharacterized protein F15H21.18
MHTIEFQKRGLPRVHLLLFLHPGNKYPSSTDIDQIISVEIPSHEDDPKLYRLVQNHMIHGPCGILQPNSPCYDRVTVVMVSNSNDTTQNVNIQNDELKEYLDCRYISPCEAAWRIFAFPIHDKKPAIERLCHEQTWRSLEPMLALAG

SEQ ID NO: 147519 - protein, 47 aa, Glycine max
  Coding DNA Sequence Number=SeqID_55834
MLSRQLGGSKKRPPSKTPTAAHLLSRTKVRDHHRHQPHGTKIAREIA

SEQ ID NO: 147520 - protein, 130 aa, Glycine max
  Coding DNA Sequence Number=SeqID_55835
MIMRGQDIYSSQDEATSSPSSSESEEAKREESSEEIYPQEEEQPLMVKECKELSVSSKRLPKKERYFEIKTNIKVISPLRQPPHFLLCEKTLVSIATSLRLEFIPQVQELLDEGLVRKSLDPCALLVPKI

SEQ ID NO: 147521 - protein, 352 aa, Glycine max
  Coding DNA Sequence Number=SeqID_55836
MSSRKRKSVSSRPTAQYDTRRFHSFEAWTRYTDNVLGRHILAERKVEIYHTELDEFKGELERRNFHKRLTNLADSSIDLALVKEFNANLYSPEGPSPEQVRIQGHIIRIDAGRLNAFLETPVVLAKGESLLAYSRYCRMPTDIREIEAALCIPGQGFILNAEGHSGNILRKDLTTLAQVWSVLSYSNLALTSHTSDLIMDRARLIFGLVTQLDMNVGALIFGQITSMAQSNSSRLRFPTLIATLSRTKGVSSNSLVFERLSPVINLAYIRKNCWNPNKPTIIIRGARRPRARPAKAPYTSAVPHLASTSAAPSSTCIAAAPSTPPPADFNVSKPCFEAYIRGRLFCCKVFSW

SEQ ID NO: 147522 - protein, 68 aa, Glycine max
  Coding DNA Sequence Number=SeqID_55837
MGVKYLKVVKRGSHPNKQMAPNDPNLSLRAIGHDCPRMAKDTIVSEWQKGVRNDHNLSPHVIGLAASG

SEQ ID NO: 147523 - protein, 203 aa, Glycine max
  Coding DNA Sequence Number=SeqID_55838
MELTSPVVLAEGETLPTYSRYCRLPTDYREIEVALCIPGRGFILNAGGHPERILKKDLTTLAQVWSVLSYSNLAPTSHTSNLIVDRARLIFGLVSRMDMNVGALISCQITSIAQSNFSRLGFPALITALCRARGVVSDSLTFEHLSPVINLAYIRRNYWNPNDLTVSIREQLLQSQLRQILNALKPCFRAFIRDRSFYCRVYK

SEQ ID NO: 147524 - protein, 147 aa, Glycine max
  Coding DNA Sequence Number=SeqID_55839
MRAGNFDIYGFLEPQSIQRSGQSQFESESYIKTWMQSSKRDVYLGAYLNGPDNYLKGIINSALKGLDDAPQPKSKTPARWIVVKCNRQKESTECGYYVMHWMSTIILGTFRNNWEAYFNDPRPLEPERLKALRIQWAQFYLRVRDQA

SEQ ID NO: 147525 - protein, 84 aa, Glycine max
  Coding DNA Sequence Number=SeqID_55840
SPYQLDFTLYASGSYNAQWNAPGLLHDKHTLRSSRILRKVEVDEPWLGLWLPLNYQVDMGANQHRTLELGWCFVIGSAVDRLGG

SEQ ID NO: 147526 - protein, 213 aa, Glycine max
  Coding DNA Sequence Number=SeqID_55841
  Gene Ontology: Mol. function=N-methyltransferase activity; Biological process=DNA methylation
  Homolog annotation: Hit_ID=A4TSW0; Match level="QueryCoverage=100%, HitCoverage=94%, E-value=1e-121, Identity=97%"; Hit description=DNA methylase
  Pfam annotation: Domain name=N6_N4_Mtase; Domain location=9-191; Score=183.9; E_value=4.2e-52; Accession=PF01555.9; Description=DNA methylase
MSGFPDNAVDFILTDPPYLVGFRDRQGRTIAGDKTDEWLQPACHEMYRVLKKDTLMVSFYGWNRVDRFMAAWKNAGFSVVGHLVFTKTYTSKAAYVGYRHECAYILAKGRPRLPQNPLPDVLGWKYSGNRHHPTEKPVTSLQPLIESFTHPGAIVLDPFAGSGSTCVAALQAGRRYIGIELLEQYHRAGQQRLAAVRRAMQYPAANDEFPEAA

SEQ ID NO: 147527 - protein, 16 aa, Glycine max
  Coding DNA Sequence Number=SeqID_55842
NLLKEASQGGELSYEK

SEQ ID NO: 147528 - protein, 108 aa, Glycine max
  Coding DNA Sequence Number=SeqID_55843
  Subcellular localization annotation: CTP_CleavageSite=49; ConfidenceScore=5.80e-01
MGSPPASTPPPPPPPPSPPPPPSDASASPSAVKRTRKASRLRSLSTRPPGAERQVVHVDPATGKADGPHMKKLRTYLGIVARDKVDITYENWKKVPTAQKDLIWEDIQ

SEQ ID NO: 147529 - protein, 175 aa, Glycine max
  Coding DNA Sequence Number=SeqID_55844
RQRTTRPRLERTTRPHHQRAARPYLQRTTCPRLERATRPHLGGLHVLAFKGSCTFNFRGLHVLAVKGSCAFTFVGLHALTFRGLHVLTIRGLHALTIRGLHVLAFRGLHALTLGTSYPHRQRTTRPRLERTTRPHHQRAARPYLQRTTCPRLERATRPHLGYYLPSPSEDYTSSP

SEQ ID NO: 147530 - protein, 82 aa, Glycine max
  Coding DNA Sequence Number=SeqID_55845
MGRDLKKVPQHLNAISVIDPVTYIKAHCPTNESWPEKKSHEERRSKKAYIAWDDNDSSDGSEKEINLLSKDYEIDENISQED

SEQ ID NO: 147531 - protein, 204 aa, Glycine max
  Coding DNA Sequence Number=SeqID_55846
  Homolog annotation: Hit_ID=A5AWV0; Match level="QueryCoverage=93%, HitCoverage=13%, E-value=2e-12, Identity=26%"; Hit description =Putative uncharacterized protein
MTLTILKLFLRPYQVTWDATVFGVFNPDFPLYIKHEDFSEIAHGGQCLSISVLELWILHLTETSMRAGNSNIYGFLEPQSIQRFWQLQFETESYIKSWMHSSKCDVYLGAYLNGRHWQMVVIMPKEHLIVWFCSLHNRPDNYLKGILNSALKGLDDAPQPKSKAHARWIVVKCNRQKGSTECGYYIMHWMSTIILGSFRNNWEA

SEQ ID NO: 147532 - protein, 110 aa, Glycine max
  Coding DNA Sequence Number=SeqID_55847
  Gene Ontology: Mol. function=structural constituent of ribosome; Cellular component=ribonucleoprotein complex; Biological process =translation
  Homolog annotation: Hit_ID=P56791; Match level="QueryCoverage=98%, HitCoverage=47%, E-value=2e-29, Identity=55%"; Hit description =Chloroplast 50S ribosomal protein L2
  Pfam annotation: Domain name=Ribosomal_L2_C; Domain location=15-110; Score=121.4; E_value=2.6e-33; Accession=PF03947.9; Description =Ribosomal Proteins L2, C-terminal domain
WEEVLIDQKEESTSTDMPLGTAIHNIEITLGKGGQLARAAGPFDIQKLLGTVGQVGNVGVNQKNLGRAGSKCWLGKRPVVRGVVMNPVDHPHGGGEGRAPIGRKKPATPW

SEQ ID NO: 147533 - protein, 58 aa, Glycine max
  Coding DNA Sequence Number=SeqID_55848
EERHGKHEKALSIIPSLITNTSLATIWKVYPAYMSFMASLAKRRKCKEDVFYVTFMPP

SEQ ID NO: 147534 - protein, 120 aa, Glycine max
  Coding DNA Sequence Number=SeqID_55849
  Gene Ontology: Mol. function=sequence-specific DNA binding; Cellular component=nucleus; Biological process=regulation of transcription, DNA-dependent
  Homolog annotation: Hit_ID=A7LHI8; Match level="QueryCoverage=35%, HitCoverage=16%, E-value=1e-17, Identity=95%"; Hit description=WRKY52
  Pfam annotation: Domain name=WRKY; Domain location=42-96; Score=39.0; E_value=1.2e-08; Accession=PF03106.6; Description=WRKY DNA -binding domain
MRKEKIPHQAPFAIQAAQLLGRAIGAGLFAITPAGERGMCCKAIKLGNARVFPVTTLGYYRCSSSKGCPARKQVERSRVDPTKLIVTYAYEHNHSLPFPKSNSSAASAAVSDGGVPSSNS

SEQ ID NO: 147535 - protein, 173 aa, Glycine max
  Coding DNA Sequence Number=SeqID_55850
TKFGHLHPLYHPEAAGPMIRGDTLRLSAPVCHPEAAGPMTSRDQVWSFGTLVSSRGGGPDDTRRYLTVIRTLLSSRGGGPDDKQRPKAAGPMTSRDQVWSFCTLVSSRGGGPDDTRRYLTVIPHPFCHPEAAGPMTSRDQVWSFCTHDTRRYLMVIRTLLSSRGGGPDDKQRP

SEQ ID NO: 147536 - protein, 20 aa, Glycine max
  Coding DNA Sequence Number=SeqID_55851
FVKEFTKIVEISSGLLEYWT

SEQ ID NO: 147537 - protein, 94 aa, Glycine max
  Coding DNA Sequence Number=SeqID_55852
MGELKYFLGLQIKQTQEEQAACNRLQLPVIDYQKALTPVIDYQALYVQLQLVLVYKELTKSELVCAATASPHASSIPRTSNLRISLNSSPNHVP

SEQ ID NO: 147538 - protein, 76 aa, Glycine max
  Coding DNA Sequence Number=SeqID_55853
PLIELVRNHVPSWEDAQEMGFQTLPYSNIPNTTNTYVFVLFTRVEEKSLEFQKPRDLRSNTFQGVGNDAILPPQGH

SEQ ID NO: 147539 - protein, 193 aa, Glycine max
  Coding DNA Sequence Number=SeqID_55854
MSSIVYRDHAHETPSGPGEFQQGPGVSSCGYGPLSILQGVAPPRHPVDSEEPNRALGFPALVTGLCQSYRAPIPPASSCHRDIGITPARHSVDPEKSNRVLGFPALIMGLCQFYGVPVTPSKVIKPSTNRAFIKKYCAPRQAQGETPQQPGVGRQQATDTPPPPPKPLSSSTKTGALPTTCGRPAGDQVQSQR

SEQ ID NO: 147540 - protein, 85 aa, Glycine max
  Coding DNA Sequence Number=SeqID_55855
YGNLSTIALSLKDPVSVKERRERFLQAKIHNICARAKGQEDEDNLWTLCFVGNSVESVDIKKELSLGHVKFDQFKRQQSGSGNAD

SEQ ID NO: 147541 - protein, 50 aa, Glycine max
  Coding DNA Sequence Number=SeqID_55856
MEQKKELPKGEFSGFRCVLECFETKLIRQIGKSVVFTFSLSQYAGLASNR

SEQ ID NO: 147542 - protein, 138 aa, Glycine max
  Coding DNA Sequence Number=SeqID_55857
MDPKKSHRALGFPTLVTGLCQSYRVPVPPARSCHRDIGIAPTKTPSGPREVQQGFGGSCPTRHPVDPKKSNRVLELSSSNYGSIKGIRPLTNRAFIKKYCVSRQVQGDTPQQPGDGRQRATDAPPSPLEFISAHPQKG

SEQ ID NO: 147543 - protein, 42 aa, Glycine max
  Coding DNA Sequence Number=SeqID_55858
MEEIHGEDDEEQRRRKGDWRHHFKEKMSQEQAHHYRKPWIRA

SEQ ID NO: 147544 - protein, 157 aa, Glycine max
  Coding DNA Sequence Number=SeqID_55859
  Homolog annotation: Hit_ID=Q2QVF2; Match level="QueryCoverage=46%, HitCoverage=8%, E-value=1e-09, Identity=37%"; Hit description =Transposon protein, putative, CACTA, En/Spm sub-class
  Subcellular localization annotation: CTP_CleavageSite=43; ConfidenceScore=5.71e-01
MATQSNSPPPPPPSTGVTSHSSSPPLKRTRKASRLRLLATRPVGAERPPYGPHSKKYKTYLGIVAHDKVDVTYENWKHVPITQKDLIWEDIQAEFDIPEASDLRTKKKILQTVGERWRQFKSDLTLKWALVADKDSVDDTNVRKKAQAVQKQNTALT

SEQ ID NO: 147545 - protein, 122 aa, Glycine max
  Coding DNA Sequence Number=SeqID_55860
MEFADHLLLAGQLCLVPGQVSADYMEWFFRISHPFMTPTQAGDQQRDAPAADPEDYIQPPSPQDDYEGYEAIAQRLERVLNLRIVTAGTELYDIMQDCLTIARGGPSADGTARARQRRRTDH

SEQ ID NO: 147546 - protein, 125 aa, Glycine max
  Coding DNA Sequence Number=SeqID_55861
MTEGCGEGFCLANLPGDAFSLWGNFSEAKKQMMADAKFAGLLGLARVGGAELWPRAKFRIGWPPPPPREGRIKATRAESQWIVAARPLCHLQYPVAYLSRLQRILPAARWELRFKASRRANPPHE

SEQ ID NO: 147547 - protein, 132 aa, Glycine max
  Coding DNA Sequence Number=SeqID_55862
MSHHQRAARPHLQRTTRPRLERATRPRLGGLHVLTFVGLHALTFRGPHVLTFRGLHALAIRGLHVLTFVGLHALTFRGLHVLANRGRHAFTFRGLHVLVNRGLHALTLRGLHALTSRGLYILAFERVARPHL

SEQ ID NO: 147548 - protein, 100 aa, Glycine max
  Coding DNA Sequence Number=SeqID_55863
  Subcellular localization annotation: CTP_CleavageSite=52; ConfidenceScore=5.24e-01
MTHQDFQVQAIGQFAQATCTPEFGLPRPFNQRLLVLHVGGVSVKQQGQPFPCVQESSTIRDSQSLNPFSEVRRREEEIFLKRDRLYNEDQSKFLIEYASG

SEQ ID NO: 147549 - protein, 204 aa, Glycine max
  Coding DNA Sequence Number=SeqID_55864
MTLLLSNILPSDRNADLPLRKYRLGSHPQDTQWTRRSPTGPWGFQLGLRASVSPTCPHFQRLHVLTFRGLHTSSPSEDYMSSLLEDYASSHSEDYTSSLSEDYMSSPSEDYTSSPLEDCMSSLSEDYTSSPFRGLHVLNFRGFHALAFRGLDVLAVRGLDVLAFRGLHVLHFRGLHVLAFRGLRALAFSGLHIRTLREFKVLYP

SEQ ID NO: 147550 - protein, 121 aa, Glycine max
  Coding DNA Sequence Number=SeqID_55865
  Homolog annotation: Hit_ID=A6FJQ2; Match level="QueryCoverage=31%, HitCoverage=84%, E-value=3e-11, Identity=92%"; Hit description=50S ribosomal protein L5
MTVKTSDTCSSRRRSQLVCKRMPGADKPVRARQRMRKEKIPHQAPFAIQAAQLLGRAIGAGLFAITPAGERGMCCKAIKLGNARVFPVENGELHKAITTHSSKLEGGGNMNENAIHGDPKK

SEQ ID NO: 147551 - protein, 252 aa, Glycine max
  Coding DNA Sequence Number=SeqID_55866
  Homolog annotation: Hit_ID=Q84VI1; Match level="QueryCoverage=100%, HitCoverage=36%, E-value=3e-92, Identity=73%"; Hit description =Envelope-like protein
MATSPKETSAPGSPAVRSSPHQEQPEFNIQPIQIIPGQASVPEKLIPRRQQGVKIAENPSPATSPREVDTEMDKKIRGIVSSILKDASVPDAEKDVPTSSTPDVSVPDVNQDVPTSSAPNAEALPSPSEEESTEEEDQASEETPAPRAPEPAPGNLIDLEEVESDEEPIANRLAPGIAERLQSRKGKTPIKRSGRIKTMAQKKSTPATPATSRRSKVAIPSKKRKEISSSDSDDDVELDVSTSKRAKKSGRK

SEQ ID NO: 147552 - protein, 74 aa, Glycine max
  Coding DNA Sequence Number=SeqID_55867
DRRRKVHNSNTAVNSPVVEVTIDYDGHGDTTVVEVTTDYDGCLPKTVVEWSYHYNGVLLRTTVVRDGVNTTTVT

SEQ ID NO: 147553 - protein, 112 aa, Glycine max
  Coding DNA Sequence Number=SeqID_55868
MASKKISTKRSRRDTAAEGSSAALEFDNHRFRSTEHQQRFKTIKGWSFHRERRVQLREDEYTDFQEEIARRHWTSLVTPMAKFDPEVVLEFYANAWPTKEGVRDMRSWVRGQ

SEQ ID NO: 147554 - protein, 107 aa, Glycine max
  Coding DNA Sequence Number=SeqID_55869
  Subcellular localization annotation: CTP_CleavageSite=17; ConfidenceScore=5.63e-01
MHTRSFTNPQFLKSRPNSQKVPSGVANCRNVPFAGERGRGSRMRFPKEERCAESPPMFICGKRRENRRKPVKMRILSSEVVFTLEEGRQKRGFCSYVPSFGEKIRPT

SEQ ID NO: 147555 - protein, 236 aa, Glycine max
  Coding DNA Sequence Number=SeqID_55870
MATKKLFSKRARKDAAGEGSSAAPQADMEFDGHRFRKIVMEFYANAWATEEGVRDKHSWVRGQWIPFDEDAINQFLEHPLVLEKGQRCEFSQRRSQTSRFDEEAIGQLLCVPRQDFTRSVTRRRVQIMRTSMTTLTQIWMTLLLSNILPSNHNSDLPLPKFQLVYTIFTQAANHRDQVQLNESFYQYTLHQQSQDPNPFPWPTPEQFGATVAWPKDRPSFQAGAGPTGTPEDEDGA

SEQ ID NO: 147556 - protein, 102 aa, Glycine max
  Coding DNA Sequence Number=SeqID_55871
  Gene Ontology: Mol. function=hydrogen ion transporting ATP synthase activity, rotational mechanism; Cellular component=proton -transporting ATP synthase complex, catalytic core F(1); Biological process=ATP synthesis coupled proton transport
  Homolog annotation: Hit_ID=Q06RC3; Match level="QueryCoverage=100%, HitCoverage=100%, E-value=2e-42, Identity=71%"; Hit description=ATP synthase epsilon chain
  Pfam annotation: Domain name=ATP-synt_DE; Domain location=54-101; Score=63.3; E_value=8e-16; Accession=PF00401.11; Description=ATP synthase, DeltaEpsilon chain, long alpha-helix domain
  Pfam annotation: Domain name=ATP-synt_DE_N; Domain location=2-70; Score=42.7; E_value=1.3e-09; Accession=PF02823.7; Description=ATP synthase, DeltaEpsilon chain, beta-sandwich domain
  Pfam module annotation: Pfam domain module=ATP-synt_DE::ATP-synt_DE _N; Domain location=54-101::2-70
MTLNLCVLTPNRIVWDSEVKEIILSTNSGQIGVLPNHAPIATAVDIVNDAEKGSDIDPQEAQQTLEIAEANLNKAEGKRQTIEANLALRRARTRVEAINVIS

SEQ ID NO: 147557 - protein, 182 aa, Glycine max
  Coding DNA Sequence Number=SeqID_55872
  Homolog annotation: Hit_ID=A5BSC1; Match level="QueryCoverage=88%, HitCoverage=7%, E-value=3e-20, Identity=33%"; Hit description =Putative uncharacterized protein
  Pfam annotation: Domain name=zf-CCHC; Domain location=68-85; Score =30.4; E_value=6.6e-06; Accession=PF00098.14; Description=Zinc knuckle
MTRKRKELHLKPHLLFKKKVTEDLNEIKEDDDFSFFVKRFNKLLRNKVNQRRTNFNPKKKGEDSPSIPKCYECNKPGHLRVDCPSFKKRMEKSDKKNFKDKKTKKAYITWEDSDIDSSGDSKNEVVNLSLMAKNYDSEEEGFLKKSWYIDSRCSKHMTRDASKFTHIPSKKSGHVTYGDNNK

SEQ ID NO: 147558 - protein, 72 aa, Glycine max
  Coding DNA Sequence Number=SeqID_55873
MTPSGPGEVQQGPGVSKLWLWASVSPIGCLVPPARDRCPQDTQWTRKEVQQGLGVSKLWLWASVSPIGCPSP

SEQ ID NO: 147559 - protein, 73 aa, Glycine max
  Coding DNA Sequence Number=SeqID_55874
  Subcellular localization annotation: CTP_CleavageSite=15; ConfidenceScore=5.18e-01
MKGGGCTVAHPSELLAFSRSNLARPGKLVTSTLSFLVGPGAGKCPKSDPFVLLLNILLISFRNVTKPYRLHGN

SEQ ID NO: 147560 - protein, 283 aa, Glycine max
  Coding DNA Sequence Number=SeqID_55875
  Gene Ontology: Biological process=transposition, DNA-mediated
  Homolog annotation: Hit_ID=Q6UUU1; Match level="QueryCoverage=21%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPVTTLNSISLVLTVYSFLACKYTVLGSGNAGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 147561 - protein, 156 aa, Glycine max
  Coding DNA Sequence Number=SeqID_55876
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=54%, HitCoverage=71%, E-value=1e-24, Identity=69%"; Hit description=LacZ protein
MEHWKAAKKVLRYLQGTKDHMLTYKRLIGCGTSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 147562 - protein, 168 aa, Glycine max
  Coding DNA Sequence Number=SeqID_55877
DAGSRQARQGASAGVGGCRGWLNYAASEQIVLRVHHMRCEIPHRCVRRKYRIRRHSPFRLRNCWEGRSVRASSLLRQLAKGGCAARRLSWVTPGFSQSRRCKTTASAKLACLQVDSRGSPAPSPNKDITKTVVYMSPSDQEDMTILYKFPRTLHYIPRKTCPSPKLCP

SEQ ID NO: 147563 - protein, 68 aa, Glycine max
  Coding DNA Sequence Number=SeqID_55878
QAFAKRDTQWLSARKNPEEDELLGFQVIKRTASAHPLSERSALSQKLLTCTKQSICALSAQARTRPLI

SEQ ID NO: 147564 - protein, 166 aa, Glycine max
  Coding DNA Sequence Number=SeqID_55879
  Homolog annotation: Hit_ID=Q8LI60; Match level="QueryCoverage=77%, HitCoverage=22%, E-value=2e-07, Identity=26%"; Hit description =Putative uncharacterized protein OJ1634_H04.130
TPGPLDPAPGKEDGPHRKKLRTYLGIVAHDKVDVTYENWKEVPTAQKDLIWEDIQTEFDIPDASDSDLTSKWALVVDKDSVDDTICEKYDISKEKWAQFCQIHKDPSWEAIQKQNTVPHVLSRGGYEYLENKLMDEKRKKKLEEAAQFGSTDTVIDPSSPIRRHVK

SEQ ID NO: 147565 - protein, 129 aa, Glycine max
  Coding DNA Sequence Number=SeqID_55880
  Pfam annotation: Domain name=Transposase_23; Domain location=51-121; Score=17.3; E_value=1.5e-05; Accession=PF03017.5; Description =TNP1ENSPM transposase
  Subcellular localization annotation: CTP_CleavageSite=34; ConfidenceScore=5.29e-01
MASFSQMQSLIQSQMQSQGLALPPEPLVGPSGTRVSTKGSCVDPSGNDSETGDSDRCGLYIEVDPARLVALGRVCEGSTIVHNTPLLPGQVKVSVEEVTHVDAPVPVPTDEVSIVGQALHTFLAWPTHL

SEQ ID NO: 147566 - protein, 106 aa, Glycine max
  Coding DNA Sequence Number=SeqID_55881
  Subcellular localization annotation: CTP_CleavageSite=64; ConfidenceScore=5.13e-01
MTMQNMQFQQETGASIHSLTNQMGQLATQLNQQQSQNSDKLPSQSIQNPKNVSVITLRSGKQCESSTGNSDLQKYHIHLPFPPRAISNKKMEEAEKEILETFRKVE

SEQ ID NO: 147567 - protein, 268 aa, Glycine max
  Coding DNA Sequence Number=SeqID_55882
  Gene Ontology: Mol. function=inorganic phosphate transmembrane transporter activity; Cellular component=1-2nm peptidoglycan-based cell wall; Biological process=phosphate transport
  Homolog annotation: Hit_ID=A8GHP5; Match level="QueryCoverage=94%, HitCoverage=45%, E-value=1e-46, Identity=39%"; Hit description =Phosphate ABC transporter, inner membrane subunit PstA precursor
MVLGETLDRQQQGDRWRYVVKTGNRDFAAPDFRVIVSQGEAQTRRPAEVLVLQRRSGGNAYGWLVELREDNEVLTARDRDALLQQRLKQVHEQLRQASNIRRIEMARLNAQLESLQQQADEQRRGGHFSLQDQSELDANSAALHKRFGALAQQLAHLQHESQRDTLVLRDVQGDDHLIPLAQVVAAWYPNSLSLGQKIGHFLSQIWQFVSDSPTSGGSENGALPAIFGTVLMVLLMSVIVMPLGVVAAVWLHEYAGRNALTRLVRIAV

SEQ ID NO: 147568 - protein, 69 aa, Glycine max
  Coding DNA Sequence Number=SeqID_55883
MALEWWSQMKHPVPVGKNGSGMEKEEREEMPLKEKMSLEEAHHHRRPWIRAWRKKEMNEGRGREEHKIL

SEQ ID NO: 147569 - protein, 89 aa, Glycine max
  Coding DNA Sequence Number=SeqID_55884
MSYFGVIQEIWEVDYTSFRVPVFKCQRVNGTTGRPSGMTYHNDESTLDIGQMSSFSKQLPSMNEADEVDDGHANRVDHDEGLWENIPTG

SEQ ID NO: 147570 - protein, 56 aa, Glycine max
  Coding DNA Sequence Number=SeqID_55885
ALKDERKRGWGHDRPIVTLLCAKQAGNVAARQPPPNSDLSKFKLGKMLIPEEGGDM

SEQ ID NO: 147571 - protein, 237 aa, Glycine max
  Coding DNA Sequence Number=SeqID_55886
DVRKKAQAIQKQNTSPHVLSRAGYEYLEQKLLAEKTKKKLEETAQSGSSVDGIIDPPSLVRCHDSFEEQATQGSFVFHGRQDVLTATIGRPEHPERVTIKQYFGSAPRTSHSSSSLCPEELQQLTRQIRDQLEESISKKVTRQLMASFSQMQSQMQSQGLALPPEPLVGPSGPRVSTKGSCVDPSGNDPETGDSDRCGLYIEADPARLVALGRVYEGSTVVHNTLFVAWPCKGGCGG

SEQ ID NO: 147572 - protein, 74 aa, Glycine max
  Coding DNA Sequence Number=SeqID_55887
  Homolog annotation: Hit_ID=Q2HW89; Match level="QueryCoverage=33%, HitCoverage=2%, E-value=8e-08, Identity=96%"; Hit description =Integrase, catalytic region; Ribonuclease H
MGNSPPRLDSIQRLCKAFANLLQRSGVEAASLVMRTKCDVSNPLSSMYEWPFSMWGIDVIGRIEPKASNGHRFI

SEQ ID NO: 147573 - protein, 88 aa, Glycine max
  Coding DNA Sequence Number=SeqID_55888
MENWRKALRNNFAGLQTRRGEWRIGEQRYAITLRGSRLEGGGCMNSARQSHSWDSEKKWRMENWRTVLPNNFAGLQTRSGGHMNSARE

SEQ ID NO: 147574 - protein, 231 aa, Glycine max
  Coding DNA Sequence Number=SeqID_55889
MKADMEAIKEKMTTLMEAMMSMRKMMEVNTATVVAASTAAKVDSTHPPGYNQVNHLASDMVGQGGEELESAGDPYFVPIQNNHSFPPCGLPPNYTPPNVVHTPDENVDNSTPIPVKSQQPQSNHAHISQPIGETHEVPRGHTLVDFKPHLGYATEGETFFSAPLPNALGGPQYRPQPQPLHFAMGEGPPAMVEREKFDHIEERLRVIEGGRHYAFADMAELCLVPDVVIPL

SEQ ID NO: 147575 - protein, 109 aa, Glycine max
  Coding DNA Sequence Number=SeqID_55890
MKHSSKLEGGGHMKQALNQRLYIIEKKIPGRIGMTVAPLYLPLIGDKRKAKIDIDFVRPALSVMTILAIMKHSSKLEGGGHMNSARRGSEKSGEWRIALEGPHLGNHEA

SEQ ID NO: 147576 - protein, 197 aa, Glycine max
  Coding DNA Sequence Number=SeqID_55891
MRRNFEAPEEDEEVRALKLELGKARLAKEKLKSAATHIRKECTELQEENAATARALEQETKRAHLFDTFDRRCEKNSARIVCCLPALCVWLVSHLFQQDTRHPCPLQSYRSCAEKGRVDWDQHLAGYGGNAINWFPHWKGKARKEFFSRVGTTLMFTLIGTRGCINYNPALAIRQLGYPIEHCKSANMKNSLSPYLE

SEQ ID NO: 147577 - protein, 183 aa, Glycine max
  Coding DNA Sequence Number=SeqID_55892
  Homolog annotation: Hit_ID=A7UQU7; Match level="QueryCoverage=72%, HitCoverage=22%, E-value=4e-19, Identity=39%"; Hit description=IMP dehydrogenase/GMP reductase, putative
MYDHLNDASQASTRQLAGYITLLHCWIYEHFLTVHTSVVDDAYDEGSPRACRWLTGKAHITGIKGAPYRRRLDALSVTDVCWMPYDEHQRVRAFDLISSYTGQLRWGQIVVYVRPEQVLRQFGYLQTVPSPPVCDSLTGDDIDDRWLNFPDHLVYSRELCVVPGQVAADYMEWFFRISHPFVT

SEQ ID NO: 147578 - protein, 118 aa, Glycine max
  Coding DNA Sequence Number=SeqID_55893
  Pfam annotation: Domain name=zf-CCHC; Domain location=51-64; Score =9.7; E_value=0.053; Accession=PF00098.14; Description=Zinc knuckle
MKKKIEMMKKTFPSLLRNFRNSSRKEELTGVRISIMEENHKMILKSLGVTTCNQIGHIKANCPSNEEWSEKSEKKRFDERRTKKAYIAWDDNDSSDGSEKEINLLTKDYESDENISQG

SEQ ID NO: 147579 - protein, 353 aa, Glycine max
  Coding DNA Sequence Number=SeqID_55894
  Gene Ontology: Mol. function=nucleoside-triphosphatase activity; Cellular component=outer membrane-bounded periplasmic space; Biological process=transport
  Homolog annotation: Hit_ID=A4W743; Match level="QueryCoverage=54%, HitCoverage=87%, E-value=6e-92, Identity=80%"; Hit description=ABC transporter related precursor
  Pfam annotation: Domain name=ABC_tran; Domain location=140-286; Score= 147.7; E_value=3.2e-41; Accession=PF00005.18; Description=ABC transporter
LEKDGTVLTDSEKVGQWGAPTLDVWVVRKDFAEKHPEVVKAFAKSAIDAQQPYISNPDEWLKQPANLEKLSRLSGVPEADVPGLVKGNTYLTPAQQVQQLTGPVNKAIVDTATFLKEQGKVPAVAADYSQYDINLTLDSGELLVVLGPSGCGKTTLLNLIAGFVPYQHGTIQLEGKKLAGINREQRLETARAMLKKVGLEGAEKRYIWQLSGGQRQRVGIARALAANPQLLLLDEPFGALDAFTREQMQTLLLRLWHETGKQVLLITHDIEEAVFMATELVLLSPGPGRVLERLPLDFARRYVAGEPVRSIKSDPLFIEQREYRRHAAGTAGGVVGSCCPAVGQPAVSAAAGT

SEQ ID NO: 147580 - protein, 69 aa, Glycine max
  Coding DNA Sequence Number=SeqID_55895
MRVTGFGSVLGRIDSLLKGNPSLALEGIDLFRFWRGSITMPIGWTSHKSGVDIEEEELTDLRSNLLDLE

SEQ ID NO: 147581 - protein, 314 aa, Glycine max
  Coding DNA Sequence Number=SeqID_55896
  Homolog annotation: Hit_ID=A5B5G7; Match level="QueryCoverage=68%, HitCoverage=15%, E-value=1e-08, Identity=24%"; Hit description =Putative uncharacterized protein
MTSKKRKTPSTPTQARFDRSRFTSQEAWERYTDIVVPRKLLLKRNVVVYCTEFDEFKKELEIRHWDEKLTDFADSSIDIAIMKEFYTNLYDPEDKSPKQVRVRGYLVKFDEDTLNTFLKTLVILKEGENLCTYSRFALLRSDPQELAAKLCIPGRGFTLNVDGQPLKILRKNMTTLAQTWSVISFSKLIPTSHTSDVTLDRAKFICGIIVKMDMNLGYLISHQISLIAQHDTSRLGLLAFIITLCKAREVQSDSRSLENLSPAINLAYIKKNCLNLDDPTVTFRRPRKARGKRSEVPTTSAAPETPTPSSSIAP

SEQ ID NO: 147582 - protein, 102 aa, Glycine max
  Coding DNA Sequence Number=SeqID_55897
  Homolog annotation: Hit_ID=Q1SWI0; Match level="QueryCoverage=98%, HitCoverage=19%, E-value=8e-08, Identity=35%"; Hit description=RNA -directed DNA polymerase
MAFNRALFMKWKWLMFQQQDHLWSRILTSKYRGWRGLEEGPPKQIFSSWWSDLRSIIIHHSSMVAVNKQFRWKLGSGDQILFWEDFWVGDGITLKDKYPELY

SEQ ID NO: 147583 - protein, 64 aa, Glycine max
  Coding DNA Sequence Number=SeqID_55898
MECPGTPPWYLQVALGSYHFGKGGKFLVVLELPAGRVVFGVGTWGASLWVGALGCTGVELEAFP

SEQ ID NO: 147584 - protein, 120 aa, Glycine max
  Coding DNA Sequence Number=SeqID_55899
  Subcellular localization annotation: CTP_CleavageSite=67; ConfidenceScore=5.22e-01
MVKVGTSLRADQRLIFAKKLAQGFPVLQVASVFYSAVPPVQLLTGVRWQSVAVPAARNPPHPAALKCAATGRVPFAIQAAQLLGRAIGAGLFAITPAGERGMCCKAIKLGNARVFPVTTL

SEQ ID NO: 147585 - protein, 109 aa, Glycine max
  Coding DNA Sequence Number=SeqID_55900
  Homolog annotation: Hit_ID=Q2HW90; Match level="QueryCoverage=83%, HitCoverage=18%, E-value=9e-09, Identity=34%"; Hit description =Putative uncharacterized protein
MGTNQNGKRFYQVKIKSLDVTSLKELGRLMGPLQRQAFRKVYGKILDLTTVEVFTEVVVSLAQYYDQPLRCFMFGDFQMVPTVEEFEEILGCPLGGRKTYLFPGFLPSL

SEQ ID NO: 147586 - protein, 188 aa, Glycine max
  Coding DNA Sequence Number=SeqID_55901
MASGLKINFSKSNVGIFGDDINWVHDAAHFLKCRQMETPFHYLGIPIGAKPSSCLVILPHSNNSNIKKKSRVNVPFGQYDLKVASEEVGQRISGPTHSATKVYVRRKEVLRSNGKAQQFKEPAVDSNSVSKTDSMPSIQQDPIELQCALLNEMGLTYGEDANKVKGLILDMENRDDMMAAERGIKKHQ

SEQ ID NO: 147587 - protein, 201 aa, Glycine max
  Coding DNA Sequence Number=SeqID_55902
  Gene Ontology: Mol. function=nucleotide binding; Cellular component =membrane; Biological process=defense response
  Homolog annotation: Hit_ID=Q19PL5; Match level="QueryCoverage=91%, HitCoverage=19%, E-value=7e-29, Identity=41%"; Hit description=NBS -LRR type disease resistance protein
MTNLEKLRIETTAGGVIDLPIISPLPMLQKLRLDGKLKKFPEWVPQLQSLVKLSLRSSQLTIDPLKSLQNMPHLLFLEMLDAYEGESLYFENGGFHQLKELSLGFFPNLKSIIIDKGALYSLEKLKIWKIMEIKTVPPGIQHLEKLQVLVIDHMSDELINECITPNEGPQHPIIQHVPLVKVTVGDYEQGIKTHIIHHSRH

SEQ ID NO: 147588 - protein, 426 aa, Glycine max
  Coding DNA Sequence Number=SeqID_55903
  Gene Ontology: Mol. function=zinc ion binding
  Homolog annotation: Hit_ID=A7QLM5; Match level="QueryCoverage=83%, HitCoverage=36%, E-value=6e-60, Identity=42%"; Hit description =Chromosome chr13 scaffold_120, whole genome shotgun sequence
  Pfam annotation: Domain name=SWIM; Domain location=36-71; Score=16.1; E_value=0.0084; Accession=PF04434.8; Description=SWIM zinc finger
MSGLTSWHKALKIPDTDVLMEDGCAKVTDQDDRDKAFVVWNTGSMLSICNCSWAQDGNLCEHILKVLSICRKRGSILPSVALFQYHQALNNMLHCPPLDSLICDHAMSLAVSVQKQLNTLLDKESVQTVVDSYGKWIVIDIPLENFRVGSANRDQDTVSKKRVINGVLSEDSDGCEDRNDSSDALGCANAMTDIADQVVDRGIARNGKPLSAGEDSLPADMDVDPSSTCVNPPRLHRVDDIVSSDAFPENKERGLATTRYEISTSENGALSNDKIKETILDEGGRDCAVDVDPPTLDTLSSTSEDVKHCETETHQNGVNEVPRVISCTKDADSHLSPPSTVKPAKPLALDMGKNSGVHPQTASKRSNNHGPPAARRTTPKGCKLPNSYDPPKGVNHPIVTIHPKGARSEDVNQGDMTLGNSHNQPL

SEQ ID NO: 147589 - protein, 205 aa, Glycine max
  Coding DNA Sequence Number=SeqID_55904
  Homolog annotation: Hit_ID=A5B2I6; Match level="QueryCoverage=41%, HitCoverage=3%, E-value=2e-08, Identity=45%"; Hit description =Putative uncharacterized protein
MLQVDLEDPRQVYLRCLTRTKPKKWVSCLPWAEFCKIHPVFHVSLLKKAIGDSFQSQPLPPMLSEDQELQAYPDSVLDIRELQPGNVEVVPTYHLEDKVSLLGRGIDKHKHKPHITKVYTCKQQAREAVIMDHQQHGTQHPRGANHPIVTTHPKDVNHPIVMIHPKGAKSEDVNQGNMILGNSRNQLKDVNQGDMTLGNSHNQPL

SEQ ID NO: 147590 - protein, 72 aa, Glycine max
  Coding DNA Sequence Number=SeqID_55905
MALITPLSAKFDHFQRAFGSIQNYLPQLDLKVLYRIKGVTSYGVGGNEGDLFYMAVVKVLTGKRVSHGQGKH

SEQ ID NO: 147591 - protein, 27 aa, Glycine max
  Coding DNA Sequence Number=SeqID_55906
MEMHQKIKEKSLGSFLEKLPCEASLRS

SEQ ID NO: 147592 - protein, 39 aa, Glycine max
  Coding DNA Sequence Number=SeqID_55907
MEGLSLVGEEEDGFSLKIQEDTGHNYDIEDSNGFWHYMP

SEQ ID NO: 147593 - protein, 99 aa, Glycine max
  Coding DNA Sequence Number=SeqID_55908
MMITKDDDKGDDKKLKGQSKNEFKMFKMESRTIQDSRGKVEEHFKIQEERYIYLGLTEKKRGYISCGSVLVEGTSTRFKENKGGYIPCGSLLVKGFLQG

SEQ ID NO: 147594 - protein, 215 aa, Glycine max
  Coding DNA Sequence Number=SeqID_55909
MEWFVGRDGGSVIGVWNSEANWVVKASISGRVVSDGDPDASLSVFAQIMSAASIDQNHDILFGYLAQVHILCFLFLIFDEKEESRGTLMASSELLVAVETKASFSPTSHLLQCETFQGRANPTTWTKVKVQPRYEATEEEWWQKHYNAIGKRLKFFQGIGVGMSDEDEGEGNGWKLFSRLVTLLILSWLSLNESTNVMIRELSTQGNEQFLAFEA

SEQ ID NO: 147595 - protein, 140 aa, Glycine max
  Coding DNA Sequence Number=SeqID_55910
MDFRNKANNNALGQTPMSLHERAESISGFTKGHHFEIPVTPMKRKTYNGGSKVRMTQRVPLGVGFQRRTMAVLWWLLVVLGDGESAWDVGNGFGRKKEKKWRFPKANWTTRLKTHNSGPNFEKIQRLPKVEKRFYRDSFM

SEQ ID NO: 147596 - protein, 191 aa, Glycine max
  Coding DNA Sequence Number=SeqID_55911
MLSSRRATHANLENMIQWIEITWLQLQHLTQYLAFLQAQPQHHVLVVVDTIIQPGIMIVLTLMTTPLTSSFNQIIIGKQDLKSICLVLMSTMNLFMKLMMSLMILMKTLMIIARKWDSRLIYMIDFGVDIGPIIATNDDIVMDVNEEPIHVESLALMLCCTSLSSHFPEDGLHHTDSRMNLFDEGGNDVEI

SEQ ID NO: 147597 - protein, 174 aa, Glycine max
  Coding DNA Sequence Number=SeqID_55912
  Gene Ontology: Mol. function=flavonoid 3',5'-hydroxylase activity; Cellular component=endoplasmic reticulum; Biological process =electron transport
  Homolog annotation: Hit_ID=A5Y5L3; Match level="QueryCoverage=54%, HitCoverage=23%, E-value=6e-25, Identity=50%"; Hit description =Flavonoid 3'5' hydroxylase
MASLDHLFLLKEIAMSILIFLITHLTIRSHFTNRHNKLPPGPRGWPIIGALSLLGSMPHVTLSRMAKNSCISQNPIQNFSNKPPNAGATHLAYDSQEVATYAASKVADPALWKRLDAAVLQWIYGTISTDLLHAILLKDDTAQGAWARLESMFQDNKASWATHLEEELAEFFVY

SEQ ID NO: 147598 - protein, 52 aa, Glycine max
  Coding DNA Sequence Number=SeqID_55913
MDTIEFVAQVGDDQDRGDQIWESSLLDSNPLDDDKKLKRMISRLSQQVQDPD

SEQ ID NO: 147599 - protein, 117 aa, Glycine max
  Coding DNA Sequence Number=SeqID_55914
MERVMMGHLGDCAKGAKDSELDVTLASNAKNELLDVHTRVHIDDDDPHKWLTRLGHKEGNGLLLVLGAWWPAMSLLRRWGWEKEILLGLEEFWVWEIAKELFVIVTQRCMELEKDKD

SEQ ID NO: 147600 - protein, 115 aa, Glycine max
  Coding DNA Sequence Number=SeqID_55915
  Subcellular localization annotation: CTP_CleavageSite=41; ConfidenceScore=5.40e-01
MDESLKKKKGSSTSSAAAAHRHHRPSEAPTAPLPPSLSSPLSSTIFSSDDQRLRYTSQFSSRIILDPKYLDIDFFNDETFDCYQVFQNFGLVDFMSLKLPYYPELVRVFYSNLKI

SEQ ID NO: 147601 - protein, 133 aa, Glycine max
  Coding DNA Sequence Number=SeqID_55916
MAKLVVMEVVLMVVTAVVAISVFGGVDNDDGSDIDGGDDSNTSGDGDVDNTDGGNHGSVEARYASNNDGDDDCGAVVAMMEVVVTIVYGKPKKLLAESRTMSLSLRRFVALPKIVQADYQPRSPQDKTAQITV

SEQ ID NO: 147602 - protein, 112 aa, Glycine max
  Coding DNA Sequence Number=SeqID_55917
  Homolog annotation: Hit_ID=A5AIH8; Match level="QueryCoverage=67%, HitCoverage=10%, E-value=1e-07, Identity=40%"; Hit description =Putative uncharacterized protein
  Subcellular localization annotation: CTP_CleavageSite=55; ConfidenceScore=5.67e-01
ASNNGFPGNLVKVSPSSRKVTDASVPWASLPSSIANLGRSSPLCSHHHRATVNIKAVNPSSNVLSSLEGMNPFLAFSLGLHMNFVGARVGMAIDDIGVWGVVKGALGFRVVV

SEQ ID NO: 147603 - protein, 175 aa, Glycine max
  Coding DNA Sequence Number=SeqID_55918
MQQSDRKLPFIANRGIIWVSGIKSRYNHIYTMLPWRRASHACLENVIRWIKITQLQLQVSHLTEQLASLHLQPQHHVHEVGFKVNMLDFDVDIGPIIVADDEIVMDANEEPDGSYSPEDDHIGNLTFQCTIIDLRMNLYEEVGNDVEIWCNHGLRRDQRGCQGFSIEIQRPKRSV

SEQ ID NO: 147604 - protein, 141 aa, Glycine max
  Coding DNA Sequence Number=SeqID_55919
  Subcellular localization annotation: CTP_CleavageSite=64; ConfidenceScore=5.15e-01
MALVKTVIDGATLKTVVPKIVVVMHSSPSCSHHHHAAINIKAVNPTSNVLSSLEVYFVFTPALVCSILAKTIAFKSLRHLKSIFRLTILATPPLPLKCLGTLSEQSEKKLEESQETARYAAISVTMSYSHLGNSENMCRDP

SEQ ID NO: 147605 - protein, 115 aa, Glycine max
  Coding DNA Sequence Number=SeqID_55920
MAYHASSKANQNSMKNHEIHFGKSYSIENFQWEPELQPYYQNEAERGSNMDKLLMQFKETIKSTQGALQSVEIQVGVLAEEVTQFMMRREKYFVKVEAQEENPVKEHESREKDEE

SEQ ID NO: 147606 - protein, 106 aa, Glycine max
  Coding DNA Sequence Number=SeqID_55921
  Subcellular localization annotation: CTP_CleavageSite=40; ConfidenceScore=5.04e-01
MYLSCLSDNKPSRCTSTCTTKDVPSNVLRQSSQAVSPLKLCEAETKDISGEQGLETIKLRRLLAKEKEEEEDIQKVFLNASQGLAFIDSSCLVKKTTRGVITLRKT

SEQ ID NO: 147607 - protein, 271 aa, Glycine max
  Coding DNA Sequence Number=SeqID_55922
  Homolog annotation: Hit_ID=A5BQ63; Match level="QueryCoverage=44%, HitCoverage=17%, E-value=4e-11, Identity=35%"; Hit description =Putative uncharacterized protein
  Pfam annotation: Domain name=DUF659; Domain location=124-246; Score= -43.3; E_value=0.00076; Accession=PF04937.6; Description=Protein of unknown function (DUF 659)
  Pfam annotation: Domain name=zf-C2HC_plant; Domain location=91-145; Score=70.0; E_value=8e-18; Accession=PF07567.3; Description=Protein of unknown function, DUF1544
  Pfam module annotation: Pfam domain module=DUF659::zf-C2HC_plant; Domain location=124-246::91-145
MTQECELRLDDTQHGDAVRWLAAREKLGSREYHEPLPTRSTTRLREAASPGSVFHFSMYGSGNGSNSSNANTDTSTGSASRSKNAPGNRTDIGWKHGTDVLGNGKKVKCNYCSKINNGGIFRFKHLLAGTRWDSKPCASVPEEVKMLMMNVCYRGTEGVESNTSQSGIEQKGMLAFKGRAKAKFVKASDISKIADIVLKMLDDVVNFVGEENVVQVITDNAANYKADFEKHLKAHQTTIKKGRRITTYIYGRTMLISIMKKFTNGRDLIRP

SEQ ID NO: 147608 - protein, 68 aa, Glycine max
  Coding DNA Sequence Number=SeqID_55923
  Subcellular localization annotation: CTP_CleavageSite=37; ConfidenceScore=5.41e-01
MAKFHFSPNAPPYWSLRLHPASRPMINFWHLFLGLKSLSNSGNLAPFAFNFSRSFEHSIERGCTMHNF

SEQ ID NO: 147609 - protein, 28 aa, Glycine max
  Coding DNA Sequence Number=SeqID_55924
MICPSRRYEEMHHAIKEQARGLSVTMHH

SEQ ID NO: 147610 - protein, 174 aa, Glycine max
  Coding DNA Sequence Number=SeqID_55925
  Homolog annotation: Hit_ID=A5C1L4; Match level="QueryCoverage=75%, HitCoverage=46%, E-value=8e-08, Identity=24%"; Hit description =Putative uncharacterized protein
  Pfam annotation: Domain name=DUF296; Domain location=9-134; Score =5.9; E_value=0.00018; Accession=PF03479.6; Description=Domain of unknown function (DUF296)
MAMPGEPFVRIVIINVDPSKDIMESILDAVHLGRAYLTILNTFGTVTMVILHNSLHVVATLTLHEPFTLLCLNGSYLLNNNFNLNFRAIIPPPLSFGIHLSTSRGQAIGGAIGSQVIVDGNVKITLWTFWHPKIYKYIPEGNKGENDDNNNKKKNYNNNPIDCNRGGNQIGFNI

SEQ ID NO: 147611 - protein, 130 aa, Glycine max
  Coding DNA Sequence Number=SeqID_55926
  Gene Ontology: Mol. function=hydrolase activity, hydrolyzing O -glycosyl compounds; Cellular component=anchored to membrane; Biological process=carbohydrate metabolic process
  Homolog annotation: Hit_ID=A7PID1; Match level="QueryCoverage=72%, HitCoverage=10%, E-value=8e-21, Identity=51%"; Hit description =Chromosome chr13 scaffold_17, whole genome shotgun sequence
MVDAVVSVVVVAGYETVPIILTETGWPSSNAAANEFDANLGYVEIYLKGLVKHLKSGMGTSLLKDGVTEVFIYEMFDKEEGATRRSWGVLYPNGTAKFHRVDFSCSSVAFGSLHIAVMIISFFLSLLVIV

SEQ ID NO: 147612 - protein, 61 aa, Glycine max
  Coding DNA Sequence Number=SeqID_55927
MAEHGIRGRSSWNSPSNRWKDLLASDICSSHDIIEAYLLLAAESLRPWDRGYVPCILTQTE

SEQ ID NO: 147613 - protein, 286 aa, Glycine max
  Coding DNA Sequence Number=SeqID_55928
MEYTSKLEDLLKGYLESTQSGVSHPPPVNCDFWGEEHFNDNCHLYSMKNSWWGQELHPYNQYDEERTSNLDDVFREFMAYHASYKASENPMQNQEIQIGKSYSMENCQWDQELHPYNQYEEEIISNLENLLMQVKETYEYTQHTFKNLEIQVGKSAKEVAKFMVTREENFVKVEVHEESLVEEHDSREKDEEKSAEMTQQQWEESSHVDSQQESILQVNIPPHQLIVKKERHEEHDKSLSVFLSLTTSTSLAMIWKVFPGYMSFKESLAKRRKCKEDVFYVTFMPP

SEQ ID NO: 147614 - protein, 77 aa, Glycine max
  Coding DNA Sequence Number=SeqID_55929
MECQPTTQAQKNDNKTVWAGSTKHKLQQDRVKTLVLQPTLDDSRGSHRNDQHDVNHCAPFTSHLLNQKLESRPHMWN

SEQ ID NO: 147615 - protein, 75 aa, Glycine max
  Coding DNA Sequence Number=SeqID_55930
  Subcellular localization annotation: CTP_CleavageSite=48; ConfidenceScore=5.09e-01
MNHRRGVCESPSGGALRPRRLGPTHGSRRLRSLIMVYSHRFASGQFPSSMMVGTLENGLGISHFGERGQFHHINF

SEQ ID NO: 147616 - protein, 67 aa, Glycine max
  Coding DNA Sequence Number=SeqID_55931
MTEARQKGQFRENKKCYEGRTPFFFTPPPIYSKIGEELATQLAQANKVASSKSNSLLEEESGRPKWT

SEQ ID NO: 147617 - protein, 97 aa, Glycine max
  Coding DNA Sequence Number=SeqID_55932
MASAITWATWTLIRVRMAYNNWHLGRGSSVIHVWVKVVMLVRMIRTRIPAAVRAKSCPGVHNSWATASSSNPLALFLLWINSHCWPSSRTSESPRTG

SEQ ID NO: 147618 - protein, 77 aa, Glycine max
  Coding DNA Sequence Number=SeqID_55933
MKKIPKGRGKRVILGNFDVKHEGRLIKVFQGSALKDIEKIEREEEERREKEAEALPNRDDHRSLHRSLFGVLWVTID

SEQ ID NO: 147619 - protein, 81 aa, Glycine max
  Coding DNA Sequence Number=SeqID_55934
MLVPKLRFFVVGGLKTKGNVEAMPSKVILMMAKNQELSKFQRFKNQDSRFKIQESSFIQESSFKNQDSRIKNQVSRIKIQE

SEQ ID NO: 147620 - protein, 262 aa, Glycine max
  Coding DNA Sequence Number=SeqID_55935
  Pfam annotation: Domain name=Chromo; Domain location=131-178; Score =24.1; E_value=0.00051; Accession=PF00385.15; Description='chromo' (CHRromatin Organisation MOdi
ALLLVDFLEMSAPAILIPILVATANVDAIVSGSVPEGLPVGIDSVGDLGELVQHGVLAAAFGAGTAVVGGGRGEAALGGLRWEREEQGRPLCGERNGKLLRQKGFKARSLQIALAKASTSPRVNEEGKPIIQPMTILDRKWDNSTPPKPLVLVQWLRLSPKDSTWENWAELQDTYHLEDKGVLSYVNSVPCRTQTAIANGEFGVTEQVANGTGDTVAGGDRSFKGELQLPLASCLEVATPIGDLGHKIAITSGDFMPIYTFQ

SEQ ID NO: 147621 - protein, 87 aa, Glycine max
  Coding DNA Sequence Number=SeqID_55936
MWPLPRHLKHLMLLVLALELVLRVNFSMVLPLSSLDFEESKAEGSMGAKRGVQHKSAESITRAKREACAKRAIQQKHMLSLQHALSA

SEQ ID NO: 147622 - protein, 171 aa, Glycine max
  Coding DNA Sequence Number=SeqID_55937
  Homolog annotation: Hit_ID=A5ANC8; Match level="QueryCoverage=92%, HitCoverage=10%, E-value=2e-10, Identity=27%"; Hit description =Putative uncharacterized protein
MGCWANLNNGNCRIPNKVVEKLTQIQRRFLWGGGLDQKKIARVKWDCWLMEHEPLRAKYPRLCNISCQQQKLIQDMGCHSANVWEWKLEWRRHLFDNEVQAATSFLDDISRGHIDRWTSDCWVWKPEPNGKFSTRSAYCMLLEGAAYQTMDEALEDLWQLKIPLKPTTFAW

SEQ ID NO: 147623 - protein, 86 aa, Glycine max
  Coding DNA Sequence Number=SeqID_55938
MAYGHDFTVKTKVERKDIELVDEEEAQIGADHSSATSNKAEIYNEEARNATQKHKPKRVESVNADAEAFGDHWKILIALCILKLKH

SEQ ID NO: 147624 - protein, 442 aa, Glycine max
  Coding DNA Sequence Number=SeqID_55939
MTKWWNYENYVQALVASAGRCILSLLPRSGNRPSYYDPSALGGARRSIGRDVRASPHCVAIVMGRHCPYLSLLAMNGITALQHKVKLTSSKDSCKIVIQACGSDDFPFFRAASSSQPFFFMYRCRFEVLGLMKLTGKNGWVSLNSMSKKLFVFDSNNFCRFFKVLTIKVMANGLPLMFNWDGSTANYFTSILSPQGIMGDFIKEGSQPIVEDSLIAGVVEVSPSTSSSILGKRKRDNCTRVLDHKNSRAPLSLCALRQAARLTPGLGRPSIMQDLPLTPLVVEAFAHVAVCYSYSSTSSCCACSGYHSYRCSFVHYTLVESWCGDHECSYDVTSSFFSSTSSSLYCVGVGVDFHFFSPTFPMFPWTISTPPTMLIPYGVWGTSLNRRPRLALCWPLTKISSINWGLTCYKLCQGLSSAKSGNFGRKWAKAPRGVKQGGIFGG

SEQ ID NO: 147625 - protein, 123 aa, Glycine max
  Coding DNA Sequence Number=SeqID_55940
MECEGDNAMERVMQGHLGDCARNAKTYEVDVTSMSNFKNRLCNVPIRVHIDDHKAHKWLAELGHGEGNGLALVLGASWPATWILRRWGWEKEILLGLICCVKWWWWMVGALRGGASVFFQKGC

SEQ ID NO: 147626 - protein, 70 aa, Glycine max
  Coding DNA Sequence Number=SeqID_55941
MDDFSEDEDQKFFDHINHQSDDQSDDQSDDEGVGRPMTPPSPPLQYHQTRCPIDLNFDHLPHCIDRHHFV

SEQ ID NO: 147627 - protein, 113 aa, Glycine max
  Coding DNA Sequence Number=SeqID_55942
MAPLVTWPRELERLILKDKGRGRGHLGHCARSAKDCEVDVTSEMILRLFLEPDGLPRGFLGGGDREGDPLGTDLLHHVVVVDGGSIERWSQCEVYGMGDGQRNVRVYEVSRDA

SEQ ID NO: 147628 - protein, 162 aa, Glycine max
  Coding DNA Sequence Number=SeqID_55943
MNLPNSLQVCSASSRVMQSYLARALDSKLQEDWVRDAREDLRAINKGHVCAFFQLWSFENYTSKFRPQLRYKISGSFSSSPSTHHLFPSSSYPWLPMVVNFFLTHLLLEVVSPTIFLPSAFRCYDLQEAKDSIDEEDPRPTSSTWSYIRRVMGEARFFNRTI

SEQ ID NO: 147629 - protein, 127 aa, Glycine max
  Coding DNA Sequence Number=SeqID_55944
MKADMEAMKEQMTIMMEAMMSMRKMIEVNTATVVAASIATKVDLTHPSSLNQGAEALGSTGGPHFMQVQNKHSFPPYGLPPNYTSPNVAHAPDENVNNSTPILIESQQPQSGHAQVPQPMEKTHKAP

SEQ ID NO: 147630 - protein, 131 aa, Glycine max
  Coding DNA Sequence Number=SeqID_55945
  Homolog annotation: Hit_ID=A7QIT8; Match level="QueryCoverage=29%, HitCoverage=10%, E-value=9e-12, Identity=76%"; Hit description =Chromosome chr2 scaffold_105, whole genome shotgun sequence
  Pfam annotation: Domain name=DUF821; Domain location=11-125; Score= -290.8; E_value=0.00051; Accession=PF05686.3; Description=Arabidopsis thaliana protein of unknown function (DUF821)
MTYFVHWDSYSPNQNHPLHGHHHAHHHRHRRTLHLLHNWVVVVVEKEPYAYWKGNPAVAETRQDLIKCNVYENQDWNARLFAQVPANTDPCTMPAPFDPPTLYATLERKESSIQQVESWEKSYWDNQTITS

SEQ ID NO: 147631 - protein, 237 aa, Glycine max
  Coding DNA Sequence Number=SeqID_55946
LHALTLGTSYPQRQRTTRPRLERTTRPHHQRAARPHLQRTTCPRLERATRPHLGGLHVLALRGLHVLTIRGLHALTSRGLHVLALRGLHALTLGTSYPHRQRTTRPRLERTTRPHHQRAARPHLQRTISPRLERATRPHLGGLHVLAVKGSCAFTFVGLHALTFRGLHVLTFRGLQVLAIRGLHFPFNGSWAPPDIGGGPTVQAQPEREAITQLLCIPGQDFTRAAAKDECGSCALT

SEQ ID NO: 147632 - protein, 37 aa, Glycine max
  Coding DNA Sequence Number=SeqID_55947
MAHGRPIGDQVQSQCRTRLVVHDPRNLNKTSTSSEGR

SEQ ID NO: 147633 - protein, 313 aa, Glycine max
  Coding DNA Sequence Number=SeqID_55948
  Gene Ontology: Mol. function=4 iron, 4 sulfur cluster binding; Cellular component=integral to membrane; Biological process=protein -chromophore linkage
  Homolog annotation: Hit_ID=P56767; Match level="QueryCoverage=100%, HitCoverage=47%, E-value=1e-164, Identity=82%"; Hit description =Photosystem I P700 chlorophyll a apoprotein A2
  Pfam annotation: Domain name=PsaA_PsaB; Domain location=1-306; Score =179.1; E_value=1.1e-50; Accession=PF00223.10; Description =Photosystem I psaApsaB protein
MTGAFAHGAIFFIRDYNPEQNEDNVLARMLDHKEAIISHLSWASLFLGFHTLGLYVHNDVMLAFGTPEKQILIEPIFAQWIQSAHGKTSYGFDILLSSTNSPAFNAGRSIWLPGWLNAVNENSNSLFLTIGPGDFLVHHAIALGLHTTTLILVKGALDARGSKLMPDKKDFGYSFPCDGPGRAGNVSQLMIFYLFDGMVKRLSMVDSSQLINGYNPFGMNSLSVWAWMFLFGHLVWATGFMFLISWRGYWQELIETLAWAHERTPLANLIRWRDKPVALSIVQARLVGLAHFSVGYIFTYAAFLIASTSGKFG

SEQ ID NO: 147634 - protein, 266 aa, Glycine max
  Coding DNA Sequence Number=SeqID_55949
  Homolog annotation: Hit_ID=Q2HW90; Match level="QueryCoverage=74%, HitCoverage=39%, E-value=2e-24, Identity=32%"; Hit description =Putative uncharacterized protein
MGQLQRQAFRKAYGKIWDLARVEVSMEPIASLSQYYDQPIRCFTFEDFQLVPTVKEFEEILGCPLGGRKPYLFSGFYPSTTRVAKVVKISAQELDRQRQVENGVFGIPRKYLEVKARILADKGEWTPFIDILTLLIFEGVLFPNVDGLVDLAAIDVFLAYHNHKESPVVAMLADLYDTFDRRCEESNARIVCCTPALLVGLVSHLFLQEGRPVYPLQGYHSCFEKGKANWDQLLASMGGRLLIGSLARRKEESRFYLHAKDVQMFP

SEQ ID NO: 147635 - protein, 184 aa, Glycine max
  Coding DNA Sequence Number=SeqID_55950
MAIMMEAMMSMKKIMEANAVAIAATSVVAKHAFLPYGLPPNYTPPNVAYTPSENVNNSTAILIESRQPQTDRAHVSQTMGETHEIPHHNLADFEPCLGYATEGQVVGGIPLQNTLEGPQFRPQPQPLHSTAGKIPLVMEEMGKVGSSRGKARAIEGGRDYAFTDIEELFLVPKRGHSQVQGAGL

SEQ ID NO: 147636 - protein, 262 aa, Glycine max
  Coding DNA Sequence Number=SeqID_55951
MSSRKRKSVSSRPTAQYDTRRFHSFEAWTRYTDNVLGRHILAERKVEIYHTELDEFKGELERRNFHKRLTNLADSSIDLALVKEFNANLYSPEGPSPEQVRIQGHIIRIDAGRLNAFLETPVVLAKGESLLAYSRYCRMPTDIREIEAALCIPGQGFILNAEGHSGNILRKDLTTLAQVWSVLSYSNLALTSHTSDLIMDRARLIFGLVTQLDMNVGALIFGQITSMAQSNSSRLRFPTLIATLSRTKGVSSNSLVFERLSP

SEQ ID NO: 147637 - protein, 252 aa, Glycine max
  Coding DNA Sequence Number=SeqID_55952
  Homolog annotation: Hit_ID=A5C169; Match level="QueryCoverage=65%, HitCoverage=14%, E-value=8e-08, Identity=26%"; Hit description =Putative uncharacterized protein
MVIDQSLFYDLTQLSSEGVPFEGTLNDDWKFDFSVHDARRLVCTNQADMTGRLLAGSLAFESDILHYLIVRILLPRSSNLAQVSEEDLIVMWAFLTGRQIDWSHLVRYRLHKALQLNAPLPYPHLVTLFLQHFNIPLDSEPYVPIKRSFLIGAAVIAFSGYRKEHDGSWVKKGAQPIDEEGNLPVGEDSSLLQRILDRFDGLQTFVGERFDALELQVDMRFDEMDSRITKVEGDVSYIRTCFDLPPPPPPSS

SEQ ID NO: 147638 - protein, 83 aa, Glycine max
  Coding DNA Sequence Number=SeqID_55953
MSDGFCGTHLQIMVRTRGLGRALGQVTRRGVGRGDHDDSNDGPQCRRPTASARRQRVAVTADHVEEPIIPDPDIQDDPMEAPA

SEQ ID NO: 147639 - protein, 185 aa, Glycine max
  Coding DNA Sequence Number=SeqID_55954
IPEERPRNQFNRDQCGPSTRPQQQGPSLYDHTMKLEETLAQFMQVSMSNQKSTESAIKNLEVQVGQLAKQLADRSSSSFIANTEKNHKEECKAVMTRSRMAIQGNDKLKEISKETEDDMEEKTPIKEKEKERIKEEEKEKEKKLKNEKHKEKVVDDEMRKGKSEANTDKKKDTTPNEGKEVPYPL

SEQ ID NO: 147640 - protein, 381 aa, Glycine max
  Coding DNA Sequence Number=SeqID_55955
  Homolog annotation: Hit_ID=Q2HW90; Match level="QueryCoverage=55%, HitCoverage=40%, E-value=3e-25, Identity=36%"; Hit description =Putative uncharacterized protein
MASQEKWGPFANILALLIFGVVLFPNVDGFVDLAAIDAFRAYHHSKESPVVAILVDLFDTFDRRCEKNSARIVCCLPALCVWLVSHLFQQDIRHPCPLQSYRSCVEKRRVNWDQHLAGIGGSANNWFPRWKEGKEGVLFSCGDYPNVPLIGTRGCINYNPALAIRQLGYPMRGAPTEESLSPFLVRDLGAQSLKVIQRVHKAWRSPLRKDKELRGIRNGVIGGYHGWLRVHTQGLDWLSKFKVIDEENFEAPEEDEEVQALKLELGKARLAKEKFKSAATHIRKECIELREENAATARALEQETKRARKEEHGREKFQGALWGSNNELKLRREERDQSRVHGMILKEELAACARSKRSLAQHLEATEQSMLAIIGASIRKS

SEQ ID NO: 147641 - protein, 102 aa, Glycine max
  Coding DNA Sequence Number=SeqID_55956
MAVQQSSSVAKSQMVMAICLAHGSPAWLAGCLRCCFFHYKTWSFESAQLHFLLCLFFISFSCILHLVAVFCFWAMVCFTPYTWFVSSSPLHIARDFSVLDIS

SEQ ID NO: 147642 - protein, 112 aa, Glycine max
  Coding DNA Sequence Number=SeqID_55957
MLRESEQPGQKGRKEIPMPLLRCPHGSSLHRPLMVRISTRNIFRAFQLAPGTSPILHPYSLRRPPPSRGRPPSSGSNHDSPSRQCLLWLRFQCDEELSPEANSRIHPTPNDV

SEQ ID NO: 147643 - protein, 82 aa, Glycine max
  Coding DNA Sequence Number=SeqID_55958
MDIEESIHVTFDKSNAILSRKNMLDDIADSLEQMPNHGPDSKGNGKGNNEDPPEEVKSNDELPKDHPLDNIIGDISKGVTTR

SEQ ID NO: 147644 - protein, 205 aa, Glycine max
  Coding DNA Sequence Number=SeqID_55959
MGSMRRPSPICYVYQGRILPRTAAGRRVQIMRTNMTTLTQICMTLLLSNIQPSDHNSDLPLPKCQLVYTILMRMSIHVAQLIADAIYLFAGMAPTRHPLDPDKSNRALGFPALITGLFQSFGVPVAPSKVIRPPITRAFIEKYCTQRQAQGDAPQAADAPPPHQASPADSFDTEQYLRHLVRQEAANHQAHVQTHDCLYQMSLSL

SEQ ID NO: 147645 - protein, 250 aa, Glycine max
  Coding DNA Sequence Number=SeqID_55960
  Gene Ontology: Mol. function=transferase activity, transferring nitrogenous groups; Cellular component=intracellular; Biological process=regulation of transcription, DNA-dependent
  Homolog annotation: Hit_ID=A8GI75; Match level="QueryCoverage=100%, HitCoverage=52%, E-value=4e-88, Identity=68%"; Hit description =Transcriptional regulator, GntR family with aminotransferase domain
  Pfam annotation: Domain name=GntR; Domain location=18-81; Score=80.8; E_value=4.3e-21; Accession=PF00392.12; Description=Bacterial regulatory proteins, gntR fam
MPTFLTTLRLDSRLAEPLYRQIYLRIKDAIAQGSLAAGSRLPSVRGLASELGVARATVESAYAQLIAEGFLQSRGQAGTYVSPQLPHVPPGAVSAAPPLAAIAPDPLQPQGMLQPFQLGVPALDAFPRALWQRIVARRLRASTVASLALPPAGGLPELREAIAHYLHLSRGISCRPEQIFLCAGYPALLDWVVETLLHAGDAVWIEDPGYPVTRPLLRAAGVRPLAVPVDEQGMDVAAGMLTAPEARLAV

SEQ ID NO: 147646 - protein, 189 aa, Glycine max
  Coding DNA Sequence Number=SeqID_55961
MAAFVRQYQYNFDMVPDRMQVENMCKKGDGSFKEHAQKVEGSGGPGGTPNNGKGDDNRDGRHIIDLVFASERINVGPKRGKFDHPTRTTEKTGANKEGEDEGETHAVTAIPVRPSFPPTQQYLYSANNKLPPYPPPSYPQRPSLNQPQSLSTALPMTNTTFSTNQKHQPRSEFCSEKACRIHPNSSVLC

SEQ ID NO: 147647 - protein, 228 aa, Glycine max
  Coding DNA Sequence Number=SeqID_55962
  Gene Ontology: Mol. function=chitin binding; Cellular component =extracellular region; Biological process=chitin metabolic process
  Homolog annotation: Hit_ID=UPI00006A17C9; Match level="QueryCoverage =57%, HitCoverage=100%, E-value=6e-14, Identity=29%"; Hit description= UPI00006A17C9 related cluster
DAGSRQARQGASAGVGGCRGWLNYAASEQIVLRVHHMRCEIPHRCVRRKYRIRRHSPFRLRNCWEGRSVRASSLLRQLAKGGCAARRLSWVTPGFSQSRRCKTTASAKLACLQVDSRGSPKARGCSPLKARKCCPLKARTCSPLKERTCSPPKVRTCSPLKLRTCSPSKGRTSSPMMVRECNPLKARACYPQKVMTCSPLKVRTCSPLKVRTCSPLTTRACSPPKARM

SEQ ID NO: 147648 - protein, 148 aa, Glycine max
  Coding DNA Sequence Number=SeqID_55963
MGTNQTGKRFYQVKVKNLDTTSVKELGRLMGPLQMQAFRKTYGKILELTLAEGKKTISFIRVSPLFEQNCNCGQGFSKKFGPHKTDSERHSGPTMGVTRRQGEGYAQSRRLGPVYGCVSFANFWDRPLSKRGWFGGPSSNRRFPCIPP

SEQ ID NO: 147649 - protein, 83 aa, Glycine max
  Coding DNA Sequence Number=SeqID_55964
MNMLMNDQGTWIHLKLACFAPWLLSVGPKLLLDLEQAANSSFKTMPCTRDWCRNLPFGGRATRDSRDAGSTKGIRAESPPTFI

SEQ ID NO: 147650 - protein, 79 aa, Glycine max
  Coding DNA Sequence Number=SeqID_55965
  Gene Ontology: Mol. function=aspartic-type endopeptidase activity; Biological process=DNA integration
  Homolog annotation: Hit_ID=A5AKU5; Match level="QueryCoverage=94%, HitCoverage=5%, E-value=3e-11, Identity=45%"; Hit description =Putative uncharacterized protein
MRIVETGNPRFIENGEISGSAVPREVEIKEVRVQVLLVYASSSKTKRDSHGNLERYKAKLVAKGFTQKDGIDYKEMFLP

SEQ ID NO: 147651 - protein, 195 aa, Glycine max
  Coding DNA Sequence Number=SeqID_55966
FQSFEVVSMASVDSFSGKPGLSDTAVMVARVMLGNSYEPRMSLGKDNDGRTCLISARGNHEKFGLGYKPIQADIRKSVAGRKSGGQGLRLVQEVEGGPPCHISRSFISAGLGHEGQVVVICKDDSPSGSVLVRPCPPGFRLGNWRVEENPDIYATSIISDDESLEGTNTWDLTIDFEQETNQTEDEEDEDVGLPP

SEQ ID NO: 147652 - protein, 33 aa, Glycine max
  Coding DNA Sequence Number=SeqID_55967
APVSLALARPRRARSDRGLRGYDSKFPQALGVV

SEQ ID NO: 147653 - protein, 99 aa, Glycine max
  Coding DNA Sequence Number=SeqID_55968
MGSKQVLRGFMGQQQRTQALKGRKRLVESQRTEEKMWDIIDLYKEKQNLAATHEQRLEDEHAKVSVLQAEREARERVIDSLYREAMMWMDRFGFTLNGS

SEQ ID NO: 147654 - protein, 73 aa, Glycine max
  Coding DNA Sequence Number=SeqID_55969
MESGSCEEHMHVCIVICLTSFRGIRWQGLTVALRVSGVVAVVGLGDSSIQGYICCWKGHDCSAVGDFAAEVEE

SEQ ID NO: 147655 - protein, 116 aa, Glycine max
  Coding DNA Sequence Number=SeqID_55970
  Homolog annotation: Hit_ID=A5AZ88; Match level="QueryCoverage=56%, HitCoverage=7%, E-value=2e-07, Identity=36%"; Hit description =Putative uncharacterized protein
MTLQLVDRSITRPYGVIEDVVVRVKHFIFPADFVGMPFMLIASCIVDMGRKKLEMGFEDQKIDFYLFVEDKPAPEQNFYLQVMEVGQEVLKNFFLKNSPFAKHKTCAKRIFAHALS

SEQ ID NO: 147656 - protein, 296 aa, Glycine max
  Coding DNA Sequence Number=SeqID_55971
  Subcellular localization annotation: CTP_CleavageSite=14; ConfidenceScore=5.27e-01
MPATVHSTQDMCGKASSVSSTPSTSGASSFAAFGPGSAMPDIEIGPFRLEVILHHVQHPGGTARGGGDMETVFGHAADNAIITDEAVIAKQQAITAATGGKLCPGIGIHAVHELDRIRADDLDLAERRGIENAHTLAHRPAFAANGGIHILARLWKIPGATPLPDRLVNRAMGLSPTVDLRLARHFEVRAAVITGEGAKGCRRIGWTEGGEPNFRLAFAQRFRSDVEAVDVGHLALIGGHAVGGVAFDVLDGAHALSHGEPQILGGHIVLVIDKSLGLAGIAIARQLRVRYTGANA

SEQ ID NO: 147657 - protein, 23 aa, Glycine max
  Coding DNA Sequence Number=SeqID_55972
ERNMSEDPLGIRSPKEGSFVSYF

SEQ ID NO: 147658 - protein, 81 aa, Glycine max
  Coding DNA Sequence Number=SeqID_55973
MKQRDGSLVIDYQLIRERVEMECLEGAWETLEGNMRCRFRGTIRFTATSLVLPDEPARTLQRTVEWTAPWISFVYFEGRCI

SEQ ID NO: 147659 - protein, 76 aa, Glycine max
  Coding DNA Sequence Number=SeqID_55974
MPEIKRKYCYAIWVQIATRPTWAFQDVPPEGSCLWRKQPGSLGQAELVCASWVAKLLPYFPINKGRSEEERGSTLL

SEQ ID NO: 147660 - protein, 80 aa, Glycine max
  Coding DNA Sequence Number=SeqID_55975
  Subcellular localization annotation: CTP_CleavageSite=55; ConfidenceScore=5.59e-01
MGCSDHPEIPHAHPHQLAPVSAGMSAPVSSTSAGAIGSSENKSSSTSGAGTTGSLCATVTGHRRCGALSESSRSNPLAVM

SEQ ID NO: 147661 - protein, 256 aa, Glycine max
  Coding DNA Sequence Number=SeqID_55976
  Homolog annotation: Hit_ID=Q84VI1; Match level="QueryCoverage=99%, HitCoverage=37%, E-value=1e-78, Identity=64%"; Hit description =Envelope-like protein
MATSPKETSAPGSPAVPSSPHQEQPEFNIQPIQIIPGQVSVPEKLVPRRQQGVKIAENPSSATSPREVDPEMDKKIRSIVSSILEDASVPDAEKDVPTSSTPSVSVPDAEKDVPTSSAPNVEALPSPSEEESTEEEDQASEETPAPRAPETAPGDLIDLEEVESDEEPIANRLAPGIAERLQGRKGKTPLKRSGRIKTMAQKKSTPITPATSRRSKVAIPSKKRKEISSSDSDEDVELDVSTSKRAKKSGKKVPEK

SEQ ID NO: 147662 - protein, 16 aa, Glycine max
  Coding DNA Sequence Number=SeqID_55977
ERELSGKRIVTWREAG

SEQ ID NO: 147663 - protein, 68 aa, Glycine max
  Coding DNA Sequence Number=SeqID_55978
MTLSLRKTRQQVSRSPCHAHATPPYGDQPESQGSSKPSDMPPSTSIPPYEKLRVLTDKFYTISMQYEV

SEQ ID NO: 147664 - protein, 73 aa, Glycine max
  Coding DNA Sequence Number=SeqID_55979
  Homolog annotation: Hit_ID=A6FJQ2; Match level="QueryCoverage=52%, HitCoverage=84%, E-value=2e-11, Identity=92%"; Hit description=50S ribosomal protein L5
MRKEKIPHQAPFAIQAAQLLGRAIGAGLFAITPAGERGMCCKAIKLGNARSMTRVVVGDGGVLLTKFVLQCSF

SEQ ID NO: 147665 - protein, 90 aa, Glycine max
  Coding DNA Sequence Number=SeqID_55980
  Subcellular localization annotation: CTP_CleavageSite=58; ConfidenceScore=5.02e-01
MAFIMFSFTHIILKFRDSCKDYYSQLAIHSQSNVTLLPVLVQAFLSQSICLLTNNSTRAIAKRDIQWLSARKNPEEVELSSSLSAPLQVI

SEQ ID NO: 147666 - protein, 95 aa, Glycine max
  Coding DNA Sequence Number=SeqID_55981
  Subcellular localization annotation: CTP_CleavageSite=46; ConfidenceScore=5.28e-01
MATPPASPPQSNQQSEAMSRNTRRSTQLRMLTRRTLDQPQPIVTVDAATGRGSGPHKEKFHSYLGVVAREKVPIVHNSWKDVPDTLKELVWNEIL

SEQ ID NO: 147667 - protein, 281 aa, Glycine max
  Coding DNA Sequence Number=SeqID_55982
MSPFLVRDLGAQNSKTIQRIHKAWETPLRKDQELRGIRNGIIGGYHEWLKARIRGLDWLAKGRRSPTLKSELGKAKLAKEKFKLAATHVRKECAGLREENAITARALERETKRARKEEYGRNKFRGALWGSNSELKLRREERDQSRAHSMVLKEELIACSRSKRSLSQRLCETETNMLAIIAKYEEELGLATAHEHRIADEYAQVYAEKEARGRVIDSLHQEATTWMDRFALTLNGSQELPRLLAKAKAMADTYSTPEEIHGLLGYCQHMIDLMVHIIRNR

SEQ ID NO: 147668 - protein, 147 aa, Glycine max
  Coding DNA Sequence Number=SeqID_55983
  Homolog annotation: Hit_ID=B0HC01; Match level="QueryCoverage=22%, HitCoverage=70%, E-value=3e-11, Identity=100%"; Hit description =Putative uncharacterized protein
MRKRHASRREKGGQVSGKRQGRNRRAHEGASRGKRLGGGAYGKTPATRPFYGSWPFAGLLLTCSFLRYPLILWITVLPPLSELIPLAAAERPSAARNSYDHDYEFELGTLSDQVDPGKSGEIIHNNIGIPLSSKAFNLHRPHQVHVK

SEQ ID NO: 147669 - protein, 171 aa, Glycine max
  Coding DNA Sequence Number=SeqID_55984
MPISPSESISWSVPSRHRGRAHKTPRGPGGAQRGPGVSISGYGPLSVLQGACPPQQGHTYHDIGIAPTRHPVDPEKSNRVLGFPDLITGLYQFYGVPVAPSKVIRPPTNRAFIKKYCAPRQAQGKTPQQPGDRRQRATDTPSPPPKPLSSSTKAGVFPMTRPASDQVQSQR

SEQ ID NO: 147670 - protein, 188 aa, Glycine max
  Coding DNA Sequence Number=SeqID_55985
  Homolog annotation: Hit_ID=Q652R5; Match level="QueryCoverage=27%, HitCoverage=20%, E-value=2e-14, Identity=72%"; Hit description =Putative uncharacterized protein P0603C10.50
  Subcellular localization annotation: CTP_CleavageSite=72; ConfidenceScore=5.28e-01
SGTDDRSARARALGFAATAAPSYSSGLGPCPDGRVSAQLGTVTQLPVHPASPVLLTKNGPLGALDSMARLNRAAAPSYLFKSFAPIPKSDERFARQYRCGPPPEFPLASPRSGIVHHLSGPDRYALTRTLHRRSGSVGGATHRGIPPISFLAPYGFTRPLTRTHVRLLGPCFKTGRMGSPQADARSAQ

SEQ ID NO: 147671 - protein, 161 aa, Glycine max
  Coding DNA Sequence Number=SeqID_55986
MTLLLSNILPSDRNANLPLQKYQLVCVVPTWGSHPQRHPVDLKKSNRALGFPALVTGLCRPYRAPVPPSKFMSSWHRDCARKTPSGPEERQQGLGVASSKYGSLSVLRSARRPNKVIRPHINRAFIKKYAPPDGRRARPTVALGWPVAGNRRTATTFRVHL

SEQ ID NO: 147672 - protein, 39 aa, Glycine max
  Coding DNA Sequence Number=SeqID_55987
MKKPAANLLNVLLSLSVSYPNFVRGPLLDDMRPFFGPCE

SEQ ID NO: 147673 - protein, 82 aa, Glycine max
  Coding DNA Sequence Number=SeqID_55988
MKKKKVEAAGVSLSEAYALSEQHPLSETLSSLSELGEFGRESAKHARTQRAISSPNESFVSSSTKRAWLAKPKFTNSRLAQK

SEQ ID NO: 147674 - protein, 157 aa, Glycine max
  Coding DNA Sequence Number=SeqID_55989
  Homolog annotation: Hit_ID=Q6L477; Match level="QueryCoverage=92%, HitCoverage=26%, E-value=2e-09, Identity=27%"; Hit description =Putative uncharacterized protein OSJNBa0009L15.8
VDVTYETWKEVPAAPKDLIWKDIQAEFEIPEAYDSRIKKKILQTVGERWRQFKYDLTRKWALAADKDGVDDIDVWKKAQAIQKQNTAPHVLSRGGYEYLEQKLMAEKTKKRLEEAAQSRSTEGIIDLPSPIRRHVKWKLTRTKKTGQMTSEAAKEIA

SEQ ID NO: 147675 - protein, 151 aa, Glycine max
  Coding DNA Sequence Number=SeqID_55990
  Homolog annotation: Hit_ID=A0ST23; Match level="QueryCoverage=29%, HitCoverage=91%, E-value=1e-11, Identity=73%"; Hit description =Putative reverse transcriptase
MTVKTSDTCSSRRRSQLVCKRMPGADKPVRARQRMRKEKIPHQAPFAIQAAQLLGRAIGAGLFAITPAGERGMCCKAIKLGNARVFPVTTFIGFLKEQASFKAMMGTELEFVIMVIAVSFGKPVVPAALMNRPTRGERRFAYWALFRFLAH

SEQ ID NO: 147676 - protein, 54 aa, Glycine max
  Coding DNA Sequence Number=SeqID_55991
MDTRLRVIGDPMNGVQRDSPSECGGGAATVRYGLISKGHSRNKIQAQGRVTRYH

SEQ ID NO: 147677 - protein, 232 aa, Glycine max
  Coding DNA Sequence Number=SeqID_55992
  Gene Ontology: Mol. function=nucleoside-triphosphatase activity; Cellular component=chloroplast
  Homolog annotation: Hit_ID=Q2PMM5; Match level="QueryCoverage=100%, HitCoverage=15%, E-value=7e-59, Identity=73%"; Hit description =Protein ycf2
MIELRKLLDRYPTSELKSFWLKNLFLVALEQLGDSLEEIRSFAFGGNMLWVVGPTYGVKSIRSKKKYLNLIDLIKRRIFLANYQTITYSQTLRGANSFHFPSHGKPFSLRLALPPPSRGILVIGSIGTGRSYLVKYLATNSYVPFITVFLNKFLDNKPKGFLIDDSDDIDDSYDSDDIDRDLDMELELLTMMNTLTMDMMPEIDRFYITFQFELAKAMSPCIIWIPNIHDLD

SEQ ID NO: 147678 - protein, 40 aa, Glycine max
  Coding DNA Sequence Number=SeqID_55993
MATIELSSRYESKLAYDIGIWVNSIDFFAGKFLPWGGLCS

SEQ ID NO: 147679 - protein, 227 aa, Glycine max
  Coding DNA Sequence Number=SeqID_55994
  Gene Ontology: Mol. function=chitin binding; Cellular component =extracellular region; Biological process=chitin metabolic process
  Homolog annotation: Hit_ID=UPI00006A17C9; Match level="QueryCoverage =85%, HitCoverage=100%, E-value=4e-18, Identity=32%"; Hit description= UPI00006A17C9 related cluster
  Subcellular localization annotation: CTP_CleavageSite=27; ConfidenceScore=5.13e-01
MLLSSNVIYICVRVFMLVRMIRTRLFAAARVKSCPGMHSSCVIASLSGCARTVGRPPISGGGPGTVRMWSTLKMARTRSPLKVRACSPLEAEDMESSGGRGRVVLSKVRACNPLLARTCSPLKVRACSPTKVRTCSPLMARACNPLKVRTCSPLMARACSPLKVRTCGPLKVRACSPTKARASSPLKARTCSPLEVRACSPLMVRTCSPLKVRTCSPLEVRACSPLM

SEQ ID NO: 147680 - protein, 83 aa, Glycine max
  Coding DNA Sequence Number=SeqID_55995
QAVSLSVCISELSEKELAIDVNSNSRTRSRYNEIGSMGGGRMNRMSDSALSPTSEAGKRTRLGVASSKAGPSIPTDLLLSVPC

SEQ ID NO: 147681 - protein, 234 aa, Glycine max
  Coding DNA Sequence Number=SeqID_55996
  Subcellular localization annotation: CTP_CleavageSite=51; ConfidenceScore=5.12e-01
VSQGSFVPHGRQDVLTASIGRLEHPSHVRTAGAGVTIKQYFRPAPRTSRTSSSMAPEELKQGLALPPKPEVGPSVARVNTKERCDDPSGNGPDTGDSDKYGLYIEENPPRLIALGRVYEGSTTVHNISLLHDQVKVGVEEVKVTDAPIHVPTDEGAVGPAKPADRPDHKVDDPLYLMTLTIPQLFLKPLQVMWDATVFGVFNEDFPLYIKHEDLSKIAHGGQCLSISVIQLWIL

SEQ ID NO: 147682 - protein, 95 aa, Glycine max
  Coding DNA Sequence Number=SeqID_55997
LQTRRWRTHERKHNSGASKKGENGEWQLAITTHSSKLEGGGHMNENAIRGAPKRLRMENCTKQFTTHGSQLEGGGHMNENAIHGAPKKGENGELH

SEQ ID NO: 147683 - protein, 182 aa, Glycine max
  Coding DNA Sequence Number=SeqID_55998
  Homolog annotation: Hit_ID=UPI0000ECBAF8; Match level="QueryCoverage =22%, HitCoverage=48%, E-value=2e-16, Identity=100%"; Hit description= UPI0000ECBAF8 related cluster
RKRKSAQYATRLSPRVGRFINAAGTTGFPTGKRAELKAELSNNPKFQKYHQQIIAEPHNHPEWSLVHPHYPCRIPLNTHRQAHRDKVLSSTLFGITMPLAYSGTAMGRPLPRLYYGIVELLRSFHHPSSGMQAWHWPSFYNVVTGKTLALPNLIALQHIPLSPAGVIAKRPAPIALPNSCAA

SEQ ID NO: 147684 - protein, 87 aa, Glycine max
  Coding DNA Sequence Number=SeqID_55999
MNCVFIHASCTHEFGAMRSDCLVQFSILNPFSDPHEIAFSFMCPPHHEFGAMRSDCLVQFSILNPFLEPMNCVFVHASSTHEFGAMR

SEQ ID NO: 147685 - protein, 105 aa, Glycine max
  Coding DNA Sequence Number=SeqID_56000
  Homolog annotation: Hit_ID=A5ZQM3; Match level="QueryCoverage=61%, HitCoverage=92%, E-value=2e-19, Identity=53%"; Hit description =Putative uncharacterized protein
VEGKEGLLLGGPEPSVRYHSGRARILTLCQDLRAEGQSQAEGSLTARPTRRAGTKVGLSDPTVPSGRAVAQRIKGWAVRPLKRYVSWVQNVVRQFGPYPVWALEH

SEQ ID NO: 147686 - protein, 104 aa, Glycine max
  Coding DNA Sequence Number=SeqID_56001
MSFYNEIENQFGKTIKIFRSDNAKEYFSHDLSSFLSSKDVTFFEDTPFFTPSIDHTSSLQEVLPIPSPYPLGNSDLNVSVVPSSPPNSPEVASSPLITDQHRTR

SEQ ID NO: 147687 - protein, 46 aa, Glycine max
  Coding DNA Sequence Number=SeqID_56002
MTVCVVLMMLHKKKNGSENGNNKENEDTTITDVLKVEAHYEGCAPV

SEQ ID NO: 147688 - protein, 91 aa, Glycine max
  Coding DNA Sequence Number=SeqID_56003
MKTKAHNRITDNIVSETKQEAPYQDDELVGLQEVLELDLDVINESLTDVDGGGEEIDADLLKQLDLVEPDEDECMLSENDIESDFDYTNTS

SEQ ID NO: 147689 - protein, 96 aa, Glycine max
  Coding DNA Sequence Number=SeqID_56004
DAGSRQARQGASAGVGGCRGWLNYAASEQIVLRVHHMRAIGAGLFAITPAGERGMCCKAIKLGNARVFPPQTIKINQPDQATSGGQPAQKSACCGS

SEQ ID NO: 147690 - protein, 171 aa, Glycine max
  Coding DNA Sequence Number=SeqID_56005
  Homolog annotation: Hit_ID=Q84VI1; Match level="QueryCoverage=91%, HitCoverage=20%, E-value=1e-42, Identity=63%"; Hit description =Envelope-like protein
MATSPKETSAPGSPSVPSSPHQEQPEFNIQPIQIIPGQASVPEKLVPRRQQGVKIAENPSLATSPREVDTEMDKKIRSIVSSILKDASVPDAEKDVPTSSTQMLLSLKLMKMSQHLPPRMFLCLMLRKMFPTSSGPNAEVLSSPSKERSTEEDDQATEETPCTTGTRTCSR

SEQ ID NO: 147691 - protein, 231 aa, Glycine max
  Coding DNA Sequence Number=SeqID_56006
MVIYHTEFDEFKEELERRKWDEELTSFDEGNISVTIVKKFYANLYDPEDKPPKQVRVRGHLVKFDEDTLNTFLKTLVIIEEGETLFAYSRFALLRPDPQDLATKLCIPGRGFKLNVDGQPLKILRKNMTTLAQPWSIVSYSNLVPTSHTFDITLDRAKLIYGIIMKMDMNLGYLISPQISIIAQHDSSRVGFPALITALCKARGVTLDFRSLESLSPAINLAYIQNCRNLE

SEQ ID NO: 147692 - protein, 299 aa, Glycine max
  Coding DNA Sequence Number=SeqID_56007
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=22%, HitCoverage=64%, E-value=5e-32, Identity=100%"; Hit description=LacZ protein
MRKRHASRREKGGQVSGNRQGRNRRAHEGASRGKRLGAGAYGKTPATRPFYGSWPFAGLLLTCSFLRYPLILWITVLPPLSELIPLAAAERPSAARNSYDHDYEFELGTLHRRQVEIDDRICPFCRSAEEEAGHLFFHCTKIIPMWWESLSWVNNVGVFPQDPRQHFLQHGSIVADGLRTNRWKCWWLAVTWTIWKKRNDIIFSDPLESTCRHASLALAVVLQRRDWENPGVTQLNRLAAHPPFASWRNSEEARTDRPSQQLRSLNGEWRLMRYFLLTHLCGISHRIWCTLSTICSDAA

SEQ ID NO: 147693 - protein, 91 aa, Glycine max
  Coding DNA Sequence Number=SeqID_56008
MWMDRFALTLNGSQELPRSLAKAKAMADTYSAPEMKADMSALKEQMASMMYAMLGMRQLMENNMATTTAVSPAAEADPTLPATAHHPLPNV

SEQ ID NO: 147694 - protein, 39 aa, Glycine max
  Coding DNA Sequence Number=SeqID_56009
MVFREENPSQGASVIDSVEILHRSSPFFVRSSSFFGLQP

SEQ ID NO: 147695 - protein, 134 aa, Glycine max
  Coding DNA Sequence Number=SeqID_56010
MIQGRFSSLDAWNRYTDNVLGRNILPERKVELYHTELDDFKTELERRNFHKRLTNLVDGSIDLALVKEFYANLYISEAEWRRKRERRCHFNEKMSIEEAHHHRRPWIRAWRKKEMNEGRGREEHEILCSKSSEI

SEQ ID NO: 147696 - protein, 144 aa, Glycine max
  Coding DNA Sequence Number=SeqID_56011
  Homolog annotation: Hit_ID=Q5NRP4; Match level="QueryCoverage=44%, HitCoverage=4%, E-value=5e-07, Identity=42%"; Hit description =Putative gag-pol polyprotein, identical
  Pfam annotation: Domain name=zf-CCHC; Domain location=71-88; Score =22.6; E_value=0.00058; Accession=PF00098.14; Description=Zinc knuckle
MKEGIGHILDLTPIGEKRKQSLKRLTLTSHTSMLLRLGNKGAAPSKPNDDKGKTIEKQPPKASMQEKTSFIKCFKCLGRGHITSQCPTKKTMLMRSQDIHSSQDEATTSPSSSESEEAKGEESSEEIYPQEEGQPLMFKEECKE

SEQ ID NO: 147697 - protein, 235 aa, Glycine max
  Coding DNA Sequence Number=SeqID_56012
  Gene Ontology: Mol. function=motor activity; Cellular component =flagellin-based flagellum basal body, distal rod, L ring; Biological process=ciliary or flagellar motility
  Homolog annotation: Hit_ID=A7ZKI4; Match level="QueryCoverage=98%, HitCoverage=100%, E-value=1e-115, Identity=88%"; Hit description =Flagellar L-ring protein precursor
  Pfam annotation: Domain name=FlgH; Domain location=25-234; Score =377.5; E_value=2.1e-110; Accession=PF02107.7; Description=Flagellar L-ring protein
  Subcellular localization annotation: CTP_CleavageSite=90; ConfidenceScore=5.06e-01
MKAMQKNAAFRYPILTVLAVSLSGCAWIPSKPLVQGATTAQPVPGPAPVVNGSIFQTAQPINYGYQPLFEDRRPRNVGDTLTIVLQENVSASKSSSANASRDGKTNFGFDTVPRYLQGLFGNARADVDASGGNTFNGKGGANASNTFSGTLTVTVDQVLVNGNLHVVGEKQIAINQGTEFIRFSGVVNPRTISGSNTVPSTQVADARIEYVGNGYINEAQNMGWLQRFFLNLSPM

SEQ ID NO: 147698 - protein, 100 aa, Glycine max
  Coding DNA Sequence Number=SeqID_56013
  Gene Ontology: Cellular component=mitochondrion
  Homolog annotation: Hit_ID=Q6YSL1; Match level="QueryCoverage=98%, HitCoverage=90%, E-value=2e-14, Identity=47%"; Hit description =Putative uncharacterized protein orf120
  Subcellular localization annotation: CTP_CleavageSite=60; ConfidenceScore=5.09e-01
MIGRTEARAASFPPRPSLCVGDIKRVHRKRTGTGSIYSMAKHPKHNCTLTRSLPRDRSIRCVGQRARGTCCPPFLLCFENRVNGEWAEGKEVLIRSRTLT

SEQ ID NO: 147699 - protein, 141 aa, Glycine max
  Coding DNA Sequence Number=SeqID_56014
MAKFDPDIVLEFYANAWPTEEGVRDMRSWVRGQWIPFNADALSQFLGDPLVLEEGQECKFSQRRNRTDGFDEEAIAQLLCISGQNFARTAAGRRVRIMHTSMTTLTHMWMTLLLSNVLPSDHNSDLPLPKCQLVCHPPGNF

SEQ ID NO: 147700 - protein, 70 aa, Glycine max
  Coding DNA Sequence Number=SeqID_56015
VEGRSPEYEEHQDLRSNPFQGGGDEAILPPKALASHLKEVSLAIRELLKEVFSKKLFKEVFSRKLLKEAT

SEQ ID NO: 147701 - protein, 133 aa, Glycine max
  Coding DNA Sequence Number=SeqID_56016
  Gene Ontology: Cellular component=mitochondrion
  Homolog annotation: Hit_ID=Q6YSR1; Match level="QueryCoverage=51%, HitCoverage=59%, E-value=1e-28, Identity=88%"; Hit description =Putative uncharacterized protein orf115b
MGLNGHCLKGLCPRGTAGPPTRDISRLWAAITIQEDTRNWKDKQTHPVDCRATSPTTQERDSLKSQGRGEYSNPGNRGLAKVQGGSKFDQGDPCPVPYSLRGGNLGQYQSIFGFYKPGGIYYPGNTPPGYKAH

SEQ ID NO: 147702 - protein, 56 aa, Glycine max
  Coding DNA Sequence Number=SeqID_56017
MSNGKRKVEAGAKMLLLARAKSQYEGEWIDKDLTSQRSLLRKLLKEATRKLMEEAS

SEQ ID NO: 147703 - protein, 305 aa, Glycine max
  Coding DNA Sequence Number=SeqID_56018
  Homolog annotation: Hit_ID=Q6WAY6; Match level="QueryCoverage=78%, HitCoverage=40%, E-value=5e-12, Identity=25%"; Hit description =Putative uncharacterized protein
MGTRGCINYNPVLARRQLGYLMRGAPLEEELAPVISQGFNETNVETLQKVRKAWEVVQKKDKELRGNNNGPIGGYRKWLKAHVQGLDWLPSLRTAKREEVEAPKEDKEVQALRAELEQAQTIKERFKSVALKIQKENAELRDINIATTKAMEQETKRARREEHGRNKFRGALWGSNNELKLRREEKDRSRVDSLILKDELKRLCETETNMLAIISKYQEELNLATAHEHRVADEYAQMYAEKEARGRVIDSLHQEATMWMDRFALTLNGSQELPRLLAKAKAMADTYSAPEEIHGLLSYCQHMID

SEQ ID NO: 147704 - protein, 85 aa, Glycine max
  Coding DNA Sequence Number=SeqID_56019
MAHRDKIWSFCTLCHPEAAGPMTYRDKIWSFCTLCHPEAAGPMTCGDKIWSFRTPLPFRHSRVRWRAETKFGHSAPFVIQRRRAR

SEQ ID NO: 147705 - protein, 72 aa, Glycine max
  Coding DNA Sequence Number=SeqID_56020
MSQFLRGYINLGCSTENKRGYISCGSVQVEDTSTWLFKENKGGYIPCGSLACKGFYKVERNLKNRWLLGDWM

SEQ ID NO: 147706 - protein, 125 aa, Glycine max
  Coding DNA Sequence Number=SeqID_56021
  Subcellular localization annotation: CTP_CleavageSite=32; ConfidenceScore=5.14e-01
MPISPCGSISWSVSSRHRDRDHKAPSGPGGVRQGLGVSSSGYGPLSVLQDARPPSKGSRPQDILWTRRSPTGPWGFQLWLRASVSPTGCPFPPARSCHRDIGKDRARKTPSGTRRSPTGSWGFQR

SEQ ID NO: 147707 - protein, 98 aa, Glycine max
  Coding DNA Sequence Number=SeqID_56022
MILGRFPTRSDKPNVHNILAVTVTVTIGGGDAILLSWVMENSSLIVNHLIQPYFNLLSENQLRGELPGNHITSETSKRVGLRPQKETTPENLAFHGFK

SEQ ID NO: 147708 - protein, 474 aa, Glycine max
  Coding DNA Sequence Number=SeqID_56023
  Homolog annotation: Hit_ID=A1X1R4; Match level="QueryCoverage=80%, HitCoverage=81%, E-value=8e-42, Identity=30%"; Hit description =Putative uncharacterized protein
  Subcellular localization annotation: CTP_CleavageSite=39; ConfidenceScore=5.67e-01
MINGIGPGSFSQLHLSSASARVTSSTASNATRQNSLTADASAKVTFSEATDAISAVYQMTPARVTASTLLSPDMQTQAMGALRSSGVSMNGIGSALLSALTQQRDDVTISVPASGGAQTDTQSAVALEITTQSGVSLTLQMTRQQDGVAVALKTTHGKLNDDEAAAIAKLSGALEKTLSGLDNGNGKLDVGDLLSFDSNQLASVDLKTDLRRSGEVMQSLNLHADPGSRWLGFHNADASFKLTTDMRSLAQASNAGQQQSALAQWSAKFDQAASRGHGDRAALALFKQGFETLNSTSAAAGVAMRTPQAITVGAHAAQAGAISGLADFSASYHQTARSSNPLKPEEEDTFALDVAQRSSQQKNGDTQRMTQETLFKLNASFHTALSASSPLALNETKESQNYHYHQIHDETRSTTEVTQDAQGNLTARFAQQLTQQETVKTYQLAKLIDSTSTPHSEKSESTRHYSPAMYLAQA

SEQ ID NO: 147709 - protein, 972 aa, Glycine max
  Coding DNA Sequence Number=SeqID_56024
  Gene Ontology: Mol. function=monooxygenase activity; Cellular component=intracellular; Biological process=electron transport
  Homolog annotation: Hit_ID=A4XUV5; Match level="QueryCoverage=41%, HitCoverage=86%, E-value=1e-173, Identity=71%"; Hit description =Coenzyme F420-dependent N5 N10-methylene tetrahydromethanopterin reductase-like protein
  Pfam annotation: Domain name=Acyl-CoA_dh_1; Domain location=343-499; Score=-0.7; E_value=0.00063; Accession=PF00441.15; Description=Acyl -CoA dehydrogenase, C-terminal dom
  Pfam annotation: Domain name=Acyl-CoA_dh_2; Domain location=1-119; Score=45.0; E_value=2.7e-10; Accession=PF08028.2; Description=Acyl -CoA dehydrogenase, C-terminal doma
  Pfam annotation: Domain name=Acyl-CoA_dh_2; Domain location=358-492; Score=86.1; E_value=1.1e-22; Accession=PF08028.2; Description=Acyl -CoA dehydrogenase, C-terminal doma
  Pfam annotation: Domain name=Acyl-CoA_dh_M; Domain location=242-292; Score=5.2; E_value=0.015; Accession=PF02770.10; Description=Acyl-CoA dehydrogenase, middle domain
  Pfam annotation: Domain name=Acyl-CoA_dh_N; Domain location=131-239; Score=-12.2; E_value=0.0046; Accession=PF02771.7; Description=Acyl -CoA dehydrogenase, N-terminal domain
  Pfam annotation: Domain name=Bac_luciferase; Domain location=534-864; Score=-107.2; E_value=0.042; Accession=PF00296.11; Description =Luciferase-like monooxygenase
  Pfam module annotation: Pfam domain module=Acyl-CoA_dh_1::Acyl-CoA_dh_ 2::Acyl-CoA_dh_2::Acyl-CoA_dh_M::Acyl-CoA_dh_N::Bac_luciferase; Domain location=343-499::1-119::358-492::242-292::131-239::534-864
ALAFIHSSSRPWVDAGVSRNADDPYILADVGRISTELSAANALLVRAARVLDSIDPHALTAAHCARASIAVAEAKVLTTEIALKASEKLLEWSGSRGTLLKHGLDRHWRNARTHTLHDPVFAKQPAARIRSAQQALQVAEELAERFRSGAAQRDRQRELPHAELQHYFQSGLGAITVPRAWGGIEISSAELAQIFVILSAADASIGQVPQNHFYALEVLRVNGSDAQQQRLYNEVLAGVHYGNALAEFASAAAHQRTTAFSQTASGLRLNGDKFYCTGALFADRIPTLAIADDGKEQLVFVPRHQPGVTVIDDWSGFGQRTTGSGSVQFRDVAIAPDDVVPFHSAFERPTTVGPFAQIMHAAIDQGIARAAFNDMLAFVQQRARPWPDSGVERACDDPLTLDRTGRLAARLSAGDALLDVAGEAVDVAQRNPSAEHVALASVEVAKARAWTTEVALEAGNLLFELGGSRASLREHNLDRHWRNARTHTLHDPILLNAFNMNCVGHIHHGMWTHPQDRSVEFNSLAYWLDLARLLERGLFDGLFIADILGVYDVYQQGIGLTARESIQLPVNDPLMLISGMASVTQHLGFGVTANLSYEAPYPFARRLSTLDHLTNGRIGWNIVTGYLDSAARAMGQQQLLAHDRRYDQADEFLDVTYQLWEGSWQDDALLADKQRRLYADAQKIHAINHQGEFYQVQGYHLSSPSPQRTPLLFQAGSSARGVAFAARHAECSFVNASSPAALREQAQRLRHAAVAAGRQADDLRIFMGVSVIVAASEREAQEKHRSYLEYASAEAGIAHFSSSIGVDLAAFGLDEPIHSGDTRAIESVSKAYNGWTRRQLLEQHALGSRYPVIVGNPSQVADQLIRWIDEGDIDGFNLTRILNPQSYRDFIELVEIRMKFASLVALSAAIFTASAFAAGDYSGALKVGTTAAFAPPLETAVAEAKKQGLQVELVEFTDWTAPNVSVENGDID

SEQ ID NO: 147710 - protein, 461 aa, Glycine max
  Coding DNA Sequence Number=SeqID_56025
  Gene Ontology: Mol. function=tetracycline:hydrogen antiporter activity; Cellular component=integral to membrane; Biological process=response to antibiotic
  Homolog annotation: Hit_ID=A4W4V3; Match level="QueryCoverage=48%, HitCoverage=44%, E-value=2e-65, Identity=58%"; Hit description=Drug resistance transporter, EmrB/QacA subfamily
  Pfam annotation: Domain name=NLPC_P60; Domain location=326-430; Score= 94.6; E_value=3.2e-25; Accession=PF00877.10; Description=NlpCP60 family
  Subcellular localization annotation: CTP_CleavageSite=69; ConfidenceScore=5.04e-01
MAFIIGMALFGSVTFLPLYLQVVKNATPTEAGLQLLPLMGGLLVTSNISGRMISRSGKYRLFPIAGTLLATTGMALMTTLTLDAPLWHIYLFSSVLGMGMGMTMQVLVLAVQNAVTPDRIGVATSSVTLFRSVGGSIGVALFGAVFSHVLKSGVTRLIEQGNVLPPSLDPVAVNHLPAALRQAYLLVFSDAVHAAFQMAAGVMLLAFILSLLLPESPLRDNRYLSVNLGKNSEDSENSGGDALFLQLLYGINLLSLLSTVKRHPMIATAARNLIACLMLLTLAGCSSHSSPAPEQESVDTSQDGGKQPDLIPVIAALHDQMHSWEGTKYQWGGTQLSGVDCSGFVWRTLKDRFNIPMDRVTTRELIAMGKPVDQAHLQPGDLVFFRIKHELHVGFYDTDRQFLHASVSQGVMRSSLNNPYWKSTHPAVNHPSPVSVAIRIQHDGCFNALCRFMGIEIQSTY

SEQ ID NO: 147711 - protein, 53 aa, Glycine max
  Coding DNA Sequence Number=SeqID_56026
MNCFHEFVAYGDVMGCRKEFGEKVLIWVSNVEVNQILVKKKEVVPRLKEMVTP

SEQ ID NO: 147712 - protein, 44 aa, Glycine max
  Coding DNA Sequence Number=SeqID_56027
MGMASNRQQMHRRHLQSPQLIHRKVRVFPTTHDRPIGRPSPKPK

SEQ ID NO: 147713 - protein, 148 aa, Glycine max
  Coding DNA Sequence Number=SeqID_56028
MWAFLTGHPINWAHLIRYGMHKALRTSAPLPYPQLVTLFLRHFEIPLNFEPFMQVKRSFSIGAGVVTSFGYRKDMDGQWLKKDAHPPQDKLLSELRGLRTYVGEHFDSLDGRIDAIDACYEGMDTCITQLEEDVSYLRWCFDLSPPPS

SEQ ID NO: 147714 - protein, 125 aa, Glycine max
  Coding DNA Sequence Number=SeqID_56029
  Gene Ontology: Mol. function=peptidase activity
  Homolog annotation: Hit_ID=Q8H6W2; Match level="QueryCoverage=77%, HitCoverage=95%, E-value=2e-10, Identity=43%"; Hit description=Gag -protease polyprotein-like protein
MASANSLFPEGNSINRPPIFNGEGYHYWKTRMQIFIEAIDLNIWEAIEIGPYIPTTVERVSIDGSHQEHEMELLRLHQHEENDKKKKGIALKASSSIQEESDQDNDPDDDDDLSLFVRRFNKFLK

SEQ ID NO: 147715 - protein, 115 aa, Glycine max
  Coding DNA Sequence Number=SeqID_56030
MELSNGKGPSRVNLGFVEPWTKDVFALGFVLPWSCVEAYQGRALDFVNPYGSASAKVGFDESCVQCKYCALTYTPLTKWQVLETRWCLSVGLTKGGPWVSQALWRIDQGIFRLGF

SEQ ID NO: 147716 - protein, 175 aa, Glycine max
  Coding DNA Sequence Number=SeqID_56031
  Gene Ontology: Cellular component=mitochondrion
  Homolog annotation: Hit_ID=Q6R9A5; Match level="QueryCoverage=32%, HitCoverage=51%, E-value=2e-27, Identity=96%"; Hit description =Putative uncharacterized protein orf111-b
EPAPFEFEALSSVRCFLIAASEQENGCANAAFFRLACDDDVELAAEKDSAFSDILEEGGDDVKSAWPLWAGPHTCYNGNYNGKQGCKAERIRKDCLSSDCSLQLGNMKLESLVIADQHAAVNMYPGPVHTARHTLGIGFARSIGPMITHDFCVPLVPQRLLVVLLAHTTVGSSTG

SEQ ID NO: 147717 - protein, 99 aa, Glycine max
  Coding DNA Sequence Number=SeqID_56032
MVSPVGRRVCTFDDLLSCIEKITLLSDEEDRILEAHEDAPPSQPQFEHQQFNILQRSVETRGLVRRWETVDAATYSLPPMLERQHGMYYTPPTFTQEPS

SEQ ID NO: 147718 - protein, 187 aa, Glycine max
  Coding DNA Sequence Number=SeqID_56033
SRERNIVKVNNDIAETGESRKGMTISVGSLILAIAHGSYKRLWLDCCYLAQWIVSQLLFSLDLATFIAIAGSLATFFRDMVEEKANALTPTAPTPSPKAGYLPEYNKRKAKKRRKRRMQKKVGTRFVGSTPLSKRSVGIRLYRTELSSHTYNLRCSPVSLLSYSTALGTDARLSAFHRYGYPAYLTT

SEQ ID NO: 147719 - protein, 388 aa, Glycine max
  Coding DNA Sequence Number=SeqID_56034
  Homolog annotation: Hit_ID=Q6WAY6; Match level="QueryCoverage=36%, HitCoverage=30%, E-value=5e-17, Identity=32%"; Hit description =Putative uncharacterized protein
IPMANQGDWVPFMDVLALLIFGVVLFPNVDGLVDLVAIDAFLAYHHSKESPVVAVLADLFDTFDRRIDWDQLLAGIGGRTISWFPRWKEGKEGVLFSCGRYPNIPLVGTRGCINYNPALAIRQLGYPMRGAPTEESMSPFLSLEAFVMASLVGTRMAESHIRGLDWLAKLKVVSEENFEAPEEDEEVQALKSELGKAKLAKEKFKLAATHVRKECAGLREENAITARALERETKRARKEEYGRNKFRGALWGSNSELKLRKEERDQSRAHSMVLKEELVACSRSKRSLSQRLCETETNMLAIIAKYQEELGLATAHEHRIADEYAQVYAEKEARGRVIDSLHQEATMWMDRFALTLNGSQELPRLLAKAKAMADTYSAPEEIHGLLGY

SEQ ID NO: 147720 - protein, 158 aa, Glycine max; identical to SEQ ID NO: 122371
  Coding DNA Sequence Number=SeqID_56035
  Homolog annotation: Hit_ID=A6FJQ2; Match level="QueryCoverage=24%, HitCoverage=84%, E-value=3e-11, Identity=92%"; Hit description=50S ribosomal protein L5

SEQ ID NO: 147721 - protein, 179 aa, Glycine max
  Coding DNA Sequence Number=SeqID_56036
MERSMIDAASGGALGDMTPAEARNLIEKMASNSQQFSARNDAIVLRGVHEVATDSSASTENKKLEGKLDALVNLVTQLAMNQKSTPVARVCGLCSSIDHYTDLILLCNNLESMSNLKLMLQIFIIDLLSSKTNNSRIIMTFQAIDTIQLVPPFQNVAGPTKPYVPPPIQQQQQQQSQQR

SEQ ID NO: 147722 - protein, 59 aa, Glycine max
  Coding DNA Sequence Number=SeqID_56037
MVAHIPDPRVDPSQYRDLVHYWCSEKGQKIRNINKRSCSKYEDLHCMGTNYLPRRIHEM

SEQ ID NO: 147723 - protein, 105 aa, Glycine max
  Coding DNA Sequence Number=SeqID_56038
  Homolog annotation: Hit_ID=A5B5G7; Match level="QueryCoverage=91%, HitCoverage=7%, E-value=2e-08, Identity=29%"; Hit description =Putative uncharacterized protein
MSFFLKVGQLAKQIADKSSNSFMANTEKNPKEECKAVMTRSKRKLEITMAFGEALQQMPLYSKFLKDMLTRKHKYIHQENIVVEGNCSVVIQKILSHPSIKTLGV

SEQ ID NO: 147724 - protein, 124 aa, Glycine max
  Coding DNA Sequence Number=SeqID_56039
LDRVQGHAETKYGHSTPCVNQEEQIRQYQDDVGHSVLIIFKIFVGSAGREVDQPNGGVQIAIRPTWAFEEVPPEGGAFWRKQPSSPGQAGRGASVTLPRRFRGRFREDFPPFFVVLRSCFGLQP

SEQ ID NO: 147725 - protein, 75 aa, Glycine max
  Coding DNA Sequence Number=SeqID_56040
MNAKDTGLPCSNILCLFSAGKGWRLVGRDPILHSLPSLSTCKYGSNDMRPIVTDHRLTLVDSRSQLVLTSNCDLR

SEQ ID NO: 147726 - protein, 94 aa, Glycine max
  Coding DNA Sequence Number=SeqID_56041
MTPTHDALLYYNRRWNMPRQHDFVGYSFTVKNPKRLDIPSGCTINELEDLIKQVAPQGLPPYGHYEYSDIVIKFEIIELKTDDDMLKVLVQSNY

SEQ ID NO: 147727 - protein, 76 aa, Glycine max
  Coding DNA Sequence Number=SeqID_56042
MLFFDDNKGDDKKLKGQSKNEFKMFKIESRTLQDSRGKLISRIKNQDSRIKRRLNQKLSSTWIFLKTCLPKSFYSL

SEQ ID NO: 147728 - protein, 16 aa, Glycine max
  Coding DNA Sequence Number=SeqID_56043
MGIFNHGVAAEDKGEE

SEQ ID NO: 147729 - protein, 150 aa, Glycine max
  Coding DNA Sequence Number=SeqID_56044
  Pfam annotation: Domain name=Transposase_23; Domain location=37-107; Score=-11.5; E_value=0.021; Accession=PF03017.5; Description =TNP1ENSPM transposase
MQSQRLALPPEPEVGPSAACVNTKGSCVDPSAVDPDTGDSDKYGLYIKENPPHLVALGRVYEGSTIVQTIPLLHDQVKVGVEEVKDADALVPVPTDEAILVGQALNTFLAWPTHLIKRLSEHGVVSPAKPADRPDPEVDDPLYLMTLTIA

SEQ ID NO: 147730 - protein, 86 aa, Glycine max
  Coding DNA Sequence Number=SeqID_56045
MLRAQNSTAHHSAYFGKRALEAARGAAFAEIPRFCKLIIVKNLNEAELELSLTRGICRLSFGFKYAITIILFGLSLVQQEESEDKA

SEQ ID NO: 147731 - protein, 165 aa, Glycine max
  Coding DNA Sequence Number=SeqID_56046
MKRTDAAIKNLEVQIGQLAEVVAKKPTETFAVNTEMKPKEDCKVIFTEREEKEKKTEEDVRDEEGEKKEEKERNEEKAQQWEKYSQVEIQQESILQVNTPPHQLIVKEERHGEHEKALSVILSLIATTSLAIMWKVLPEYMSFMASLAKRQKCKEDVFYVTFMPP

SEQ ID NO: 147732 - protein, 238 aa, Glycine max
  Coding DNA Sequence Number=SeqID_56047
  Homolog annotation: Hit_ID=Q6WAY6; Match level="QueryCoverage=91%, HitCoverage=61%, E-value=4e-13, Identity=37%"; Hit description =Putative uncharacterized protein
MGTNQTSKRFYQVKVKGLDTTSIKELGRLMEPLRMQAFRKTYGKILDLTIAEISIEAIASLTQYYDQPLRCFTFGDFQLVPTIEEFEEILGCPLGGRKPYLFSGCLPSLSRIATVVKDSARGGRTINWFPRWKEGKEGVLFSCGGYPNIPLIGTRGCINYNPALAIRHLGYPMRGAPTEEDMSPFLVRDFGAQNSKAIQRIHKAWETPLRKDQELRGIRNGIIGGYHEWLKVHIRGLD

SEQ ID NO: 147733 - protein, 170 aa, Glycine max
  Coding DNA Sequence Number=SeqID_56048
MTLTYKNRRITRPFRLARFGDDADAGSRQARQGASAGVGGCRGWLNYAASEQIVLRVHHMRCEIPHRCVRRKYRIRRHSPFRLRNCWEGRSVRASSLLRQLAKGGCAARRLSWVTPGFSQSRRCKTTASAKLACLQVDSRGSPVQDVSLIGDPNDLGSLIVGGGMEGYGD

SEQ ID NO: 147734 - protein, 78 aa, Glycine max
  Coding DNA Sequence Number=SeqID_56049
MTAGHLSESVGCPRPLMCPQEIWCAAFAEWLIVKRRCPPFQDLSKKMLRWKVTQWGGPHRKFEYDHDTKRNVEDNCHW

SEQ ID NO: 147735 - protein, 67 aa, Glycine max
  Coding DNA Sequence Number=SeqID_56050
MTMTQDHEKLGSNLIATCVVGMIREDPSIKISLIQERINSEFSYKGKSRTSSVSSSILDIWSMQRSF

SEQ ID NO: 147736 - protein, 236 aa, Glycine max
  Coding DNA Sequence Number=SeqID_56051
MTTLTQTWMTLLLSNILPSDHNSDLPLPKCQLVYAILTRMNIHVAQLITNAIYLFVGMAPTRHPLDPDKSNRALGFPALITGLCQSFGVPVAPSKVIRPPITWAFIEKYFTQRQAQGDAPQAAGAPPPPHQADPAGSFDTERYLRHSMRQHAANHRGLGQVHECLYQVSLSMQSQGFAPFLCPTPDQFKAEVAWPGDWPEAQAREAPAEAPDDGEEAGMDEEMSDLLGFLGGSGAT

SEQ ID NO: 147737 - protein, 240 aa, Glycine max
  Coding DNA Sequence Number=SeqID_56052
  Homolog annotation: Hit_ID=Q84VH5; Match level="QueryCoverage=88%, HitCoverage=35%, E-value=1e-105, Identity=82%"; Hit description =Envelope-like protein
MVNIPSDITNRKSDEYQKVFVRGKCIRFSPAVINKYLGRPTEGVVDIAVSEHQIAKEITAKQVQHWPKKGKLSAGKLSVKYAILHRIGTANWVPTNHTSTVATESFAVKLPIAFPTVLCGIMLSQHPNILNNIDSVKKRESPLSLHYKLFEGTHVPDIVSTSGKAATSGAVSKDDLIAELKDTCKVLEATIKANTEKKMELERLIKRLSDNGVDDGEAAEEEEDAAEDTESDDDDSDATR

SEQ ID NO: 147738 - protein, 232 aa, Glycine max
  Coding DNA Sequence Number=SeqID_56053
MVEPSKKRKSSSSRSQRHSETQEMPIPSSIPSASLFSSEEQQIWYTNIFSSHSIVDPKFIDMDFYSNESFECIQAFENSNLIPFMSLKLLVYSELVKSFYSNLEIQEGTLISEVYGIKMVIDQSLLYELTQLSSEGVPFEGTLIDDWKYEFSVHDARWLVCTNQADMTGRLLAGSLAFESCILHYLIVRILLPRSSNLAQVFEEDLIVMWAFHKGRQIDWAHLVRYRMHKAL

SEQ ID NO: 147739 - protein, 109 aa, Glycine max
  Coding DNA Sequence Number=SeqID_56054
MAPKKLLSKRARKDTVGEGSERRVQLQEGEYMEFQEEVARRQWTQLTGPMAKYDPEIVMEFYANVWPIEEGVRDKHSWVRGQWVPFDEDAIHQFLGHPLVLEEGQYCEF

SEQ ID NO: 147740 - protein, 178 aa, Glycine max
  Coding DNA Sequence Number=SeqID_56055
  Homolog annotation: Hit_ID=A5AZ88; Match level="QueryCoverage=81%, HitCoverage=12%, E-value=2e-08, Identity=33%"; Hit description =Putative uncharacterized protein
MERSMIDAASGGALGDMTPAEARNLIEKMASNSQQFSARNDAIVIRGVHEVATNPSASSETKKLEGKLDALVNLVTQLALNQKSVPVARTFALPCSNLEQLSSLKLMLQIFTIDLLNLSSKSPQQSNYDLSSNRYNPGWRNHPNLRWSSPRQQQQQPAPSFQNAAGPSRPYIPPPIQQ

SEQ ID NO: 147741 - protein, 90 aa, Glycine max
  Coding DNA Sequence Number=SeqID_56056
EEAEETQVGSWLAQLLRRSLEATSEHSAPVVNVPCRQPAADPSTPLLQMPDDPSTPVLAVDTSPPTTPMLQLTDEEDGQTQDTQDQSQEF

SEQ ID NO: 147742 - protein, 153 aa, Glycine max
  Coding DNA Sequence Number=SeqID_56057
MSRREEEIVEVDTQEESPVNEHDLEEEDEEKAQQREQCLQEDNLQVNTCSHQLTIKEERHEDHEGSIILGQPCLSFASCVLDMGKGRLELNVEDQKISFDLIEAIKHLDDGEDWFEAEMSEQEMELIASAMDWKTIDQKKNPKVELKILPTHL

SEQ ID NO: 147743 - protein, 115 aa, Glycine max
  Coding DNA Sequence Number=SeqID_56058
MATPFKTKDINEEVTSEDIKSLMEQANYTNKYLQILGETIKTKVAPMQKSVEEASPSIPIEKSLFKPFKVSEKAKRKIRELRKTKSLVEGVGHSGNSPTLEKYFQNGNKKYLQIN

SEQ ID NO: 147744 - protein, 122 aa, Glycine max
  Coding DNA Sequence Number=SeqID_56059
APVLPGPFAQSLELFMSMLQSLHQGQLLIIQSLQDVVQQRPVMSLEEFVQKMAWPGVQPSPLGGVAATPQVTPEPSTAVLDISSSQLESSAPVPNLPLSQDSPSSTTALELNEHAMDSALDH

SEQ ID NO: 147745 - protein, 111 aa, Glycine max
  Coding DNA Sequence Number=SeqID_56060
  Homolog annotation: Hit_ID=A6FJQ2; Match level="QueryCoverage=34%, HitCoverage=84%, E-value=3e-11, Identity=92%"; Hit description=50S ribosomal protein L5
MTVKTSDTCSSRRRSQLVCKRMPGADKPVRARQRMRKEKIPHQAPFAIQAAQLLGRAIGAGLFAITPAGERGMCCKAIKLGNARVFPVTTLSTLEDPPVPDKCFDKCAIGA

SEQ ID NO: 147746 - protein, 172 aa, Glycine max
  Coding DNA Sequence Number=SeqID_56061
  Homolog annotation: Hit_ID=Q6L477; Match level="QueryCoverage=41%, HitCoverage=11%, E-value=2e-09, Identity=35%"; Hit description =Putative uncharacterized protein OSJNBa0009L15.8
  Subcellular localization annotation: CTP_CleavageSite=37; ConfidenceScore=5.74e-01
MASPPASPPPPPPSPPPPPPLPSDASASPSVVKRTCKALHLRSLSTRPPGADRPVVHVDPTTGKADDPHRKKLRTYLGIVACDKVDVTYENWKEVPTAQKDLIWEDIQVEFEIPEPSDSRTKKKLLQTIGERWRQFKSDLTRKWALAADQDGVDDTVCEKYDISKEKWAQFC

SEQ ID NO: 147747 - protein, 42 aa, Glycine max
  Coding DNA Sequence Number=SeqID_56062
MAQPPPRERTLREMAAPDFTYESLCIQYPDEDVPYVKTRTNI

SEQ ID NO: 147748 - protein, 72 aa, Glycine max
  Coding DNA Sequence Number=SeqID_56063
STLEDPWGDEWQRNGEGRERGDRHFKEKMSLEEAHHHRRPWIRAWRKKEMNEGREREEHEIFCSKRALKSEV

SEQ ID NO: 147749 - protein, 96 aa, Glycine max
  Coding DNA Sequence Number=SeqID_56064
LGSNPKAQQSDKSKEMMRSNTKAQQTEEPFVYSNPTSKGHPLSSLYEDPIQLQCDILKEMGLSYEEEDSKVKGLLLDMENKDDLMAAKKGIKSQQL

SEQ ID NO: 147750 - protein, 152 aa, Glycine max
  Coding DNA Sequence Number=SeqID_56065
  Subcellular localization annotation: CTP_CleavageSite=67; ConfidenceScore=5.06e-01
MTTLTWMSLLFSNILPNDHNANLPLQMYQLGSRLQDTQWTRRSPTGPWGFQLWLRASVVLQGARSPRQGHGSRLQDTQWTRRSPTGSWSCQALITGLSQFYGVPVTPSKVIRPPTNRAFIKKYCVPRQAQGETPQQPEDGRQRATDAPPPPL

SEQ ID NO: 147751 - protein, 285 aa, Glycine max
  Coding DNA Sequence Number=SeqID_56066
  Homolog annotation: Hit_ID=A0HD97; Match level="QueryCoverage=33%, HitCoverage=14%, E-value=2e-11, Identity=42%"; Hit description =Putative uncharacterized protein precursor
VAHVAHDARQALVHGLERGHQVAGLVARSDLDVAAQVTIGDTTRGVHRQPQGPRDAARHQPAEQQAEGHAGQRQQDHDETGAAIQIGDFVHRLIGGFFLGLRQLAHQALGLARRRRRALGDAGNGGIDLRQGQRLRVVEEFDGLALPELLGFGELRQQAFAAFADEVLRGLGAQALQVFDIAVEFGAQRLAFLLGRGRQETLARPASRDQADVGFLDVGQSAKFDLGDLIIHVVDAGQPPHPERADDAAQQGHQQERARQAHADARADMQSRKKPQHACLPVRHH

SEQ ID NO: 147752 - protein, 152 aa, Glycine max
  Coding DNA Sequence Number=SeqID_56067
MAGTFFLLKKQNSLEIMSSEKEITPNRVVNWPFRTLYHYFGDATITEATEALEAIFQKRGGACRPVASSLSNPTFKMFWKGLDSKCYLHSVATYPSVGGRRVTRGKRVPRKEYARSRHQRLFEENVGKTGKDAIYELFSERFGSCIYARGRY

SEQ ID NO: 147753 - protein, 39 aa, Glycine max
  Coding DNA Sequence Number=SeqID_56068
VFLPKLCAVAEGANARRQMGEIKSSELSDESAIAPFPQY

SEQ ID NO: 147754 - protein, 93 aa, Glycine max
  Coding DNA Sequence Number=SeqID_56069
MVVRAFVGTRREVRGEIDLPVQIGPHTCQLPFGTPVDPLGGSRSLYTPLKIEIRSRGAFGYRIGRGRHLDELPILYVICGSRRGVIRNNLPVF

SEQ ID NO: 147755 - protein, 121 aa, Glycine max
  Coding DNA Sequence Number=SeqID_56070
MQVSSPGRATPAPKYKSDERGDVFAFKNFFSPLFKSHTHGIYEFAPLGSLLFAFFDSILRLYSSPTSIRNTRMCTYAIFDSQSALSMHVCKFSKGNACDVGNGPEEACLKEVQEGQCGRRN

SEQ ID NO: 147756 - protein, 199 aa, Glycine max
  Coding DNA Sequence Number=SeqID_56071
  Gene Ontology: Mol. function=RNA-directed RNA polymerase activity; Cellular component=mitochondrion; Biological process=RNA-dependent DNA replication
  Homolog annotation: Hit_ID=P92543; Match level="QueryCoverage=49%, HitCoverage=39%, E-value=9e-18, Identity=51%"; Hit description =Uncharacterized mitochondrial protein AtMg01110
MRDSYPLCQSQVEEKRVYGIPSFGSPGRLAQSTDSGAGKRRIFAIGNYVNQRLLKPLHDWAPHRKGGRGDPVEYPFARGRPVVSFETGQPLGYLSSWPLFTLSHHLVLQSCAEKVYPGRYFDRYAILGDDICIADRKVASVYHQVVTDLGVDLSIPKSLVSDSGGAEFSKRFRCHNLSVDFLRWKACRRLLGKEREEGE

SEQ ID NO: 147757 - protein, 263 aa, Glycine max
  Coding DNA Sequence Number=SeqID_56072
  Gene Ontology: Mol. function=malate dehydrogenase (acceptor) activity; Cellular component=plasma membrane; Biological process =tricarboxylic acid cycle
  Homolog annotation: Hit_ID=A4WCM3; Match level="QueryCoverage=96%, HitCoverage=46%, E-value=1e-118, Identity=84%"; Hit description =Probable malate:quinone oxidoreductase
  Pfam annotation: Domain name=Mqo; Domain location=1-232; Score=201.5; E_value=2e-57; Accession=PF06039.6; Description=Malate:quinone oxidoreductase (Mqo)
MRASRWPVKFLVSDNPEVVNRHLAKVYGQASVGAPPMSVPHIDTRMLDGKRVVLFGPFATFSSKFLKNGSLWDLLSATTTSNVKPMMDVGLDNFDLVKYLISQVMLSDEERFEALKEYYPQAKKEDWRLWQAGQRVQIIKRDPKEGGVLRLGTEVVSDKDGTIAALLGASPGASTAAPIMLHLMEKVFKDKVSSPEWQAKLKTIIPSYGTKLNGNVDATEQELEYTSRVLQLQYVKPQAAADAAPKAELKAQPENKPVADIAL

SEQ ID NO: 147758 - protein, 73 aa, Glycine max
  Coding DNA Sequence Number=SeqID_56073
MLVATPRIFLPWKMHHRVPRRAPAGGQVATISKQKFCHIGNWKGGLVPSLEEFESRSKGATTLRAIGLRSTPN

SEQ ID NO: 147759 - protein, 96 aa, Glycine max
  Coding DNA Sequence Number=SeqID_56074
  Subcellular localization annotation: CTP_CleavageSite=69; ConfidenceScore=5.22e-01
MDHFKVQRLKRTTFQVLIPSSNVNTTSESGIFFMTGFLRFFRRFPQINVGGDSAHFPPLEDAPVSLALLARKRVGCDSHDQAFLAMVKGEESVTRC

SEQ ID NO: 147760 - protein, 115 aa, Glycine max
  Coding DNA Sequence Number=SeqID_56075
MGTNQTGKRFYQVKIKGLDITSIKELGRLMGPLQMQAFRKAYGKILDLTIAEISTEGIASLTQYYDQPLRCFTAIPRKYFMGSISEWIVPTATMMFFKGDDTSRNHQRDRYNYLG

SEQ ID NO: 147761 - protein, 342 aa, Glycine max
  Coding DNA Sequence Number=SeqID_56076
  Gene Ontology: Mol. function=nucleoside-triphosphatase activity; Cellular component=cytoplasm; Biological process=response to DNA damage stimulus
  Homolog annotation: Hit_ID=P24542; Match level="QueryCoverage=100%, HitCoverage=100%, E-value=1e-169, Identity=90%"; Hit description =Protein recA
  Pfam annotation: Domain name=Rad51; Domain location=16-272; Score= -100.1; E_value=0.00029; Accession=PF08423.2; Description=Rad51
  Pfam annotation: Domain name=RecA; Domain location=7-329; Score =848.5; E_value=3.4e-252; Accession=PF00154.12; Description=recA bacterial DNA recombination prot
  Pfam module annotation: Pfam domain module=Rad51::RecA; Domain location=16-272::7-329
MDDNKSKALAAALSQIEKQFGKGSIMRMGDADIGEDLQVVSTGSLGLDIALGVGGLPRGRIVEIYGPESSGKTTLTLSAIAEMQKLGGTAAFIDAEHALDPQYAAKLGVNVPDLLISQPDTGEQALEIADMLVRSGSVDIVVVDSVAALTPRAEIEGEMGDSHMGLQARLMSQALRKLTGNIKRTNTLVIFINQIRMKIGVMFGNPETTTGGNALKFYSSVRLDIRRTGAIKKGDEVIGSETKVKVIKNKVAPPFKQAEFDIMYGEGISRLGEVIELGTNLKLVEKSGAWYSYNGEKIGQGKENAKEFLRENPAIAAEIEAKIRENSNVLADGMAAARGEDD

SEQ ID NO: 147762 - protein, 47 aa, Glycine max
  Coding DNA Sequence Number=SeqID_56077
MSGQRKFFNHPLAKRALCAKRIIMHALSESPLALSVSTPTHWLKGPS

SEQ ID NO: 147763 - protein, 24 aa, Glycine max
  Coding DNA Sequence Number=SeqID_56078
MSDKRAETNSAPFVIQEQRVEWFR

SEQ ID NO: 147764 - protein, 44 aa, Glycine max
  Coding DNA Sequence Number=SeqID_56079
MKACGSCSLKPLSVAFCFHFWCYYSLQQVQHRRFKIGARMQFQA

SEQ ID NO: 147765 - protein, 98 aa, Glycine max
  Coding DNA Sequence Number=SeqID_56080
YPTVERTTRPHHQRVARPYLQRTTCPRLERATRPHLGGLHVLQHQRAARPHLQRTISPRLERAARPSPWVLVTLTVRGLHVPRLERTTRPHSEGCIAP

SEQ ID NO: 147766 - protein, 165 aa, Glycine max
  Coding DNA Sequence Number=SeqID_56081
  Homolog annotation: Hit_ID=Q6WAY6; Match level="QueryCoverage=81%, HitCoverage=21%, E-value=2e-14, Identity=38%"; Hit description =Putative uncharacterized protein
MCKESPVVAIFAYHYSKESPVVAILADLFDTFDRRCEKNSARIVCCLPALCVWLVSHLFQQDTRHPCPLQSYRSCTEKGRVVWGQHLAGIGGSAINWFPRWKEGKEGVLFSYGDYPNIPLIGTRGCINYNPVLAIRQLGYPMRGAPTEESLSPFLVRDLGAQGLK

SEQ ID NO: 147767 - protein, 50 aa, Glycine max
  Coding DNA Sequence Number=SeqID_56082
MSNKTQRQIMVPLAGRFTGRKTSKEGQLSYPNFVRGPLLGGMQLSFDHFE

SEQ ID NO: 147768 - protein, 150 aa, Glycine max
  Coding DNA Sequence Number=SeqID_56083
MASTFFLLKKQNSLEIMSGTPHVISQSEVYTADSIYEGRFFEDPNNEGLTIDFDRDISQMINEEEDVLSPELERLVAQEEREMKPHQEETELVNLGTPEERKRFLSCGAVPGVGGQHYPSPEKGRQGSNVCRLPGLEPGQSKRQFSPATH

SEQ ID NO: 147769 - protein, 122 aa, Glycine max
  Coding DNA Sequence Number=SeqID_56084
MEGDSIIHTVAYADDVVRVSVETVIDPEAEHPQRIPHNEDAHVPKPANMDADDPLRGLIKYSFDIYDKPLEISFDGSFLGIVDASTSIFITYSDDRRSECEQYLEIWLKESDREVYIGPYFH

SEQ ID NO: 147770 - protein, 158 aa, Glycine max
  Coding DNA Sequence Number=SeqID_56085
WIPFDADAIGQLLGYPLVLDEGQECEYGQRRNRSDGFDEEAIAQLLCIPGQDFARTAAGRRTARRDRSRAANHQAHVQTHDCLYQMSLSLQSQGFTSFLCPTTDQFRAEVAWPGDWPDAQVGEAPAGAPAEAPDEAEEAREDEEMTDLLDFLGGSGAA

SEQ ID NO: 147771 - protein, 77 aa, Glycine max
  Coding DNA Sequence Number=SeqID_56086
MARAGDNGGVYHQLDGSQRLFLDAMSTQMQRLLNCNKEELYRRIAKSSLFTLKPLSLREVCDNQIRMREKREQEKEN

SEQ ID NO: 147772 - protein, 350 aa, Glycine max
  Coding DNA Sequence Number=SeqID_56087
  Gene Ontology: Mol. function=chitin binding; Cellular component =extracellular region; Biological process=chitin metabolic process
  Homolog annotation: Hit_ID=UPI00006A17C9; Match level="QueryCoverage =89%, HitCoverage=100%, E-value=6e-44, Identity=31%"; Hit description= UPI00006A17C9 related cluster
MLLSSNIIHICVRVVMLVRMIRTRLFAAARVKSWPGMHSSCVIASLSGCARTVGHPPISGGGPGTDKGNYWPLNRERKSRACNPLKLRTCHPLKARACSPLKVRTCSPLKVRACSPLMERMCSPLKMRTCSPLKVRTCSPRKMRMCSPLKVRVYSPLMARTCSPLKARTCSPLNVRTCSPLKVRTCSHLKVRACSPLMARTCSPLKERTCSPLKVRACSPLMTRTCSPLKARTCSPLKVRACRPMKARTCSPPKVRACSPTKARTCSPLRARACSPQKERTCGSLKVRTCSPLKARTCGPLKMRACSHTMVRTCSPLMARACSPLKVRMCIPLKARTCSPLKMRPCSPLK

SEQ ID NO: 147773 - protein, 77 aa, Glycine max
  Coding DNA Sequence Number=SeqID_56088
MCSATDYKIKSIGGMCILIQMWAWKRCTTLAPKRTPLVLENKPLGHRCLRRGNQHIDNDDLIVFRRKLDIMKRHEFL

SEQ ID NO: 147774 - protein, 114 aa, Glycine max
  Coding DNA Sequence Number=SeqID_56089
MTEKKMMTMIVDTIPVFYYEKMVSYTRSSFDDMVFTDERIDVGLKKGKFSHPAWMNEKTGANEEGEDEGEARAVTPIPIQPNFPPTQQCHYSANNKPSPYPPPSYPQRPSLNRQ

SEQ ID NO: 147775 - protein, 201 aa, Glycine max
  Coding DNA Sequence Number=SeqID_56090
MTLLLSKILPSNHNSDLPLPKCMPPTRHPLDPDKSNRALGFLALITGLCQSFGVPVTPSKVIRLPITQVFIEKYYTPRQAQGGDPQAPDAPPPPHQADLVGSFDTERYLRHLVHRQAANHRAHVQTHDCLYQLSLSLQSQGFVPFPCPTLDQFRAEVAWPGDWPEAQAGEAPAEAPGDADEAHVDEEMTNLLNFLEGSGAT

SEQ ID NO: 147776 - protein, 35 aa, Glycine max
  Coding DNA Sequence Number=SeqID_56091
NFKFNLLGTSLSLEIAEENYFHEENPSRGASVTFP

SEQ ID NO: 147777 - protein, 216 aa, Glycine max
  Coding DNA Sequence Number=SeqID_56092
  Homolog annotation: Hit_ID=Q6WAY6; Match level="QueryCoverage=90%, HitCoverage=31%, E-value=1e-16, Identity=31%"; Hit description =Putative uncharacterized protein
NRVVGIPRKHLEEKAKALADQGEWALFIDVLALLVFGAVVFPTVDGLVDLATIDTFHTYHHSKESLVMAVLANAYDTFNRRCEKSGARIVCCTPTLYVWMVSHLFHHESRPVYPLQGHHICPEKGKANWEHLLANMVEASVNWFPRWKEGRVGVLSSCEGFSNIPLMGMRGCINYNLILAIRQLGYPMRRASSEESITPFIARGFSDPNARIFQRV

SEQ ID NO: 147778 - protein, 71 aa, Glycine max
  Coding DNA Sequence Number=SeqID_56093
MVGAFSQNIVTLTGLPMILLSESDLTNPLFGVSYYVLLSVPGWFFTDMMTRWIALRNHMLKDVGTQRSDRM

SEQ ID NO: 147779 - protein, 53 aa, Glycine max
  Coding DNA Sequence Number=SeqID_56094
ELEKGGIGAHQLKKFEVKEATGQPPLKSYWTKKHSKLSETPKREQPPKLRTFL

SEQ ID NO: 147780 - protein, 94 aa, Glycine max
  Coding DNA Sequence Number=SeqID_56095
  Homolog annotation: Hit_ID=A5APQ3; Match level="QueryCoverage=90%, HitCoverage=5%, E-value=3e-08, Identity=34%"; Hit description =Putative uncharacterized protein
MRQFGMQQPIPRLVMQPNNIHDLTLKGKEGKNWMRLMQLALNEWNSRYERRVEQAPPQTGTLSMNSEYMRWYRRKTKGEIVETMHFMVSPLGRR

SEQ ID NO: 147781 - protein, 111 aa, Glycine max
  Coding DNA Sequence Number=SeqID_56096
NARLDRHRVATRRPQMHRRHPLRLIQLANHRAHVQTHDSLYQLSLSLQSQGFTSFPCPTPNQFRAEVAWSGDWPEAQAAEAPAEAPNKADDAHEDEEMTDFLDFLGGSGAT

SEQ ID NO: 147782 - protein, 124 aa, Glycine max
  Coding DNA Sequence Number=SeqID_56097
MAKYRLKAQVEKDEGSSGEGQSPRVEKDEGPEAKTLSRLLITYQGNPGGVYPDLSSFTGSGVYLDLSSFIGSGVYPDLSSFTGSGVYPNLSSFTGSGVIQTFVACIKRSAPTQVHIIWYQSFSS

SEQ ID NO: 147783 - protein, 33 aa, Glycine max
  Coding DNA Sequence Number=SeqID_56098
MENWRTALGDQFAGLQTQGSRLEGGGHMNSARQ

SEQ ID NO: 147784 - protein, 157 aa, Glycine max
  Coding DNA Sequence Number=SeqID_56099
MTKKSAETSRADVRPKKPTGGEDPRRETRREEAGNSQAQMPKKKKKVKQVEPEPSVTVEGGEPARKKKKKTKSSKEQGDNQPVDVQPPSTDVDGTEAEATPSIAEKGNPVEQPDLPQEQPTVEVQQNVSVEEIPSCARTSPAPETDAVNAEEQGEGQ

SEQ ID NO: 147785 - protein, 761 aa, Glycine max
  Coding DNA Sequence Number=SeqID_56100
  Gene Ontology: Mol. function=homoserine dehydrogenase activity; Cellular component=chloroplast; Biological process=aspartate family amino acid biosynthetic process
  Homolog annotation: Hit_ID=P00561; Match level="QueryCoverage=100%, HitCoverage=94%, E-value=0.0, Identity=87%"; Hit description =Bifunctional aspartokinase/homoserine dehydrogenase 1 (Aspartokinase I/homoserine ...
  Homolog annotation: Hit description=dehydrogenase I) (AKI-HDI) [Includes: Aspartokinase (EC 2.7.2.4); Homoserine dehydrogenase (EC 1.1.1.3)]
  Pfam annotation: Domain name=AA_kinase; Domain location=4-235; Score =133.7; E_value=5.1e-37; Accession=PF00696.19; Description=Amino acid kinase family
  Pfam annotation: Domain name=ACT; Domain location=270-330; Score =26.8; E_value=7.8e-05; Accession=PF01842.16; Description=ACT domain
  Pfam annotation: Domain name=ACT; Domain location=351-411; Score =31.9; E_value=2.3e-06; Accession=PF01842.16; Description=ACT domain
  Pfam annotation: Domain name=Homoserine_dh; Domain location=555-752; Score=345.4; E_value=9.9e-101; Accession=PF00742.10; Description =Homoserine dehydrogenase
  Pfam annotation: Domain name=NAD_binding_3; Domain location=423-547; Score=114.7; E_value=2.8e-31; Accession=PF03447.7; Description =Homoserine dehydrogenase, NAD binding domain
  Pfam module annotation: Pfam domain module=AA_kinase::ACT::ACT::Homose rine_dh::NAD_binding_3; Domain location=4-235::270-330::351-411::555 -752::423-547
MIEKTIGGQDALPNISDAERIFAELLQGLAEAQPGFPLAQLKSFVEQEFAQIKHVLHGISLLGQCPDSINAALICRGEKLSIAIMAGLLEARGHNVTVIDPVEKLLAVGHYLESTVDIAESTRRIAASKIPSDHMILMAGFTAGNEKGELVVLGRNGSDYSAAVLAACLRADCCEIWTDVDGVYTCDPRQVPDARLLKSMSYQEAMELSYFGAKVLHPRTISPIAQFQIPCLIKNTGNPQAPGTLIGASTDEDGLPVKGISNLNNMAMFSVSGPGMKGMVGMAARVFAAMSRNGISVVLITQSSSEYSISFCVPQADCLRARRALEEEFYLELKEELLEPLAIQERLAIISVVGDGMRTLRGISAKFFAALARANINIVAIAQGSSERSISVVVDNDDATTGVRVVHQMLFNTDQVIELFLIGVGGVGGALLEQVKRQQAWLKKKHIDLRVCGIANSKALLTNVHGLNLENWQAEMKEAKEPFNLGRLIRLVKEYHLLNPVIVDCTSNQAVADQYADFLREGQHLVDGLLPPVRLAASKSRRKFLYDTNVGAGLPVIENLQNLLNAGDELQRFSGILSGSLSFIFGKLDEGMSLSEATRAARELGYTEPDPRDDLSGMDVARKLLILARETGRDLELSDIVIEPVLPAEFDSSGDVGAFMARLSQLDDVFAARVAKARDEGKVLRYVGNIEEDGVCRVKIAEVDGNDPLYKVKNGENALAFYSHYYQPLPLVLRGYGAGNDVTAAGVFADLLRTLSWKLGV

SEQ ID NO: 147786 - protein, 72 aa, Glycine max
  Coding DNA Sequence Number=SeqID_56101
MQALICTKNWLLRFDMQGKEDEDVEMEKTQATSNIESFFVGDVSYSKASTKEPSAKISKAKYKDEIVNCPEN

SEQ ID NO: 147787 - protein, 234 aa, Glycine max
  Coding DNA Sequence Number=SeqID_56102
ERGFDENAIEVQLQGRSSVTKGKQGRVKETEGVLNGAVYSHCHGFFSVQKIIRLSMKKHPTGMLFKLLEILCNFNPSKLTLSNRSKISIRSPESRDKKIHSCKTNPKRNTNKIHRESKDSQNPNSRSVPCMPIKADLKWPKEAWILGQDVSSGFTPSIRKKPRFFVQQEEAQAWSKLNLLQDHQPLGAKKGQSLRVALLSLLKYRLHSSTSLRHASESSSGKKGETPSDNTFIG

SEQ ID NO: 147788 - protein, 63 aa, Glycine max
  Coding DNA Sequence Number=SeqID_56103
MLMHNPTQAHLGPPEDSSRRRLLLEEAPCSPGRAELAWASWAATPPLFAINRGGNDEGRGPAP

SEQ ID NO: 147789 - protein, 160 aa, Glycine max
  Coding DNA Sequence Number=SeqID_56104
MVASDIAILRDKAHFPTKKSLLELTSQDTLLAQNKLLSKQLEALTETLRCAICGGAHNSGCCILNEEPAHEVNYMGNQPRQNFNADQGGPSTRPQQQGPSLYDRTTKLEETLAQFMQQLAYKPSSSFIANTEKNPKEECKVVMTRSRMAIQADEGRAKGK

SEQ ID NO: 147790 - protein, 44 aa, Glycine max
  Coding DNA Sequence Number=SeqID_56105
MSKGNDKGNNEDPPEEVKSNNELPREWKASRDHPLEHYGDISKG

SEQ ID NO: 147791 - protein, 161 aa, Glycine max
  Coding DNA Sequence Number=SeqID_56106
MERSMIDAASGGALGDMTPAEARNLIEKMASDSQQFSAINEAIVIRGVHEVATNSSASSETKKLEVKLDALVNLPEAYAANIYNRPPQPQQQNQPQQNNYDLSSNRPYVPPPIQQQQQKQQPQQPQKQQTVEAPPQPSLKELMRQMTMQNMQFQQEIGASI

SEQ ID NO: 147792 - protein, 102 aa, Glycine max
  Coding DNA Sequence Number=SeqID_56107
ALWGSNSELKLRREERDQSRVDSLILKDELKARGRVINSLHQEATMWMDRFALTLNGSQELPRLLAKAKAMADTYFALEEIHGLLSYCQHMINLMTHIIRNL

SEQ ID NO: 147793 - protein, 97 aa, Glycine max
  Coding DNA Sequence Number=SeqID_56108
VVVIIKKGENVNHEDFDDIKKNLLEKEGDKNLTRLLQMISICFKNNSRLLQQTKPCSRSLKTKPCLKTMCFQDMQGSGNRLPGSVIDYQKTGLRNSC

SEQ ID NO: 147794 - protein, 239 aa, Glycine max
  Coding DNA Sequence Number=SeqID_56109
GLVPLPSSIAIASGALSTSSVLKPSWDGPSTERDASAQDDEYTDFQEEIARQRGRCWSLPWPVDPDIVLEFYANAWPTEEGVRDMRSWECEYIQRRNRADGFDEEAIAQQLCIPGQDFARTAAGRRVQIMHTNMTTLTQTWMTLLLSNILPSDHNFDRPLPKCQLVYAILTRMSVHVAQLIADAIYLFAGMPPTRHPLDLDKSNKALGFPALITGLCQSFGVPVTPSNGDSTADHPTFQ

SEQ ID NO: 147795 - protein, 128 aa, Glycine max
  Coding DNA Sequence Number=SeqID_56110
ALIAPAQIHLLRKGLSIVVKKGRGNKIAIMQIGDDFYPYLKDSFTHSEVLQSGIAVNADIIAAHQTSAWSGSKPIYRITFKFKTREQVEVQASLNHTLNFSDIERFKPGDNMEIVSTIVLTMAWAIPL

SEQ ID NO: 147796 - protein, 79 aa, Glycine max
  Coding DNA Sequence Number=SeqID_56111
  Subcellular localization annotation: CTP_CleavageSite=4; ConfidenceScore=5.03e-01
MSVQCNQASRRPSMTTDSPPLLMFPWTPSPVESPTVAIYPSAGGRHETHGMRLPRKEYVQSRHQSLNVGKTGKDVVYEL

SEQ ID NO: 147797 - protein, 98 aa, Glycine max
  Coding DNA Sequence Number=SeqID_56112
MMPHRKSKRPIPLSFWISGKRPETYGDTQENQQGRLGRILTGKPRKWKSNADANSDDHNFQLGCPIDFYDILRPSLLANACRSTLEDTNPQHFLQISV

SEQ ID NO: 147798 - protein, 153 aa, Glycine max
  Coding DNA Sequence Number=SeqID_56113
  Homolog annotation: Hit_ID=Q84VI1; Match level="QueryCoverage=32%, HitCoverage=7%, E-value=3e-18, Identity=90%"; Hit description =Envelope-like protein
  Pfam annotation: Domain name=Toxin_27; Domain location=84-116; Score =24.3; E_value=0.00044; Accession=PF08099.2; Description=Scorpion calcine family
FSPAVINKYLDRPTNGVMDIAVSEHQIAKGITAKRVQHWPKKGKLSAGKLRGAAAADDDSDWELLEDAAVRAWRQGEQIADVTGDVLTSWRRLVADRRCCSKHGDRLGAEAESRCHVRCLDILETTCNLSRLQIPLCLITLIMEVADPTCITA

SEQ ID NO: 147799 - protein, 50 aa, Glycine max
  Coding DNA Sequence Number=SeqID_56114
STLEDPTLRDCESLVVKHLNTRDGLSLCGSDFVKDFTKIVEISSGLLEYW

SEQ ID NO: 147800 - protein, 259 aa, Glycine max
  Coding DNA Sequence Number=SeqID_56115
  Homolog annotation: Hit_ID=UPI00016621D1; Match level="QueryCoverage =46%, HitCoverage=37%, E-value=3e-08, Identity=35%"; Hit description =UPI00016621D1 related cluster
LHVLTSRGLHVLVFRGLHVLAIRGLHVLAFRGLHVLAFRGLHILAFRGLHALTFRGLHVLTFRGLHVLTFKGLHVLTIRGLQALAFRGLEVLAFRGLHAFAFRVLHVLAFEGYASSLSEGQLCEHNQRKAIAQLLCITGQGFTRAIAKRRVDCARKTPSGPGEAQQGPGVSSSGYGPLLVLQGASSPQQGIAPARHLVNPKKSKRVLRFPALITGLCQFYGVPIIPSKVIRPPTNRAFIKKYCTPRQAEGETPQQHWDG

SEQ ID NO: 147801 - protein, 106 aa, Glycine max
  Coding DNA Sequence Number=SeqID_56116
MASNSQQFSARNDAIVIRGVHEVATNSSTSSETKKLEGKLDALVNLVTQLTMNQKSALVTRLCGLCSSADHHTDLCPSVQQSEAIEQPEAYAANIYNRPLQPQQQN

SEQ ID NO: 147802 - protein, 84 aa, Glycine max
  Coding DNA Sequence Number=SeqID_56117
  Subcellular localization annotation: CTP_CleavageSite=61; ConfidenceScore=5.05e-01
MAMLHCFSRFSEQNPSRPTLDGVQFPSLGQGKKESLVARFSEVEMKSAVWTMSPLFSQLVVCFLYGTIQLFMWKGELKAIAFYF

SEQ ID NO: 147803 - protein, 208 aa, Glycine max
  Coding DNA Sequence Number=SeqID_56118
MASKKRKFIASSSSHIKFDKSRFHSQEACDRYNDIVVPRKLLLERNVVVYYTEFDELKEELERRKWDKELTSFTEGSIDVAIVKEFYVNLYDSEDKSPKQELAAKLYIPGRGFELNADGQPLKILRKNMITLAQTWSVLSISNLVPTSHTSNVTLNRAKLIYGIIMKMDMNLGYLIFHQISIIAQHDSSRLGFPALIIALCKARGVTS

SEQ ID NO: 147804 - protein, 150 aa, Glycine max
  Coding DNA Sequence Number=SeqID_56119
  Subcellular localization annotation: CTP_CleavageSite=35; ConfidenceScore=5.11e-01
MSPPPLEPHNHSQTHLMLSGRLPLQARFFAGGFVRACALSATLNHLACISEFQLSAHLLTQQMDSSGALSGMNPHSANMHSSSFFQVLPCTQPRSVTLSGWLAKPADWLSERMKSNTSQTCLINLKLRGIDIKTHKMEVLSIYYLSLTKK

SEQ ID NO: 147805 - protein, 28 aa, Glycine max
  Coding DNA Sequence Number=SeqID_56120
MSKMLQEDWARAAEEGSRVLMNLRGSIM

SEQ ID NO: 147806 - protein, 246 aa, Glycine max
  Coding DNA Sequence Number=SeqID_56121
MNTFIGWPTNLVKPFSADSNQDVRNPKGHIDRSNAGVAKDPLGEIMKILYEVYMNPVELPWEASRFGIPNIDAKFYITHADMAEIISGHKCLKISILQLWMMYLDECATSRGDGSVYGFLEPQSIHIGKEDCQQCQLYIETWVKESQRCLYLGAYLHHAMKTISSSLEGMSQQGPPRWIEPKSHVQSGGYECGYYVMHWMWCIVSGRLKDDWNRWFSDGSALDVEAMTIIRKNWTTYFLATRNNIC

SEQ ID NO: 147807 - protein, 514 aa, Glycine max
  Coding DNA Sequence Number=SeqID_56122
  Gene Ontology: Mol. function=ATPase activity, coupled to transmembrane movement of substances; Cellular component=integral to membrane; Biological process=transport
  Homolog annotation: Hit_ID=A7Q947; Match level="QueryCoverage=92%, HitCoverage=51%, E-value=1e-155, Identity=53%"; Hit description =Chromosome chr19 scaffold_66, whole genome shotgun sequence
  Pfam annotation: Domain name=ABC_tran; Domain location=174-303; Score= 23.4; E_value=9e-09; Accession=PF00005.18; Description=ABC transporter
MEFKDKRMKATSEILNSMRILKLQAWEMKFLSKIIQLRKTEETWLKKFLVGTAIVRFLFYNTPTFIAVVTFGECALIGIPLESGKVLSALATFRILQMPIYSLPDTISMIAQTKVSLERIASFLRLDEWKTDVVEKLPRDSSDKAIELVDGNFSWDLSSPNPTLKNVNLTVFHGMRVVICGTKAYVSQSPWIQSGKIEDNILFGKEMDREKYDEVLEACSLTKDLEVLPFGDQTTIGEKGINLSGGQKQRVQRARALYQDSDIYLFDDPFSALDAHTRSHLFKVMREGRITQSGKYNDILRSGTDFMELVGAHKAALSSIKSLERRPTFKTSTTTKEDTSSVSCFELDKNVKYITTAYGGALVPFILLSTILTVAFQIASNYWMILATLMSTTAEPDIGSFKLMVVYVALAIGSSIFTFARAFLAVIAGYKTATASTDQNALDMNISNLVWAIVFNLVQILGNIVAMSQAAWQTSLRQGLVMMGHKLLFQHLVKTGDAGEGQRGRWVKSRKGWL

SEQ ID NO: 147808 - protein, 145 aa, Glycine max
  Coding DNA Sequence Number=SeqID_56123
  Homolog annotation: Hit_ID=A5BSR3; Match level="QueryCoverage=44%, HitCoverage=20%, E-value=1e-10, Identity=47%"; Hit description =Putative uncharacterized protein
MKIFKGYTKNLHRPEASIVERCAKKGTGHPETKHCPSRAISWGYEYLEKKLMDEKRKKKLDEVAQSGSIDTIIDPPSPIKRHVKWKLARTKKTGHMTSEAAKEIADKIDSFEEQASQGSFVAHGCHDVLTAAIGRPEHPGRVRAI

SEQ ID NO: 147809 - protein, 96 aa, Glycine max
  Coding DNA Sequence Number=SeqID_56124
  Subcellular localization annotation: CTP_CleavageSite=21; ConfidenceScore=5.06e-01
GVTNLPCYTYASTSLSHVHCSCARLVVFLVLFVLGLRLLFVAAVEETREATGQKERGKEGGRRETKSGKRKRGSTILMTHTLRRSEMNNPGFRLNL

SEQ ID NO: 147810 - protein, 158 aa, Glycine max
  Coding DNA Sequence Number=SeqID_56125
MATVVATTLIASAITTVINHHHLCHRDLRCHHCHHHYHHLPPLPLSITPRPTTKTVIVGGGGDNNDDNHDGGGADSRGDDDGLIINNGDLIGCDLFGESFRDIIVIFGSVWGSCKFLLPLSPPPPLPLPPPPVNHAGFDDAKVLPKDVCHHKKWGKCE

SEQ ID NO: 147811 - protein, 108 aa, Glycine max
  Coding DNA Sequence Number=SeqID_56126
  Subcellular localization annotation: CTP_CleavageSite=69; ConfidenceScore=5.21e-01
MDANTLETQESLKISEKKKKKEKNPSRGASVTLSRRFRERFRGSSSLFSVVLHSFFVVLRSSTMKLRLKSTHKPSFVCKSHLTWTVLRSNALKRSSLLLSVNMDRSKA

SEQ ID NO: 147812 - protein, 367 aa, Glycine max
  Coding DNA Sequence Number=SeqID_56127
  Gene Ontology: Mol. function=nucleic acid binding; Cellular component= ribosome
  Homolog annotation: Hit_ID=A2Q6B4; Match level="QueryCoverage=55%, HitCoverage=86%, E-value=6e-31, Identity=34%"; Hit description =Ribosomal protein L33; Nucleic acid-binding, OB-fold
  Pfam annotation: Domain name=DUF223; Domain location=70-165; Score= -15.4; E_value=0.082; Accession=PF02721.5; Description=Domain of unknown function DUF223
MHVCFVTDSLTLFVSGGDDKVIHEEAYSKIMARIPDKIKNINGSKETLKLVVRITDLWFVGTPDKSEQAEMVIVDSDGDEIHVVCKQDQLKSWKMDLKENCTYVMHNFKVIKNDGQYRVCDHQYKLAFTRVIVVMQSDLDGLPFKNFKFAEFANVIVGRFQPSLLVDIIGVVYEVVFCHVSSRSTRVVFKLKDLSDQLLSCTLWEDYCFQFLEYLNELENDGPIIVLLTHARIKEAQGSYPPSVSNSLKASKLLINQPVVEIQEFKQRLFELGIEVWSVLTPRGQGSSQLSGSTQLSSKDAFFSKAEAKSIYEINNIFEEIVCVIVGTITRIVMENHSWCYPACIHCHKKIDIDTAPFTCACGKYNE

SEQ ID NO: 147813 - protein, 168 aa, Glycine max
  Coding DNA Sequence Number=SeqID_56128
MKAGRLSGSVGPKNQLISPASHLPFYIDVIETKWEHDDMLHMDHFSEFLCCCRILDVQELGFVSFTFSFHGTRLRCPIVASRCPCLRGLSKEEELGLSGSTWMDQSLEQGVRDFKKSLVPSIGIKADGSTWCPAPTSKMMMVEIPCIESLPRGRSRQHVPWVERRCNI

SEQ ID NO: 147814 - protein, 47 aa, Glycine max
  Coding DNA Sequence Number=SeqID_56129
MTFFSLRSQPLTDSLVHRIIYIGHIYGNHFFQVYLKDRCPLPPVALL

SEQ ID NO: 147815 - protein, 375 aa, Glycine max
  Coding DNA Sequence Number=SeqID_56130
HDKGGGDNHDDAIVKSNNESVGGINHEDLVTNSNDRILKTDPNIYGPWFLVKKSMGKGGVKGKVNGGNARNSTNDHVMHDEAGGPKDMKWVVPELSNKNDTKGNKNQNGASTLGPKQGVDEAKKDSSLNNLDMIHALHNTKSGFMFSAKFINNNSGKSMFILDEETMRLIQVKTKILLKRGSSSLPPDGKGSEVVVIKEMSVSYAMETNVVSVANAMKIEVVVQNKTRATRPDKSRGLWCLRNPNLWRVKVLEEAAQILHLEESKRIGGTESLNHKGRRAFREVMDYCHMLDAAWLTQPELRMVVDGNWKKDEEAGKGSLEGIGGSVISERCSLVLKIKMFPSLENKEIEMLRGDISDDEVRKTIFHMGVLQGFG

SEQ ID NO: 147816 - protein, 76 aa, Glycine max
  Coding DNA Sequence Number=SeqID_56131
MAQIFGIELKLFGTSLWLSNWIPELGPLVEFATRELNGKDLTKTITELVVHEGGSNSDYLGSSLMRTLKLKDPHKN

SEQ ID NO: 147817 - protein, 93 aa, Glycine max
  Coding DNA Sequence Number=SeqID_56132
MRIWYQKLLLIELINSELIRLIQCGEKELPRPLNQSKEYIPNNLERCNAPLVHSLAAKLSRLIRSPYHIFWSSICDKNIPSFDYSGSHKRLAR

SEQ ID NO: 147818 - protein, 110 aa, Glycine max
  Coding DNA Sequence Number=SeqID_56133
  Homolog annotation: Hit_ID=A5ATA8; Match level="QueryCoverage=82%, HitCoverage=4%, E-value=2e-17, Identity=47%"; Hit description =Putative uncharacterized protein
MEALQKLLQQSMVIAEKGGTTVVAQRGNFLHALNISKERTKSWIIDLGASDHMTGDFTLFSSYSPCPYNYTVRIADETHSKGKMIGNAEECVVLSFKLKNQKKNSRTILM

SEQ ID NO: 147819 - protein, 74 aa, Glycine max
  Coding DNA Sequence Number=SeqID_56134
MDRRCAILYNMEEEAGHMFFHCSKVIPIWWETLSWVKKSTALPYDPRHHFLHHGSILNEGTRANRWKCWWLAVT

SEQ ID NO: 147820 - protein, 51 aa, Glycine max
  Coding DNA Sequence Number=SeqID_56135
MDEWEDGSGKMEVVEAVRRGQSEWRHDECLMSDKGLLHPDTPLSHAIDYYD

SEQ ID NO: 147821 - protein, 145 aa, Glycine max
  Coding DNA Sequence Number=SeqID_56136
MCFVDGETDKAADGGGGSIVGGCHYGFSGRNSLEGEGEGDYCETMIASAREREIMIHGRVEGVRLQAVIMWGCEVGLCGGAVATLARWSARKGRESEHSAKEVGDTRESPLALVRQPVTWRAAGFCYHGWRNRCLAHFAIPMSET

SEQ ID NO: 147822 - protein, 73 aa, Glycine max
  Coding DNA Sequence Number=SeqID_56137
  Homolog annotation: Hit_ID=A7PNL1; Match level="QueryCoverage=42%, HitCoverage=9%, E-value=4e-08, Identity=87%"; Hit description =Chromosome chr8 scaffold_23, whole genome shotgun sequence
MTWSKDDPVGAPFARKFTKDDPVLNKIDKELLRRSDGHFTPGGSVKVKVPVFSVAVVVGSIRGTADCTDQVDP

SEQ ID NO: 147823 - protein, 48 aa, Glycine max
  Coding DNA Sequence Number=SeqID_56138
  Subcellular localization annotation: CTP_CleavageSite=40; ConfidenceScore=5.02e-01
MSAWRLPQKESPSTSSIVAHVLPRAKFALPSTAFPLSVIVSLRVWQSG

SEQ ID NO: 147824 - protein, 118 aa, Glycine max
  Coding DNA Sequence Number=SeqID_56139
MLYLECDPIPKAVENEDDLDDVPVASHEEDVGGGERERDADAVEQRRVGEQRDADAGEQRDGGGSEEEKEIDSDEWFTDFSCMRNEVEVEVETDGYHSEELKIPISSDDEDEDVEVYP

SEQ ID NO: 147825 - protein, 129 aa, Glycine max
  Coding DNA Sequence Number=SeqID_56140
MASKDSSWRSSGVSGGGGGAWGHWGGCYYHHPHKRMKSMQLAYVLWQDHKKMSVGLLMVQSGLCKIESSNLLRFMFHAGFDGCLLDPETKLKGRAKWLFCNDFRQPFTQGSNQLAWANQVSSGLSNQLT

SEQ ID NO: 147826 - protein, 213 aa, Glycine max
  Coding DNA Sequence Number=SeqID_56141
MSSRKRNSVGSRPTAQYDTWRFHSFDAWTRYTDNVLRRHILAERKVEIYHTKLDEFKGKLKRRNFHKPLTNLADSSIDLALVKEFYANLYSPEGPSPKQVRIRRHLIRIDADNLNAFLETPVVLAEGEFLPAYSRYCRMPTDNREIEAALCISSQGFILNAEGHPGKILRKDLTTLAQVWSVLSYSNLAPTSHTSDLTVDQASFMQDQRSCLR

SEQ ID NO: 147827 - protein, 477 aa, Glycine max
  Coding DNA Sequence Number=SeqID_56142
  Homolog annotation: Hit_ID=A2DMT3; Match level="QueryCoverage=83%, HitCoverage=76%, E-value=7e-07, Identity=23%"; Hit description =Dentin sialophosphoprotein, putative
  Subcellular localization annotation: CTP_CleavageSite=57; ConfidenceScore=5.15e-01
MASPMTCRDKYGHLLPLSKTRCLSTETTLVSLRHPKMASLMTRRNQYGHLLPLSKARCLSTETTLVSPFRNPETIKSDDTQSSPKTRNNQHGCLHPLSKTRHLSTETTLVFTFRHPETIKYNDKQQPTWSSSPFVEDVTSIDGDYFSLPSSSRDGKSDDAHRPICQSTHFVEDSMSINRDYISLPSSSKDGKYDDAHRPIWSSAPFIKDWMSIDQRQSSPMTRSDQHGHLHPLSKMRCLSIETTLVSPFCHPTTIMSDDTQQPTWSSAPCVEDVSSIDRDYFGLSFSSSIDNQARHLSIETTFCSTFHHPETIKSNDMQQPKWSSPPFVEDPTSIDRDYFSLPSSSRDGKSDDTKRPIWSSATFVEDSIDQHGRLHPLSKTRRLLTETTLVSTFRHPETIKFNGTQQPTWLSTPFVEDATSIDQDYFSLPSPYRDSKSDDMQQPTWSSAPFVEDSMSIDRDYFSLPSSSRDSKSDDA

SEQ ID NO: 147828 - protein, 213 aa, Glycine max
  Coding DNA Sequence Number=SeqID_56143
MREVVAAQLVQPSCNPFQGAVNFGLVLLMEVKNNIHLLNHKRLKRVPLVCMLLLSFFFHFLFHLVDVYCCWWLSYHNPFMINISHPKLLEMPFGYLIGGFGEINNLIRNIDIQVINESRGHADEGTHYLFTPNHKARLTGASSKGGKCAESPPTFICGKRWKNRRKLVMKNILDSGVVFTFEEGINTSHVDKRGVLAPTYPPSKRKSDLRSSF

SEQ ID NO: 147829 - protein, 217 aa, Glycine max
  Coding DNA Sequence Number=SeqID_56144
MEEVAKEAKFMREHTKKLEEAIINISTTSYSNLENTMEVINLLKDHVKELVVQTKQIANKVDCNVVTTRSGLTTKEPIRKDMKVDDREKEDIQDEDVIVEEIAREPIKTKSQLIQEAKQAIIREKLYPHKPTKQDKERFLMMPKYNKTRLLQEIFKVKQTEIASRLIQGQANKINCDQETVCLLASENLEHKGEGSQDVFKVCKGFTEIVENIKWDA

SEQ ID NO: 147830 - protein, 144 aa, Glycine max
  Coding DNA Sequence Number=SeqID_56145
  Homolog annotation: Hit_ID=A5BS28; Match level="QueryCoverage=77%, HitCoverage=28%, E-value=7e-09, Identity=33%"; Hit description =Putative uncharacterized protein
MDPKSTLRLMRTLRFGWKEIYDWVCIHDWKLPCQLEGHTSTHNGFVPTEAEYIALTKAVKEGIWLKGLINNLGFPQEKAIIFYKSLSAICLAKDHSIMRGLSTLISDTTSSVLRRGSRSKIWILGRIQLICSLSLFQEASSCTD

SEQ ID NO: 147831 - protein, 50 aa, Glycine max
  Coding DNA Sequence Number=SeqID_56146
MKNQEFRIPVTGLVYPLHLCGLRRSSLAGSHLLRCLGCKASTISHNRRSR

SEQ ID NO: 147832 - protein, 78 aa, Glycine max
  Coding DNA Sequence Number=SeqID_56147
MEEAKEKDFGRGCWMRMEGEGKAMDRSRKREKGRAHMGEREKEKGTDGKRGGQWGKRKRRGVRGRGKKEGWKILKFGA

SEQ ID NO: 147833 - protein, 107 aa, Glycine max
  Coding DNA Sequence Number=SeqID_56148
MEEFSLQVGWPGVQPSSHGGGDVATYPSAGGRHGAHGAHGAHGCIFHGRKMRGVATNVYSRKTSENPERYGLRTLSVKGSGVVFTHGEGCFPCSYVFLNCDKEIRPT

SEQ ID NO: 147834 - protein, 163 aa, Glycine max
  Coding DNA Sequence Number=SeqID_56149
MRPRRYRIVIVIDFYIVLRSVFFVRHPKCLFVLYTHGTYTFAHTVSYWALYPGLWRCKKWRLICGHAGSPTRLMTTKPHLEFFSLMYVCLCATNHMLSCMHTHTVSSLMHRISLVIFVTGSRKVRITFFIACIGHHGNVCERTMIPNALWVIRDGLSDSYVRR

SEQ ID NO: 147835 - protein, 112 aa, Glycine max
  Coding DNA Sequence Number=SeqID_56150
MLHSMLQSIHRGQSIIMQNLQGLGLPSIMSMEEFDAQVDWPRDQPCSSRGGGAFTAQEPVTEEPPAPAPSSAVAEEETTPTQTPQPSPPPAPALEEIQPSTLDLNEEQPHEE

SEQ ID NO: 147836 - protein, 127 aa, Glycine max
  Coding DNA Sequence Number=SeqID_56151
MNRLSAAGVLSAFITNPIKIHKGFHPFFNHIAPNGLLDYLKSVEASFMMMNQGTSFVVQVEGTSTWVVVTENKRGYISCGSVQVEGTSTWLFKENKGGYIPCGSLLVKDFTRLKRNLKNRWLLGDWM

SEQ ID NO: 147837 - protein, 169 aa, Glycine max
  Coding DNA Sequence Number=SeqID_56152
MVINQSLFYDLTQLSSEGVPFEGTLNNDWKFDFFVHDARWLVCTNQEDMTRRLLVGSLALESRILHYLIVRILLPRSSNFAQVSEEYLIVMWAFHTGQQIDWAHLVRYCMHKALRLNAPLPYPHPVTLFLLHFNIPLDFEPYVPIKRSFFIGVAVIASFGYRKEHDGSW

SEQ ID NO: 147838 - protein, 29 aa, Glycine max
  Coding DNA Sequence Number=SeqID_56153
MEDVSKQFSWKVGRGDQALFWEDSWVDGG

SEQ ID NO: 147839 - protein, 165 aa, Glycine max
  Coding DNA Sequence Number=SeqID_56154
  Homolog annotation: Hit_ID=A7PZL1; Match level="QueryCoverage=81%, HitCoverage=46%, E-value=2e-27, Identity=44%"; Hit description =Chromosome chr15 scaffold_40, whole genome shotgun sequence
MLDNLVGSLDLAKVKNSGKGKVLMQAMYGVKVETVFICRVFTVAFSGSSKKLSDLNVADIHSWALHFRRLQNLVNEEIRDGVDTVEIEWLLKTVEELRAGIEKLSQGNDLLAKGVDRFFEAVMTSRDTLLSSVIVPHAVAASSLILCHNLHFKDSFRGGLLTDTH

SEQ ID NO: 147840 - protein, 130 aa, Glycine max
  Coding DNA Sequence Number=SeqID_56155
MLKSILLQSLQVVAPPGSIPSVEQFTEMVAWPGTQPSLHREDEGPTAQVSQHVEDDSFEATIPEPFVIGEEAEETQVRQVAATTPERSLKATSEPSAQGEDIPYLSLLQRTRLHQSWLWTLLLQLLQYCI

SEQ ID NO: 147841 - protein, 119 aa, Glycine max
  Coding DNA Sequence Number=SeqID_56156
  Gene Ontology: Mol. function=nucleic acid binding; Biological process= DNA integration
  Homolog annotation: Hit_ID=A5AFZ5; Match level="QueryCoverage=99%, HitCoverage=15%, E-value=2e-28, Identity=40%"; Hit description =Putative uncharacterized protein
LKGENFKDWKENMQIVLGYMDLDLALKIEKPSSSTDSNDITSAKDFLAEIEKLFAKSDKAETSTLLQNLIYMRYQVLSSLPSQFSQFKISYNCQKEKWSLNELISFYVQEGGKAEAKKD

SEQ ID NO: 147842 - protein, 151 aa, Glycine max
  Coding DNA Sequence Number=SeqID_56157
MVVYLAEIMPAEVRASGFSLAYSLARAVWDGFTPGDFAKLSDSCYTIKRCLASGCRLPSFSAADWPREPFSAVSQTCASPQHSRSIGPFSRVREKAGDEGASQLLLCVLALTLTLSRTREREPFSAVSQTCASPQRPRGGLLLPSAGEGGG

SEQ ID NO: 147843 - protein, 77 aa, Glycine max
  Coding DNA Sequence Number=SeqID_56158
MRGIMHEPQVNIGADPKFSPVDVFKQGKRRGDQPWNFNRLIKRQTSLFPSLQNGQVTKSNRTYTLREFPERFAKDRI

SEQ ID NO: 147844 - protein, 117 aa, Glycine max
  Coding DNA Sequence Number=SeqID_56159
  Gene Ontology: Biological process=transposition, DNA-mediated
  Homolog annotation: Hit_ID=Q1J7G7; Match level="QueryCoverage=39%, HitCoverage=78%, E-value=1e-15, Identity=76%"; Hit description =Transposase
YDGVFEVLQWLLFLSAVPPVQLLTGWCVTAKAPPDISAGKCSGRVPFAIQAAQLLGRAIGAGLFAITPAGERGMCCKAIKLGNARVFPVTTLGLANPGYRALGTIGITEEAEARGSF

SEQ ID NO: 147845 - protein, 98 aa, Glycine max
  Coding DNA Sequence Number=SeqID_56160
  Subcellular localization annotation: CTP_CleavageSite=53; ConfidenceScore=5.39e-01
MVKVGTSYVPINFISAKCGPGYTRSTGTPGALSHSPCQAAQLLKNGQPGRSVRAFALLRQLALKGGCVHTGDYYVGTDNARVFQSECVRGREKRLHRE

SEQ ID NO: 147846 - protein, 123 aa, Glycine max
  Coding DNA Sequence Number=SeqID_56161
MVKVGTSYVPINVALLMQKYIYARFRYNRHQDLCLFAKYPSPRAARFPFGKPCQAAQLLMNRPTRGRSSAGLCVLPSGAKGGCAAYGDYYVGTEKKAARCSAEYVMTHYRANWSSTAVAAAQN

SEQ ID NO: 147847 - protein, 138 aa, Glycine max
  Coding DNA Sequence Number=SeqID_56162
MNFAAKKPIEFTPILVSYADLLPYLLDNSMVAITPAKVHQPPFFREYDLMATCACHEEAPGHSIEHCRALKRKDFQVYAININHSYNAKMDKSDIFVPHPLVITSLLPLECGCKPLVCLLERHALLSADFQDHSIRNY

SEQ ID NO: 147848 - protein, 117 aa, Glycine max
  Coding DNA Sequence Number=SeqID_56163
MGESRGDTGTDESRHVGSERTDGFHDGGHVRNEAAHGEKRGHCCRCQFGCRSRPNSLGYRAPSSLKHRYGRGKIGTRWGMTTLYPHLGYNRAAYPYGLPPNYSPPVLQDDAGHIASP

SEQ ID NO: 147849 - protein, 269 aa, Glycine max
  Coding DNA Sequence Number=SeqID_56164
  Homolog annotation: Hit_ID=UPI00006A2939; Match level="QueryCoverage =51%, HitCoverage=87%, E-value=3e-13, Identity=32%"; Hit description =UPI00006A2939 related cluster
LHVLTFRGLHALAIRGLHVLTFVGLHALTFRGLHALTFRGLHVLTFRGLHVLAIRGLHVLTFVGLHVLTFRGLHALAIRGLHVLTFVGLHALTLRGLHALAIRGLYVLTLRGLHVLALRGLHVLTIRGLHALTSRGLHVLALRGLPALALGTSYPHLQRTTRPHLQRATRPHHQRIGCPHLCRATRPHLQRATRPRHQRTACPHLRRATRPHLERATCPCHQRTTCPHLQRAARPHLERTTRPRHQRAARPHLQRTTHPRLERAARPHL

SEQ ID NO: 147850 - protein, 281 aa, Glycine max
  Coding DNA Sequence Number=SeqID_56165
  Gene Ontology: Biological process=transposition, DNA-mediated
  Homolog annotation: Hit_ID=Q6UUU1; Match level="QueryCoverage=21%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPEFDVTVTEESGGMRGHPTVTRKRSFAIWGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 147851 - protein, 95 aa, Glycine max
  Coding DNA Sequence Number=SeqID_56166
  Subcellular localization annotation: CTP_CleavageSite=33; ConfidenceScore=5.09e-01
RTTRPRLERTTRPHNQRAARPHLQRTTCPRLVKGLTPSPCRVLVTLTFRGLHVLAFRGLHVLTIRGLRPYLRGLHVLAFRRATRPHLQRTIAPSS

SEQ ID NO: 147852 - protein, 95 aa, Glycine max
  Coding DNA Sequence Number=SeqID_56167
MGEYAKDEELLIHSFQEKSYWGSCYLDATIEHLQKRGTDLSKNTPKRWRDLAAQVVPPMMERETMIVMVDTLSILYYEKMVGYAPSKLCGFGLRQ

SEQ ID NO: 147853 - protein, 263 aa, Glycine max
  Coding DNA Sequence Number=SeqID_56168
  Homolog annotation: Hit_ID=Q84VH5; Match level="QueryCoverage=98%, HitCoverage=48%, E-value=3e-37, Identity=51%"; Hit description =Envelope-like protein
MDKKIRSIVSNILKNASVPDAEKDVPTSSTPNAEVVSSPSKEESTEEEEQATEETPAPRAPEPAPGDLIDLEEVESDEEPIANKLAPGIAERLQSRKGKTSPLRDVPDIKRAKTSGKKVPGNVPDAPLDNISFHSIGNALKGGNSCINCRLALERELGRAALDCKEIMEKLSVVVIPSSAFPNSSQIFTKPFQKLCFSMATSPKETSAPGSPSVPSSPSSTKAPSIQEQPEFHIQPMQMIPGQAPVPEKLVPKRQQGVRFLKP

SEQ ID NO: 147854 - protein, 31 aa, Glycine max
  Coding DNA Sequence Number=SeqID_56169
MKNGKKERWLPPSSPKRAGLLPPEGTACRSI

SEQ ID NO: 147855 - protein, 81 aa, Glycine max
  Coding DNA Sequence Number=SeqID_56170
MTPSQQHDAPIPTPNAPLGTPWNVPRIILDIGDLLGADLRHQFSAEADQVEMGRHRGRRNPDRQAQRWDRPCDILTSSRIS

SEQ ID NO: 147856 - protein, 23 aa, Glycine max
  Coding DNA Sequence Number=SeqID_56171
MVIPKFKVPDFDKNLPESILGRT

SEQ ID NO: 147857 - protein, 88 aa, Glycine max
  Coding DNA Sequence Number=SeqID_56172
MWNRHRLKGALKPGVFTPKAYTPKSLLGPLPPNSALLSFKRLAKILLKHKHLDNEGKLELLHMMSNIMSRNQIGLHNAQGKIKCQMKN

SEQ ID NO: 147858 - protein, 131 aa, Glycine max
  Coding DNA Sequence Number=SeqID_56173
  Pfam annotation: Domain name=Transposase_23; Domain location=57-121; Score=-16.6; E_value=0.079; Accession=PF03017.5; Description =TNP1ENSPM transposase
MAPEELEQLTQQIKDQLEESITEKGLALPPKPEVGPSAACVSTKGSYVGPSPTDPETGDSDKCGLYIEENPFRLVALGRVYEGSTAVHNIPLLHGQVKVGVDEVKDAEAPIPVPTDEAVVSLEKPADGPDP

SEQ ID NO: 147859 - protein, 106 aa, Glycine max
  Coding DNA Sequence Number=SeqID_56174
MSRLIRDSPQISASPHQLDFTPYASGSYNAQWNAPGLLYDKHTLRSSRILGEMEVDEPWLGLRLPLNYQVDMGARMAFVDNWVVGKEKGCYWLSNDIVGLVGSLAM

SEQ ID NO: 147860 - protein, 135 aa, Glycine max
  Coding DNA Sequence Number=SeqID_56175
MTRGNPSDLQPFDPEIDMTFHRLVRHHLVPFEHPEHSVIGDFEHYSFEHSDFEHSKNMAQPPPRERTLREMAAPDFTYESLCIQYPDEDIPYVLKTGLIHLLPKFLASIEAPQASFPSSGNQSTRASSRCSLNLH

SEQ ID NO: 147861 - protein, 212 aa, Glycine max
  Coding DNA Sequence Number=SeqID_56176
  Gene Ontology: Mol. function=nucleoside-triphosphatase activity
  Homolog annotation: Hit_ID=A1FRY7; Match level="QueryCoverage=78%, HitCoverage=20%, E-value=7e-91, Identity=98%"; Hit description=Type IV secretion/conjugal transfer ATPase, VirB4 family
MAKRDEMIFRLLGLRLMFKLKVRNVQEHDGMSLETPWQYLFGSSRMFSPDTSISEFIPLSSHVAPNVVKTTGGDYLLTWHLEGLPFVGREEWELEHRHNTFNRLLQTLRAPDFVNVAFWVHDIRRRRTLKGKSNYKQRFNQDVSDQYMGMLSSQRIMQNELYLTMIYRPVVTGKRFVEKSANVDKLRAEQEQAIEKLMELAGNVEAVIRDYA

SEQ ID NO: 147862 - protein, 122 aa, Glycine max
  Coding DNA Sequence Number=SeqID_56177
MAIYRGMLLDLARNLRNKLGVGGLTAEVRMLVYIIMYILAPRSNNHARVTDDDLQIMYGLKSDIMLKSRRLVDFEFPYAVLTSRFIYYFNIDVSNKIVDFTKASNEITEWHLKKLGMAYVDH

SEQ ID NO: 147863 - protein, 191 aa, Glycine max
  Coding DNA Sequence Number=SeqID_56178
AGITNTFHRSIGVSLMMVMLRLAHVPIGGIRMGYIQTVPPPPFRDSLTGTDIDDRWVYFLDHVVPTGELCVVLGQVAPDYMEWFFQILHPFVTLTEDTAEPRPAPPPPPTHDDEFVEPPVPEVPVASDLPTHFVVDCTGCVRIAEHLERAINLRMVTKGTDLYDIMDICQRIARGNDPDDSLMPRQRHRIY

SEQ ID NO: 147864 - protein, 126 aa, Glycine max
  Coding DNA Sequence Number=SeqID_56179
MHDAIKEQARAKGHFRAVAARPGELKLSVEVMSSPRRVGFFTLKLFGGAGKPEASLARHSLANWLSARKNPKEEELSSSLSAPLQVIKRTASGHPLSERSALSQKSLTCNKRFIRVLSGSYFPLCI

SEQ ID NO: 147865 - protein, 142 aa, Glycine max
  Coding DNA Sequence Number=SeqID_56180
MSVLELYIEKDVAGGSMFHSANSLTSCENNLSNNEAEPPRNVSNLHGDEDDDDYLVSNSYVEESLDEDDSVDGISDTDNEVTDVIQPVYKEFKIHFGMMLCIITISIGVILMRRTFAVWRCHPVLMLGNNYMLAWILIVKMR

SEQ ID NO: 147866 - protein, 74 aa, Glycine max
  Coding DNA Sequence Number=SeqID_56181
MARKILEPVIIGSLWKAIAVPMLGFDCTIKMAEYDCRVRSLGRSQSNGTIDFDVKLLKVYAGDLRRISSQLDNV

SEQ ID NO: 147867 - protein, 177 aa, Glycine max
  Coding DNA Sequence Number=SeqID_56182
GEPLGTSTLVSRGLYILALRGLHVLTIRGLHTLTSRGLHVLALRGLHALTLGTSYPHRQRTTRPRLERTTHPHHQRAARPHLQRTTCPRLERATRPHLGGLHVLALRGLHVLTTRGLHALTSRGLYVLALRGLHALTLGTSYLQLQRTTRPRRQRVMCLHLCRATRPHLQRTTRPHL

SEQ ID NO: 147868 - protein, 78 aa, Glycine max
  Coding DNA Sequence Number=SeqID_56183
MRFTTSLSNACYVARVMNEIEEVQEQMKPNMEAMKEQMTTMMEAMMSMRKMIEVNMTTVVFASTATEVDPIHPSGLNQ

SEQ ID NO: 147869 - protein, 601 aa, Glycine max
  Coding DNA Sequence Number=SeqID_56184
  Gene Ontology: Mol. function=motor activity; Cellular component=cell projection
  Homolog annotation: Hit_ID=P15305; Match level="QueryCoverage=97%, HitCoverage=91%, E-value=2e-20, Identity=18%"; Hit description =Dynein heavy chain
GGPLGTSTLTFRRLHVLAFRGLHALTFRGLHVLAFRGLHVLAIEGLQALTFRGLHVLAFIGLHALAFRGLHVLTIRGLYALALRGLHSLTFRGLHVLALRGLHAFTFRGLHTLTFRGLHVLAFKGLHALTFRGLHVLTIRGLYALAFRGLHAFTFRGLHVLTIRGLYALSFRGLRALAFRGLHVLALSGLHAFALGTSTLTFRGLHDLAFRGLHPLTFRGLHTLTFRGLHAFTFRGLHVLTFRGLHVLGFRGLHVLTFRGLDVLAFRGLDALTFRGLHALAFRGLHAFAFKGLHALTFRGLLVLAFRGLDVLAIRGLHILAFRGLDVLAFRGLHALVFKGLDILAFGGLDVLTLSGLHARALGTSTLTFRGLHTLTFRGLHVLAFKGLHALAFRGLHVFTIRGMYALAFRGLHALAFRGLHVLTIRGLYAFAFRGLHTLAFRGLHVLALRGLHALALGTSALTFRGLHALTFRGLHVLAFRGLHALTFRGLHTFTFRGLHVLTFRGLHVLGFRGLHVLTFRGLDVLAFRELDVLAFKGLNVLTFRGLDVLAFRGLHALAFIGLHALTFRGLHVLAFRGLDVLAFRGLHILAFRGLDVLAFR

SEQ ID NO: 147870 - protein, 119 aa, Glycine max
  Coding DNA Sequence Number=SeqID_56185
MLCKSPCCAFAHLHHAVTQALYVGLVFCRRKSEDPYCLLNCTHGALCPQMRNLTFCMSHCVEVLAIKIAIPWVMGLNQARAFRKKVHRVKLKYGSNHFAKIGAKDGSCYIIASSTAKHV

SEQ ID NO: 147871 - protein, 151 aa, Glycine max
  Coding DNA Sequence Number=SeqID_56186
  Homolog annotation: Hit_ID=A5AK77; Match level="QueryCoverage=41%, HitCoverage=7%, E-value=8e-08, Identity=42%"; Hit description =Putative uncharacterized protein
MAGTLFLLKQQNSLEVMSGKKEMTPNRVVNWPFGTLYLHPGHSVHFEHSVEGDSEYSDFEHSTTNFHTENMAQPPPCERTLREMAAPDFTYESLCIQYPNQAFPYVLKTGLIHLLPKFHGLAGEDPHKHIKEFHIICSTMKPLMSKKIISF

SEQ ID NO: 147872 - protein, 87 aa, Glycine max
  Coding DNA Sequence Number=SeqID_56187
MEKSYKMNFKKKEKKGYITCEDNVINYSSDSEKKIISLDIMMKDYENGEEQMEVGSSYWKLKVKNGSWKLEVEVTGSWKLEMKVIGS

SEQ ID NO: 147873 - protein, 274 aa, Glycine max
  Coding DNA Sequence Number=SeqID_56188
  Homolog annotation: Hit_ID=Q2HTA0; Match level="QueryCoverage=83%, HitCoverage=43%, E-value=1e-23, Identity=34%"; Hit description=IMP dehydrogenase/GMP reductase, related
  Pfam annotation: Domain name=DUF1723; Domain location=33-82; Score =61.0; E_value=3.9e-15; Accession=PF08330.1; Description=Protein of unknown function (DUF1723)
RSRGSLIWEAVPAIEGLVVATGLSPLIECSVVTGDPRLISAFVERWHRETSTFHLPVGELTITLDDVSSLLHLPISGAFHSFEAFSVDEAVFLLMELLEVSGEEARAETSRGYAWGAAALVHMYDQLDEASRTTTRQIGGYLTLLQCVIDNAYEETSPRASGWLTTKAHMKGIIGASYRAHCDALTVTDVCWFPYSDHRGVRGFELISSFQGQLRWGPTMVTVRSERVLRQFGYIQSIPPLPVSASLSYDNIDDRWMHFSDHVVAVGDLCVVPE

SEQ ID NO: 147874 - protein, 90 aa, Glycine max
  Coding DNA Sequence Number=SeqID_56189
MAMGRVGYGYCLPNPLPRLLNISPYPYPIPDGFEFIVSSPYPSGTRRVSVIPYPYPYPTFGYRGKPEPVPIPGQFGYYPSKSGRIRADTH

SEQ ID NO: 147875 - protein, 61 aa, Glycine max
  Coding DNA Sequence Number=SeqID_56190
EEKKSEENKVEEKKANEEEKKEEEKKLEESKDDKESKEESAPPEIVQGTTFAMHGYFKHDF

SEQ ID NO: 147876 - protein, 95 aa, Glycine max
  Coding DNA Sequence Number=SeqID_56191
MKREKHVSNSSHDSCKSLSEEVRHYYRGRHSSHTKHHSQRREKDRRPQKVEQLFACYHISEERKSSIWLPLAFKDMPSIGGLPLLGKRMDSWGIL

SEQ ID NO: 147877 - protein, 155 aa, Glycine max
  Coding DNA Sequence Number=SeqID_56192
MTGRLLAGSLTFDCRIMHYIIVRILMPHSSNPSQASEEDLILMCAFLTGRPIEWAHLVRYCMHKALWSGAPLPYPQLVTLFLRNFEIPLDYEPFVLVKRSFVIGVGAVTSFGYRKDIDGQWLKKDAQPPQDERTPSPPPQRDDSSALMNEVLSEL

SEQ ID NO: 147878 - protein, 117 aa, Glycine max
  Coding DNA Sequence Number=SeqID_56193
MERKTRKKRKRKREGRHRLHLRPHSHRREKERKPQEDNINLQYFHGKDNEEAYLDWKICVKQQLKRKSTLKSYGSHSYPKKDQGQGILGVTPSKPKDDKASMQEKTSFIMCFKCLER

SEQ ID NO: 147879 - protein, 247 aa, Glycine max
  Coding DNA Sequence Number=SeqID_56194
  Homolog annotation: Hit_ID=Q6WAY4; Match level="QueryCoverage=77%, HitCoverage=34%, E-value=3e-14, Identity=28%"; Hit description =Putative uncharacterized protein
MGTNQTGKRFYQVKIKGLDITSIKELGRLMGPLQMQAFRKAYRKMLDLTIAEISTEAIASLTQYYDQPLRCFMFGDFQLVPTVEEFEEILGCPLGGRKPYLFSGFLPSLSKIAIVVRDSARGLDRVKQTRNGIVGLPRKYLEGKAKDMANQEEWVPFMDVLGLLIFGVVLFPNVVSLVDLAVIDAFLAYHHSKESPVVAVLADLFDTFDQRRQNSQLVSTMEIRKGGSSLLMWGLPKHPADRNEGLH

SEQ ID NO: 147880 - protein, 69 aa, Glycine max
  Coding DNA Sequence Number=SeqID_56195
MTTEEKTSEVSNTPEYSCPATAGYVGGTERGRLELNVEDQKVSFDLFEAMKHLDIGDACSKKEEVEQEI

SEQ ID NO: 147881 - protein, 375 aa, Glycine max
  Coding DNA Sequence Number=SeqID_56196
  Homolog annotation: Hit_ID=Q6WAY6; Match level="QueryCoverage=57%, HitCoverage=34%, E-value=2e-22, Identity=32%"; Hit description =Putative uncharacterized protein
MASQDKWGPFADILALLIFGVVLFPNMDGLEDLAAIDAFLAYHHGKESPVVAILADLFDTFDRRCEKNSARIVCYLPALCVWLVSHLFQQDTRHPCPLQSYRSCAEKGRVDWDQHLAGIGGNAINWFPRWKEGKEGVLFSCGDYPNVPLIGTRDCINYNPALAIRQLGYPMRGAPTEESLSPFLVRDLGAQSLKVIQRVHKAWRSPLKKDKELRGIRKECTEARKEEYGQEKFRGALWGSNNELKLRREERDRSRVHGMILKEELAACARSKRSLAQHLEATEQSMLAIIGQYKEELNQSVAHEQKLVEDLAQVYAEKEARGRVIDALPQEATMWMDRFALTLNGSQDLPRLLAKAKAMAEVCTAPEEIQGLINY

SEQ ID NO: 147882 - protein, 89 aa, Glycine max
  Coding DNA Sequence Number=SeqID_56197
MGLSQAFLLKKRFYQVKVKSLGVTSLKELGQLMGQLQRQAFHKAYGKIWDLAVAEVSTEAIASLAQYYDQPLRCFTFGGLPVITHGGRV

SEQ ID NO: 147883 - protein, 189 aa, Glycine max
  Coding DNA Sequence Number=SeqID_56198
MTNLVLSDGGFRASAAACDVADKAQGQVAVVGVSVALIAVEGLCVAGGERQRALFQLQRQGTGNHVDHFTPAFGVRGRVIALARHQRPFPQLGPLPRRHAGGEQRLAARLRALPGQLAHQMAAARLRRLDQIGERNRQGGGDLVEHRQADVAIAGLDARQHAAADAGKLGQRFLAQARPLAVAAQIAAQ

SEQ ID NO: 147884 - protein, 83 aa, Glycine max
  Coding DNA Sequence Number=SeqID_56199
MAETAILGAPKKVREWRFALRNPSAWLQPRGLGMHDEYRNSWGSEKGKGREWRIALSNHYTWLETRGWRMHERKRNSWGSEKG

SEQ ID NO: 147885 - protein, 171 aa, Glycine max
  Coding DNA Sequence Number=SeqID_56200
  Subcellular localization annotation: CTP_CleavageSite=11; ConfidenceScore=5.01e-01
TTSGTKQRSVMSANGQSKAFNTSRSLLEEIKFPSFLLPGVVLLWTRSIDCADEVVRGKVLGAAPRRGPGVELDIPLGISLIFGPTSGAHPKGKPARCIPNGGPASCAPVSFTWHTRPPPHLIGGGLEFVGSLVMIVGSASAAELTALASEWPTFFFRTMSCLDSGMHALPS

SEQ ID NO: 147886 - protein, 74 aa, Glycine max
  Coding DNA Sequence Number=SeqID_56201
MVSKDIILFDINVVAVGTTSDNISSKRKTLDKCRNLPFGGRAMQGSRVRLPWEEGAQSRHQRLFEENVGKIRKV

SEQ ID NO: 147887 - protein, 46 aa, Glycine max
  Coding DNA Sequence Number=SeqID_56202
STLEDPTPLPKFKVLDFDKYKGTTCPKNHPKMYCRKIRAYAKMRNC

SEQ ID NO: 147888 - protein, 100 aa, Glycine max
  Coding DNA Sequence Number=SeqID_56203
MKLVERDQYIHWHRLKDEDVVRDIFWCHPDAVKLCNAFSHRQECQGKMSLIGQKNAWKYVMDAWGSLVDCRSEHQFDDYLKKFEIVCSPWPMFVDYVNET

SEQ ID NO: 147889 - protein, 216 aa, Glycine max
  Coding DNA Sequence Number=SeqID_56204
MGQFGEAIHLPGEVGIASGLHGLLQGVGVHRQRVGTHPPYQGVELSGRGYVAQLCEPDIADEQDVGSDLTYRESIGAVRFHQHHPLRTEHHADAELLGGRGQVSVDGGRELRAAGHGTDEHRSSQPPAQELGGQVDAGETGVGQASMWRFLRSCNNALVPLEVWIAIAIVAVVVVAALVFGLVRYRSRRISLTRSDKNTGITEGATPTDRSGGYTA

SEQ ID NO: 147890 - protein, 142 aa, Glycine max
  Coding DNA Sequence Number=SeqID_56205
  Gene Ontology: Mol. function=RNA-directed DNA polymerase activity; Biological process=regulation of transcription, DNA-dependent
  Homolog annotation: Hit_ID=A5ANM4; Match level="QueryCoverage=73%, HitCoverage=6%, E-value=2e-21, Identity=50%"; Hit description =Putative uncharacterized protein
  Pfam annotation: Domain name=MP; Domain location=6-133; Score=-29.2; E_value=0.011; Accession=PF01107.9; Description=Viral movement protein (MP)
MSRNQTHEVAPKHNLFDEEVRFEEINQNMDDWTHYAAVLMCLRDIRHNKFEDSLIGTVETSLGQGLVYFNCYPNKTVSLMDRNILDSLFLNIHFHGLNMKEGSIPTALIYRIQYKVMNTCASRVLLKPQLGETTLFVADMTG

SEQ ID NO: 147891 - protein, 157 aa, Glycine max
  Coding DNA Sequence Number=SeqID_56206
MPPAVKATHTIINHLASANGEMLHVGVSPVLSARLVPVQGHLLGSLGFKGYLCIAGKYVALQICDDEDVETMIESFQQQQQMSVLELYVEKDVVGGSMFHAANSVTSCERNVSHQESELPRNISNLHVDVHDDDDDDDYLASNSYVEESFDEDDSDD

SEQ ID NO: 147892 - protein, 84 aa, Glycine max
  Coding DNA Sequence Number=SeqID_56207
MIIEESILVSFDESNAIPPRKDILDDIAESLEQMHIHEQDFKGKGDGSNEDPPVEAKTNDELPREWKASRDHSLDNIIGDISKG

SEQ ID NO: 147893 - protein, 166 aa, Glycine max
  Coding DNA Sequence Number=SeqID_56208
NEDMGYVGVRELRWRWAIGDGGVELPAFIFDHRVVPGDMSRGSGDLGDVRRAPGSQQIKGTKTTKQGGLCGGWPAVNLCDIWVMASGNRLPRGEARGASGNRLPGDVIDYQASKGNWKTVEASGNQLPVFVIDYTEEWIVMAAQLIHDRVEMECLERAWETLEGNT

SEQ ID NO: 147894 - protein, 211 aa, Glycine max
  Coding DNA Sequence Number=SeqID_56209
  Homolog annotation: Hit_ID=Q6WAY6; Match level="QueryCoverage=71%, HitCoverage=26%, E-value=1e-14, Identity=35%"; Hit description =Putative uncharacterized protein
RRTREPRLARPQKGRLRQLATPLGIVFVKKGGANCDRLLANKEGASVNWFPRWKEGRTRVLISCRGFPNVPLMGTRGCISYNPVLAIRQLGYPMRGAPLEEELTPVISRGFNKTNVETLQKVRKAWEVVQKKDKELRGSNNGPIGGYRRWLKAHVQGLDWLPSLRTAKREEVEAPENAELRDINIATTKALEQETKRARREEHGRNKFRGA

SEQ ID NO: 147895 - protein, 126 aa, Glycine max
  Coding DNA Sequence Number=SeqID_56210
MVGYTPSSFTDLVFASKRIDVGPKRGKFDHPTRTTEKTGANEEGEKEGETHAVTAIPIRPSFPPTQQCHYSANNKPPPYPPTTITLAKVHQAPFLREYDSNATCACHGEAPGRTIEHCRALKRKVQ

SEQ ID NO: 147896 - protein, 66 aa, Glycine max
  Coding DNA Sequence Number=SeqID_56211
MTLGLGRTLKASLPEGFFPCCNSCQDWHRWRDEVALDDMNGSGMEKEEREEMPLQGEDESRRSSPP

SEQ ID NO: 147897 - protein, 266 aa, Glycine max
  Coding DNA Sequence Number=SeqID_56212
  Gene Ontology: Biological process=transposition, DNA-mediated
  Homolog annotation: Hit_ID=Q6UUU1; Match level="QueryCoverage=22%, HitCoverage=40%, E-value=3e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGIRCRIAAKHGRAVDEEEGDGLLPNFPPPFAGIIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 147898 - protein, 314 aa, Glycine max
  Coding DNA Sequence Number=SeqID_56213
  Homolog annotation: Hit_ID=A9MHF0; Match level="QueryCoverage=97%, HitCoverage=21%, E-value=3e-40, Identity=37%"; Hit description =Putative uncharacterized protein
EAVLVQASVQRHGVDQADVRAFRRFDRADAAVVGRVHVTHFEAGALAGQTARAQCRNTTLVRDFRQRVGLVHELRQLARTEELLDGGRDRLGVDQVVRHQVFGLGLAQTFLDGAFDAHEAGAELVLGQFADATHAAVAQVIDIVDLATAVTQLDQHLDGFKDVFVGQRHRAGDVLTTAQAAVDLHATDARQVVRFFAVEQALEQRFHRFFGGRFTRTHHAVDGNARGHLVGGFIGAQRLRNVRAAIQVVRVERLDVVHVGGAQGAQHAFGDLVVGVGDDFAGIGVNDVLGQHAAVQEVFRHGDALDAAGSQVAQ

SEQ ID NO: 147899 - protein, 109 aa, Glycine max
  Coding DNA Sequence Number=SeqID_56214
MEWFFRISHPFMTPTQAGDQQRDAPAADPEDYIQPPSPQVPVAFDPPPYVDDYEGYEAIAQRLERVLNLRIVTAGTKLYDIIQDCLAIARGGPSADGIVKAHQRRRTDH

SEQ ID NO: 147900 - protein, 121 aa, Glycine max
  Coding DNA Sequence Number=SeqID_56215
MVKVGTSYVPINVSFCAEKLAQGDSGINRDTKDLFILRSRSSDHRYLIRRNTVRLGVMLPSLLIPFSWRIWFLSAVPSCSATDGVGYPRHNSAQSIPPEASALASVAWGADADANSPPRRA

SEQ ID NO: 147901 - protein, 163 aa, Glycine max
  Coding DNA Sequence Number=SeqID_56216
MGDQEEVQEQMRADMSALKEQMASMMDAMLGMRQLMEKNAATAAAVSSAVEEDPTLPAIAHHPIPNVVGQERSTLGHISNPHLGYNQVAYPYGLPPNYIPPVIRDDADHVPPPILEGEPLQQSDEVHEDRREHAVATCPFAGGRRVTRGKRVPRKEYARSRHQ

SEQ ID NO: 147902 - protein, 58 aa, Glycine max
  Coding DNA Sequence Number=SeqID_56217
MPLQGEYESRISSPPEEAMDKSLKVGKDEWRERRSTKFCASNEPTNTRSRPRFSTKCG

SEQ ID NO: 147903 - protein, 46 aa, Glycine max
  Coding DNA Sequence Number=SeqID_56218
MGDFVKIFHHSSSFFVRSSSFFGLQPNKIQPFGHAVTTLETKKDVK

SEQ ID NO: 147904 - protein, 70 aa, Glycine max
  Coding DNA Sequence Number=SeqID_56219
  Subcellular localization annotation: CTP_CleavageSite=28; ConfidenceScore=5.16e-01
MVPSGVANCRNLPFGGRATRGSQVRLPRKENARSCYQRLFKENVGKMGKVWSTNFNRERFGSCIYARGRY

SEQ ID NO: 147905 - protein, 40 aa, Glycine max
  Coding DNA Sequence Number=SeqID_56220
FFINSTHSPLLIQEKQACKRIGRGDLIQGLYVLDLKDTLD

SEQ ID NO: 147906 - protein, 287 aa, Glycine max
  Coding DNA Sequence Number=SeqID_56221
  Homolog annotation: Hit_ID=Q6WAY6; Match level="QueryCoverage=81%, HitCoverage=40%, E-value=1e-12, Identity=28%"; Hit description =Putative uncharacterized protein
KGGANWDRLLANKEGASVNWFPRWKEGRIGVLISCRGFPNVPLMGTRGCISYNPVLAIRQLGYPMRGALLEEELMPVISRGFNKANVETFQKVRKAWEVVQKKDKELRDSNNGPIGRYRRWLKAHVQGLDWLPSLRTAKREEVEAPEEDEEALEQETKRVRREEHGRDKFRGALWGSNSELKRRREERDQSRVHSMVFKEELATCSRSKKSLAQHLEATEQSMLAIIGQYKEELNQSLTHEQKLVEDFAQAYAEKEARGRVIDALHQEATMSMDRFALTLNGSQDLP

SEQ ID NO: 147907 - protein, 266 aa, Glycine max
  Coding DNA Sequence Number=SeqID_56222
  Gene Ontology: Biological process=transposition, DNA-mediated
  Homolog annotation: Hit_ID=Q6UUU1; Match level="QueryCoverage=22%, HitCoverage=40%, E-value=3e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPVTTLNSIPSCKGSRNQYPDYLSFPPKLLRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 147908 - protein, 65 aa, Glycine max
  Coding DNA Sequence Number=SeqID_56223
GLHVLAIRGLHVLAIRGLHVLAIRGLHALTFRGLRVLTFRGLHVLAFRGLHTLSFSGLDTLTFKG

SEQ ID NO: 147909 - protein, 92 aa, Glycine max
  Coding DNA Sequence Number=SeqID_56224
  Subcellular localization annotation: CTP_CleavageSite=79; ConfidenceScore=5.12e-01
SGYGPLSVLQGARTPRQGHVIIGIAPARHPVDPKKSNRVLELSSSNYGSLSVLRSNRHTATTSRVNLSSSAKRLERCLRHMADQQATKSKAK

SEQ ID NO: 147910 - protein, 102 aa, Glycine max
  Coding DNA Sequence Number=SeqID_56225
MAPLPSLQNGQMTIEFLQPGGSTSSRAAATAVELQFALYWRNSEEARTDRPSQQLRSLNGEWDAPCSGALSAAGVVVTRSVTATLASADVRRCFCRYAPPRQ

SEQ ID NO: 147911 - protein, 124 aa, Glycine max
  Coding DNA Sequence Number=SeqID_56226
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=79%, HitCoverage=75%, E-value=3e-25, Identity=66%"; Hit description=LacZ protein
  Subcellular localization annotation: CTP_CleavageSite=32; ConfidenceScore=5.05e-01
MTMITPSSKLTLTKGNKSCPGDPLVLERPPPRWSSNSPYSESYYNSLAVVLQRRDWENPGVTQLNRLAAHPPFASWRNSEEARTDRPSQQLRSLNGEWDAPCSGALSAAGCGGYAQRDRYTCQR

SEQ ID NO: 147912 - protein, 370 aa, Glycine max
  Coding DNA Sequence Number=SeqID_56227
  Gene Ontology: Mol. function=siderophore-iron transmembrane transporter activity; Cellular component=cell outer membrane; Biological process=siderophore transport
  Homolog annotation: Hit_ID=Q0JY22; Match level="QueryCoverage=82%, HitCoverage=42%, E-value=1e-124, Identity=69%"; Hit description =Outer membrane receptor for Fe(III)-dicitrate precursor
  Pfam annotation: Domain name=TonB_dep_Rec; Domain location=67-309; Score=92.2; E_value=1.6e-24; Accession=PF00593.15; Description=TonB dependent receptor
PLDAPNPQYQYRTGGTTAHAVYIDDTINVGNWTITPGVRYEFIDSFLNDKSNPAARTHTSIKSEEPLPSLSVVYHVSEQWSVFANAGQSFGPLQYFQIASTTNGLHPEKATTYEVGTHFNGGGWKGELTLFNIDFDDELQLRGGTNGGSDAWTNLGATRHRGLETGLSYDLGELSTALSGLSLYGTYTYTQATYKAGVFEGRDLPFYSRNVASLGARYTRNQWTFNVDTFLQSKQRSPGAPDPGARYQTEESANGAYGDIPGYGTVHVRAAYDFGKQMHNLNIALGVKNLFDKRYFTRSTDNNAGKRRWRIDRAPARAAPLRRMCRRHGGLNPRVHGGITAPLFAQQALDASDHAQRHRPRNDAEQGAEQ

SEQ ID NO: 147913 - protein, 38 aa, Glycine max
  Coding DNA Sequence Number=SeqID_56228
MTTNLSSHPKKKTKVDKSGALAPTYPPSKRKSDLRSSS

SEQ ID NO: 147914 - protein, 203 aa, Glycine max
  Coding DNA Sequence Number=SeqID_56229
DHYSPPVLQEDAGHIASPVLEREPPQQPDEVHKDSQDYARRDVEFYPPIPEGPAPGTLLQPNIAASPIVLSMEGPPPATEERRKLDLLEERLRAVEGFGDYPFADMTDLCLVPNVVIPPKFKGQDHLELPSGVETKHEQQKPIKVHRNGCKWGWGHDRLIVALFSTLRKRRTSLQGSPVSFVFAVFFYFLFVLKISNQCLTLT

SEQ ID NO: 147915 - protein, 216 aa, Glycine max
  Coding DNA Sequence Number=SeqID_56230
  Homolog annotation: Hit_ID=A5AZG1; Match level="QueryCoverage=43%, HitCoverage=30%, E-value=3e-08, Identity=35%"; Hit description =Putative uncharacterized protein
  Pfam annotation: Domain name=zf-CCHC; Domain location=187-204; Score =22.6; E_value=0.00058; Accession=PF00098.14; Description=Zinc knuckle
MSLHSSSSINGEGSTPKDPLKTREKRRRNKKRVEEISQEEKEKIREKERREILRELRKEKHASYSSHNSWKSLSEELRDYYEGRHRAHIRPHSHWREKERKHQEANINLPYFHGKDNVEANLDWEIRVEQQLKRKSTSKSNCSHSYPKKDQGQGILGVTPSKPKDDKGKTIEKQPLKASMQEKTSSIKCFKCLGRGHITSQCPTKKTMIMREPRHL

SEQ ID NO: 147916 - protein, 164 aa, Glycine max
  Coding DNA Sequence Number=SeqID_56231
  Homolog annotation: Hit_ID=UPI00006A2D9E; Match level="QueryCoverage =82%, HitCoverage=69%, E-value=1e-06, Identity=20%"; Hit description =UPI00006A2D9E related cluster
TLTLRGLHALAIRGLHVLAFRGLHVLAFRGLHVLAFRGLHVLALRGLHALAFRGLDVLTFRGLHALTFRGLHVLPFRGLHALSFRGLHVLAFKGAARPRLQRATCPRLQRIGRPHLQRPTRPHLQRTIRPPLERTTCPHLQRATCPYLQRTTCLPFQRATRPRL

SEQ ID NO: 147917 - protein, 174 aa, Glycine max
  Coding DNA Sequence Number=SeqID_56232
MRGAPTEESLSPFLVRDFGAQSLKIVQRVHKAWESPLRKDKELRGIRNGIIDCYHEWLRVHTRGLDWLSMLKIINEENFEASEEDEEVQALKSELGKARLAKEKFKSVATDIRKECAGLREENAATTRALERETKRARKEEYGRYKFRGALWGSNNELKLRRRKETSHEYMAWS

SEQ ID NO: 147918 - protein, 169 aa, Glycine max
  Coding DNA Sequence Number=SeqID_56233
  Subcellular localization annotation: CTP_CleavageSite=47; ConfidenceScore=5.16e-01
ALCPDILQHKVPLSTSPSHLFPRTQGSRSSQDPNTNSKPGQAHETIYAKTQAYMQCGTMSVKNLIGRLGVHDKTNHTIGDQSGLQCFAKMLQPYEINIGLKEHSNCVTFKAYTPKSPSGPLPPDSGPTQKTFYHTDSIYELYKTHDFSIILKIILTRRHLRVLSLTRRP

SEQ ID NO: 147919 - protein, 151 aa, Glycine max
  Coding DNA Sequence Number=SeqID_56234
MAQLISDVIYYLQGSHPQRHPVDPKKSNRALGFPALESHPQRHPVDPEKSNWALGFPALVTGLCSPTGCLFPPTRSRHHDIALITGLCQFYGVPVTSSKGIRPPTNRAFIKKYCVPRQAQGETPQPPGDGQQRATDAPPSPLEFNSAHPQK

SEQ ID NO: 147920 - protein, 206 aa, Glycine max
  Coding DNA Sequence Number=SeqID_56235
  Homolog annotation: Hit_ID=Q6UUU1; Match level="QueryCoverage=29%, HitCoverage=40%, E-value=2e-18, Identity=78%"; Hit description =Putative uncharacterized protein
MVKVGTSYVPINVSFSPKVGPGLPGINRDTRIYLFCEVIFRHSCPSCSATDGVVRNGKSTIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTGKTIKIPAFPPGGSLVRSPVPAFRFTGVIP

SEQ ID NO: 147921 - protein, 80 aa, Glycine max
  Coding DNA Sequence Number=SeqID_56236
MMTKVMTKSSKINQRTTQNNSRVQDKNQEEFKTQEESLESRIKIQGSRSQESRSRFKTQDSRIKRRLNHDKYEKFFSKIE

SEQ ID NO: 147922 - protein, 119 aa, Glycine max
  Coding DNA Sequence Number=SeqID_56237
  Homolog annotation: Hit_ID=A5C6E9; Match level="QueryCoverage=74%, HitCoverage=8%, E-value=3e-09, Identity=38%"; Hit description =Putative uncharacterized protein
  Pfam annotation: Domain name=zf-BED; Domain location=33-79; Score =24.8; E_value=0.00031; Accession=PF02892.6; Description=BED zinc finger
EGPNNERMQQPPNMVVDDHVASSTKTGGGGLRSIAWNHIDKIKTTNGKDKAQCKYNKKLLGGASKNGTKHLHAHMEKCIQKRLHDKGKGQTFLIPKVTQGRQELTVGSYNEENAKKDLA

SEQ ID NO: 147923 - protein, 261 aa, Glycine max
  Coding DNA Sequence Number=SeqID_56238
  Homolog annotation: Hit_ID=Q6WAY6; Match level="QueryCoverage=35%, HitCoverage=16%, E-value=5e-11, Identity=37%"; Hit description =Putative uncharacterized protein
MEGRKGGSLFSCGDYPNVPLIGTRGCINYNPALAIRQLGYPMRGTPTEESLSPFLVRDFGAQSLKVIQRVHKAWRSPLRKDKELRGIRNGVIGGYHGWLRVHTRGLDWLPKLKVINEENFEALEEDEEVQALKLELGKARLAKEKFKSAATNIRKECTELREENVATARALEQETKRARKEERGRDKFRGALWGSNNELELRREERDQSRVHGMILKEELAACARSKRSLAQHLEAMEQSMLAIIGQYKEELNQSVTHEQS

SEQ ID NO: 147924 - protein, 182 aa, Glycine max
  Coding DNA Sequence Number=SeqID_56239
  Gene Ontology: Biological process=transposition, DNA-mediated
  Homolog annotation: Hit_ID=Q1J7G7; Match level="QueryCoverage=22%, HitCoverage=71%, E-value=4e-12, Identity=74%"; Hit description =Transposase
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPVTTLNSINQRSVLKELRRSDFLIAIEEYVGARETPLRTREPRVALPSKGRLQQLATPLGTVFR

SEQ ID NO: 147925 - protein, 294 aa, Glycine max
  Coding DNA Sequence Number=SeqID_56240
  Gene Ontology: Cellular component=integral to membrane
  Homolog annotation: Hit_ID=P76361; Match level="QueryCoverage=72%, HitCoverage=41%, E-value=8e-70, Identity=61%"; Hit description=Inner membrane protein yeeR
MEQFTCRLSEIEQKALNRILNEFAALGELTAAAFSVENNRRLLEASITLAQAHALLKASLNILGVILGLGALIVAGPPLLAGYIVERVTYALHSRWLLGVPLAIAGMVISFMWGLDGKHIAYEAYSFDSMKFILTAAFASGLLAVPVQTKAILQNGLIPADINAKLKEYYCCFYTSYFLMACSAATPFIAWQYNISSSLMWWTGLLYWIAALLTQFYAANQIQELKKLTNAINTGLNEQKAINNQLWLTELKEGSNLSAEFVETIYLKLVSQHIFQGDTREQDLAGENWLLNDA

SEQ ID NO: 147926 - protein, 77 aa, Glycine max
  Coding DNA Sequence Number=SeqID_56241
  Subcellular localization annotation: CTP_CleavageSite=42; ConfidenceScore=5.06e-01
MEAVQIRPHKEMGPCSRLGRMCRKRHGPSRNRTLLPTFCLVGVMNIWSRSPRRSCRKLHSQEALMASLTLHPPSDAT

SEQ ID NO: 147927 - protein, 254 aa, Glycine max
  Coding DNA Sequence Number=SeqID_56242
MEACLVVGDLLQQMIDQGRLEVSDEGEEEKHICMQSADKEGPRQPKPLVLHFTRDTAPQKPRHPSAVSGVRPISFPYKNSHAVPWRYAPPSGKKEEATDISSLSAKVTNITGLSGITRSSRVFAPPDLPTQPVNAKGKARMMEGQNVKVIPTLDEDVPTKDLFEGREGCGKKEVSLEEASEFLHTIQQSEFKCRQRIKLKVLMIPKDYMNHMLLKGIKLKVLMMPKDYMNHMLLKDLLKTKQLEIFKMDNQDSL

SEQ ID NO: 147928 - protein, 142 aa, Glycine max
  Coding DNA Sequence Number=SeqID_56243
MGSSQKPSLKKRFYQVKIKSLEVTSLRELGQLMGQLQRCFTFEDFQLVPTVKEFEEILGCPLGGRKPYLFSGFYPSTIRVAKVVKISAQELDRVKQNRNGVVGVPRKFVLFPNMEGLVDLAAVDAFLAFHHGKESPIVAILA

SEQ ID NO: 147929 - protein, 97 aa, Glycine max
  Coding DNA Sequence Number=SeqID_56244
  Subcellular localization annotation: CTP_CleavageSite=48; ConfidenceScore=5.19e-01
MATCPCLQRTAHPYLQNTAHPRLQRTTCPCLQRAARPRLQRTTSEGPVVSLYQSLGHPPDLGGGPTGARPPQQGHAIVTGIAPARHLVDPEKSNRLL

SEQ ID NO: 147930 - protein, 195 aa, Glycine max
  Coding DNA Sequence Number=SeqID_56245
RYTSGKNIPSYKRKTRPLQEPLNKKPKGPARRNMAERNSEEHCGVATMSSSSEGRRDTGHGSKRSLAQHLEATEQSMLAIIGKYKEELNQFVTHEQKLVEDFAQVYAEKEARGRVIDALHQEATMWMDRFALTLNGSQDLPRLLAKAKAMAEEQMKADLSALKDQMASILEVMLKLQKTIEDKAMTTSQPKSYRP

SEQ ID NO: 147931 - protein, 136 aa, Glycine max
  Coding DNA Sequence Number=SeqID_56246
MGTRGCINYNPVLAHKTVRVSYESEANTEILQKIHKAWNKVERKDKELRGISNGVIGGYHKWLKSRVQGIAWLKKLEGLNGKEIEVSEESEEVQVLKAELEKTKVAKEKLKVLVTRVRKECDRMKDINMSTVDALE

SEQ ID NO: 147932 - protein, 37 aa, Glycine max
  Coding DNA Sequence Number=SeqID_56247
MRRGNVDVDNDIECMYMGGAVTLLAIPGGGDKVVNKY

SEQ ID NO: 147933 - protein, 88 aa, Glycine max
  Coding DNA Sequence Number=SeqID_56248
MAYTHIPVSTSDSPQISASPYQLDLAPYASEPYNAQWNAPGLLRDKRTLRSSRILGEMEVDEPWLGLWLPLNYQVVFVIGSAVDMLCG

SEQ ID NO: 147934 - protein, 184 aa, Glycine max
  Coding DNA Sequence Number=SeqID_56249
ARPVRGLDLGRHAGAGGGAGDHVPGVPGGRAAVGRGGLEAGGLRGVVRLRIRLPGGGGLRLHGRPGGHLDQPDLGRGHRCHRAGVAVAAGPEDRLAGRRDPVAPASGAIDRLRPWRGGDLAGVGPAVQRLRLRRCDAARRHGPVPGAVGAAGHADAGDRARHLHAPAELDHDPDRHGGGRRPDR

SEQ ID NO: 147935 - protein, 34 aa, Glycine max
  Coding DNA Sequence Number=SeqID_56250
MEIKKKDEVGCEALVDIASVPGMRLGRSRSGRLA

SEQ ID NO: 147936 - protein, 79 aa, Glycine max
  Coding DNA Sequence Number=SeqID_56251
  Gene Ontology: Biological process=transposition, DNA-mediated
  Homolog annotation: Hit_ID=Q1J7G7; Match level="QueryCoverage=49%, HitCoverage=55%, E-value=1e-14, Identity=94%"; Hit description =Transposase
MVKVGTSYVPINVSFSPKVGPGLPVYDGVFGVLQWLLFLSAVPPVQLLTGWCVTAKAPPDISAGKCSGHAARNHHARRA

SEQ ID NO: 147937 - protein, 25 aa, Glycine max
  Coding DNA Sequence Number=SeqID_56252
KGWIEDSKKIGRDAREGPRILMSLQ

SEQ ID NO: 147938 - protein, 148 aa, Glycine max
  Coding DNA Sequence Number=SeqID_56253
MGRTRGLGRAIGRVVGRDRAADEDAGDVPERRRPTASARRLRVHQMTMEGRDMAEDVAGMTDDVPEQPTEAPEMRADAQGADSGEGSDDDDAAEGFPGGPRDPSVLTSFAEHVAHAVWSGQERPDLKLVSHGRKVTLIGRPVSEIEGL

SEQ ID NO: 147939 - protein, 202 aa, Glycine max
  Coding DNA Sequence Number=SeqID_56254
EKFKLAATHIRKECAGLREENATTAKALEQETKRARKEEYGRNKFRGALWGRNSELKLRREERDRSRAHSMVLKEELVACSRSKKSLSQRLCETETNMLAIIAKYQEELSLATAHEHRVVDEYAQVYAEKEARGRVIDSLHQEATMWMDRFALTLNGSQELPRLLAKAKAMADTYSAPEEIHGLLGYCQHMIDLMTHIIRNR

SEQ ID NO: 147940 - protein, 276 aa, Glycine max
  Coding DNA Sequence Number=SeqID_56255
  Gene Ontology: Mol. function=oxidoreductase activity, acting on the CH-OH group of donors, NAD or NADP as acceptor; Cellular component =cytoplasm; Biological process=metabolic process
  Homolog annotation: Hit_ID=Q7W5R9; Match level="QueryCoverage=100%, HitCoverage=35%, E-value=1e-132, Identity=85%"; Hit description=NADP- dependent malic enzyme
  Pfam annotation: Domain name=PTA_PTB; Domain location=98-276; Score= -26.5; E_value=2.8e-10; Accession=PF01515.10; Description=Phosphate acetylbutaryl transferase
MDAGASRITEEMKLACVKAIAELAQAEQNDEVARAYAGQELSFGPDYIIPKPFDPRLIVQIAPAVAQAAADSGVAARPIEDIEAYRQKLMGFVYHSGQLMRPLFAQAKKAPKRVIYADGEDERVLRAVQTVADEKLAFPILIGRPSVIEMRIKKFGLRLIAGQHFEIVDPEDDSRFNETWSAYYQLKGREGVTPAIAKAMIRKHNTLIGAMLLRRGDADALLCGVASKYDNQLKYIDEIIGKKEGQTYAALNVLMLPDQTLFVTDTHVNENPSAEE

SEQ ID NO: 147941 - protein, 83 aa, Glycine max
  Coding DNA Sequence Number=SeqID_56256
MNLRVKDAGKNGGSLVTVMKRLPEEQIFRKTLGTPLPECFRKMYLFRKHSGRGFFRMTFQWFRKHFPEEPSSVIVPKKYFFRK

SEQ ID NO: 147942 - protein, 63 aa, Glycine max
  Coding DNA Sequence Number=SeqID_56257
MLVRMTEIKEGSSTKTSQSIPLELVGIGSSSSMDSFASWKMNGSGMEKGRERRHHFKEKMSLE

SEQ ID NO: 147943 - protein, 121 aa, Glycine max
  Coding DNA Sequence Number=SeqID_56258
MVEVSTEAIASLAQYYDQPLRCFTFGDFQLSPMELDHRRQVENGVVGIPRKYLEAKARILEGKGEWAPFIDILALLIFGGVLFPNVDGLVDLATIDAFLAYHNHKESLVVAMLADLYDTFD

SEQ ID NO: 147944 - protein, 49 aa, Glycine max
  Coding DNA Sequence Number=SeqID_56259
MEELINKTQRSPQNNPNVITSAWELLNRISSLHPTAVILLPRTRCAIIT

SEQ ID NO: 147945 - protein, 148 aa, Glycine max
  Coding DNA Sequence Number=SeqID_56260
  Gene Ontology: Mol. function=UTP:glucose-1-phosphate uridylyltransfera se activity; Biological process=UDP-glucose metabolic process
  Homolog annotation: Hit_ID=A8GC45; Match level="QueryCoverage=98%, HitCoverage=48%, E-value=1e-68, Identity=85%"; Hit description=UTP -glucose-1-phosphate uridylyltransferase
MIQRFGDTGYSQIMVEPVPEQDVSKYGVVDCAGATIAAGESAPMTAVVEKPAREDAPSNLAVVGRYVLAADIWPLLEKTPPGAGDEIQLTDAIAMLMDEQTVEAFHMSGKSHDCGDKFGYMKAFVQYGLRHGTEGENFSRWLKQTLGK

SEQ ID NO: 147946 - protein, 99 aa, Glycine max
  Coding DNA Sequence Number=SeqID_56261
MSILELYIEKDVAGGSMFHSANSLTSCGNYLSNDETQPATNLSNLHIDEDNDDDDDDYVVSNLYVEESLDEDDSLDGISDIDDEATDIPQSIRIVHPTK

SEQ ID NO: 147947 - protein, 79 aa, Glycine max
  Coding DNA Sequence Number=SeqID_56262
MTPFQENCIRLRQERGLRTIGRFELVYTRVEVEAARFLDLAQFLTKLHKISSISSNVDNRSKEQLYACKVYVAGHLALG

SEQ ID NO: 147948 - protein, 90 aa, Glycine max
  Coding DNA Sequence Number=SeqID_56263
MVSRGIIPFEEHTAAVGTLATSPVESPTVATYPSAGGRCVTHGMRVPRKEYARSRHQRLFEENVGKTGKDAIYELLSERFGSCIYARGRY

SEQ ID NO: 147949 - protein, 113 aa, Glycine max
  Coding DNA Sequence Number=SeqID_56264
MGEVEEEQEKMKADREAMKEQKATIMEAMMSMKKIMEANVVAVAATSAVAKARSWQVWAAPIVCKFKTKHTFPPYDLPPNYTPPNVAYTPNEDVNNSTPILIESRQPHHVHVS

SEQ ID NO: 147950 - protein, 157 aa, Glycine max
  Coding DNA Sequence Number=SeqID_56265
MVEREMITMMVDTLPVFYYEKLVGYMPSSFADLVFAGERIEVGLKRGKFDYVSSTNVNAKRIGATGAKRKGGVCPLNPIGLFTRRMVKYLPNTHGTIITQSPYSFSVLLGERLVSSTPVQWVLCLLRHSTQRKLRKFVNVRNATRPALVNRQARTRL

SEQ ID NO: 147951 - protein, 160 aa, Glycine max
  Coding DNA Sequence Number=SeqID_56266
  Pfam annotation: Domain name=Transposase_23; Domain location=80-153; Score=-13.2; E_value=0.033; Accession=PF03017.5; Description =TNP1ENSPM transposase
MPPEDLEQLTQQIRDQLEESITEKVTRKMMASFSQMQSQFQSQMQSQGLALPPEPEVGPSGPRFSTKESCVAPLGNDPGTGDSDKCGLYIEENPSRLVALGRLYEGSTTVHNIPLLHGQVKVGVEEVKDAEALVPVPTDELCLQQNLQKARMKRSMIPCT

SEQ ID NO: 147952 - protein, 124 aa, Glycine max
  Coding DNA Sequence Number=SeqID_56267
GGPSNRPQQQGPNLYDRTTKLEETLAQFVQVSMSNQKSTESTIKNLEVQVGQLAKQLADRPSSSFGSNTEKNPKEECKAVMTRSKLGAMKDGENGIGAKKQQLVSGPTLDPVVESLSESDEELE

SEQ ID NO: 147953 - protein, 140 aa, Glycine max
  Coding DNA Sequence Number=SeqID_56268
MHLTETSMRARNYDIYGFLEPHSIQRSGQSQFETESYIKSWMQSSKHDVYLGAYLNGGHWQMVVIMSKEHLVVWFCSLHNRPNNYHKGIINNALKGLDDAPQPKSKAPARWIVIKYFNDLRPLEPKRLKALRIHWAQYYL

SEQ ID NO: 147954 - protein, 287 aa, Glycine max
  Coding DNA Sequence Number=SeqID_56269
  Gene Ontology: Biological process=transposition, DNA-mediated
  Homolog annotation: Hit_ID=Q6UUU1; Match level="QueryCoverage=20%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPVTTLANWSSTAVAAALELVDPPGCRNSMNFFDGRGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 147955 - protein, 227 aa, Glycine max
  Coding DNA Sequence Number=SeqID_56270
  Homolog annotation: Hit_ID=A6TF34; Match level="QueryCoverage=35%, HitCoverage=96%, E-value=3e-34, Identity=92%"; Hit description =Putative uncharacterized protein
  Pfam annotation: Domain name=DUF1471; Domain location=2-88; Score =65.9; E_value=1.4e-16; Accession=PF07338.4; Description=Protein of unknown function (DUF1471)
AMKLVTGIVASLVIGSLSFGAFAAKEIQKDEVAKMNLTKVGSITTSRTTSPMDAKRDLSKKADELGGKYFVVIAGEKNEKTVHANADAGFPFRAAFTAAGKAAIGVFGHLDRFPRRFQAAQHGVDQRLWRMQAGAHLIGFNALLQSQHIANGNIHPATRPTHQAKDHDVKQNYRQNAYQAVARVLAKAHGLDEDQVGVRGGGAAEFTPHHPHGAGFHFAIAFACFNR

SEQ ID NO: 147956 - protein, 62 aa, Glycine max
  Coding DNA Sequence Number=SeqID_56271
MFACSLFAKRTPRTKCISVHALSCESHALRAQSLHLRLIWSAKLAKVELSFSLIAKRQLSRG

SEQ ID NO: 147957 - protein, 252 aa, Glycine max
  Coding DNA Sequence Number=SeqID_56272
  Gene Ontology: Mol. function=phosphoprotein phosphatase activity
  Homolog annotation: Hit_ID=Q2HTA0; Match level="QueryCoverage=84%, HitCoverage=29%, E-value=1e-22, Identity=33%"; Hit description=IMP dehydrogenase/GMP reductase, related
MVFLDALRDLTQSRGYAWGAAALVHMYDNLNDTSKSTVRQLVGYITLLQCWIYEQFSSVSFTVPAEDYDEKRQRACRWTSGKALPISTYRRRMDRLTPDAVCWSPYGDHRSFREFEVISLFFGHFKWGPLAVIHRPERVVQQFGYIQTIPPHPIASSLSIEEINDRRMQFGEYIAPVGQLCAIPDHYSPDYMDWFYMISHPFMSLAQPRDPPRVPLVQQYEEFVEPYMYQQSMAAAASNEADVDVHHLRHAM

SEQ ID NO: 147958 - protein, 61 aa, Glycine max
  Coding DNA Sequence Number=SeqID_56273
MASLITHDMALKLMRSEEGYQRREIKRTNRKAHRRPAYKSQVFKNEEAKVAAELHRIDREE

SEQ ID NO: 147959 - protein, 178 aa, Glycine max
  Coding DNA Sequence Number=SeqID_56274
MTPTRHPLDPDKSNRALGFPALITGLCQSFSVPVTPSKVIRSPITRAYIEKYCTQRQVQGDAPQVADASPPHQAGPAGLFDTEQYLRHLVRQQAANHRAHVQTHDCLYQMSLSLQSQGFTSFPCPTLDQFRAEVAWPRDWPEAQAGEAPAEAPDEADEAREDEEMTDLLDFLGGSGAT

SEQ ID NO: 147960 - protein, 228 aa, Glycine max
  Coding DNA Sequence Number=SeqID_56275
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=22%, HitCoverage=50%, E-value=1e-22, Identity=98%"; Hit description=LacZ protein
ASRYQQGHQDLFILRSDLPSQVLQWLLFLSAVPPVQLLTGWCVTAKAPPDISAGKCSGHAARRVPFAIQAAQLLGRAIGAGLFAITPAGERGMCCKAIKLGNARVFPVTTFPGDPLVLERPPPRWSSNSPYSESYYNSLAVVLQRRDWENTGVTQLNRLAAHPPFASWRNSEEARTDRPSQQLRSLNGEWDAPCSGALSAAGVVVTRSVTATLASADVRRCFCRYAPP

SEQ ID NO: 147961 - protein, 236 aa, Glycine max
  Coding DNA Sequence Number=SeqID_56276
  Homolog annotation: Hit_ID=A5ATL8; Match level="QueryCoverage=23%, HitCoverage=45%, E-value=3e-18, Identity=82%"; Hit description =Putative uncharacterized protein
TLGLRHGPDSYGRQQWGIFRNGRKPDGAMPREASANSVPAAAVRQRMQALSGMIGRKASVEGISGGAVEMRRDRKEHQRRKHSAGPTLTTERRKLGERMGIRYPSSPSRKRWILGAVRIDPCNAVANALSIPPGEYVRKNETQRKLTGARTSGGACGLISMQSERTLPGLDMPRILLKERGAFGNADTGGAWLSSARATAGDKPEEGEDDVKSSCPLCPGRHTCYNGRDKGSRSRE

SEQ ID NO: 147962 - protein, 233 aa, Glycine max
  Coding DNA Sequence Number=SeqID_56277
  Gene Ontology: Biological process=transposition, DNA-mediated
  Homolog annotation: Hit_ID=Q1J7G7; Match level="QueryCoverage=16%, HitCoverage=67%, E-value=2e-10, Identity=72%"; Hit description =Transposase
LPGINRDTRIYLFCEVIFRHRCSQWLLFLSAVPPVQLLTGWCVTAKAPPDISAGKCSGRVPFAIQAAQLLGRAIGAGLFAITPAGERGMCCKAIKLGNARVFPEFDRGGNKSKALGSKYILQGWFPRLHHNTQSASNSLADTNQAYRYRRPRGGARYQLLFPLVRVNFELGVIMVIAVSFGKPVVPAALMNRPTRGERRFAYWALAECILAYYVGTDEGVSEVLHVAGEKRLH

SEQ ID NO: 147963 - protein, 248 aa, Glycine max
  Coding DNA Sequence Number=SeqID_56278
  Gene Ontology: Biological process=transposition, DNA-mediated
  Homolog annotation: Hit_ID=Q6UUU1; Match level="QueryCoverage=24%, HitCoverage=40%, E-value=3e-18, Identity=78%"; Hit description =Putative uncharacterized protein
DLPSQWLLFLSAVPPVQLLTGWCVTAKAPPDISAGKCSGRVPFAIQAAQLLGRAIGAGLFAITPAGERGMCCKAIKLGNARVFPEFDTLAEPVYLFFTLIWPKWLYLDQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 147964 - protein, 62 aa, Glycine max
  Coding DNA Sequence Number=SeqID_56279
MVAITPAKVHQPLFLREYDSNATCACHREASGHSIKHCRALKRKDFQVYTIIVNHGYIAKNG

SEQ ID NO: 147965 - protein, 77 aa, Glycine max
  Coding DNA Sequence Number=SeqID_56280
MQKGLWTRQHLNNIELSPPNKEGKETMTQGGPLPLVANQNPVRFRLSRLALNKNRKGKDPNIRAKFLTKTPFPKKSY

SEQ ID NO: 147966 - protein, 140 aa, Glycine max
  Coding DNA Sequence Number=SeqID_56281
LSELGIEIRSILTRRSQWSSQPSGSAQLPSRETFISMSEAKSISEINNLCKEFVCVTVGTITRILMDNHSWCYPSCIQCYKKIDVYPEPFVCPCGKHNDRAVLRYRVVVMVNYKDENTKFLLWNCECTELIGQSADEGIL

SEQ ID NO: 147967 - protein, 26 aa, Glycine max
  Coding DNA Sequence Number=SeqID_56282
MELRVEVHTSPSLSHANDLIWMEMEQ

SEQ ID NO: 147968 - protein, 137 aa, Glycine max
  Coding DNA Sequence Number=SeqID_56283
MAPDRTQLQNMVKKESESFKEYALEGLGSTSSPSHGRKGNDYHDVGYMPSNFTDLVFTGERIEVGLKRGKFDYVSSTSTNARRIGATRAKRKERDTHAVTSAPAWIKPPQISHGTHQYAQHHSSFSARAGDSSNSAP

SEQ ID NO: 147969 - protein, 144 aa, Glycine max
  Coding DNA Sequence Number=SeqID_56284
MVTVTPAKVPQPPFFRGYDSNATCSYHGGVPGHSIEHCMTLKRCENPQTTIDTSKPYTGATRGTMRKPQANLGVDKKFSPNRFSTTRFSQHALLRASEARLTGALSKGGKMRGVTTNVYLWKTLEKPKETGQNENPKFGSCIYV

SEQ ID NO: 147970 - protein, 94 aa, Glycine max
  Coding DNA Sequence Number=SeqID_56285
  Subcellular localization annotation: CTP_CleavageSite=58; ConfidenceScore=5.25e-01
MIPNNMLSMMHAPDLNSQMQCGTTHQGNSVSVSARHSHFGKLGTTPRPPLHGDQPKSQGSSKPSDMPPSTSIPPHEKLQVLTDKVYTISMQYEV

SEQ ID NO: 147971 - protein, 108 aa, Glycine max
  Coding DNA Sequence Number=SeqID_56286
FFLFDPKPIDLAMSRLKRALTGLGGPNPLERMMSMARGRALNGLGPDSYAKVPKQSLSGKGSDRAMTPRRAQVIHRSDETLKVAFSSVSSGTFCQSGKVFGDNTWRYQ

SEQ ID NO: 147972 - protein, 284 aa, Glycine max
  Coding DNA Sequence Number=SeqID_56287
  Gene Ontology: Biological process=transposition, DNA-mediated
  Homolog annotation: Hit_ID=Q6UUU1; Match level="QueryCoverage=21%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGIRSTCPNLSGRSCPKDLGIALICLIRHQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 147973 - protein, 112 aa, Glycine max
  Coding DNA Sequence Number=SeqID_56288
  Homolog annotation: Hit_ID=Q6WAY6; Match level="QueryCoverage=95%, HitCoverage=28%, E-value=2e-13, Identity=34%"; Hit description =Putative uncharacterized protein
EWAPFIDILALLIFGGVLFPNVDGLVDLAAIDVFLTYHNHKERPVVAMLADLYDTFDRRCVSFTPFSPRGFPNVPLMGTRGCISYNPVLAIRQLGYPMRGAPLEDELAPVIS

SEQ ID NO: 147974 - protein, 254 aa, Glycine max
  Coding DNA Sequence Number=SeqID_56289
PAALRGHQGMIISSGATHPAQGRRVYRLPGGDSSPAVGITGYPHGQWISFNADALSQFQGYPLVLEEGQECEYGQRRNRSDGFDEEAIAQLLCIPGQDFARTAVGRRVRIMRTNMTTLTQIWMTLLLSNIQPNDHNSDLPLPKCQLVYAILTRMSIHVAQLITDAIYLFAGMAPTRHPLDPDKSNRALGFPALITGLCQSFGVPVAPSKVIRPPITQAFIEKYCTQRQAQGDAPQAADAPPPHQAGPAGSFDTE

SEQ ID NO: 147975 - protein, 155 aa, Glycine max
  Coding DNA Sequence Number=SeqID_56290
GPGISLADHRTLPVIRSPRCTYQGNSAAHHQRQAQGDAPQAASAPPPPHQAGQAGAFDMEQYLRHLVRQHVANHRAHVQTHDCLYQMSLSMQSQGFASFSCPTPDQFRAEVAWPGDWPEAQAGEAPPEAPGDGEEAHEDEEMADLLDFLGGSGDT

SEQ ID NO: 147976 - protein, 140 aa, Glycine max
  Coding DNA Sequence Number=SeqID_56291
  Gene Ontology: Biological process=transposition, DNA-mediated
  Homolog annotation: Hit_ID=Q1J7G7; Match level="QueryCoverage=29%, HitCoverage=71%, E-value=2e-12, Identity=74%"; Hit description =Transposase
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPEFDLGIPHPCIQRFFIRQSVS

SEQ ID NO: 147977 - protein, 93 aa, Glycine max
  Coding DNA Sequence Number=SeqID_56292
  Subcellular localization annotation: CTP_CleavageSite=62; ConfidenceScore=5.34e-01
MSSVLMKNSKYQTFTVSRICPLDLMMKYVQFQWVKRASTAKRSFNVLSTTEESGKASISRPRAKRKINALSATVLFSQAQCTTDAKLKSTYSR

SEQ ID NO: 147978 - protein, 76 aa, Glycine max
  Coding DNA Sequence Number=SeqID_56293
MPFCGRVRARLTGVLSKGGKMRGVATNVYLWETSEKPKETVDKSGALAPTYPPSKRKSDLRSSSLKVNQAILLLER

SEQ ID NO: 147979 - protein, 206 aa, Glycine max
  Coding DNA Sequence Number=SeqID_56294
MVNSVITVLYFNGRVYEENDGIIFEGSKKAIQIKREISFNALKKKLEIRFLVSRKYVALQICDDEDVEIMLESFQQQNQMSVLELYIENDVAGDSMFHSANSLISCGNNLSNNEAQPPTNVSNLHGDENDDDDDDDDDFVSNLYVEESLDEDDNIDGISSTDDEVTDMIQPVYKELKIHFGMMFCIITISTGVILMRKTFVVWRCH

SEQ ID NO: 147980 - protein, 108 aa, Glycine max
  Coding DNA Sequence Number=SeqID_56295
MSEFLIALEDTQEQGQRSCRPQKTVSRICPLDLMMKYVQFQLSLAHLWAKGASTAKHSFSALSATKESGKASAPRSCAKRKINALSAAVVFSQAQHTIGSKPESTYSR

SEQ ID NO: 147981 - protein, 167 aa, Glycine max
  Coding DNA Sequence Number=SeqID_56296
  Subcellular localization annotation: CTP_CleavageSite=6; ConfidenceScore=5.58e-01
MNVLPSAVHVSSHNDSGAPRIYCLALFANSPFSTFMRAPPMNLLPSAVHVSSTHDSRSPANLLSSAVRQFSILHFFRSPMNLLPSVVHVSSTHKSRAREFIASAVRQFANLLPSVVRQFSILHFFLSPVNLLPSAVHVSSTNESGAPRIYCLALFANSAFSTFFEAP

SEQ ID NO: 147982 - protein, 130 aa, Glycine max
  Coding DNA Sequence Number=SeqID_56297
  Gene Ontology: Mol. function=protein-tyrosine kinase activity; Cellular component=integral to membrane; Biological process=protein amino acid phosphorylation
  Homolog annotation: Hit_ID=A7P6F9; Match level="QueryCoverage=96%, HitCoverage=24%, E-value=6e-29, Identity=44%"; Hit description =Chromosome chr9 scaffold_7, whole genome shotgun sequence
MHYLYTILASLDLPHEYLKSNNVLVGPDNEPMLIDYEASHMILTARFPSQYVSNGKGRADVVQWVETAISEGRESEVLDPKIAGSRNWLAEMEQLLHIGAACTESNPQQRLDLSEAIRRIMEIKFKCGHD

SEQ ID NO: 147983 - protein, 165 aa, Glycine max
  Coding DNA Sequence Number=SeqID_56298
  Homolog annotation: Hit_ID=Q2HW90; Match level="QueryCoverage=55%, HitCoverage=18%, E-value=7e-11, Identity=36%"; Hit description =Putative uncharacterized protein
MGTNQTSKRFYQVKVKSPDTTSIKELGRLMEPLQMQAFRKTYGKILELTIAEVSIEAIASLTQYYDQPLRCFTFGDFQLVPTIEEFEEILGCPLGGRKPYLSSGCLPSLSRNATVVKGFSKEIYLTHLTEGARRVAHGSSVAYPPSVFGWFHTCSNKTQDIHVRS

SEQ ID NO: 147984 - protein, 146 aa, Glycine max
  Coding DNA Sequence Number=SeqID_56299
  Gene Ontology: Biological process=transposition, DNA-mediated
  Homolog annotation: Hit_ID=Q1J7G7; Match level="QueryCoverage=23%, HitCoverage=48%, E-value=7e-12, Identity=97%"; Hit description =Transposase
MVKVGTSYVPINVSFRQKLAQGFPVLQWLLFLSAVPPVQLLTGWCVTAKAPPDISAGKCSGHAARRVPFAIQAAQLLGRAIGAGLFAITPAGERGMCCKAIKLGNARVFPVTTLTCHKLDSHNYLRVGLSYLDIKLIDTVDLEGGP

SEQ ID NO: 147985 - protein, 129 aa, Glycine max
  Coding DNA Sequence Number=SeqID_56300
MEYQRQHIIKRESSRRGIRPLFYSNPWVLRMQCKNAEKIAVIIFTQFNKMHTRSFTIPQFPKKGLTHKKQSPVESPTVATCHFAGERGEAHGCAFQRRKMRGVATNVYLWKTSEKSKETGQNENSKFGS

SEQ ID NO: 147986 - protein, 34 aa, Glycine max
  Coding DNA Sequence Number=SeqID_56301
MKLCMVKLIQEKMRTAESRQKNYQDKRRKDLEFK

SEQ ID NO: 147987 - protein, 241 aa, Glycine max
  Coding DNA Sequence Number=SeqID_56302
MNLIIVIKRKEHALWHPYRTRARARVMGEAEEVQEKMKADMEAMKEKMATMMEAMMSVKKIMEANAVAIAATSVVAKVNLMSPSGINQMNHPTSDMVGKDLGSTGSPHNVQIQNEHAFPPYGLPPNYTPPNVAYTLNENLNNSTPILIESQQPQTDQAYISQTMGETQEIPHHNLADFEPWLGYATEGQAVGGIPFENTLEGPQFRPQPQPLHFAVGRAPPAMAEKGKADHLKERLRAIEG

SEQ ID NO: 147988 - protein, 53 aa, Glycine max
  Coding DNA Sequence Number=SeqID_56303
CFKKVLMMLHSLNQKAPTRWIVIKYFNDPRPLEVERLKALRIQWAQFYLRVRD

SEQ ID NO: 147989 - protein, 274 aa, Glycine max
  Coding DNA Sequence Number=SeqID_56304
  Gene Ontology: Biological process=transposition, DNA-mediated
  Homolog annotation: Hit_ID=Q6UUU1; Match level="QueryCoverage=21%, HitCoverage=40%, E-value=4e-18, Identity=78%"; Hit description =Putative uncharacterized protein
GHQDLFILRSDLPSQWLLFLSAVPPVQLLTGWCVTAKAPPDISAGKCSGHAARRVPFAIQAAQLLGRAIGAGLFAITPAGERGMCCKAIKLGNARVFPVTTLANWSSTAVAAALELVDPPGCRNSIGLNGSDLMSGLKSLTQERLSYHKGGFVIKASIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 147990 - protein, 121 aa, Glycine max
  Coding DNA Sequence Number=SeqID_56305
MVSRGGDERDERDECLFHLRESHDMETCPAVEELLQRLMDWGQLEVSKGGREEPQICMQSEEKKAKVTNITGLSGVTRSGRVFAPPHSAEFPSKGKAPHGPRTHRRSHSLERSGSSGGKRS

SEQ ID NO: 147991 - protein, 226 aa, Glycine max
  Coding DNA Sequence Number=SeqID_56306
  Homolog annotation: Hit_ID=Q652R5; Match level="QueryCoverage=95%, HitCoverage=83%, E-value=3e-09, Identity=59%"; Hit description =Putative uncharacterized protein P0603C10.50
RGAVAPPDASNHWLYPDRTRPAGSSYPEGNFGGNQLLDGSISLSPPIPKSDERFARQYRCGPPPEFPFGFAPLRHSSPSFGSRQVCSHSNPSQKIRVGRRCNPQGDPTNQLPCALRVYSPVDSHTCQTPWSVFQDGPNGEPTGRRQERAGAEARQGRALPSTIAMMTSPRAYQQPGLGPPSQSASVNVPSRSADRLSPFHIRPGHIAGPHPLPSRQFQALFDSLFK

SEQ ID NO: 147992 - protein, 144 aa, Glycine max
  Coding DNA Sequence Number=SeqID_56307
  Subcellular localization annotation: CTP_CleavageSite=52; ConfidenceScore=5.35e-01
MVKVGTSYVPINVSFSPKVGPGLPGRVRFPVGKPVGNCNEANARAIECGFAIAGARRSVIRRLLCWALMQGVPVKCFCKGRNCNNKGELELHRCVSLELVIQDIFRFLAQLTRYARSFTAASGTMVTNGAEISWKMPGRYLTGK

SEQ ID NO: 147993 - protein, 114 aa, Glycine max
  Coding DNA Sequence Number=SeqID_56308
MEHFLEQVAWPEAQLPLVRPNEAASPEPTPVQVDPEPADPQSLVVNPPSSSELEVAPSSPPLIVISDASSDEAAAPPDSPAGETADPSTSPVGGIADLFDSSSGEVVALTDSPV

SEQ ID NO: 147994 - protein, 93 aa, Glycine max
  Coding DNA Sequence Number=SeqID_56309
MGITPTETPIGPEEVQQGPGVSSSGYGPLSALQGARSPPASSCRCGIGKECMSPPARSSGPPLPIELSSRSTAPPGRRKAKHHISIGMAGSGQ

SEQ ID NO: 147995 - protein, 252 aa, Glycine max
  Coding DNA Sequence Number=SeqID_56310
  Gene Ontology: Biological process=transposition, DNA-mediated
  Homolog annotation: Hit_ID=Q6UUU1; Match level="QueryCoverage=23%, HitCoverage=40%, E-value=3e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGCHMLIWAIKDSVYIWGGLIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 147996 - protein, 102 aa, Glycine max
  Coding DNA Sequence Number=SeqID_56311
  Homolog annotation: Hit_ID=A2Q2J0; Match level="QueryCoverage=40%, HitCoverage=3%, E-value=2e-08, Identity=65%"; Hit description=RNA -directed DNA polymerase (Reverse transcriptase); Ribonuclease H
MVLLRCVDVRRAEQMLVEVHEGSFGTHANRHAMVRKILRAGLTVGILKIKTFGLPLSEKGVLRAIPTEGNYAERPKVVLSPFPIERKCVERPEGLLSKSCKL

SEQ ID NO: 147997 - protein, 124 aa, Glycine max; identical to SEQ ID NO: 136775
  Coding DNA Sequence Number=SeqID_56312
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=79%, HitCoverage=75%, E-value=3e-25, Identity=66%"; Hit description=LacZ protein
  Subcellular localization annotation: CTP_CleavageSite=32; ConfidenceScore=5.06e-01

SEQ ID NO: 147998 - protein, 66 aa, Glycine max
  Coding DNA Sequence Number=SeqID_56313
MTCQRLKGSVSAQSVKFRNIPEGVQIATRPTWAFQDVPPEGGCFWRKQPSLPGRAGWQAPPLFSYK

SEQ ID NO: 147999 - protein, 139 aa, Glycine max
  Coding DNA Sequence Number=SeqID_56314
VMLVRVIRTRLFAAAQVKSCPGMHSSCVIASLSSCAHTVGRPPISGGKDVQPYEGEDVQSSEGEDVQSSEGEDMTYSPLKVRACSPLMARTCGVMKVRTYSHLKVRACSLLKARTCSPLKARACSPLKARTCSPLMART

SEQ ID NO: 148000 - protein, 67 aa, Glycine max
  Coding DNA Sequence Number=SeqID_56315
MKEIKRNWPCYPEDIDVWNWYDVGNPFWIPSDGQKSSVKLLLHFFYFQGGFGLHPSQFLFYRGTLGI

SEQ ID NO: 148001 - protein, 142 aa, Glycine max
  Coding DNA Sequence Number=SeqID_56316
  Subcellular localization annotation: CTP_CleavageSite=28; ConfidenceScore=5.20e-01
MWSLRFLFNLINSFTSKDPQGMYPPLFSLNNLVDVPSTRTDPQEMYPLLFLVTTTQVDVPSTCTTKDVLSNVLRQSSQAVSPLKLCEWGNKRILRRGRIKRILRLCRFEFFDKGEGRHKKIQAVSPLFFWKREKRDTKRIQA

SEQ ID NO: 148002 - protein, 52 aa, Glycine max
  Coding DNA Sequence Number=SeqID_56317
MTRTCSPQKARACSPLKTRTCSPLKARTGSPLEMITKDDDKGDDKKLKEQLK

SEQ ID NO: 148003 - protein, 192 aa, Glycine max
  Coding DNA Sequence Number=SeqID_56318
MASRDQVWSFCTHDTRRYLTVIRPPFAIQTQSCSMASRDQVWSFCTHDTRRYLTVIRPPFAIQTQSCLMASRDQVWSFCTHDTRRYLTVIRPPFAIQTQSCSMASRDQVWSFCTHDTRRYLMVIRTHSFAICKDRTLDSMQGLTQSSAPFVPPGTTKSFTCGNFMVARDSRQPRGAKLVSYTDFRGPLLDDM

SEQ ID NO: 148004 - protein, 73 aa, Glycine max
  Coding DNA Sequence Number=SeqID_56319
MATIALYGSKLAYDIRIWGESYKLFAAKFLSWLVFWFVLKVVFGHWVCGKHEGLVADLGMAFVDDWVRGTVIS

SEQ ID NO: 148005 - protein, 120 aa, Glycine max
  Coding DNA Sequence Number=SeqID_56320
  Homolog annotation: Hit_ID=A0PAV3; Match level="QueryCoverage=31%, HitCoverage=17%, E-value=5e-07, Identity=76%"; Hit description =Restriction endonuclease
MVKVGTSYVPINVSFSPKVGPGLPGINRDTRIYLFCEVIFRHSCPSCSATDGVGFPSHDVVKRRPVNCNTTHYRANWSSTAVAAALELVDPPGCRNSMLKKRGPTGGHTVLLGVNVSCSG

SEQ ID NO: 148006 - protein, 169 aa, Glycine max
  Coding DNA Sequence Number=SeqID_56321
  Subcellular localization annotation: CTP_CleavageSite=31; ConfidenceScore=5.12e-01
MVKVGTSYVPINVCIFAKSWPQPRGVSWFLSAVPPVQLLTGNWYPLTIRTQAYRAGTSARQSGCANLLGRAIGAGFAIKNRPTRRKGDVRKFAIKLGNARSVPSLAYCWRIGEKSSTAVASARTSGPRAEQEYSASSSLTQPTLGRSTAASGNGLRTGRRFPGRCQEDT

SEQ ID NO: 148007 - protein, 148 aa, Glycine max
  Coding DNA Sequence Number=SeqID_56322
  Subcellular localization annotation: CTP_CleavageSite=54; ConfidenceScore=5.47e-01
MNRVCMKGSVKRFGFSVGSRSPAPPHSPLVGRVVNLEGARLLFRRVFDNLAVVRSPLLEAGVLGRWGFLFLNQFGCVSPEIGWSNIYELAGQRWMEGKIDWSSSGTGPSIDHGAYSTLTEFILLKRNVKLLMLHFFGLESSRMLSVDF

SEQ ID NO: 148008 - protein, 81 aa, Glycine max
  Coding DNA Sequence Number=SeqID_56323
MLPLRRAFHSGNHSGCATVMTANGAIECGPFAIRQLALKGDVLILAITMLGTVQAARADGGRSRTGAEIPRKTAGMIFLTG

SEQ ID NO: 148009 - protein, 163 aa, Glycine max
  Coding DNA Sequence Number=SeqID_56324
  Pfam annotation: Domain name=G-patch; Domain location=56-100; Score =24.5; E_value=0.00021; Accession=PF01585.14; Description=G-patch domain
GRAFGYRIRRGRHLGELPILYAIYGGRRGVIRNRFPEVVSICSVYFFSGQPCLSDTAVMVARVMLGNGYEPVMGLGKDNGGITSLISAKGNRGKFGLGYKPTQADIRKSVAGRRSGSQGSRLRQEDEGSPPCHISRSFISVGLGDEGQVVAICEDDAPSGSDL

SEQ ID NO: 148010 - protein, 272 aa, Glycine max
  Coding DNA Sequence Number=SeqID_56325
MGEVEEVQKQMKADMEAMKEQMATMMEAMMSMKKIMKANAVAVAATSAFAKVNPMPPSGLNQMNHPTSDMVGMAGKELEGPGGPHLVRENKHAFPPYGFPPNYMPPNVAYTPNENANNFTPILIKSQQPQSDHAHVSRPMGETHEMPHHNLVDFEPRLGYATEGQAVGDIPLQNTLEGPQYHPQPHLLHFTAGKNPHAIEEMGKLDHLEESLRAIEGGEDYAFANLEELFLVPNIITPPKFKVLDFDKVQGDYLPQEPSKDVLSEDGGIRKR

SEQ ID NO: 148011 - protein, 107 aa, Glycine max
  Coding DNA Sequence Number=SeqID_56326
AIKQIPRYAKFLKELCTHKKKLKGNERISMGRNVSALIGKFVPHIPEKCKDPGNIHFYLIYILVIPYALNLNLSLNLILYLIFMLRMNLNLSLVLIFWVLYLLMLIF

SEQ ID NO: 148012 - protein, 106 aa, Glycine max
  Coding DNA Sequence Number=SeqID_56327
  Gene Ontology: Mol. function=tetracycline:hydrogen antiporter activity; Cellular component=integral to membrane; Biological process=response to antibiotic
  Homolog annotation: Hit_ID=A6WZJ4; Match level="QueryCoverage=100%, HitCoverage=25%, E-value=1e-46, Identity=91%"; Hit description=Major facilitator superfamily MFS_1
MHDPQVVRRGLLLVFMTLFLDIIGIAIIMPVLPTFLEELTGADISTAAVDGGWLLLVYAGMQFLFAPMIGNLSDRFGRRPVLLASIFTFRARQSDLCARTTYWMLF

SEQ ID NO: 148013 - protein, 116 aa, Glycine max
  Coding DNA Sequence Number=SeqID_56328
WLPHERRAPSEESITSFIARGFSDPNARVLQGVRKAWDVVRRKDKELRGSSNGIIGNYRKWLRVRTQGLDWLRKLRAARDEEAKAPEESEEVQALKAELERAWEVKEKFKSMAIKV

SEQ ID NO: 148014 - protein, 29 aa, Glycine max
  Coding DNA Sequence Number=SeqID_56329
GTKAGTGPPLEVDGIDKLDKTKYFESYER

SEQ ID NO: 148015 - protein, 212 aa, Glycine max
  Coding DNA Sequence Number=SeqID_56330
  Homolog annotation: Hit_ID=UPI00006A2D9E; Match level="QueryCoverage =75%, HitCoverage=83%, E-value=2e-11, Identity=20%"; Hit description =UPI00006A2D9E related cluster
HVLAIRGLHALTFRGLHVLAIRGLHALTFRGLQVLAIRGLHVLTFRRLHVLTFRGLHALAFRGLHALAFRGLHVLVFRGSHTFSFRGLHALAFKGRHVLNFRGLHALAFRGLRVLTFSGLHIHTLREFKGSRPQDTQWTRRSPIGPWGFQLWLRASVSPTGCPFPPNKGLRLQDTQCTQRSPTGSWGSSSDYGPLSVLQTARRPQQGHQAPY

SEQ ID NO: 148016 - protein, 96 aa, Glycine max
  Coding DNA Sequence Number=SeqID_56331
MASNSQQFSARNDAIVIRGVHEVATNPYASSETKKLEGKLDALVNLNMAQPPPERTLREMAAPDFTYESLIQYPDEESHYVHSKTEAPDSFASKVS

SEQ ID NO: 148017 - protein, 120 aa, Glycine max
  Coding DNA Sequence Number=SeqID_56332
MNSSSRERKETSHGKLQDLPDTPKQRPPSQGQLPPHTYYPLQEDDEGDAHLGPLLPLKDPAPHELPQPNIVRYVPSPSAPITELVPFAKDKGKIDLLEERLRVVESLGNYPFSDLADLCL

SEQ ID NO: 148018 - protein, 51 aa, Glycine max
  Coding DNA Sequence Number=SeqID_56333
MAEINQGTDASGDGVTTDQSLSFPGAKRAENVTAKQPSILCGCSFFYYCSF

SEQ ID NO: 148019 - protein, 229 aa, Glycine max
  Coding DNA Sequence Number=SeqID_56334
  Homolog annotation: Hit_ID=A6FJQ2; Match level="QueryCoverage=16%, HitCoverage=84%, E-value=7e-11, Identity=92%"; Hit description=50S ribosomal protein L5
MRKEKIPHQAPFAIQAAQLLGRAIGAGLFAITPAGERGMCCKAIKLGNARVFPVTTLSTHGILCACELFRYTVGSIPVESVHIFWRRLCFSDQGLCETEVSIKEEIDTISKRFDELDVSGKVTLKSKLREIAYPDHNSMCPSSSKYVDAFHSVQSSNSPVKRSASCSESPQPTKDHPDVGSICAILSRFIRDVVDVQSGLWSHEYMNLFGGTERFEQLKLSLLVDGFSK

SEQ ID NO: 148020 - protein, 74 aa, Glycine max
  Coding DNA Sequence Number=SeqID_56335
MDPKRIKVILEWPTPPSVEERIHEFQEPLDFRSNPFQGGGNDAILPPQGHWIEYSKKIGPKIQEKALRFSGAIG

SEQ ID NO: 148021 - protein, 55 aa, Glycine max
  Coding DNA Sequence Number=SeqID_56336
MCEMHMRKAQHENVHVKNGTQRVRSVPLLKGPMWEGANKAFSDNSQGGHISLEGL

SEQ ID NO: 148022 - protein, 76 aa, Glycine max
  Coding DNA Sequence Number=SeqID_56337
MAAEWRRKRERRRHFKEKMSLEEAHHHRRPWIRAWRKKEMNEGRGREEHEILCSKRALKSEPTNPRSIPRFSTKSA

SEQ ID NO: 148023 - protein, 95 aa, Glycine max
  Coding DNA Sequence Number=SeqID_56338
STLEDPENEPEGFPGGPSDPSVLTEYSDHVAGSVWTGEEHPELKLSSHGRKVHSLGRPVPAIEGLVAGIGLSPRIACLIDTGDRGLLSSFLERWH

SEQ ID NO: 148024 - protein, 178 aa, Glycine max
  Coding DNA Sequence Number=SeqID_56339
  Homolog annotation: Hit_ID=A2Q4S5; Match level="QueryCoverage=80%, HitCoverage=23%, E-value=2e-19, Identity=35%"; Hit description=IMP dehydrogenase/GMP reductase, putative
  Pfam annotation: Domain name=DUF1723; Domain location=95-144; Score =59.5; E_value=1.1e-14; Accession=PF08330.1; Description=Protein of unknown function (DUF1723)
PERTATADDAEIDRLASDGTTDDDEGFPGGPRDPSVLIGFADHVAHNIWSGQEQADLKLVSHGRKVDKFGRPAAEIEGMIAATGLDPLIRCSVITTDPGLISAFVERWHRETSSFHLPVGEVTITLYDISSLLHIPITGALHSFEPLATSDAVALLTELLEVTLDEATAETRQAGGPH

SEQ ID NO: 148025 - protein, 82 aa, Glycine max
  Coding DNA Sequence Number=SeqID_56340
MLADVDEERSDENHQTGQIQAKGPSGEGRRPRVEKDEGPEAETLSRLLITYQGNPCGVYPDLSSFTGSGVYPDLSSFTGSGL

SEQ ID NO: 148026 - protein, 92 aa, Glycine max
  Coding DNA Sequence Number=SeqID_56341
  Homolog annotation: Hit_ID=A5BGA4; Match level="QueryCoverage=94%, HitCoverage=34%, E-value=4e-14, Identity=39%"; Hit description =Putative uncharacterized protein
MLTYKRLDQWEIIGYSNSVYAETLDSLRSTSVPSTPLLLHPLLAAEFVTCYEASNHGTNSMVADPLIKGLPPKVFHEHVAHMCVLQFEESLV

SEQ ID NO: 148027 - protein, 102 aa, Glycine max
  Coding DNA Sequence Number=SeqID_56342
  Subcellular localization annotation: CTP_CleavageSite=53; ConfidenceScore=5.71e-01
MGSPPASTPHPPPPPPSDASASPSVVKRTRKTSHLRSLSTRPPGVERPVVHVDPATRKADDPHRKKLRTYLGIMARDKVNVTYKNWKEVPTAQKDLIWEDIQ

SEQ ID NO: 148028 - protein, 70 aa, Glycine max
  Coding DNA Sequence Number=SeqID_56343
MTSEFGRPQGSRPRPKREISSLSESIRVTNFGDQSCILLPRIRGSALEAIERQKLSKEARVHHFERLKSV

SEQ ID NO: 148029 - protein, 237 aa, Glycine max
  Coding DNA Sequence Number=SeqID_56344
  Gene Ontology: Mol. function=protein dimerization activity; Biological process=proteolysis
  Homolog annotation: Hit_ID=A0QCF4; Match level="QueryCoverage=32%, HitCoverage=22%, E-value=9e-33, Identity=91%"; Hit description =Succinyl-diaminopimelate desuccinylase
  Subcellular localization annotation: CTP_CleavageSite=77; ConfidenceScore=5.19e-01
MTVKTSDTCSSRRRSQLVCKRMPGADKPVRARQRVLAGVGAGLTMRHQSRLCVRRKYRIRRHSPFRLRNCWEGRSVRASSLLRQLAKGGCAARRLSWVTPGFSQSRRCKTTASAKLACLQVDSRGSPDGCTYREGLSAVRIDGGVAGNVIPDAAAVTVNFRFAPDRSVPDALQHVHDVLAGLDVQIEQTDAAAGAMPGLSQPAAKGYRARIRNHGHSCFLCEIVIRSQFHTTYEPEA

SEQ ID NO: 148030 - protein, 141 aa, Glycine max
  Coding DNA Sequence Number=SeqID_56345
MYFMKMASRKCKSIGSRPTARYDTRRFSSLDAWTRYTDNVVGRNILPERKVEIYHTEVDEFEAELERHNFHKRLTNLVDGSIDLALVKEFYANLYSSEDRPPKQYRVRGHLVKIDADSLNTFLETPVVLADGETLPVYSRY

SEQ ID NO: 148031 - protein, 84 aa, Glycine max
  Coding DNA Sequence Number=SeqID_56346
MVKEECKEVSVSSKRLAKKESHFSTKTKIKETFLLRQLPHFLLCKKTLVSIVTPLGLEVIPQVKELLDDDLVCKSLNPCALGIL

SEQ ID NO: 148032 - protein, 73 aa, Glycine max
  Coding DNA Sequence Number=SeqID_56347
MTDLVSVEDDQKNVYTDNHSGISARQRDSNVNMTDLVSAEDDGAEDDVSLCMLSGFLSYRYQKNVLKVRTTTW

SEQ ID NO: 148033 - protein, 123 aa, Glycine max
  Coding DNA Sequence Number=SeqID_56348
GPFDASPEIEIRGWWTLGDSVRRRRYVGELPLLRAKCGSSGGIIGNNFPILRGGTVMSPEWVWARTATGMPMWSTLGGTHTNMGWGRGGGNRRGISTRFAKFRATMPSPQDPPSQLEVYTADS

SEQ ID NO: 148034 - protein, 319 aa, Glycine max
  Coding DNA Sequence Number=SeqID_56349
  Gene Ontology: Mol. function=protein-N(PI)-phosphohistidine-sugar phosphotransferase activity; Cellular component=integral to membrane; Biological process=phosphoenolpyruvate-dependent sugar phosphotransferase system
  Homolog annotation: Hit_ID=P56580; Match level="QueryCoverage=100%, HitCoverage=100%, E-value=1e-152, Identity=85%"; Hit description =Glucitol/sorbitol-specific phosphotransferase enzyme IIB component
  Pfam annotation: Domain name=EIIBC-GUT_C; Domain location=226-318; Score=197.7; E_value=2.8e-56; Accession=PF07663.2; Description =Sorbitol phosphotransferase enzyme II
  Pfam annotation: Domain name=EIIBC-GUT_N; Domain location=2-171; Score=387.7; E_value=1.8e-113; Accession=PF03612.5; Description =Sorbitol phosphotransferase enzyme II
  Pfam module annotation: Pfam domain module=EIIBC-GUT_C::EIIBC-GUT_N; Domain location=226-318::2-171
MSRIRIEKGTGGWGGPLEFDATEGKKIVYITAGTRPAIVDKLRGLTGWEAVDGFKEGEPPEAEIGVAVIDCGGTLRCGLYPKRRIPTVNIHSTGKSGPLAQYILEDIYVSGVKEDNITLVNGTSAPQKAAPRDYDTSKKITEQSDGLLAKVGMGMGSAVAVLFQSGRDTIDTVLKTILPFMAFVSALIGIIMASGLGDWIAHGLAPLASHPLGLVTLALICSFPLLSPFLGPGAVIAQVIGVLIGVQIGLGNIPPHLALPALFAINAQAACDFIPVGLSLAEARQDTVRVGVPSVLVSRFLTGAPTVLIAWFVSGFIYQ

SEQ ID NO: 148035 - protein, 135 aa, Glycine max
  Coding DNA Sequence Number=SeqID_56350
VDNSAPIPIESHQPQSNHAHVSQSMGETHEAPRDHSLADFEPHLRYVTEGQAFCSVPLPNTLGGPQYRPQPQPLHFAVGRVPPIMVEREKFDHMEERLRVIEGGENYAFVDMAELCLLLDMVIPPKFKVSNFDKY

SEQ ID NO: 148036 - protein, 311 aa, Glycine max
  Coding DNA Sequence Number=SeqID_56351
  Gene Ontology: Mol. function=4-aminobutyrate transaminase activity; Cellular component=cytoplasm; Biological process=gamma-aminobutyric acid metabolic process
  Homolog annotation: Hit_ID=Q6F767; Match level="QueryCoverage=100%, HitCoverage=72%, E-value=1e-121, Identity=68%"; Hit description=4 -aminobutyrate aminotransferase, PLP-dependent
  Pfam annotation: Domain name=Aminotran_3; Domain location=27-311; Score=327.9; E_value=1.8e-95; Accession=PF00202.12; Description =Aminotransferase class-III
MEGKNSQLQQRKDDALPRGTGNLCQWYVDQAENATLRDVEGNSWIDFAGGIAVLNTGHRHPRIVQAIADQLAKFTHTAFQVTPYESYVALAERINQRVPIAGKAKTAFFTTGAEAVENAVKVARAATRRHGIITFGNAFHGRTFMTMAMTGKVAPYKRDFGPMPASVFHARYPNAVTGISVEDAIASLHDLFSHDIAPQDVAAIVLEPVQGEGGFHIAPAEFLTQLRALADEHGILLIADEVQSGFGRTGKLFAMEHYSVQPDLITMAKSLAGGMPLSAVSGRADIMDAPGPGGLGGTYAGNPLSIAAAHA

SEQ ID NO: 148037 - protein, 108 aa, Glycine max
  Coding DNA Sequence Number=SeqID_56352
EIVRLHDLPRSIVSDRDSVTSWKFLSGILFLEAFSSSPTLLFFSLSPPPLLPIKAPNFAHHFYSKLQREAIFGVVKRTSTLWDFEFQVWVDFFSHEIRGYSVFGRYDG

SEQ ID NO: 148038 - protein, 293 aa, Glycine max
  Coding DNA Sequence Number=SeqID_56353
MLFHLGRARHVLEARRAEQVEVVLGLDLAGEDVVERRGLRQVRHGLRPARTLGLHRGQQRRMTVRLPVAPGCRPRRGRRQQVCLYCSTAASTSPWRRCVRPAARPPEDGRSATRHCPDRPRARQRRAPAKPPCAHRAAAQAGGNNAPLATPTSAAAARSTAYREDVGPRRHSSDGTSTGTSSGTGDHGEGQVGRRLDIGAAGPSAPPARGAWPAIARAGPAARLPAWRRPGRPAARRFCEAEPSSYRRWVSQRTPWRASTTCFSVNATRSASDAEVMAPVTMLPARERRADSS

SEQ ID NO: 148039 - protein, 196 aa, Glycine max
  Coding DNA Sequence Number=SeqID_56354
MSVLELYIEKDVASGSMFHSANSLTSCGNYLSNDDTQSPTNMSNLNLDEDDDHDDDDYLVSNSYVEESLDEDDSVDGISDTDNEVPDMIPPVRIVHPAEGVQGIQNPFWNDALHYNNINWSHLDEEDIYGLEMPSSFNVGQELYVGMEFDSKDAVKNEVKQYVMKVHQSIKVVESKWDKHDQRRSIHKSFIDSRED

SEQ ID NO: 148040 - protein, 997 aa, Glycine max
  Coding DNA Sequence Number=SeqID_56355
  Gene Ontology: Mol. function=catalytic activity; Cellular component =nucleus; Biological process=metabolic process
  Homolog annotation: Hit_ID=A7PZB8; Match level="QueryCoverage=87%, HitCoverage=99%, E-value=0.0, Identity=66%"; Hit description =Chromosome chr15 scaffold_40, whole genome shotgun sequence
  Pfam annotation: Domain name=PPR; Domain location=236-270; Score =14.7; E_value=0.14; Accession=PF01535.11; Description=PPR repeat
  Pfam annotation: Domain name=PPR; Domain location=306-339; Score =10.8; E_value=0.4; Accession=PF01535.11; Description=PPR repeat
  Pfam annotation: Domain name=PPR; Domain location=340-374; Score =18.5; E_value=0.026; Accession=PF01535.11; Description=PPR repeat
  Pfam annotation: Domain name=PPR; Domain location=442-476; Score =49.1; E_value=1.5e-11; Accession=PF01535.11; Description=PPR repeat
  Pfam annotation: Domain name=PPR; Domain location=477-511; Score =44.1; E_value=4.9e-10; Accession=PF01535.11; Description=PPR repeat
  Pfam annotation: Domain name=PPR; Domain location=588-622; Score =26.9; E_value=7.6e-05; Accession=PF01535.11; Description=PPR repeat
  Pfam annotation: Domain name=PPR; Domain location=692-726; Score =44.8; E_value=3.1e-10; Accession=PF01535.11; Description=PPR repeat
  Pfam annotation: Domain name=PPR; Domain location=727-760; Score=9.1; E_value=0.65; Accession=PF01535.11; Description=PPR repeat
  Pfam annotation: Domain name=PPR; Domain location=763-797; Score =12.9; E_value=0.23; Accession=PF01535.11; Description=PPR repeat
  Pfam annotation: Domain name=PPR; Domain location=829-863; Score=7.7; E_value=0.96; Accession=PF01535.11; Description=PPR repeat
  Pfam module annotation: Pfam domain module=PPR::PPR::PPR::PPR::PPR::PP R::PPR::PPR::PPR::PPR; Domain location=236-270::306-339::340-374::442- 476::477-511::588-622::692-726::727-760::763-797::829-863
MWRLRDIKLISPRVETKYNKNENLGKVEWRSCRKGERRCFLRRNHSNGYQQGQGVGYSHRERVRRGTRRSRASTSSVRVYDQHQPQHRPPWTDFDVAYYHSYAHLGIHQEMIKDRVRTETYRDAIMQHQSSIAGKQLHHRYRCSISMLLRCFPIKSKLLQSQFTNTRLLSCATIPITALKECNSLAHAKLLHQQSIMQGLLFHLATNLIGTYIASNSTAYAILLLERLPPSPSSVFWWNQLIRRALHLGSPRDVFTLYRQMKSLGWTPDHYTFPFVFKACANLSSLSLGASLHATVSRSGFASNVFVCNAVVSMYGKCGALRHAHNMFDDLCHRGIQDLVSWNSVVSAYMWASDANTALALFHKMTTRHLMSPDVISLVNILPACASLAASLRGRQVHGFSIRSGLVDDVFVGNAVVDMYAKCGKMEEANKVFQRMKFKDVVSWNAMVTGYSQAGRLEHALSLFERMTEENIELDVVTWTAVITGYAQRGQGCEALDVFRQMCDCGSRPNVVTLVSLLSACVSVGALLHGKETHCYAIKFILNLDGPDPGADDLKVINGLIDMYAKCQSTEVARKMFDSVSPKDRDVVTWTVMIGGYAQHGDANNALQLFSGMFKMDKSIKPNDFTLSCALVACARLAALRFGRQVHAYVLRNFYGSVMLFVANCLIDMYSKSGDVDTAQIVFDNMPQRNAVSWTSLMTGYGMHGRGEDALRVFDEMRKVPLVPDGITFLVVLYACSHSGMVDHGINFFNRMSKDFGVDPGPEHYACMVDLWGRAGRLGEAMKLINEMPMEPTPVVWVALLSACRLHSNVELGEFAANRLLELESGNDGSYTLLSNIYANARRWKDVARIRYTMKRTGIKKRPGCSWIQGRKGVATFYVGDRSHPQSQQIYETLADLIQRIKAIGYVPQTSFALHDVDDEEKGDLLFEHSEKLALAYGILTLHPRAPIRITKNLRICGDCHSAITYISKIIEHEIILRDSSRFHHFKNGSCSCKGYW

SEQ ID NO: 148041 - protein, 318 aa, Glycine max
  Coding DNA Sequence Number=SeqID_56356
  Gene Ontology: Mol. function=protein serine/threonine kinase activity; Cellular component=cytoplasm; Biological process=protein amino acid phosphorylation
  Homolog annotation: Hit_ID=P93323; Match level="QueryCoverage=100%, HitCoverage=100%, E-value=1e-148, Identity=82%"; Hit description =Cdc2MsF protein
  Pfam annotation: Domain name=Pkinase; Domain location=13-310; Score =263.4; E_value=4.8e-76; Accession=PF00069.16; Description=Protein kinase domain
  Pfam annotation: Domain name=Pkinase_Tyr; Domain location=13-308; Score=-4.4; E_value=4e-12; Accession=PF07714.8; Description=Protein tyrosine kinase
  Pfam module annotation: Pfam domain module=Pkinase::Pkinase_Tyr; Domain location=13-310::13-308
MEKTGVLSAKEAFEKLEKVGEGTYGKVYRAREKATGKIVALKKTRLHEDEEGVPPTTLREVSILRMLSRDPHVVRLMDVKQGQNKEGKTVLYLVFEYMDTDLKKFIRSFRQSGETIPPHIIKSLMYQLCKGVAFCHGHGILHRDLKPHNLLMDRKTMMLKIADLGLARAFTVPIKKYTHEILTLWYRAPEVLLGATHYSMAVDMWSVGCIFVYVRLRVYYCYLPSLVYVRLRVYYCYLPSLVLLGTPNEDVWPGVSKLMNWHEYPQWNPQSLSTAVPSLDELGLDLLSQMLKYEPSKRISAKKAMEHVYFDDLDKRHL

SEQ ID NO: 148042 - protein, 447 aa, Glycine max
  Coding DNA Sequence Number=SeqID_56357
  Gene Ontology: Mol. function=hydrolase activity, acting on acid anhydrides, in phosphorus-containing anhydrides; Cellular component =nucleus; Biological process=nucleobase, nucleoside, nucleotide and nucleic acid metabolic process
  Homolog annotation: Hit_ID=A7QPD2; Match level="QueryCoverage=98%, HitCoverage=34%, E-value=1e-171, Identity=67%"; Hit description =Chromosome chr18 scaffold_137, whole genome shotgun sequence
  Pfam annotation: Domain name=DEAD_2; Domain location=135-299; Score =220.0; E_value=5.6e-63; Accession=PF06733.6; Description=DEAD_2
MISASNPNPKNVYHIGGLQVEFPYQPYGSQFAFMGRVISTLNRAQKEGHCHALLESPTGTGKSLSLLCSSLAWQHHYKSQHHHLKSAHEATADPLAYGGGFVPDEVPLSSESLDRTQSEGNNKKQKKKEAPTIYYASRTHSQISQVVRELRKTAYRVPMAVLASRKHYCTNKNIMGKENINDECKLLLKDQATGCPEFKNAHKVKGHPSLHKGGCNEVHDIEDLVKVGQLVKGCSYYAARSMSDDAQLVFCPYNYIINPVIRAAMDVDIKGAIVILDEAHNIEDIARDAGSVDIEEDVVDSMLNYMVIPLKELQMELQQLCSIKAEIYQPLYEMTQGLTSWMEQKKNKLEKRDFQHYVSCWTGDKALRELEEANISKQCFPILLECATKAIKVATDLETDAPHISAMSVITLEGLFSSLTYFFSRNGSHMLDYQLALQRCIREDTGK

SEQ ID NO: 148043 - protein, 982 aa, Glycine max
  Coding DNA Sequence Number=SeqID_56358
  Gene Ontology: Mol. function=protein binding; Cellular component =postsynaptic membrane; Biological process=cell adhesion
  Homolog annotation: Hit_ID=A7QPB6; Match level="QueryCoverage=72%, HitCoverage=90%, E-value=0.0, Identity=67%"; Hit description =Chromosome chr18 scaffold_137, whole genome shotgun sequence
  Pfam annotation: Domain name=BACK; Domain location=449-572; Score =7.0; E_value=0.00015; Accession=PF07707.6; Description=BTB And C -terminal Kelch
  Pfam annotation: Domain name=BTB; Domain location=196-294; Score =45.3; E_value=2.2e-10; Accession=PF00651.22; Description=BTBPOZ domain
  Pfam annotation: Domain name=BTB; Domain location=330-443; Score =87.7; E_value=3.6e-23; Accession=PF00651.22; Description=BTBPOZ domain
  Pfam module annotation: Pfam domain module=BACK::BTB::BTB; Domain location=449-572::196-294::330-443
MSAKFLTVPPFECAWREDLKFREAGRGCVAFEAFACNDVTLVFRENVGSQGYHYKRDSSPHYTIILGSHRNRRLRIEVNGKAVVDVAGVGLCCSSSFQSYWISIYDGLISIGNGKYPFQDVVFQWLDSYPNCNVQYIGLSSWDKHVKYRNVNVLSLTHTHVPLSKHVVFGDYQVEDEVDAADCYNYKNMDYDKWGLKKFLESWDLSDVLFIVGKEEKPVPAHKAILAASGKFSLCSSSFVINLPTVSYLLFRALLHYIYVGWTQEQLGSLRDLSLQFEVTPLVKQCEETMERFKLDKKLFDTGKNVELTYPSIRPHCSTLPSLPVSTQQLKQLKLTGQYSDVNIYIEGYGLIARAHKIVLSLWSIPFARMFTNGMSESMSSEVTLRDVPPEAFKAMLNFLYDGQLNDKVIDSGALLLQLLLLADQFGVTFLQQECCKMLLECLSEDSVCPLLQVVSSMPSCRLIKESLQRRISMNFDYYISASTDFVLLDETTLINIIKHPDLTVTSEEKVLNAILMFGMNAKQLFGWEVVDQLMENSKPELLFGERLQLIYDLLPFVRFPLLQYSLLEKLQHSSIGRHIPVFQNLVNEAINFVKCGLAESENEEKELQYICDGDDHGVLYFAGTSYGEHPWVNPLLAEPRKITITASSPHSRYTDPKVLVSRTYQGTCFAGPRLENGQNCSWWMVDLGQDHQLMCNYYTLRQDGSKAFPRCWNVQEPPPMPPIPGISAFVTWNCMATSFKSLAMPIPYLPKIQFQLLHAQAQDKGSGMGEDEMESKTVILQGSLIHFSQNLTSTAGREFTEFATEPSMQRQVVEALHSGDRKKASDLLSDFGSRSRHSLTADHFVHIFEYCARSPDPLFVMEILRFMELKGVSMNNICSSLMMQALCNGGYLEEAFDIVDYLGGSQRLYPVLPLYNSLLRSCTTMQNIIQASRCLDLMEKKMVGKNEVTYIELLKTDNVRLRDHFNPFSNCGMSLHIYLTA

SEQ ID NO: 148044 - protein, 189 aa, Glycine max
  Coding DNA Sequence Number=SeqID_56359
  Homolog annotation: Hit_ID=A5C0F9; Match level="QueryCoverage=68%, HitCoverage=33%, E-value=2e-19, Identity=35%"; Hit description =Putative uncharacterized protein
MDNVLVASEIIHCLKSKRSGGFEELSLKVDINKAKDRINWGYLRVVMIKIMESNLVWVKKIMFSNTDDARRNLLSNILGVHARIGAEKYLGMPLIIGKNRRSTFGFVKDKAILTYVMSAYLLPKSTMEEFQGNKGGGLSLSPTDMVALRRRIGDGVNINVWSQHWINNETSGPIGDVPHSQSKSWWLKI

SEQ ID NO: 148045 - protein, 382 aa, Glycine max
  Coding DNA Sequence Number=SeqID_56360
  Gene Ontology: Mol. function=isomerase activity; Cellular component =cellular_component; Biological process=tRNA processing
  Homolog annotation: Hit_ID=Q8GW59; Match level="QueryCoverage=88%, HitCoverage=76%, E-value=4e-79, Identity=44%"; Hit description =Putative uncharacterized protein At1g20410/F5M15_23
MEKEAELGEKEFEQMVRALPSDAVKELLSHGVCTRCIFRLFGLQGPVYASPPSLSSLFDATQQDCLCTLCLGILQFTYSNVQNDNLPLLIADMVKRQAYQFDTFSLEVSIPPIIIDDLLYENQIWIPTLVPRKLAQWMHLYKGRLKIFSYLSSSKSSGEPSIVGERSFSSTLENDSSDCCKFLLEKANEPCHFTYSCYRTPFYFGGRYLKYSRNVSQTRWIIDDERMGEASVEEIIGGNILQACQGDSFKFHAAGREDIDVRMLGPGRPFLVEVQNGRHIPSELFVKDIEKTINKMENKLVRVKNLKLVGSDGWNLMREGEAEKQKQYAALVWISRPLKDEDIQCVSSLKDLLEQVSLVGINTNEHLQPGHSVIPIVLLPKS

SEQ ID NO: 148046 - protein, 404 aa, Glycine max
  Coding DNA Sequence Number=SeqID_56361
  Gene Ontology: Mol. function=protein serine/threonine kinase activity; Cellular component=mitochondrion; Biological process =protein amino acid phosphorylation
  Homolog annotation: Hit_ID=A7NVU0; Match level="QueryCoverage=98%, HitCoverage=52%, E-value=1e-116, Identity=56%"; Hit description =Chromosome chr18 scaffold_1, whole genome shotgun sequence
  Pfam annotation: Domain name=PPR; Domain location=158-192; Score =29.2; E_value=1.5e-05; Accession=PF01535.11; Description=PPR repeat
  Pfam annotation: Domain name=PPR; Domain location=193-227; Score =26.7; E_value=8.6e-05; Accession=PF01535.11; Description=PPR repeat
  Pfam annotation: Domain name=PPR; Domain location=228-262; Score =26.7; E_value=8.8e-05; Accession=PF01535.11; Description=PPR repeat
  Pfam annotation: Domain name=PPR; Domain location=263-297; Score =12.5; E_value=0.26; Accession=PF01535.11; Description=PPR repeat
  Pfam annotation: Domain name=PPR; Domain location=43-77; Score=18.9; E_value=0.02; Accession=PF01535.11; Description=PPR repeat
  Pfam module annotation: Pfam domain module=PPR::PPR::PPR::PPR::PPR; Domain location=158-192::193-227::228-262::263-297::43-77
MQQKNLKPYDSTLASLSITCSKALQLDLAEAFLNQISECLYPNPYNALLASCDQLNQLERAIRVFAKMEQKKVLPNIRTCELLFSLFGVVNGHYEDSDALSKDRNGILFIYIAYDLAMFFGSFQMRALGEEGMIKELIQYLHVAENLFIYRNPSLGTHMYNTVLHYLVEAKESDTVIAIFKKMKLCGCHPDSETYNIMIDCCTILKSYRSACLLLSMMIRKGFHPVICTYNAIIEILLEDENFNEALNLLKQVILDGIQPDVLLFNTVLKEACYKGRIDVIEFIVECMRREKVPPDTRTCGYVFSAYVDSGFHNTAIEALQVLSLRMMSEDGNILRENTNFVNEFILSEDVAVVESQILKLFEDSEDELAIGLLNLRWCAIAGFPICKSADQSLWAKRLEGMQL

SEQ ID NO: 148047 - protein, 66 aa, Glycine max
  Coding DNA Sequence Number=SeqID_56362
MAPLQTALLHMVAAEDYQDLPTCCTSMSLAPSFPSVKHRVEERKERTGYSDSEREQEREEEGGGNY

SEQ ID NO: 148048 - protein, 315 aa, Glycine max
  Coding DNA Sequence Number=SeqID_56363
  Gene Ontology: Mol. function=protein binding; Cellular component =cytoskeleton; Biological process=ubiquitin-dependent protein catabolic process
  Homolog annotation: Hit_ID=Q155U2; Match level="QueryCoverage=33%, HitCoverage=67%, E-value=5e-35, Identity=71%"; Hit description=SKP1 -like b
  Pfam annotation: Domain name=Skp1_POZ; Domain location=198-260; Score= 95.7; E_value=1.5e-25; Accession=PF03931.6; Description=Skp1 family, tetramerisation domain
MAPLQTALLLMVAAEDYQDLPTCCTSVGGGKEGEGGILRVREGTGERGGGGHGGVVHDVNGDGGFVVDFERQDTTLSLPPSFSHYSVSCTSFSHHSRSDLLPLLLQEAEPGGETELREHPSGVQGDHHGQGLRSEEDGGGGGWGCWYTIWDVELATREFVEGNVIGEGGYAVVYRGVLHDASVVNILNNKEIEMASTKKITLKSSDGETFEVEEAVAVAVESQTIKLMIEDNCADSGIPLPNVTSKILAKVIDYCKKHVEANCADEKPSEDELKAWDADFVKVDQATLFDLILEPDFYTVLVEPQESFGINEAPV

SEQ ID NO: 148049 - protein, 111 aa, Glycine max
  Coding DNA Sequence Number=SeqID_56364
  Gene Ontology: Mol. function=protein serine/threonine kinase activity; Cellular component=plasma membrane; Biological process =protein amino acid phosphorylation
  Homolog annotation: Hit_ID=Q38868; Match level="QueryCoverage=75%, HitCoverage=16%, E-value=8e-26, Identity=68%"; Hit description =Calmodulin-domain protein kinase CDPK isoform 9
MNWSTSETEKGMFDAILEGMLDMDNEPWPSISESAKDLVRKMLTCDPKECITTADALGGEASDKHPDSAVLIRMKWFRAMNQMKKLALKGSSRKSFKGRNKGPETYVQLHL

SEQ ID NO: 148050 - protein, 715 aa, Glycine max
  Coding DNA Sequence Number=SeqID_56365
  Gene Ontology: Mol. function=protein serine/threonine kinase activity; Cellular component=plasma membrane; Biological process =protein amino acid phosphorylation
  Homolog annotation: Hit_ID=A7NVN1; Match level="QueryCoverage=98%, HitCoverage=99%, E-value=1e-175, Identity=64%"; Hit description =Chromosome chr18 scaffold_1, whole genome shotgun sequence
  Pfam annotation: Domain name=Pkinase; Domain location=281-522; Score =314.1; E_value=2.5e-91; Accession=PF00069.16; Description=Protein kinase domain
  Pfam annotation: Domain name=Pkinase; Domain location=75-275; Score =108.2; E_value=2.4e-29; Accession=PF00069.16; Description=Protein kinase domain
  Pfam annotation: Domain name=Pkinase_Tyr; Domain location=281-520; Score=-51.6; E_value=3e-09; Accession=PF07714.8; Description=Protein tyrosine kinase
  Pfam annotation: Domain name=efhand; Domain location=569-597; Score =37.8; E_value=3.8e-08; Accession=PF00036.23; Description=EF hand
  Pfam annotation: Domain name=efhand; Domain location=605-633; Score =30.3; E_value=7.2e-06; Accession=PF00036.23; Description=EF hand
  Pfam annotation: Domain name=efhand; Domain location=641-669; Score =32.2; E_value=1.8e-06; Accession=PF00036.23; Description=EF hand
  Pfam annotation: Domain name=efhand; Domain location=676-704; Score =39.8; E_value=1e-08; Accession=PF00036.23; Description=EF hand
  Pfam module annotation: Pfam domain module=Pkinase::Pkinase::Pkinase _Tyr::efhand::efhand::efhand::efhand; Domain location=281-522::75 -275::281-520::569-597::605-633::641-669::676-704
MGLGMFKALFCCSKPHEIDIADSWDSSPDHTPKQHSKPKPKPNAAPTHSNNKQTTTSTQIGAILGKPYVNIHQMYEMKKELGSGQSGVTYLCVEKTTKREYACKSISRSKLLSTQEIEDVRREVMILQHLSGQPNIVEFRGAYEDKQNVHLVMELCSGGELFDRIIAKGNYSEREAATVMRQIVNVVHVCHFMGVMHRDLKPENFLLATNHPDAAVKATDFGLSIFIEEDSRRTQQPQLQPQPGYPNRTPKSDPSPSSSSFGDQVAARILDKPYFDIKSLYNLERELGRGQFGITRLCTEKTTGRKYACKSIPKRKLSKKKHTDDVKREVLILQHLSGQPNIVEFKGAYEDWQHVHLVMELCLGGELFDRITAKGSYSESEAASIFRQIVNVVHACHFMGVMHRDLKPENFLLANKDPKAPLKATDFGLSVFIEEEIVGSAYYVAPEVLKRNYGKEIDVWSAGIILYILLSGVPPFWGGKLDLESAPWPSISAAAKDLIRKMLNNDPKKRITAAEALEHPWMKEGGEASDKPLDNAVLTRMKQFRAMNKMKKLALKVIAENLSEEEIKGLKQMFNNMDTDRSGTITFEELKSGLTKLGSKLSESEIKQLMDAADVDKSGTIDYQEFITATINRHKLEKEENLFKAFQYFDKDSSGYITRDELRQALTEYQMGDEATIDEVIDDVDTDNDGKINYQEFVAMMRKGILDIDEKEKPQ

SEQ ID NO: 148051 - protein, 273 aa, Glycine max
  Coding DNA Sequence Number=SeqID_56366
  Gene Ontology: Mol. function=glutamate-1-semialdehyde 2,1-aminomutase activity; Cellular component=chloroplast; Biological process =tetrapyrrole biosynthetic process
  Homolog annotation: Hit_ID=A7PHL3; Match level="QueryCoverage=99%, HitCoverage=84%, E-value=3e-98, Identity=58%"; Hit description =Chromosome chr17 scaffold_16, whole genome shotgun sequence
  Pfam annotation: Domain name=Aminotran_3; Domain location=1-245; Score=-4.4; E_value=2.9e-14; Accession=PF00202.12; Description =Aminotransferase class-III
MKKGTSVGAPCLLENTLAEMVISAVPSIEMIRSVNSGTEACMGALRLARAFTGKQKIIKFEGCSHAMLILFLLRQLTSNTLTALFNDILAIEKLFENHKGEIAALILEPAVGNSGFIVPKLEFLDTIRKIIKENNALLIFDEVMTGFQLSYGGAQEYFGIVPDLKTLGNIIVSGLPADTLSGNPLAMAAGIEAQKLIKEAGTYEYLDEVTGELVQGILQSDLAKFASFYRGMLEQGVYFASSQFEAGFTSLAHTTEDIKMTIAAAERVLRQIG

SEQ ID NO: 148052 - protein, 140 aa, Glycine max
  Coding DNA Sequence Number=SeqID_56367
  Gene Ontology: Cellular component=extracellular region; Biological process=cellulose and pectin-containing cell wall organization and biogenesis
  Homolog annotation: Hit_ID=Q8GZD3; Match level="QueryCoverage=72%, HitCoverage=39%, E-value=8e-53, Identity=98%"; Hit description =Expansin
  Pfam annotation: Domain name=Pollen_allerg_1; Domain location=48-125; Score=167.2; E_value=4.2e-47; Accession=PF01357.12; Description =Pollen allergen
MEAGATHHSSILIWPNPLGKRLVFTEEGSSPCYSKGLNMVPCKKHGGVRFSVNGRDYFELVLISNVGGAGSIQSVSIKGSKTGWMAMSRNWGSNWQSNAYLNGQSLSFRVTTTDGETRVFQDIVPASWTFGQTFSSPVQF

SEQ ID NO: 148053 - protein, 316 aa, Glycine max
  Coding DNA Sequence Number=SeqID_56368
  Gene Ontology: Mol. function=oxidoreductase activity; Cellular component=extracellular region; Biological process=hydrogen peroxide catabolic process
  Homolog annotation: Hit_ID=A7NVL9; Match level="QueryCoverage=100%, HitCoverage=98%, E-value=1e-136, Identity=76%"; Hit description =Chromosome chr18 scaffold_1, whole genome shotgun sequence
  Pfam annotation: Domain name=peroxidase; Domain location=38-283; Score=445.8; E_value=5.7e-131; Accession=PF00141.14; Description =Peroxidase
MATIATVMLITMSLASLVSALNVNYYENACPHNVDSIVAAAVHKATMNDKTVPAALLRMHFHDCFIRGCDASVLLESKGKKKAEKDGPPNISLHAFYVIDNAKKAVEAVCPGVVSCADILALAARDAVALSGGPTWDVPKGRKDGRISKATETRQLPAPTFNISQLQQSFSQRGLSLEDLVALSGGHTLGFAHCSSFQNRIHKFSQKLEIDPSLNPSFARSLRGICPSHNKVKNAGSSLDSSSTLFDNAYYKLLLQGKSLFSSDQALLTHPTTKALVSNFADSQEEFERAFVKSMIKMSSITNGGQEIRLNCKLVR

SEQ ID NO: 148054 - protein, 341 aa, Glycine max
  Coding DNA Sequence Number=SeqID_56369
  Gene Ontology: Mol. function=hydrolase activity, acting on ester bonds; Cellular component=cellulose and pectin-containing cell wall; Biological process=lipid metabolic process
  Homolog annotation: Hit_ID=A7NSS0; Match level="QueryCoverage=93%, HitCoverage=90%, E-value=4e-86, Identity=51%"; Hit description =Chromosome chr18 scaffold_1, whole genome shotgun sequence
  Pfam annotation: Domain name=Lipase_GDSL; Domain location=10-318; Score=158.3; E_value=2.1e-44; Accession=PF00657.13; Description=GDSL- like LipaseAcylhydrolase
MAVNGTIPALFSFGDSILDTGNNNNLQTLTKCNFPPYGIDFQGGIPTGRCCNGKTPTDLIATALGIKETVAAYLSGNLSPQDLVTGVCFASAGSGIDDLTAQIQGVLSLPTQLGMFREYIGKLTALVGQQRAANIISNSVYLVSAGNNDIAITYSQILATTQPFPLYATRLIDTTSNFLKSLYELGARRVWVLSTLPLGCLPGGRTVAGGPLRICAPFANLFAQTFNGQLSSAVNSIRTTLPNYDIRFIDVYTPLFNLINNPQPEGFVDVSEGCCGTAPFGVSGICSLFSLCPNPSSYVFWDSAHPTERAYKFVVSTILQSHTNNVSSSFAFAPFNSSLSN

SEQ ID NO: 148055 - protein, 144 aa, Glycine max
  Coding DNA Sequence Number=SeqID_56370
MKLLLKLCLEQITKGERLGSSFTKDETISGTLLMHQMNGGRPNNWYKGLPIAHQLTILFKDVVTTRDFMWAPSSGILPSTLGGDVNDVYRPYLDGININMGEGSRDSDDVSVGVTNEFGDININASQVTGSQAIGSQKSGEKCK

SEQ ID NO: 148056 - protein, 490 aa, Glycine max
  Coding DNA Sequence Number=SeqID_56371
  Homolog annotation: Hit_ID=A5B1D7; Match level="QueryCoverage=22%, HitCoverage=24%, E-value=8e-08, Identity=36%"; Hit description =Putative uncharacterized protein
MEKAEKDRREKKEKKREKKERKREKKEKKERRKAEKERKLKDGASACPGTDDGKKFKLINELKETKADGKLQKGEDSENEQHERSGITEELDLPVTSVEPCCLSDCTQSSKRKRSSPESTHDHGEEGSAIKIRLPLRKHREPEELKSKSKFQAGCSSGSVGETANSFTKTTLGSDRQSQCLRITELNRVLGNSDSRHGKAMQNSVHGDVVVTKNTIGSNRQSQCHRTTEPKHVIGNSGKVMQNSVHGDAAVIKNTIGSDRQSQCLRTTEPKRVLGNSGKVMQNSVHGDAAVIKNSIGSDCQSQCLGTTVPKRVLGNSVKAMQAVHGDAVVTKKNLGSDQYLRVTEPKRVLGNSDSRNGKAKQNPVHGDAVVTKNTFGSDHQLKSLEITEPKRILGNSDSKHCKALQNLVPGSQKVESLYESLLQIPPLTYDGLDSVYDDWLFSSEPKESRPVSKKQKCDSDVFQLSNSMWPRAQYLPEVEVYALPYAVPF

SEQ ID NO: 148057 - protein, 887 aa, Glycine max
  Coding DNA Sequence Number=SeqID_56372
  Gene Ontology: Mol. function=unfolded protein binding; Cellular component=endoplasmic reticulum lumen; Biological process=protein folding
  Homolog annotation: Hit_ID=P35016; Match level="QueryCoverage=96%, HitCoverage=99%, E-value=0.0, Identity=74%"; Hit description =Endoplasmin homolog precursor
  Pfam annotation: Domain name=HATPase_c; Domain location=129-285; Score=56.1; E_value=1.2e-13; Accession=PF02518.17; Description =Histidine kinase-, DNA gyrase B-, and HSP90-like ATPase
  Pfam annotation: Domain name=HSP90; Domain location=338-882; Score =1154.6; E_value=0; Accession=PF00183.9; Description=Hsp90 protein
  Pfam module annotation: Pfam domain module=HATPase_c::HSP90; Domain location=129-285::338-882
MRKWTVASALLLLSLLFLFADQGMPLHNSLFFYTLRMLLFEFLYAPAFGFLGRKFQANAEGDSDELVDPPKVEDKIGAVPHGLSTDSDVVKREAESISKRSLRSNAEKFEFQAEVSRLMDIIINSLYSNKDIFLRELISNASDALDKIRFLSLTDKEVLGEGDNTKLDIQIKLDKEKKILSIRDRGIGMTKEDLIKNLGTIAKSGTSAFVEKMQTSGDLNLIGQFGVGFYSVYLVADYVEVISKNNDDKQYVWESKADGAFAISEDTWNEPLGRGTEIRLHLKEEAGEYLEESKLKSPSHSLHLGVIYFEVYLIYGHACICYFILTSVHRCYVIDFQRELVKRYSEFINFPIYIWASKEVDVEVPADEDDSSDEEDSSESSSKEESEDEDADKSEDEEKKPKTKTVKETTYEWELLNDVKAIWLRNPKEVTEEEYTKFYHSLAKDFSDEKPLAWSHFTAEGDVEFKAVLFVPPKAPQDLYESYYNANKSNLKLYVRRVFISDEFNELLPKYLNFLLGLVDSDTLPLNVSREMLQQHSSLKTIKKKLIRKALDMIRRIADEDPDESTDKEKKEDASSDNDEKKGQYSKFWNEFGKSIKLGIIEDATNRNRLAKLLRFESTKSEGKLTSLDQYISRMKTGQKDIFYITGTSKEQLENSPFLERLKKKNFEVIFFTDPVDEYLMQYLMDYEDKKFQNVSKEGLKLGKDSKDKELKESFKDLTKWWKTALSKDNVDDVKISNRLDNTPCVVVTSKFGWSANMERIMQSQTLSDASKQAYMRGKRVLEINPRHPIIKELRERVVKNPEDEGVKHTAQLMYQTALFESGFLLDDPKDFASRIYDSVKTSLDISPEATVEEEDDTEVEAESDAKEDSKPETDAVNDDNDVKDEL

SEQ ID NO: 148058 - protein, 125 aa, Glycine max
  Coding DNA Sequence Number=SeqID_56373
  Homolog annotation: Hit_ID=A7NST6; Match level="QueryCoverage=82%, HitCoverage=76%, E-value=5e-21, Identity=51%"; Hit description =Chromosome chr18 scaffold_1, whole genome shotgun sequence
MAVSDAVMSNLTVLYVAVIACIKAYGFLCGRSFSGWFVLVVSTAAVALILVATLTWDVSRKATYAFATDQPPPPPHHTHEACKGGICWHGVAVRSPASQLAQRSNVAFGFSLLGVELVHSKREHV

SEQ ID NO: 148059 - protein, 318 aa, Glycine max
  Coding DNA Sequence Number=SeqID_56374
  Gene Ontology: Mol. function=molecular_function; Cellular component =anchored to membrane; Biological process=biological_process
  Homolog annotation: Hit_ID=A9PEG5; Match level="QueryCoverage=93%, HitCoverage=93%, E-value=1e-127, Identity=73%"; Hit description =Putative uncharacterized protein
  Pfam annotation: Domain name=Thaumatin; Domain location=32-249; Score= 292.1; E_value=1.1e-84; Accession=PF00314.8; Description=Thaumatin family
  Subcellular localization annotation: CTP_CleavageSite=43; ConfidenceScore=5.05e-01
MDMKETLKLNVSLVSVLSPPQRVISTTFTLVNKCDYTVWPGILSNAGVPPLSTTGLVLQTGASTTIAAPASWGGRFWGRTLCSEDSTGKFSCVTGDCGSGKLECSGNGAAPPATLAEFTLDGAGGLDFFDVSLVDGYNVPMLVVPQGGSGEKCTATGCVGDLNGACPSELKVMGADGREGVVACKSACEAFNSPQYCCSGAYGTPDTCKPSAYSAIFKSACPRAYSYAYDDKTSTFTCASADYTITFCPSPTTSQKASQGQDGSSTSPFLNNNSTMVYEGAFDQSEMSWATCRHVFQSQAIAGIVSITMAMWRLCQLF

SEQ ID NO: 148060 - protein, 592 aa, Glycine max
  Coding DNA Sequence Number=SeqID_56375
  Gene Ontology: Mol. function=receptor activity; Cellular component =mitochondrion; Biological process=protein amino acid phosphorylation
  Homolog annotation: Hit_ID=A7NSU5; Match level="QueryCoverage=100%, HitCoverage=98%, E-value=1e-152, Identity=51%"; Hit description =Chromosome chr18 scaffold_1, whole genome shotgun sequence
  Pfam annotation: Domain name=DUF668; Domain location=341-426; Score =138.5; E_value=1.9e-38; Accession=PF05003.3; Description=Protein of unknown function (DUF668)
MGSVCSAEKNKNKEVGGKTLGKKLKKLKSIAKGKGDCYSNSRTSDRGRKQKERNSGFSSEFNLSNPSRKEGKEDFQRGSFWGRASERAVEVLDTLGSSVPKLSNSNGFGFGSGMAPRGNRISILAFEVANTINKGAILFQSLSEENIQFLKKEILQSEGVLQLVSTDTKELIGLVETDKREEFNVFSREVVRFGNLCKDPQWHSLEQYFSRLHLDIWDNMQPTVEAEMTMQELTTIAQNTAELYHELTSLEHFEQDYQHKLKEMESLNLPLNGDSLTAFQIEIKHQRKLVRSLKKKSLWSRNLEEIVEKLVEIVTHIDQAILEFLRNHGATAVKHCNGSERLGEAGLSLHYANIINQISMIASRPTVLPPNLRDTLYHGLPNYIKSALPSRLQNIDAMKELSITQVKAEMDKTLQWLTPFATNTIKAHQGFGWVGEWANTSNEFGENTTKESNLIRLQTLYYAEKHKIDFYIIELLTQIHYLVTFVRYRHNTMKPMPKRTSPRRLDFQSKFISIDSINKPLGSKLSQEDKRLLEEVTMRRRSPGVSKSEDLAVTKKRSAKVWHHSNSVGSSPVTREGLDHQRSNVLDIIDGL

SEQ ID NO: 148061 - protein, 99 aa, Glycine max
  Coding DNA Sequence Number=SeqID_56376
MGLLAKIRVRRMRFQTKEEKVQAANDSLSEADPLSEWHPFSKASSSLSGWETLENKESEIYALSRQLTRPARTLSLLALTAPYLAMPKFTNLRLVSPAR

SEQ ID NO: 148062 - protein, 109 aa, Glycine max
  Coding DNA Sequence Number=SeqID_56377
MRKKTDNKEEKKTKSELAREKNKEAIPSTGKYDEYQKELERRRWHKALTRQPDNHIDMALVKEFYVNLYDPEDKSPRQVRGKLIKFDVKTLNTFLETPVVLELGEKYSA

SEQ ID NO: 148063 - protein, 132 aa, Glycine max
  Coding DNA Sequence Number=SeqID_56378
MSRLDTGGVTKALVHWFKLGTLCFQRKTLCLKVTIRRRRYCVRWVWSIRRFMLALMIAYYRDMNFKKCQNALGVGYHCTKSRMMTSVVVTTLKEGPPSEGVMMTQRTLHGMQMGETAMECSVIRSIPPSGRT

SEQ ID NO: 148064 - protein, 135 aa, Glycine max
  Coding DNA Sequence Number=SeqID_56379
  Gene Ontology: Mol. function=cysteine-type peptidase activity; Biological process=proteolysis
  Homolog annotation: Hit_ID=Q6L477; Match level="QueryCoverage=51%, HitCoverage=11%, E-value=5e-10, Identity=35%"; Hit description =Putative uncharacterized protein OSJNBa0009L15.8
  Subcellular localization annotation: CTP_CleavageSite=38; ConfidenceScore=5.64e-01
MATPPSSPPPPPPTGAASQLPSTLKCIRNTTRLRSLVTRSVRAERPLLHVDPSTGKVDSPHSKKLRTYLGIIARDKVNVTYENWKQVPAAQKDLIWEDIQAEFDIPEASYQRTKKKILQTMGERWRQFKSDLALK

SEQ ID NO: 148065 - protein, 85 aa, Glycine max
  Coding DNA Sequence Number=SeqID_56380
MFKKESRTIQDSRGKLNSRIKIQGSSFKIKIQDSRFKNSREDLIKISMKRIFQKLSSTWIFLKTCLPKSFYSLVIDYQIVVIDYQ

SEQ ID NO: 148066 - protein, 174 aa, Glycine max
  Coding DNA Sequence Number=SeqID_56381
  Homolog annotation: Hit_ID=Q84VH5; Match level="QueryCoverage=58%, HitCoverage=14%, E-value=6e-49, Identity=94%"; Hit description =Envelope-like protein
MVNIPSDITNRKSDDYQRVFVRGKCVRFSPAVINKYLGRPTDGVVDITVSEHQIAKEITAKQVQHWPKKGKLSAGKLSVKYAILHRIGAANWVPPIITSTVAQLIEDAAVNCFTAVRADEDRGSKKLMSRKMIPDILETTCNLSKLQIPLCLMTLIMEVADPTCITARTCSGSV

SEQ ID NO: 148067 - protein, 123 aa, Glycine max
  Coding DNA Sequence Number=SeqID_56382
MSVLELYTEKDVAGGSMFHSANSLTSCENNLSNNEAQSPRNVSNLHGDEDDDDDDLVSNSYVEESLDEDDSVDGISDTDDEVTDMIQPVYKEFKIHFGMMLCIITISIEVILMRRTFVVWRCH

SEQ ID NO: 148068 - protein, 130 aa, Glycine max
  Coding DNA Sequence Number=SeqID_56383
  Homolog annotation: Hit_ID=A7Q8B9; Match level="QueryCoverage=20%, HitCoverage=6%, E-value=4e-08, Identity=96%"; Hit description =Chromosome chr14 scaffold_63, whole genome shotgun sequence
MPLKDSTETKTGCQERRGGRMGSWSDLGFLIWDPGEEDQAGPCEQLDALSPFNPLSEMWQKEKESMDRPHRLHPVGTTRSPQGRLRHPGSRTDHRTLFKKRRISYPLSGWTLSVPGSPVAGSSGTTRILS

SEQ ID NO: 148069 - protein, 208 aa, Glycine max
  Coding DNA Sequence Number=SeqID_56384
  Pfam annotation: Domain name=G-patch; Domain location=79-118; Score =28.9; E_value=1.8e-05; Accession=PF01585.14; Description=G-patch domain
MVVRAFDDTRRELSVDPISGSCSLYTPPKVEIHSGRASGHRIRRGRHLGELPVLYALCGGHIGVIRNRFSVFRGAIMMARVMLGSGYEPGMGLGKDNGGITSLINAKGNRGKYGLGYKPTQANIKRSVAGRKSGSQGSRLRQEGEGNPPCQISKSFISAGLGDEGQVVTIYEDDVPSTLDLVRPCPPDFQLGNWRVEERPDIYATSIM

SEQ ID NO: 148070 - protein, 18 aa, Glycine max
  Coding DNA Sequence Number=SeqID_56385
MVFIKSSLRILEKMIEKG

SEQ ID NO: 148071 - protein, 47 aa, Glycine max
  Coding DNA Sequence Number=SeqID_56386
MGRNVSALIGKSVPQIPEKCKDLGPGIILTGSVPIILGQTFYCSKSV

SEQ ID NO: 148072 - protein, 187 aa, Glycine max
  Coding DNA Sequence Number=SeqID_56387
  Gene Ontology: Mol. function=helicase activity; Biological process =protein amino acid phosphorylation
  Homolog annotation: Hit_ID=Q2A9E0; Match level="QueryCoverage=95%, HitCoverage=12%, E-value=1e-42, Identity=49%"; Hit description =Putative uncharacterized protein
  Pfam annotation: Domain name=DUF889; Domain location=34-185; Score =104.7; E_value=2.8e-28; Accession=PF05970.5; Description=Eukaryotic protein of unknown function (DUF889)
MAHKFCFEALDHSRRDIIKHNSKDNKIFGGKVMVFGGDFRQILPAIPRGSRSDIVNATIDSSYLWVHCQILRLTKNMCLQNNMEATDQEEIAAFAQWIIDIGDGIIGDENDGYATIEIPQELLITEYNDPIHSIISSTFPDLSCHHNDPEYFQTRAILASTNETVQRVNDYMLTMIPGNHIVNKWNI

SEQ ID NO: 148073 - protein, 81 aa, Glycine max
  Coding DNA Sequence Number=SeqID_56388
MGHPNQGIGCTSFRRRNQVQPFPLESYHGVEVVPCSQNVQNQNVQNYNAQNQDVQNYQPQNAPNAQDAQKDQRVVSQMDCP

SEQ ID NO: 148074 - protein, 159 aa, Glycine max
  Coding DNA Sequence Number=SeqID_56389
MTLLLSNILPSDRIANLPLQKYQLVCVVPTWGSHPQRHPVDLKKSNRALGFPALVTGLYRPYRALVPPASSCHHDIGKDCARKTPSGPEEGQQCLGVASSKYGSLSVQGSACCPQQGHQAPLPIEFSSRSAASPGRRRAKHHSSLGMAGSGQQTHRHHL

SEQ ID NO: 148075 - protein, 202 aa, Glycine max
  Coding DNA Sequence Number=SeqID_56390
MLTNISILLPTPEQNVNNGQTLISDNKSTKKTVENNGSVTQETIFNFFLPIQTVPADPNSNRVYDSEKNSIDELKKFLKEELKDEEVSIWGVPLLKDDRTDVILLKFVKARELQTLSDGGRTSTSTPFWMKIWATTWRRWCSCTYTTERAILSVTTSMASFRTRTSITRPCALRIIETSFFDGVFSCWSAVFGTSRIMKKKL

SEQ ID NO: 148076 - protein, 231 aa, Glycine max
  Coding DNA Sequence Number=SeqID_56391
  Homolog annotation: Hit_ID=Q6WAY6; Match level="QueryCoverage=19%, HitCoverage=7%, E-value=3e-07, Identity=56%"; Hit description =Putative uncharacterized protein
GRPLAGFPWWKEGGAGVLCLCEGFPNIPLIGTRGCINDNLVLAIRQLGYPMRGAPSEETIVPFIARGFNEANTKTLQKIRITWLPKLKSLSGEEIEMPEESEEVQALKAELEKTRVVNEKLKVAVIRVRKECDELKDINMSAAEALEREMKKARKEEWSRNKFRGALLGSSNELKLRKIERDKSRMESLMLEDKLKSCQRSKRNAGRQIGKGVSLAESRASKVVSQSQGDG

SEQ ID NO: 148077 - protein, 90 aa, Glycine max
  Coding DNA Sequence Number=SeqID_56392
ETYQGNPCGVYPDLSSFIGSGVYPDLSSLTGSGVYPDLSSFTGSGVYPDLSSFSGSGVYHDLSSFTGSGVYPDLSSFTGSGVIQIFVACI

SEQ ID NO: 148078 - protein, 144 aa, Glycine max
  Coding DNA Sequence Number=SeqID_56393
  Pfam annotation: Domain name=zf-CCHC; Domain location=72-89; Score =24.7; E_value=0.00028; Accession=PF00098.14; Description=Zinc knuckle
MELQRLNQNEETDKRKRSIALKASSSIQEEEEDEEDFSLFVKKFHKFVKKRRIERRQNFNHGKRFQEDSPTIRCYKCNQLGHIKANFPSNEQWPKKNEKKSHEERRSKKAYIAWDDNDSSDGSEKEINLLSKDYESDENISQED

SEQ ID NO: 148079 - protein, 197 aa, Glycine max
  Coding DNA Sequence Number=SeqID_56394
  Pfam annotation: Domain name=G-patch; Domain location=35-79; Score =17.2; E_value=0.0016; Accession=PF01585.14; Description=G-patch domain
MEAAEESLETTFQSFEVVSCASVETSPLLPCLSNAALMVAWVMLRHGYEPGMGMGKDSHGNADVVDIRGNPYKYGLGYEPGKPGRRNVPSRLRADRAWPGYVSQCFTSAGMMFEEEVAAIGEESPQDPPSFVRPCHPNSQVGNWRVMSQSEVYTTDSIYEGRFFEDPNEGLIIDFDREVSQTINEEEEDEVLSPESE

SEQ ID NO: 148080 - protein, 47 aa, Glycine max
  Coding DNA Sequence Number=SeqID_56395
MWTTTGEELTTQLAQASKVASSRSNSLQEEGSGRPKWARLLFVPPLY

SEQ ID NO: 148081 - protein, 107 aa, Glycine max
  Coding DNA Sequence Number=SeqID_56396
  Homolog annotation: Hit_ID=A5C7C5; Match level="QueryCoverage=100%, HitCoverage=15%, E-value=9e-15, Identity=35%"; Hit description =Putative uncharacterized protein
PGHLRVDCPIFKKRIEKSKKKVFNEKKTKKAYITWDDNDMDLSEDSENEVVNLSLMAKNYESDEEDSLKKSWYIDSGCSKHMTGDASKFTHISPKKSGHMTYGNNNK

SEQ ID NO: 148082 - protein, 116 aa, Glycine max
  Coding DNA Sequence Number=SeqID_56397
MATYLLNILPHKLLTYKSPLRVLYHKDLTYSHLRTYDFLDDGPNPYVVHHLVSQSTTPNAQTLGLVPFGPNSSNIATGPTIEPKKNIVNCMNYSATASPPLSPAHLLGLLHAASMG

SEQ ID NO: 148083 - protein, 254 aa, Glycine max
  Coding DNA Sequence Number=SeqID_56398
MRGAPIEESLSPCLVRDLGAQGLKVIQRIHKAWRNPLKKDKELRGIRNGVIGGYHGWLRIHARGLDWLSKLKVIDEENFEASEEDEEVRALKLELGKARLAKEKFKSATTHIRKECTELQEENAATAKALEQETKRARKEEYGREKFQGALWGSNNGLKLRREERDRSRVHGMILKEELVACARFKRSLAQHLEAMEQNMLATIGQYKEELNQSMAHEQKLVEDFAQVYAEKEARGRVIDALHQEATMWMDRFA

SEQ ID NO: 148084 - protein, 248 aa, Glycine max
  Coding DNA Sequence Number=SeqID_56399
  Homolog annotation: Hit_ID=A7UQU7; Match level="QueryCoverage=48%, HitCoverage=20%, E-value=2e-20, Identity=45%"; Hit description=IMP dehydrogenase/GMP reductase, putative
MSHSRQLGGYITLLQCWIYEHFSSVAESTADQDYDETSPRACKWIATKKTVKSIRTPSYRERLDRLRIPDVCWIPYGEHWEVRDFHVRSCYSGLLRWGPVAVYYRPERVVRQFGYTQTIPAPPVDSWVLYDDIHDRWMHYEDHIVPAGEVYVVPGACSSDYIDWFFRISHPFMTPGHTIDPLPHGHAPQPRVVPQAPQTDIPRVPESGASSTSAEEPRHAVEVCDDIVKRLERHLSLGVVTLGSSTHE

SEQ ID NO: 148085 - protein, 65 aa, Glycine max
  Coding DNA Sequence Number=SeqID_56400
MDAYCTIKILMFPTSGNANVLKNNTDLLIIPLRSLYGLWLEEPIHIGIPCSHTCLSHMPIAVNIK

SEQ ID NO: 148086 - protein, 103 aa, Glycine max
  Coding DNA Sequence Number=SeqID_56401
  Subcellular localization annotation: CTP_CleavageSite=38; ConfidenceScore=5.06e-01
MNCVFVHVSSTIEFGAMRSDFLVQFSILNLFWSPLNCVFVHVSSTFEFGAMRSDCLVQFSILNLFGAPRIAFSFMCPSTFDFRAMRSDCLVQFSILNPFFGTP

SEQ ID NO: 148087 - protein, 124 aa, Glycine max
  Coding DNA Sequence Number=SeqID_56402
MSKSCGFGMTGPLDESISCFLIRVDPWVLVTLTVERTTRPHHQRTTCPRHQRTTCPRHQRTSCPCHQRAARPHLQRTTCPRLQRATRPHHQRTISPRLQRAARPHLQRTTCPRRERATRPHLGY

SEQ ID NO: 148088 - protein, 50 aa, Glycine max
  Coding DNA Sequence Number=SeqID_56403
ERIEVGLKRGKFDYVSYTSTNARRIGATGEKRKEGDTYAITSTPAWVKPP

SEQ ID NO: 148089 - protein, 137 aa, Glycine max
  Coding DNA Sequence Number=SeqID_56404
MLPFALHGYRTSGTNYAYWGNAPYSLVYGTEAVLHLRVGQMPFPEDRTEGRNQSGLEIRVRGSNTLPTTNVFNPIFEDIGCLITLRESRRTRTTKPTFIVTKRVFPEGATLVLTTWGLKRGGSSLTLNSDVVKRYYA

SEQ ID NO: 148090 - protein, 136 aa, Glycine max
  Coding DNA Sequence Number=SeqID_56405
MFNSLRSLSQHIGGYILCGTSRGYIYLGLTENKRGYISCGSVLVEGTSTRFKENKGGPLDPTVTNSPGRARLLQVEAIARLSELLFNLLPSYPINKLEGVEVMGSNFQTLKDLVKLRRRRRKKKKKRGRGTSELHS

SEQ ID NO: 148091 - protein, 133 aa, Glycine max
  Coding DNA Sequence Number=SeqID_56406
MGEGVHLDRAWLSQADDRRISFLNVANGTILNRHEGQRVGNHTSLPAAPDRRSCRLYAVTVFRVVWPEILNTNAELLLFASDFGGYGWRGMEPAPLGNRTGSVMDRPSCAVPKNTGSDFFALELELFVESGAR

SEQ ID NO: 148092 - protein, 179 aa, Glycine max
  Coding DNA Sequence Number=SeqID_56407
  Gene Ontology: Mol. function=chitin binding; Cellular component =extracellular region; Biological process=chitin metabolic process
  Homolog annotation: Hit_ID=UPI000069F178; Match level="QueryCoverage =98%, HitCoverage=99%, E-value=2e-18, Identity=34%"; Hit description =Mitochondrial antiviral-signaling protein (Interferon-beta promoter stimulator ...
  Homolog annotation: Hit description=protein 1) (IPS-1) (Virus-induced- signaling adapter) (CARD adapter inducing interferon-beta) (Cardif) (Putative NF-kappa-B- activating protein 031N).
MARTCSPLKVRTCSPLKVRACSPTKVKAHDPLTARTCSPLKLKVHDPLKARTCSPLKVKARTYSPLEVRACSPLVVRTCSPLKARTCSPLTVRARTYSPLEVRACSPLMVRTCSPLKARTCSPLTVRVRACSPLMVRTCSPLKARTCSPLTVRARTYSPLEVRACSPLVLRTCSPLKAR

SEQ ID NO: 148093 - protein, 52 aa, Glycine max
  Coding DNA Sequence Number=SeqID_56408
MFELGLASRAKTGSDDDDTLDMVWLSDVEGNFNSYQEDIDVQENPDALEIIE

SEQ ID NO: 148094 - protein, 156 aa, Glycine max
  Coding DNA Sequence Number=SeqID_56409
MAPRKLASKRSRKDKAAEGTSSAPEYDSHRFRSAVHQQRFEAIKGWSFLRERRVQLRDDEYTDFQEEIGRRRWASLVTPMAKFDPEIVLEFYANAWPTEEGVRDMRSWRARNVSMARGGTGLMGSMRRPSPSCYVYRGRILPGQLQGGECESCAPT

SEQ ID NO: 148095 - protein, 394 aa, Glycine max
  Coding DNA Sequence Number=SeqID_56410
NNGQAAAPQVPPGQRQAESDPAQSGQAHALVQGRDAGRQVEVLHPLQAGGAQHVRQGFLVGMHADGFGQVAVAGLVLGHRLAQPGQHVEGIPVVGRRQRLGDAGELQHQQLAARLEHAGHLGQGAILVGHVAQPESHADAVEIARRERQALGVTDGGGHQLAGVGQAVAADAQHGIVDIGQPDLAGGARALGESLGQVAGAARDVQHLHAGADGGAADGEGLPDAVQAGRHEIVHDVVALRHRVEDFGDLAGFFAFRHRLEAEMRRLGRGIRGMLRFGGPIGARRMPPAGAGRRRAVTYLKYCGHTIAMFAPRRRSEACPIRHVQHHPRRRRRTRNPGTDRRQPVLRRPQGAARLRRRPGPDPDPRRTARPDPAGLDAARHLRPGHGAQAAQPR

SEQ ID NO: 148096 - protein, 123 aa, Glycine max
  Coding DNA Sequence Number=SeqID_56411
TDKRKRSIALKASSSMQEENEDEELEDEEDFSLFVKKFHKFVKNRISERRQNFNHGKRSHEGSLTLRCYNHEERKTKKAYIVWDDNDSFEESEKEDDRGRTRIKKTLKMQYLGSDPRSSPNEQ

SEQ ID NO: 148097 - protein, 83 aa, Glycine max
  Coding DNA Sequence Number=SeqID_56412
MLGFTRDSPQISASPHQLDLAPYALRSYSAQWNAPGILHDKHTLRSSRILGKMEVEETLQGLWLPLHYRVDMGASQHRTPELG

SEQ ID NO: 148098 - protein, 228 aa, Glycine max
  Coding DNA Sequence Number=SeqID_56413
MEVETPEEDEEVQALKTELEKAQTVKEKFKSAVVRIRKENAELRDVNIATTKALGQETKRARKEEHGRNKFRGALWGSNSELKLRREERDQSRVDGLILNDELRVCLRSKRSLSQRLCETETNMLAIISKYKEELNLATAHEHKVADEYARVYAEKEARRRVIDSLHQEATMWMDRFALTLNGSQELPRLLAKGKAMADTYSAHKEIHGLLRYCQHMIDLMAHIIRSC

SEQ ID NO: 148099 - protein, 109 aa, Glycine max
  Coding DNA Sequence Number=SeqID_56414
  Subcellular localization annotation: CTP_CleavageSite=94; ConfidenceScore=5.31e-01
MNSLPSVVHVSSTIESGAPRIDCLSLFAYPPSSNLIRRPMNSLPSAVHVSSTNESGAPRIDCLALFANSPFSNLIRRPMNSLPSLVHVPSVIKRGASEKEEGETRVVID

SEQ ID NO: 148100 - protein, 208 aa, Glycine max
  Coding DNA Sequence Number=SeqID_56415
MTGSLDESISCFLIREDPWVHALAFKGLDALTFRGLHTLTFRGLYVLLLRGLHVLTIIGLNGLTFRGLHVLTFRGFHALAFKGRHVLNFRGLHALAFRGLHTLAFKGTRNFPSTILFPGPPLDLKGGPTVRAQPEEGYRAATVHTGARGRTHKTPSGPGEVQQGPGVSNSGYGPLSVLQGARSPNKGSRPQDTQWTWRSPTGSWGFQL

SEQ ID NO: 148101 - protein, 75 aa, Glycine max
  Coding DNA Sequence Number=SeqID_56416
PVLSRTLESDQFPLLNDPNKTCIYVIKVALVRARALSALMDRFSAPVRLANLYNSSSSGFILAVSPGVLRLADAR

SEQ ID NO: 148102 - protein, 120 aa, Glycine max
  Coding DNA Sequence Number=SeqID_56417
MSPPSLWVSITYLKQTIVKETANAKDTGLPCSDVLCLFSIGKGQRSVGRDPSPTCIRPYVPVSRKQKIQWPIVSGHRLTSVDFRSQLVSTSNRDLRRPCPCYHKICMNVPNAMTFLVKDG

SEQ ID NO: 148103 - protein, 79 aa, Glycine max
  Coding DNA Sequence Number=SeqID_56418
  Gene Ontology: Mol. function=RNA-directed DNA polymerase activity; Biological process=regulation of transcription, DNA-dependent
  Homolog annotation: Hit_ID=A7PBL2; Match level="QueryCoverage=77%, HitCoverage=19%, E-value=3e-10, Identity=54%"; Hit description =Chromosome chr16 scaffold_10, whole genome shotgun sequence
MALFDTGADSNCILEGLIPTKFFEKISEKLSTASGSKLKINYKLSNAIIENQGLRINTNFLQEVSFNNIQIQLEKPQLK

SEQ ID NO: 148104 - protein, 144 aa, Glycine max
  Coding DNA Sequence Number=SeqID_56419
NEDKGYMGVRELSWRWATGDGGFVRDFVDVENLFCTIARPPPSTTCDGVVPGDMSRGSGDLGDVRRAPGSQQIKGTKTTKQGGLCGGWPAETKMVSGNRLQRECNRLPGLKGQEARRAASNRLPRGCNRLPGLEMKAAGCGGLW

SEQ ID NO: 148105 - protein, 98 aa, Glycine max
  Coding DNA Sequence Number=SeqID_56420
MEAHGKIEVELSLNGRVLEGLGGNGVACQLKEEWVKIRDWVEIQRGWAPHLFCTHKESQSRVITIGDSDEHGGLRCSRKGFREENLRKRGLKNCDFER

SEQ ID NO: 148106 - protein, 365 aa, Glycine max
  Coding DNA Sequence Number=SeqID_56421
MAPRKLASKRSRKDKAAEGTSSAPEYDSHRFRSAEHQQRFEAIKGWSFLQERRVQLGDDEYTDFQEEIGHQRWASLWIPFDANAIGQLLGYPLVLEEGQECENGQRRNQFDGFDEEAIAQLLCIPGQDFSRTAAGRRVRIMRTNMTTLTQIWMTLLLSNILPTDHNSDLPLPKCQLVYAILTRMSIHVAQLIADAIYIFAGMAPTRHPLDPDKSNRALGFPALITGLCQSFGVPVTPSKVIRPPITRAFIEKYCTQRQIQGDAPQAADAPPPHQAGPAGSFDTEQYLRHLVRQQAANHRAHSQGFTSFSCPTPDQFRAEVAWPGDWPEAQAGEEPAGAPAEAPDEADEAREDEEMTDLLDFLGGS

SEQ ID NO: 148107 - protein, 131 aa, Glycine max
  Coding DNA Sequence Number=SeqID_56422
MNALSAPVALSLFIATVKILDFQMIALSGPCRARREFYANLYDPEDKSPKQVRVRGHLIKFDEDTLNTFLKTLVIVEEGENLCVYSKFALLRLDPQELAAKLCIPGRGFELNTDGQPLKILRKNITTLAQT

SEQ ID NO: 148108 - protein, 62 aa, Glycine max
  Coding DNA Sequence Number=SeqID_56423
GDGTKEEEPTDLRPNPLQRGGDDVILPRKGPVTKAISKKLQEDWAKVGEEGPKVLMNFRVDF

SEQ ID NO: 148109 - protein, 114 aa, Glycine max
  Coding DNA Sequence Number=SeqID_56424
  Homolog annotation: Hit_ID=A8GFH5; Match level="QueryCoverage=100%, HitCoverage=100%, E-value=5e-31, Identity=64%"; Hit description =Endoribonuclease L-PSP
  Pfam annotation: Domain name=Ribonuc_L-PSP; Domain location=2-114; Score=94.6; E_value=3.1e-25; Accession=PF01042.12; Description =Endoribonuclease L-PSP
MNIERIDPDQRWSEAVVHNETVYYTSVPENLDDDATAQTANALAAIDVLLARVGSDKSRILDATIFLANSADFAAMNAAWDAWVVAGSAPVRCTVQAQLMNPKYKVEIKIIAAL

SEQ ID NO: 148110 - protein, 150 aa, Glycine max
  Coding DNA Sequence Number=SeqID_56425
MGAYSTDEKLLVHFFQDPTPWWYDPGACEYHSGAPGHDIGKTTCRPFSPSGLPMTEREMIHMVDTLPTFYYEKLIGYMPVFADLVFAGERIESGLRKGKSWNMPPTRPPITQKSPSGLGTLEVKRKEIPTRSPPPNMDESTPKYPNLIPA

SEQ ID NO: 148111 - protein, 91 aa, Glycine max
  Coding DNA Sequence Number=SeqID_56426
MTSRDQVWSFCTHDTRRYLMVIRTLLSSRGGGPDDKQRPKTKFGHSAPMIRGDTLWLFAPFCHPEAAGPMTSRDQVWSFCTLVSSRGGGPD

SEQ ID NO: 148112 - protein, 120 aa, Glycine max
  Coding DNA Sequence Number=SeqID_56427
MKLEETLAQFMQVSMSNHKSTESAIKNLEVQVGQLAKQLVDRPSSSFSANTKKNSKEECKAVMARSRMAIQANEGRAEEKVEGYKQQSAIEPALEPVFDFVKLEEVVEDEDDQQERERHQ

SEQ ID NO: 148113 - protein, 79 aa, Glycine max
  Coding DNA Sequence Number=SeqID_56428
VDSRGSHLPPSFSIEAPHKASTFGAHFCSKSWKESIFGVVKCVATSGTSKIQDFAQVQKNTRHLLVVERAVQNEFWMFA

SEQ ID NO: 148114 - protein, 174 aa, Glycine max
  Coding DNA Sequence Number=SeqID_56429
MEGFLVSRKYVALQICDDEDVETMIKSFQQDQMSVLELYIEKDVAGGSMFHSANSLTSCENNLSNNEAEPPRNVSNLHGDEDDDDYLVSNSYVEESLDEDDSVDGISDTDNEVTDVIQPVYKEFKIHFGMMLCIITISIGVILMRRTFAVWRCHRVLMLGKNYVWAWILIVKMR

SEQ ID NO: 148115 - protein, 89 aa, Glycine max
  Coding DNA Sequence Number=SeqID_56430
  Subcellular localization annotation: CTP_CleavageSite=49; ConfidenceScore=5.30e-01
MNPGLTHKNSPQWSRQQSQPTLWWASEARLTGASSKGGKCAESPPTFICGKRRKNRRKSVMKNIPDSGVVFTFEEGISTSHVCPRGQQP

SEQ ID NO: 148116 - protein, 155 aa, Glycine max
  Coding DNA Sequence Number=SeqID_56431
  Subcellular localization annotation: CTP_CleavageSite=24; ConfidenceScore=5.35e-01
MSRYAHSSLLMNMASKKRKAPSTPTQARFDRSRFTSLEAWERYTDIVVPRKLLLERNVVVYYTEFDEFKEELERRDWDEKLTDISDSSIDIAIVKEFYANLYDLEDKLPKQVRVRGHLVKFVEDTLNTFLKTPIILEEGENLCTYSRFALLRSDP

SEQ ID NO: 148117 - protein, 167 aa, Glycine max
  Coding DNA Sequence Number=SeqID_56432
  Homolog annotation: Hit_ID=A0ST23; Match level="QueryCoverage=26%, HitCoverage=91%, E-value=1e-11, Identity=73%"; Hit description =Putative reverse transcriptase
MTVKTSDTCSSRRRSQLVCKRMPGADKPVRARQRMRKEKIPHQAPFAIQAAQLLGRAIGAGLFAITPAGERGMCCKAIKLGNARVFPVTTLSTLEDPPSTQAPIRPQILSKAHQNHIHYVHGTELEFVIMVIAVSFGKPVVPAALMNRPTRGERRFAYWALFRFLAH

SEQ ID NO: 148118 - protein, 79 aa, Glycine max
  Coding DNA Sequence Number=SeqID_56433
  Subcellular localization annotation: CTP_CleavageSite=43; ConfidenceScore=5.32e-01
MGSSYRILPLSRSMRSPGAGSPSVLDHLPLLRSFSLCWGKRVLQHLGRKMFGTSFSTSGTETFGGQVGNLHQLHLLVCP

SEQ ID NO: 148119 - protein, 200 aa, Glycine max
  Coding DNA Sequence Number=SeqID_56434
  Gene Ontology: Mol. function=protein serine/threonine kinase activity; Cellular component=integral to membrane; Biological process=recognition or rejection of self pollen
  Homolog annotation: Hit_ID=A7P186; Match level="QueryCoverage=60%, HitCoverage=15%, E-value=2e-30, Identity=53%"; Hit description =Chromosome chr19 scaffold_4, whole genome shotgun sequence
  Pfam annotation: Domain name=B_lectin; Domain location=114-200; Score= 58.8; E_value=1.8e-14; Accession=PF01453.15; Description=D-mannose binding lectin
  Subcellular localization annotation: CTP_CleavageSite=27; ConfidenceScore=5.15e-01
MHERGASVVKQVTKDFRRGQTFSAAPPCRETSPPVEAPETPLTTAPLFARTPLSSLSFPMKKNSETETSSITQSQPLSYGKTLVSPSGIFELGFFNLGNPNKIYLGIWYKNIPLQNMVWVANSSIPIKDSSPILKLDSSGNLVLTHNNTIVWSTSSPERVWNPVAELLDSGNLVIRDENGAKEDAYLWQSFDYHSNTMLP

SEQ ID NO: 148120 - protein, 51 aa, Glycine max
  Coding DNA Sequence Number=SeqID_56435
MDSLGFGGVGDEKESKVLDPFHLFDWSADINNNTNSNTSSSFENPNNKIRL

SEQ ID NO: 148121 - protein, 143 aa, Glycine max
  Coding DNA Sequence Number=SeqID_56436
MPPRKLSAKRSRRDAAAEGTSAAPEFDSHRFRSVEHQQHFEAIKGWSFHRERRVQLKDDEYTDFQEEIARRRWTSLEGVRDMRSWVRGQWIPFDADALSQFLGDLLVLEEGQECEFSQRRNRADGFDEEAIAQLLCILGQDFA

SEQ ID NO: 148122 - protein, 180 aa, Glycine max
  Coding DNA Sequence Number=SeqID_56437
MAPEKLSSKRSRRGAAAEGSSAAPEFDSHRFRSAEHQQCFEAIKGWSFHRERCIQLREDEYTNFQEEIARKHWTSRVTPMAKFDLEIVLEFYANAWPIEEGVRDMCSWVRGQWIAFDADALSQFLGDPLVLEEGQQCEFSQRRNRADGFDEEAIAQLLCTLGQDFARTVAGGGCGSCAPA

SEQ ID NO: 148123 - protein, 181 aa, Glycine max
  Coding DNA Sequence Number=SeqID_56438
  Homolog annotation: Hit_ID=UPI0000ECBAF8; Match level="QueryCoverage =22%, HitCoverage=48%, E-value=2e-16, Identity=100%"; Hit description= UPI0000ECBAF8 related cluster
ATLPEGRKADRYPVSGRVGTGERTRELPGGNACLWKNASNAAFLRFLAFCWPFAHMFFPALSPDSVDNRITAFEKRKSAQYANRLSPRVGRFINAAGTTGFPTGKRAVSATQLIYDHDYEFELGTQVLGMQAWHWPSFYNVVTGKTLALPNLIALQHIPLSPAGVIAKRPAPIALPNSCAA

SEQ ID NO: 148124 - protein, 81 aa, Glycine max
  Coding DNA Sequence Number=SeqID_56439
  Homolog annotation: Hit_ID=A6FJQ2; Match level="QueryCoverage=46%, HitCoverage=84%, E-value=3e-11, Identity=92%"; Hit description=50S ribosomal protein L5
MQLPGDGHSLSVSGCREQTSPSGRMRKEKIPHQAPFAIQAAQLLGRAIGAGLFAITPAGERGMCCKAIKLGNARVFPVTTL

SEQ ID NO: 148125 - protein, 64 aa, Glycine max
  Coding DNA Sequence Number=SeqID_56440
MACTHIPGEAKIDSPQISASPHQLGLAPYASEPYNAQWNAPGLLHDKHTLRSSRILEKMEIEET

SEQ ID NO: 148126 - protein, 311 aa, Glycine max
  Coding DNA Sequence Number=SeqID_56441
SEAGRYNLGASLGRSSLGKREKACGGKAAEERQRDAPRRNRRRVRPGTGPGDACAGSGSLGLAAAAALGGKRRQRLAGQLGQEAFVGQRQPSLGAGRLDQFGATRSGQRQRALPAPARDVGMVAAEQRRRHGRALVDFGARVMRAVQQAGQRVVEGVLQRGVAVVQHARQQAHRGVDDGERGDFPAGQHKVAQRDFMRDTALDETLVDAFVATTDQDQTVAGGQRLGAGLVVALAHGREQRHRGRPQALGRARRLGGIDGGLQRGRHHHHAGAAAIGAVVHGTVRIIGEIARIPRMQGPPALGVGPAGDAQ

SEQ ID NO: 148127 - protein, 224 aa, Glycine max
  Coding DNA Sequence Number=SeqID_56442
MWLTDHNSDLPLPKCQLVYAILTRMSIHVAQLIADAIYIFAGMAPTRHPLDPDKSNRALGFPALITGLCQSFGVPVTPSKVIRPPITRAFIEKYCTQRQVQGDAPQAADAPPPHQAGPAGSFDTEQYLWHLVRQQAANHRAHVQTYDCLYQMSLSLQSQGFTSFPCPTPDQFRAEVAWPGDWPEAQAGEAPARAPAEAPDEADGAREDEEMTDLLDFLGGSRAT

SEQ ID NO: 148128 - protein, 516 aa, Glycine max
  Coding DNA Sequence Number=SeqID_56443
  Homolog annotation: Hit_ID=Q6WAY4; Match level="QueryCoverage=85%, HitCoverage=93%, E-value=2e-36, Identity=26%"; Hit description =Putative uncharacterized protein
MGTNQNGKRFYQVKVKSLDVTSLKELGRLMGPLQRQAFRKVYGKILDLTAAEVFTEAVVSLAQYYDQPLRCFTFGDFQMVPTIEEFEEILGCPLGGRKPYLFSGFLPSLSKIAAVVGDSTKEMDRMKQTRNGVVGLPRKYLEGKARDMASQEKWDLFADILALLIFGVVLFPNVDSLVDLAAIDAFLAYHHSKETPVVAILADLFDTLDRRCEKNSARIEGKEGVPFLCGDYPNVPLIGTRGCINYNPALAIRQLGYPMRGAPTEESLSPFLVRDLGAQSLKVIQRVHKAWRNPLRKDKELRGIQNGVIRGYHGWLRVHTRGLDWLSKLKVINEENSEAPEEDEEVQALKLELGNARLAKEKFKSAATHIWKECTELQEENAATARALEQETKRARKEEYGREKFRGALWGSNNELKLRREERDRSRVYGMILKEELAACARSKKSLAQHLEATEQSMLAIIGQYKEELNQFVAHEPKLAEDFAQVYAEKEERGRVIDALHQEATMWIISSVDLEW

SEQ ID NO: 148129 - protein, 97 aa, Glycine max
  Coding DNA Sequence Number=SeqID_56444
  Homolog annotation: Hit_ID=B0HC01; Match level="QueryCoverage=32%, HitCoverage=68%, E-value=4e-10, Identity=100%"; Hit description =Putative uncharacterized protein
MEKRQQRGLFTVPGLLLAFAHMFFLRYPLILWITVLPPLSELIPLAAAERPSAASHWHDRFPDWKAGSERNAINETAMTMITNSSSVPPVKTFLYGV

SEQ ID NO: 148130 - protein, 26 aa, Glycine max
  Coding DNA Sequence Number=SeqID_56445
EDWAKDTREGPRVPMSLRIDFEPMGQ

SEQ ID NO: 148131 - protein, 69 aa, Glycine max
  Coding DNA Sequence Number=SeqID_56446
VSYPNFVRGLLFDDIQPLIGRFEILVMQAQLELVGLGSSSSMDSFASWKMNGSGMEKGRERGDATSRRR

SEQ ID NO: 148132 - protein, 224 aa, Glycine max
  Coding DNA Sequence Number=SeqID_56447
  Gene Ontology: Mol. function=phosphoprotein phosphatase activity
  Homolog annotation: Hit_ID=A2Q4S5; Match level="QueryCoverage=48%, HitCoverage=16%, E-value=2e-16, Identity=40%"; Hit description=IMP dehydrogenase/GMP reductase, putative
CWIYEHFPSVADSTADQEYDEDSPRACRWIAKKKTMKSIRTPAYREHLDQLRILDVCWIPYGEHRSVRDFHVISCYSGLLHWGPVAIYYRPERVVRQFGYTQTIPAPPVDSWVSYDDIHDRWMHYSNHIVPAGEVCVVPGQCASDYMDWFFRISHHFMTPGHASDPLPDGHAPQTDIPHVSEPGTSSTSVEEPGHAVEVSDDIAERLERHLSLGVVTPDSSTHE

SEQ ID NO: 148133 - protein, 79 aa, Glycine max
  Coding DNA Sequence Number=SeqID_56448
MAKSSRKQDIMVDEIPLDSEWRRKGNQKPKSTRDQERTRKQGSKKTMNSDPNQMSNPFQEETNSSVFTNEMEASTSAPS

SEQ ID NO: 148134 - protein, 189 aa, Glycine max
  Coding DNA Sequence Number=SeqID_56449
MERSMIDAASGGALGDMTPAEAKNLIEKMASNFQQFSARSDAIVIRGVHEVATNSSGETKKLEDSVVYAPLPTTTQTFAPLCNNLKQLNSLKLMLQTSTRDLLNLNSKISHNRIIMTSPATVAIPDGGIIPTLDGRILYNSNSNNKLIFKMLLAQADHTSLHQSSSNNNNNPRNSKQLRPLRNLPLKNL

SEQ ID NO: 148135 - protein, 111 aa, Glycine max
  Coding DNA Sequence Number=SeqID_56450
MVTITPARVPQPPFFRGYNSNATCAYHGGVLGHSIEHCRALKYKVQGLIDAGWLKFEENRLLNPNINKRHHTWGNFQSCCSENKTTMDTYEPYTGAMKGTMHKPQANLGAD

SEQ ID NO: 148136 - protein, 93 aa, Glycine max
  Coding DNA Sequence Number=SeqID_56451
  Subcellular localization annotation: CTP_CleavageSite=77; ConfidenceScore=5.19e-01
MLVRMIHTRLFAAARVQSCSGMHSRYVIASFSGCARTVGHPPISGGSPGTVERKPWPPTLKMRTHSPLKARACSPLQARMCSPLMSRTYGPLK

SEQ ID NO: 148137 - protein, 95 aa, Glycine max
  Coding DNA Sequence Number=SeqID_56452
MDPIKTAHNDACTWLNTQMQCASAKDPGRSVHSAPHNHTQHPTCERGQKLVPKTLEGQCIVPPTNIHNMHMPMHFQHQSTFHFHVIHNINIISSQ

SEQ ID NO: 148138 - protein, 76 aa, Glycine max
  Coding DNA Sequence Number=SeqID_56453
MAKYDPEIVVEFYSNAWPIEEAVRDKHSWVQGQQASFDDDDINQFLGHLLVLEEGQRCEFSERRSQASGFNEEAIG

SEQ ID NO: 148139 - protein, 69 aa, Glycine max
  Coding DNA Sequence Number=SeqID_56454
  Homolog annotation: Hit_ID=A5BP60; Match level="QueryCoverage=86%, HitCoverage=23%, E-value=9e-09, Identity=43%"; Hit description =Putative uncharacterized protein
MASSKFPFPEGNSINRPFMFNGEGYHYWKTRMQILIEAIDLNIWEAIEVGPFVPTKVVGNATIEKPREE

SEQ ID NO: 148140 - protein, 190 aa, Glycine max
  Coding DNA Sequence Number=SeqID_56455
  Subcellular localization annotation: CTP_CleavageSite=41; ConfidenceScore=5.45e-01
MAEPSKKRKGSSSTAAAAAHRRHGPSETPTTSILPYLSSPRSSTLFSSDDQRLRYLSQFSSRIILDPKYLDVEFFNDETFDCYQVFQNSGLVDFMSLKLPYYPELVKVFYCNLKIQDGVIISEVHGIPMVIDQSLFFSLTNLPSQGAPFEGTIVDDWKFDYSSHDARRMVCNDQVEMTDRLGPFGSVPHA

SEQ ID NO: 148141 - protein, 237 aa, Glycine max
  Coding DNA Sequence Number=SeqID_56456
QYGLADAQADALQAPAHQDGGGGQSDDQADPHALRAHAQPQAEPGAERHAQAPVREHGDEHRHAGVLQAAQCAGGQYLDAIREGEGGRVQQQGGGQAGHRQVVGVDTDDGIVAEQQHRRRQRLRAHDDRVASPRRTAHAEAIATADCMADPHGGGFGHAHRDHEAQLRHVDRDLVRGRFIGTEAADQQRGDDEQAALHQHGDADRQAGAQQIPDRLPARPFEVREQLQVGEALGEPQ

SEQ ID NO: 148142 - protein, 54 aa, Glycine max
  Coding DNA Sequence Number=SeqID_56457
MEDEENEDVGLPLELEKIVVHEDQEMGPHQEETKIVDLGTSNGKKEVKIGTNYL

SEQ ID NO: 148143 - protein, 35 aa, Glycine max
  Coding DNA Sequence Number=SeqID_56458
MKMLLIPHDVASCGAYEWQRNGETRDRGDTTSRRR

SEQ ID NO: 148144 - protein, 138 aa, Glycine max
  Coding DNA Sequence Number=SeqID_56459
  Homolog annotation: Hit_ID=A0PAV3; Match level="QueryCoverage=27%, HitCoverage=17%, E-value=5e-07, Identity=76%"; Hit description =Restriction endonuclease
MVKVGTSYVPINVSFSPKVGPGLPGINRDTRIYLFCEVIFRHSCPSCSATDGVGFPSHDVVKRRPVNCNTTHYRANWSSTAVAAALELVDPPGCRNSISTLRCNVGTVLSLSRPLGCARNSPPPIGDQPGSPKVFPTR

SEQ ID NO: 148145 - protein, 112 aa, Glycine max
  Coding DNA Sequence Number=SeqID_56460
MSGRSSTRQFPSWKPGGHGRTKFDPLGESSSHIIMTWPSCPRLALIKLLLMWQGGPPLTFRPNYEPWLPLFLPATLFLMSACIGAYLYREVDLPPNLSAGAVEGTDHHGTWL

SEQ ID NO: 148146 - protein, 182 aa, Glycine max
  Coding DNA Sequence Number=SeqID_56461
  Homolog annotation: Hit_ID=UPI00006A2D9E; Match level="QueryCoverage =69%, HitCoverage=73%, E-value=1e-08, Identity=20%"; Hit description =UPI00006A2D9E related cluster
GEPLGTSTFTFRGLHVLAFRGLHAFTFRGLHALTFRGLHALAFRGLHALSFRGLHTVAFRGLHALAFRGLHVHTFRRLHALSFRGLHALAFRALHALTFRGLHVLAFRGLHICAFRELKGELCEHNQRRRQVSSFDEEAIAQLLCIPGHDFAQTAAGRRAGALPTTHGRPVGNQPLEQVLCS

SEQ ID NO: 148147 - protein, 149 aa, Glycine max
  Coding DNA Sequence Number=SeqID_56462
GMTLTKGEDNHNVCPRATGPLGHNSRIETFSRSWPKDVDISGKGADDHIGGDSADFPFLEDAPTSPASPTRRRVGCDNADTSEKGADDHIGLYKTLTSPGRVQMTALVSACQRARSPLADERSEDACHTLISSGDQFFGGMQPSLDHFE

SEQ ID NO: 148148 - protein, 130 aa, Glycine max
  Coding DNA Sequence Number=SeqID_56463
  Homolog annotation: Hit_ID=A5C8K0; Match level="QueryCoverage=87%, HitCoverage=6%, E-value=3e-07, Identity=28%"; Hit description =Putative uncharacterized protein
  Pfam annotation: Domain name=zf-CCHC; Domain location=42-59; Score =8.6; E_value=0.076; Accession=PF00098.14; Description=Zinc knuckle
MEEDDDFSLFVKRFNKFLRNKGNKRKTNFNPKKKGEDSSYVPKCCECDHPGHLRVDCLSFKIRMEKSDKKTFKDKKGKKVYISWEDNNMDSSGDLENEVVNLSLMAKNYESEEEDSLKRSCSLIADALNT

SEQ ID NO: 148149 - protein, 156 aa, Glycine max
  Coding DNA Sequence Number=SeqID_56464
  Gene Ontology: Mol. function=chitin binding; Cellular component =extracellular region; Biological process=chitin metabolic process
  Homolog annotation: Hit_ID=UPI000066154C; Match level="QueryCoverage =91%, HitCoverage=100%, E-value=8e-21, Identity=40%"; Hit description= Homolog of Homo sapiens "Keratin-associated protein 10-1
  Subcellular localization annotation: CTP_CleavageSite=33; ConfidenceScore=5.57e-01
MARACSPLKVRTCGPLMARACSPLKVRTCSPLRARACSPLKVRTCGPLKVRACSPTKVRTCGPLMARACSPLKVRTCSPLMARACSPLKVRTCGPLKVRACSPTKVRTCGPLMARACSPLKVRTCSPLMARACSPLKVRTCGPLKVRVLVPKGSPL

SEQ ID NO: 148150 - protein, 105 aa, Glycine max
  Coding DNA Sequence Number=SeqID_56465
  Homolog annotation: Hit_ID=A5C3T2; Match level="QueryCoverage=98%, HitCoverage=14%, E-value=2e-25, Identity=48%"; Hit description =Putative uncharacterized protein
MDIDYAIRKDEPPAITDESSPADVALYERWERSNRLNVMFIKTKISAGIRGSVDQHEKEEERLVMEMGKIALLTTAYGKNKAIKSQANQKGNGKIPPQADIKKVA

SEQ ID NO: 148151 - protein, 153 aa, Glycine max
  Coding DNA Sequence Number=SeqID_56466
  Pfam annotation: Domain name=G-patch; Domain location=19-63; Score =33.4; E_value=8e-07; Accession=PF01585.14; Description=G-patch domain
HCLRRFLLWATLPVRYSSDGGPGARVMLGKGYELGMGLGRNNDGRTSLISTRGNHGKFGLGYKPMQADIRKSVAGRKSGSQGSQLGQKVEGGPPCHISRSFISEGLGHKGQVVVICEDDSPSGSDLVRPCPPGFRLGNWRVEQCPDIYETSIM

SEQ ID NO: 148152 - protein, 245 aa, Glycine max
  Coding DNA Sequence Number=SeqID_56467
  Homolog annotation: Hit_ID=A2Q4S5; Match level="QueryCoverage=69%, HitCoverage=28%, E-value=6e-19, Identity=34%"; Hit description=IMP dehydrogenase/GMP reductase, putative
  Pfam annotation: Domain name=DUF1723; Domain location=156-205; Score =53.4; E_value=7.8e-13; Accession=PF08330.1; Description=Protein of unknown function (DUF1723)
MVRTRGLGRAIGKVIGRDRQDEHDAVDVPERRRPNASARRQRVHQMTEDVPHMTEDVPDMAEDAPEMTADVQGDDGAEGSHADDVEGFPGGPRDPSVLTSFADHVAHAIWSGHERCELKLVSHGRTVTLIGRSVPKIEGLVGATGLSPLIGCSVVTGYPGLISAFVERWHSETSTFHLSVGELTITLDDVSSLLHLPISGTFHSFHALSVDGAIFLLTELLEVSAEETRAETTRSRGAYVRLGWV

SEQ ID NO: 148153 - protein, 165 aa, Glycine max
  Coding DNA Sequence Number=SeqID_56468
RDSNVSVTDLVSVEDDTSKKNICTDNHSGISARQRDSNVSMTDLVSAEDDTAKKNVYTDNHSGISARQRDSNVSMTELVSADDDGNLRVSTCLTAAIDEGRRRRRYFPRLRDSNVSMTDLVSAEDDGAKTTLVSACYQLFVLQTAKKNVYTDNHSGISARQRDSN

SEQ ID NO: 148154 - protein, 61 aa, Glycine max
  Coding DNA Sequence Number=SeqID_56469
MEKSGGKQNKFGSMKEREWKIFRSDKFSASFSKKPLEKASQRSHEEASGGSLLMKLLEKAT

SEQ ID NO: 148155 - protein, 55 aa, Glycine max
  Coding DNA Sequence Number=SeqID_56470
MPKDRGICLDFRDCHHQKGGDCRQRIKLNVLMMPKFSHASQSFIQDKGIKDIQDG

SEQ ID NO: 148156 - protein, 85 aa, Glycine max
  Coding DNA Sequence Number=SeqID_56471
  Subcellular localization annotation: CTP_CleavageSite=32; ConfidenceScore=5.41e-01
MSPVRRTKAKWRRTKPPNLSSFTGSGVYPDLSSFTGSGVYPDLSSFTGSGVYPDLSSFTGSGVIQNLRSLYQTIRSYSGSHQGFS

SEQ ID NO: 148157 - protein, 166 aa, Glycine max
  Coding DNA Sequence Number=SeqID_56472
MERSMIDAASGGALGDMTPAEARNLIEKMASNSQQFSAKNDAIVIRGVHEVATNSFASSETKKLEDLCPSVQQSGAIEQPEAYAANINNRPPQPQQQNLPQQKNYDLSSNRYNPRWRNHSNLRWSSPPQQQQQQQQPYFQNAAGQSRPYVPPPIQQQQQQQQQPQK

SEQ ID NO: 148158 - protein, 23 aa, Glycine max
  Coding DNA Sequence Number=SeqID_56473
IKKIQVKIQEKTQDMQELQEKHQ

SEQ ID NO: 148159 - protein, 80 aa, Glycine max
  Coding DNA Sequence Number=SeqID_56474
MRMGLFALTLNRSQELPRLLAKAKAMADTYSAPKEIHGLPSYSCIARPPPSFVTGSRKDHITFLIVHMGHCAPKCASKKR

SEQ ID NO: 148160 - protein, 87 aa, Glycine max
  Coding DNA Sequence Number=SeqID_56475
MGVQIAPRPTWALQKAVASGGSNLARLGELGGNHLPYFAINRGGSEEEKAEALPKRFRNVFREEFREGFDRSSTFFIRSSSFFDLQR

SEQ ID NO: 148161 - protein, 150 aa, Glycine max
  Coding DNA Sequence Number=SeqID_56476
STLEDPPVAQQLHDPRTAITHNVTGLGVEQTHFEIPHPWSMYSTPSPVHQTFGHTSESVTATTHEWMTDLFGVDFNTPNSVASYLATLQQFDAPHLFGEQGQSSSTATTNIENTNTEQQHHHDVGEPVILERRNLRRNRRPPPCGTGHRL

SEQ ID NO: 148162 - protein, 288 aa, Glycine max
  Coding DNA Sequence Number=SeqID_56477
  Homolog annotation: Hit_ID=A2Q4S5; Match level="QueryCoverage=37%, HitCoverage=16%, E-value=4e-17, Identity=43%"; Hit description=IMP dehydrogenase/GMP reductase, putative
MTFQVIFSGGFRVTFQVIQEGVILEKCWIYEHFPSVTESTADQDYDEASPCACRWIATKKTVKSFRTPAYRERLDRLRISDVCWIPYGEHREVRDFHVRSCYSGLLRWGPVAVYYRPERVVRQFGYTQTIPTPPVDSWVSYDDIHDRWMHYKDHIVPAGEVCVVPGACSSDYIDWFFRISHPFMTPGHAVDPLPHGHAPQPRVVPQAPQTDIPHVSEPGASSTSTEEPRHEVCDDIAERLEHHLSLGVLTPGSSTHEVIEECLRLARSVTQDHLVYVRCRRRRRTDQA

SEQ ID NO: 148163 - protein, 79 aa, Glycine max
  Coding DNA Sequence Number=SeqID_56478
  Subcellular localization annotation: CTP_CleavageSite=70; ConfidenceScore=5.47e-01
NISRAPQIHYLTTLPVNSYRKVVMPPKALGISLRGGRSTGKGSRLALPEPTTKKSSTSYGSPTQAGSSIRKTNLEGSST

SEQ ID NO: 148164 - protein, 112 aa, Glycine max
  Coding DNA Sequence Number=SeqID_56479
MSSIVCRDHAHERPSGPGEVQQGPGVSSSSYGPLSVLQGAHPPARTCHRDIGITPTRHLVDPKKSNRAPGFPALVMGLCPSYRAPVPPASSCHRDIGKDHTRKTFSGLGEVQ

SEQ ID NO: 148165 - protein, 51 aa, Glycine max
  Coding DNA Sequence Number=SeqID_56480
MVANNSNKCDDGSAMVCKSVKSRINETLCLIQILVMDLKRANKAALTLVNF

SEQ ID NO: 148166 - protein, 45 aa, Glycine max
  Coding DNA Sequence Number=SeqID_56481
MAPKKLSAKRSRKDTVAEGTSATPEFDSHHFRSTEHQQRFEAIKG

SEQ ID NO: 148167 - protein, 313 aa, Glycine max
  Coding DNA Sequence Number=SeqID_56482
  Homolog annotation: Hit_ID=A7ZN99; Match level="QueryCoverage=50%, HitCoverage=30%, E-value=5e-28, Identity=40%"; Hit description =Conserved domain protein
MERALTHKDEQEAASAVDMLMGGEANKILTYMRLTGKSYKELMDQQKRYNLVTKEGADGAIRGNIAFSNLRSVWGAAVEEIAGKLGGSLAPKVTQLADELSAWFKNGGIEIISTTIKNKWIPNMVEFANGIMTVTKLFLAIARRLSWLLPNEQSDKKAIVRSLGKGDIEGARDFAQSHGLGPWLESIIADPKKQKTLQGIYRDTQYSVTSERVFSPGEYWDKADDRALAAIGETDKNDDPLDGAFAYLSSLINQSTAGDKPQVTDNSRKEIHMNVYALPGQDAQAVADSAVSSLKNMDVFNGNNAMHDPAEAW

SEQ ID NO: 148168 - protein, 80 aa, Glycine max
  Coding DNA Sequence Number=SeqID_56483
MFHPANSITSCGHNISHHESELPRNISNLHDDEDDDDDYLASNSYVEKSFDEDDSVDGISDTDDEVTDIVEPVSIVHPTK

SEQ ID NO: 148169 - protein, 135 aa, Glycine max
  Coding DNA Sequence Number=SeqID_56484
NIVPLDLEIEATLRRNRAERRRKLLQDRTVASILEEESHSSDLLSPDSPSSRESVTQLPEAITMVEEHDQRITLEDYASSSVPQFFTSIARPEVQANNINYPHSLIHLIQGDLFQGLPNEDDGILLVGLLWRLDL

SEQ ID NO: 148170 - protein, 62 aa, Glycine max
  Coding DNA Sequence Number=SeqID_56485
MPNSNLSKFKLGKMLIHEKGGDMAYNAFLNNGTCHIVPVLLLLTPKRAPTKCSVKCLNGISA

SEQ ID NO: 148171 - protein, 71 aa, Glycine max
  Coding DNA Sequence Number=SeqID_56486
MRGYLMVIRIFRQPEASKPVDTQRLTLSSAPLSSGDGESDDRRGFYFRHPETSKPDDAPDSSLLGRDDRVQ

SEQ ID NO: 148172 - protein, 95 aa, Glycine max
  Coding DNA Sequence Number=SeqID_56487
MYMNHEDVGCMTDFTKEGCNTQHIHHITYFRDLVPNVATCPFAGERRRGSRVRFPKEERSAESPPTFICGKRRKNRRKPVEMKILSSGVVFTFEE

SEQ ID NO: 148173 - protein, 121 aa, Glycine max
  Coding DNA Sequence Number=SeqID_56488
  Pfam annotation: Domain name=G-patch; Domain location=46-90; Score =11.6; E_value=0.0075; Accession=PF01585.14; Description=G-patch domain
MDSLGGSCPFNAPPKTKIHGGGALSHCFEGGGCSESLSMRPRMSGVAMMVACVMLGHNYESGMGLGKNNDDMTSLVDIKENRGKFGLGYKPTRTDVRRSIVERRNRGASPQLRPQAREDPP

SEQ ID NO: 148174 - protein, 99 aa, Glycine max
  Coding DNA Sequence Number=SeqID_56489
  Homolog annotation: Hit_ID=A7Q846; Match level="QueryCoverage=44%, HitCoverage=30%, E-value=6e-08, Identity=50%"; Hit description =Chromosome undetermined scaffold_62, whole genome shotgun sequence
MKVSKNYLNFQHCTLEGAEVNKWRWFERCIGAQNETHIPVAISPDERPRYHDRKGDVSTNVLAACGPYLRGKEGGGCRPTHPGELGCFHQKAPPSGGRP

SEQ ID NO: 148175 - protein, 194 aa, Glycine max
  Coding DNA Sequence Number=SeqID_56490
  Subcellular localization annotation: CTP_CleavageSite=6; ConfidenceScore=5.02e-01
MARKARSSPFWPCMTRSTGDVKRVTQELFVVHWLSMCGWFHTFFSKKVGPSIRYKVTARRKNQDSIFMRRMSKCSLDGTRGCINYNPVLAIRQLGYPMRGVPSYESITPFIARGFSDPNARDRELRGSSNGSIGGYHKWLRVWTQGLDWLPNLKTMRDDEVKALEESDEVQALKAELERARVVKEKFKSIAIKV

SEQ ID NO: 148176 - protein, 66 aa, Glycine max
  Coding DNA Sequence Number=SeqID_56491
MRLTAYESSRLYKERVKTYHDKKVLKKNFQPGQQVNYATLKNATFHLLAKPICRLSERPLSATLIS

SEQ ID NO: 148177 - protein, 102 aa, Glycine max
  Coding DNA Sequence Number=SeqID_56492
TYQGNPCGVYPDLSSFIGSGVYPDLSSLTGSGVYPDLSSFTGSGVYPDLSSFTGSGVIQKLYSLYKVIRPVRLKAQVEKDEGPSGEGQSPRVEKDEGPSGEG

SEQ ID NO: 148178 - protein, 69 aa, Glycine max
  Coding DNA Sequence Number=SeqID_56493
  Subcellular localization annotation: CTP_CleavageSite=31; ConfidenceScore=5.13e-01
MLEAAIATALASIIFFTLITASIIVAIFSLMASMSAFIFSCISSTSPITLALARFRNGFMIPTWLAHGA

SEQ ID NO: 148179 - protein, 113 aa, Glycine max
  Coding DNA Sequence Number=SeqID_56494
MTKGSVLGLTRHCQWRQSWREAGIVTGSGDIGGERLGLADRDGEIGQGQSRRFKASCRLRMLSLFMMRLNIRSEIGLITSCKCSQNTCNDIEYLQNFILKESKKLKRGRKRFV

SEQ ID NO: 148180 - protein, 29 aa, Glycine max
  Coding DNA Sequence Number=SeqID_56495
MKKTTMEEKLACGASMEAGSLSFNEVLQW

SEQ ID NO: 148181 - protein, 443 aa, Glycine max
  Coding DNA Sequence Number=SeqID_56496
  Gene Ontology: Mol. function=oxidoreductase activity, acting on the CH-OH group of donors, NAD or NADP as acceptor; Cellular component =cytoplasm; Biological process=metabolic process
  Homolog annotation: Hit_ID=A7IIH0; Match level="QueryCoverage=69%, HitCoverage=97%, E-value=1e-107, Identity=63%"; Hit description=D -isomer specific 2-hydroxyacid dehydrogenase NAD-binding
  Pfam annotation: Domain name=2-Hacid_dh_C; Domain location=235-408; Score=202.3; E_value=1.1e-57; Accession=PF02826.10; Description=D -isomer specific 2-hydroxyacid dehydr
  Pfam annotation: Domain name=DHquinase_II; Domain location=2-146; Score=159.1; E_value=1.2e-44; Accession=PF01220.10; Description =Dehydroquinase class II
  Pfam annotation: Domain name=NAD_binding_2; Domain location=267-431; Score=-69.2; E_value=0.0024; Accession=PF03446.6; Description=NAD binding domain of 6-phosphogluconate dehydrogenase
  Pfam module annotation: Pfam domain module=2-Hacid_dh_C::DHquinase _II::NAD_binding_2; Domain location=235-408::2-146::267-431
MPQIFFLNGPNANLYGMDRHGTYGSDSFASIGERCQQRADAHGLRLQFRQSNHEGVLVDWIQEARQQADGLIINAAGLSYRSVPILDALLMFDGPIIEAHMSNIWQRESFRHQSLVSKAATGVIAGLGALGAKRMTTLVFYSEFDSFEAWSALLAPQLPDVTICRADQVEDADSVQFALAWKPPRGFFAPYRQLKLLVNLGAGVDSLVGRDDLPDITIVRLSDPDMARMMAGYVLFAVLRYARDIPAFERAQREHRWHYLHPREPASIRVGVLGLGELGAYAARELARQGFDVRGWSRSPKALDGIHCVSGMQALDAFLTSSDILVVMLPLTPQTHGLLDAQRLARLPPGCALINVSRGAIIDQPALTAALQSGQIAHATLDVFDREPLPPDDALWGMENVLITPHLASVAIPASAARQVADNIQRVMRGEPVLNQVFPARGY

SEQ ID NO: 148182 - protein, 111 aa, Glycine max
  Coding DNA Sequence Number=SeqID_56497
VLMITKDDDKGDEQKAQRSKNNSSESRTSQEFKNQEEFKTQEESLESRIKIQDSRSQESRSRFKTQDSRMKKRPNQDKYIYLGLTENKRGYISCGSVLVEGTSTRFKENKG

SEQ ID NO: 148183 - protein, 320 aa, Glycine max
  Coding DNA Sequence Number=SeqID_56498
  Homolog annotation: Hit_ID=UPI00006A2D9E; Match level="QueryCoverage =56%, HitCoverage=85%, E-value=2e-16, Identity=18%"; Hit description =UPI00006A2D9E related cluster
TFRGLHVLTFVRATRPHLWRTACPHLQRLHALAFRGLHVLTFSGLHALAIRGLHVLTFRGPHALAIRGPHVLTFVGLHALTFRGPHVLTFKGLHALAIRGPHVLTFRGLHALAIRGPHVLTFRGLHALAIRGLHVLTFRGLHALAIRGLHVLTFRGLHALTFRGPHVLTFRGLHALAIRGPHVLTFVGLHALTFRGLHVLTFRGLHALGSEDYTSSSSEDYIGLRALAFVGLHALTFRGLCPHLQRATRPRLRRATRPHLPRTTCPHLQRATRPRLRRATRLHLPRTTCPHLQRATRPRLRMATRPHLPRTTCPHLQRTT

SEQ ID NO: 148184 - protein, 39 aa, Glycine max
  Coding DNA Sequence Number=SeqID_56499
GIHVLEVMQSYPARALGRRLQVDWARDPREGPRVLMNLR

SEQ ID NO: 148185 - protein, 223 aa, Glycine max
  Coding DNA Sequence Number=SeqID_56500
  Gene Ontology: Mol. function=tetracycline:hydrogen antiporter activity; Cellular component=integral to membrane; Biological process=response to antibiotic
  Homolog annotation: Hit_ID=Q47336; Match level="QueryCoverage=17%, HitCoverage=44%, E-value=2e-10, Identity=80%"; Hit description=LacZ -alpha peptide
MPISPCERVAPTRHSMDPEKSNRALGFPALVTGLYQSYRVPVPPGKVMPSRHRDRARRTPSGPKEVQQGPGVSNSNYGPLSSGLLLTELSSRSTAPPRKVQGETPQQPGDGRQRAINAPPPPLEFTSSNSCRPGDPLVLERPPPRWSSNSPYSESYYNSLAVVLQRRDWENPGVTQLNRLAAHPPFSCWIAHPEWRTGRALERRIKRGGCGGYAHRDRYTCQR

SEQ ID NO: 148186 - protein, 109 aa, Glycine max
  Coding DNA Sequence Number=SeqID_56501
  Homolog annotation: Hit_ID=UPI00016621D1; Match level="QueryCoverage =97%, HitCoverage=37%, E-value=9e-09, Identity=37%"; Hit description =UPI00016621D1 related cluster
LHVLTFRGLHVLAFRGLDVLAFVGLHALTFRGLHVLTFRGSCTFTFRGLHVLAFKGLHALTFRGLPVLAFKGLHALTFRGLDVLALRGLHVLAFGGMHALIFRGLYVLP

SEQ ID NO: 148187 - protein, 223 aa, Glycine max
  Coding DNA Sequence Number=SeqID_56502
GPSPKQARVRGHLVKIDADSLNTFLETPVVLAEGETFPPYSRYCRLPTDYREIEAALCIPSQGFILNAKGYFGRILMKDLTTLAQSLHVVAPLGSIPSVEQFLERVAWLRAQPSLYREDEGPTAQVPQHVEDESSEATILKPFIVEEEAGETQVRHEVAATPERSLKGTSKPPAPVVDLSSPQHAVDPSTPILEIPEDPTTPILTLNTSPSATPVLHLTDEED

SEQ ID NO: 148188 - protein, 322 aa, Glycine max
  Coding DNA Sequence Number=SeqID_56503
  Homolog annotation: Hit_ID=Q6WAY6; Match level="QueryCoverage=72%, HitCoverage=43%, E-value=2e-10, Identity=27%"; Hit description =Putative uncharacterized protein
MRRISNVPLKGTRGCINYNLVLAIRQLGYPMRGAPLEEELTPVISRGFSETNVETLRKVRKAWEVVQKKDKEHRGSNNGPIGGYREWLKAHMQGLDWLPSLRTAKREEVEAPEEDEEVQALRTELEQAQTVKERFKSVALRIQKENAELRDVNVATTKALEQETKRSRREEHGRNKFRGALWGSNSELKLRREERDQSRVDSLILKDELKACSRSERSLSQRLCETETNMLAIITKYQEELNLAAAHEHRVVDEYARVYAEKEARGREIDSLHQEATMWMDRFALTLNGSCRNLPFGGRATRDSRDACSTKGIRAESPPTFI

SEQ ID NO: 148189 - protein, 123 aa, Glycine max
  Coding DNA Sequence Number=SeqID_56504
  Subcellular localization annotation: CTP_CleavageSite=13; ConfidenceScore=5.06e-01
MLLSSNVIYICVRVDMLVRMIRTRLFAAARVKSCPSMHSSSVIASLSSCARTVGPPPISGGGPGTVKRKLLVWIWSPLKVRTRSPLKARTCSPLEVRACSPLMVRTCSPLKARTCSPLNGEGN

SEQ ID NO: 148190 - protein, 108 aa, Glycine max
  Coding DNA Sequence Number=SeqID_56505
MQRKDRELRGSSNGIIDDYHKWLRVRTQGLDWLPNLKTVRDDEVKASEESDELKPWNEKPRRPERKNTTKTSFEGLYRAAIVSSSSEEVKGIITGQRNDLEGRAKGLP

SEQ ID NO: 148191 - protein, 193 aa, Glycine max
  Coding DNA Sequence Number=SeqID_56506
MTLTYKNRRITRPFRLARFGDDADAGSRQARQGASAGVGGCRGWLNYAASEQIVLRVHHMRCEIPHRCVRRKYRIRRHSPFRLRNCWEGRSVRASSLLRQLAKGGCAARRLSWVTPGFSQSRRCKTTASAKLACLQVDSRGSPHLSERSCNPRPRSSNTARPLQPAMTHGVNGGDEHGSDRPRQRERVPSSNS

SEQ ID NO: 148192 - protein, 261 aa, Glycine max
  Coding DNA Sequence Number=SeqID_56507
  Homolog annotation: Hit_ID=A5BSR3; Match level="QueryCoverage=28%, HitCoverage=23%, E-value=6e-07, Identity=43%"; Hit description =Putative uncharacterized protein
KLKEAAQSGSMDGVIDLPSPVKRHVKWKMARTKKTREMTTEAAKEIADKIGNSFEEQASQGSFIPHGCQDVLTAAIGCLEHPGRVCASRGPARGVDQRKSDSATHGIIQPDAVPVLVPDAISGTAFEASGNDPETSDSDRCGLYIEAHPTRLVALGRVYERFIVVHNTLLLSGQVKVGNSHLPCLSDTSGQAFITAVVSPAKPPQKPDPKVDDPLYLMTLTIPKLFLRPYQVTWDATMFGVFNPDFPLYIKHKDLSKIAHG

SEQ ID NO: 148193 - protein, 72 aa, Glycine max
  Coding DNA Sequence Number=SeqID_56508
  Homolog annotation: Hit_ID=Q2HW89; Match level="QueryCoverage=38%, HitCoverage=2%, E-value=4e-07, Identity=85%"; Hit description =Integrase, catalytic region; Ribonuclease H
MSHAVKDNRGKWAPNYEGPFMVKRAFSGGALILTRELRWIPIHCICLISLKRKDGRGFSPPFGFKPCVLDLL

SEQ ID NO: 148194 - protein, 86 aa, Glycine max
  Coding DNA Sequence Number=SeqID_56509
MGAKYLEVVKRKLHPNNGWSPDEIRTQNDHNSSLRFVGHDRAWAARHRMTIICLYVPPDTIASGWRKGAQNDHNLSPRIYHPTCCS

SEQ ID NO: 148195 - protein, 178 aa, Glycine max
  Coding DNA Sequence Number=SeqID_56510
MFHSANSLTSCGNNLSNNEAQPPINVSNLHGDEDDDDDDYLVSNSYVEESLDKDDSIDGISDTDDEVTGMIQPVRIVHPVEGVQGIQNPFWNDVLHYNNINWSHPDDEDICGLEMPSSFNVGQELYVGINFDSKDVVKNAVKQYVMKVHQSFKVVESKSNKHDQRRSINKSFFDSREA

SEQ ID NO: 148196 - protein, 136 aa, Glycine max
  Coding DNA Sequence Number=SeqID_56511
MTLLLSNILPSDRNANLPLQKYQLVCVVPTWGSHPQRHLVDLKKSNRAVGFPALVTGLYQSYRVPVPPQQGHVIIGIVPARHPVDPKKSNRVLELSSSNYGSLKGIRPPTNRAFIKKYCVSRQAQGETPHQHWDGR

SEQ ID NO: 148197 - protein, 188 aa, Glycine max
  Coding DNA Sequence Number=SeqID_56512
  Homolog annotation: Hit_ID=A0ST23; Match level="QueryCoverage=23%, HitCoverage=91%, E-value=2e-11, Identity=73%"; Hit description =Putative reverse transcriptase
DAGSRQARQGASAGVGGCRGWLNYAASEQIVLRVHHMRAIGAGLFAITPAGERGMCCKAIKLGNARVFPVTTLSTLEDPPNGLVQAELWGLYEELKLAFSKGLRLIKGIQQLLAQEWTIKLVSIFKEANKCVDAIANEACEMGTELEFVIMVIAVSFGKPVVPAALMNRPTRGERRFAYWALFRFLAH

SEQ ID NO: 148198 - protein, 174 aa, Glycine max
  Coding DNA Sequence Number=SeqID_56513
  Gene Ontology: Mol. function=aspartic-type endopeptidase activity; Biological process=proteolysis
  Homolog annotation: Hit_ID=A5AK77; Match level="QueryCoverage=60%, HitCoverage=13%, E-value=8e-13, Identity=38%"; Hit description =Putative uncharacterized protein
MAQPLPRERTLRETAAPDFTYENLCIQYPDKGVPYVLKTGLVHLLPKFHGLAGEDPHKHLKEFHIVCSTMNPPDVKEDHIFLKAFPHSLEGVAKDWFYYLAPRSCNLVGLSNIERSMIDAASGEALGNMTPAEARNLIEKMASNTQQFIARNDAIHLHLLKIKSLKENLMPWST

SEQ ID NO: 148199 - protein, 147 aa, Glycine max
  Coding DNA Sequence Number=SeqID_56514
MACLDQQHSGKEGQTVVVMEDLSISDLDDSFNLDCIYCMKGHNYSAVVGFAAEEMKMNSIISCNELLGVGSHLLNQIPSLSRGHISKSFTTGSINHTPLNVAKSLIEILKKELLRNQVVRTACTQFVESFLVLIQAFTTKLHDLGAR

SEQ ID NO: 148200 - protein, 155 aa, Glycine max
  Coding DNA Sequence Number=SeqID_56515
MAPKKLSTKRSRRDAIGEGSSTAPEFDSHRFRSAEHQQRFEAIRGWSFHRERRVHLREDEYMDFHEEIARRRWTPLVTPMAKFDPEIVLEFYANAWPMEEGVRDMRSWVRGQWIPFDADALNQFLGDPLVLEEGQQCEFSQRRNKADGFGDEAIA

SEQ ID NO: 148201 - protein, 52 aa, Glycine max
  Coding DNA Sequence Number=SeqID_56516
MHIVVVKQGRDHLELPSGVGTKHEQQKPTKVLRNGYNWGWGHDRLIVAPSLR

SEQ ID NO: 148202 - protein, 62 aa, Glycine max
  Coding DNA Sequence Number=SeqID_56517
MEKEKHASYSSHDSCKSLSEELSDYYRGRHRSHPKPHSHRREKERKPQEANINLSYFHGKNN

SEQ ID NO: 148203 - protein, 58 aa, Glycine max
  Coding DNA Sequence Number=SeqID_56518
DAYAMHDMNAFYEHESPENYLFLLAHLGAQCPMCTIKKVSAIALALANNRGKFLTPVQ

SEQ ID NO: 148204 - protein, 50 aa, Glycine max
  Coding DNA Sequence Number=SeqID_56519
MRKTLEEDERYRFTKRTASVHPLSQKSLMCAKRSIHLQRPEHEAGAGLRA

SEQ ID NO: 148205 - protein, 64 aa, Glycine max
  Coding DNA Sequence Number=SeqID_56520
MSIQSTLDDIDKLNMDKDEDDYVPQPSTNTMEDVNPNESNMGDESHSFDEEGSPKVDPTLTSWI

SEQ ID NO: 148206 - protein, 123 aa, Glycine max
  Coding DNA Sequence Number=SeqID_56521
MDNEEGVQEQMKADLSALKDQMASITEVVLKLQKTIEDNSMTAASNTAREAEPVLQPAINLGRDRNMTVLGRRYSPQAYPYDLPSDFTPRTAPDDLSQAPTFVGQLPPYADYPFKKMMKEMPI

SEQ ID NO: 148207 - protein, 87 aa, Glycine max
  Coding DNA Sequence Number=SeqID_56522
MTSSSSCSSSIQTRSGPIEGDVLWMQPKHVSEHVWNGEPDRKLHIRRAIPTYQGEEQIPEEIVPLLRQCGFYWIIKMGYLKINAALI

SEQ ID NO: 148208 - protein, 130 aa, Glycine max
  Coding DNA Sequence Number=SeqID_56523
  Subcellular localization annotation: CTP_CleavageSite=40; ConfidenceScore=5.06e-01
MEVNTATVVAASTATKVDLTHPSGLNHFRTSIPSHHTPPNVAHTPDENVNNSTPILIESQQPQFGQAQVPQPIGETHEVPRDHTLADFEPCLGYAIKEQAFGGVPLLNTLGGPQYHPQPQTLHFVVGGIL

SEQ ID NO: 148209 - protein, 125 aa, Glycine max
  Coding DNA Sequence Number=SeqID_56524
MAYERGGDFLEDARKILNREAFPPGGSLVRSPVPAFRFTGVIPLLWPRLSHSTPDTQFRVGSSLQAGLYARTPRSVRPLRLIRHAPVKAKTEKDKFLVTALLQASYLGSKSWVAQRTFEKTALQG

SEQ ID NO: 148210 - protein, 313 aa, Glycine max
  Coding DNA Sequence Number=SeqID_56525
  Homolog annotation: Hit_ID=Q2HW90; Match level="QueryCoverage=70%, HitCoverage=44%, E-value=2e-25, Identity=32%"; Hit description =Putative uncharacterized protein
MGSSQKPSFKKRFYQVKIKSLEVTSLRELGQLMGQLQRQAFRKAYGKIWDLARVEVSTESIASLAQYYDHPLRCFTFGDFQLSPMVEEFEEILGCPLGGRKPYLFSGFYPSLARISKIFQILAKELDHQKQVENGVVGIPRKCLEAKARILAGRNECAPFIDVIALLIFGGVLFSNVDGLVDLAAIDAFLAYHNHKESPVVAMLADLYDTFDRGCEKSSARIVCCALALYVWLVSHLFLQEGRPVYPLQGHRSCVEKGKANWDQLLASMEGRLLIGSLARRKEELGLYLHAKDVQMFPGWEHGVVLIIILCSP

SEQ ID NO: 148211 - protein, 218 aa, Glycine max
  Coding DNA Sequence Number=SeqID_56526
  Homolog annotation: Hit_ID=Q6WAY6; Match level="QueryCoverage=89%, HitCoverage=38%, E-value=2e-20, Identity=30%"; Hit description =Putative uncharacterized protein
MASQGDWVPFMDVLALLIFGVVLFPNVDGLVDLAAIDAFLAYHHSKESLVQDTRHPCPLQSHRSCTEKRRIDWDQLLAGIGGRTINWFPRWKEGKEGVLFSCGGYPNIPLIGTRGCINYNPALAIRQLGYPMRGAPMEESMSPFLVRDFGAQNFKAIQRIHKAWETPLRKDQELRGIRNGIIGGYHEWLKVHIRGLDWLAKLKLVSEESFEAPEEDEE

SEQ ID NO: 148212 - protein, 66 aa, Glycine max
  Coding DNA Sequence Number=SeqID_56527
MRGANEPVGARTDIRPSAPFVVVDREIKVTCGVTLWLPAPLVNHGQRIRWRVENYIVFCSFCRPDP

SEQ ID NO: 148213 - protein, 86 aa, Glycine max
  Coding DNA Sequence Number=SeqID_56528
MNCVFVHASSTHEFGAMRSDCLVQFSILNPYRSRMNCVFLHASSTHDFGVMRSDCLVQFSILNPFSEHHELCFRSCVLHPRLWSHA

SEQ ID NO: 148214 - protein, 84 aa, Glycine max
  Coding DNA Sequence Number=SeqID_56529
MSDGFCGTHLQIMVRTRGLGRALSQVTGRGLDRGDRDDSDDAPQRRRPTASAWRQRVAVTVDHVDEPVIPAPDVQDDPMEAPTA

SEQ ID NO: 148215 - protein, 392 aa, Glycine max
  Coding DNA Sequence Number=SeqID_56530
MEVETLEDRITWELGYNVRTKFLGDDMVLLPGMSDDKAKLLIQSETESDDSLFYSLEKWTPKCRPNNRVVWLQLWGFPIQVWEMKNLRRAVAAIGDVIESDDDTEDRRRLDRARVLVQTPLPPLIRSEVIVRVGELEYRVWIVEETGFEGGSNRKGSSPSDGWSEMITSDDGGEVGDVLDDTNTNFSFSPELPNQKLSPSRTQRAEGGTDVRCCDLRPLGNIQADVTPKEKSKGTVEGMLGSSFGKLNLGDSFAGTEEEAANTKEVTCYNTLHDDRRHRNHIEGKYLNGGAKVAADQTFIGEEEGHVTQSLSPSLSGQIQQGIGPGCIKGPISTQGGCNKEDIHPVELLGVQAVQNKKEGGLSNDLGPILKTDGCHKKESLPVIQSIKETPD

SEQ ID NO: 148216 - protein, 173 aa, Glycine max
  Coding DNA Sequence Number=SeqID_56531
MKREKHASYSSHNSCKSLSEELRDYYEGRHRSHLRPHSHRREKERKPQEANIKLSYFHGKDNVEANIDWEIRVEQQLKKKTHYFSMPHHKNHDYEGQDIYSSQDEATTSPSSSESEKAKGEESSEEIYPQEEGQPLVVKEKCKEALASIATPLGLEFIPQVKKLLDDGLGPIR

SEQ ID NO: 148217 - protein, 26 aa, Glycine max
  Coding DNA Sequence Number=SeqID_56532
MDNSEPSTGAMKGSIRDPQASYGPSK

SEQ ID NO: 148218 - protein, 150 aa, Glycine max
  Coding DNA Sequence Number=SeqID_56533
MRKQEVILHGIWKWNVYWLMYLEIKGICATRVAEVGKDRATGHGAETAMDADEAMSRETNEVEFMGLGATAIDLEEPSSNTKGKKQGSTSSGTHPHKRKMGEKEGIIASLDKMANSFNRMVEKMDGKVDDEDIQEVLREATLIPDLNRQQ

SEQ ID NO: 148219 - protein, 179 aa, Glycine max
  Coding DNA Sequence Number=SeqID_56534
  Pfam annotation: Domain name=G-patch; Domain location=1-42; Score =21.1; E_value=0.00054; Accession=PF01585.14; Description=G-patch domain
MVARVMLRNGFEPGMGLGKDCLGNADVVDIKGNPYKYGLGYEPGMPGRRNVPSRFRADRVWPDRISQCFTSAGMVSEEEVATIEEEFPQDPPSFVQPCDPDSQVGNWHMISQSEVYTADSIYEGRFFEGPNNEGLKIDFDRDISQKINEEEEEDVLSPELERLVAQEEREMKPHQEETE

SEQ ID NO: 148220 - protein, 107 aa, Glycine max
  Coding DNA Sequence Number=SeqID_56535
MEVYQVPEIMEERRERKRERETFFFEESATVFASELRNVILGELVEGLVEDGSEGGGGGTAVHGLRFRHPLVGGTINFVESVVVVQRLGWGEMGEGWEGFFRTWGEP

SEQ ID NO: 148221 - protein, 490 aa, Glycine max
  Coding DNA Sequence Number=SeqID_56536
  Gene Ontology: Mol. function=oxidoreductase activity, acting on single donors with incorporation of molecular oxygen, incorporation of two atoms of oxygen; Cellular component=plasma membrane; Biological process=...
  Gene Ontology: Biological process=methionine biosynthetic process
  Homolog annotation: Hit_ID=Q8H185; Match level="QueryCoverage=36%, HitCoverage=98%, E-value=4e-80, Identity=75%"; Hit description=1,2 -dihydroxy-3-keto-5-methylthiopentene dioxygenase 4
  Pfam annotation: Domain name=ARD; Domain location=313-461; Score =261.2; E_value=2.2e-75; Accession=PF03079.5; Description=ARDARD' family
  Pfam annotation: Domain name=CCT_2; Domain location=222-249; Score =28.0; E_value=3.5e-05; Accession=PF09425.1; Description=Divergent CCT motif
  Pfam annotation: Domain name=Cupin_2; Domain location=387-459; Score =21.0; E_value=0.0025; Accession=PF07883.2; Description=Cupin domain
  Pfam annotation: Domain name=tify; Domain location=130-156; Score =10.3; E_value=0.014; Accession=PF06200.5; Description=tify domain
  Pfam module annotation: Pfam domain module=ARD::CCT_2::Cupin_2::tify; Domain location=313-461::222-249::387-459::130-156
MSKTRVRTGMRRPSWNKSQAIQQVISLKALLEPSDDDTPPPTAMHHRSHAPPPPPQPQSQVNLTEPPPPPKAPPPEESSFHAAEDIQKPASSGEKPSETNDTNTNVASPNSVKSEGCGLEGLDRRIWVVKTLNVTVNVYDGVSPDKARAIMQLAVSPVQFTQDDPSNGNAAVWPSPCHLPMDKDVLIPVDTTILQVAQSDKMMEYPLQYREKGSIARDAEGQASRKVSLQRYLEKRKDRGRLKGKKLTGITSSNFEMYLNLPVKVHASNGNSSRSSTSSPPQPRLPLVSSGSADNQLKVALPIDLNDKVGTLQAWLMDESNEDPRLPHRRNPNKSVSLDQLAEFGVLYWKLNPTIYENDEELAKIREDRGYNYMDLLDLCPEKVENYEQKLKNFYTEHIHQDEEIRYCLEGSGYFDVRDKDDRWIRILIKAGDLIILPAGIYHRFTLDPSNYVKGEPVWTAYNRPQEDNPARKEYIKGLTEKFGVPLATH

SEQ ID NO: 148222 - protein, 343 aa, Glycine max
  Coding DNA Sequence Number=SeqID_56537
  Homolog annotation: Hit_ID=A7NWU5; Match level="QueryCoverage=62%, HitCoverage=86%, E-value=1e-76, Identity=66%"; Hit description =Chromosome chr5 scaffold_2, whole genome shotgun sequence
MLAVFDKSVAKSPEGLQSPHSDSVSALKDGFIAEHFSSVHPGSVTVNLGSSGLLAYSLHRQNPLLPRLFAVVDDIFCLFQGHLENVANLKQQYGLNKTATEVIIIIEAYRTLRDRGPYPAAQVVRDFQGKFAFILYDSGSKTAFVAADADGSVPFVWGTDADGNLIFSDETEIVTKSCGKSSAPFPKGNNKTPLLNISCEITPLKIIQANTRMETRMEAMEKAIEENREAVEARLSSIEGMIQRLAASWEKKPPESNGEDPMGWLTKTERYFRLQAVREEDKLEVVMVAMDGEALGWFQWWESWNPNHSWEGFKITISQRFQASNLGNPFQALLALEHEETVQ

SEQ ID NO: 148223 - protein, 71 aa, Glycine max
  Coding DNA Sequence Number=SeqID_56538
  Homolog annotation: Hit_ID=A7NWU5; Match level="QueryCoverage=69%, HitCoverage=19%, E-value=3e-15, Identity=81%"; Hit description =Chromosome chr5 scaffold_2, whole genome shotgun sequence
MSDIWIFNGFFFSTSGGLSSFEHPLNEVKPVPRVDSSGQVCGATFKVDAEAKKEATGMPRVGSAANWSNNI

SEQ ID NO: 148224 - protein, 95 aa, Glycine max
  Coding DNA Sequence Number=SeqID_56539
MDSINESAKVITFCAVSFCSRSPQPPLSEKEALLLWQWRWRATKSTPSLAINAKVEYNNDNKHESEDEGDREIDDEGDCESDGEGHRESGNKGQH

SEQ ID NO: 148225 - protein, 56 aa, Glycine max
  Coding DNA Sequence Number=SeqID_56540
MAMAMAMVMALGVYRGPRFWEGGQEIYIDDDFGFRSCHDDNTWLCWVGYMLSTWLR

SEQ ID NO: 148226 - protein, 156 aa, Glycine max
  Coding DNA Sequence Number=SeqID_56541
  Homolog annotation: Hit_ID=A7QGV8; Match level="QueryCoverage=48%, HitCoverage=39%, E-value=9e-19, Identity=52%"; Hit description =Chromosome chr16 scaffold_94, whole genome shotgun sequence
  Pfam annotation: Domain name=ATS3; Domain location=1-58; Score=-16.1; E_value=1.5e-06; Accession=PF06232.2; Description=Embryo-specific protein 3, (ATS3)
MRQDWMIQLQICYVYLYRSGLDGWKPESVKINGYNGRPVTFYYNTYIPRDTWYGFNLCNGASSSSSYQVSMQKWLIFMVLGFVLSCWFFILTNNGQTFHEFVASELFKQLMSLFPGSSDAIIRQKKGLGGLLFYTNSITSKMISLARVAIVGVSIF

SEQ ID NO: 148227 - protein, 98 aa, Glycine max
  Coding DNA Sequence Number=SeqID_56542
MRNPQGKWERALRGSASPGNKEGGNMVAQNGTVGPSFAQVRMLQLRRGDCMEERNMVLVGNGFHYVIIAVMVIWSSAQEVELFLLFTKDTRLPHFFSL

SEQ ID NO: 148228 - protein, 146 aa, Glycine max
  Coding DNA Sequence Number=SeqID_56543
  Gene Ontology: Mol. function=protein serine/threonine kinase activity; Cellular component=integral to membrane; Biological process=protein amino acid phosphorylation
  Homolog annotation: Hit_ID=A7QGX1; Match level="QueryCoverage=93%, HitCoverage=18%, E-value=2e-50, Identity=68%"; Hit description =Chromosome chr16 scaffold_94, whole genome shotgun sequence
MRGTVFYVAPEYGYNGDASEKCDVYSFGVLLLVIVSGRRPLEVTGSPVSEFQRANLVSWARQCARRGKLLEMVDESVEGMDKEQASMCVTVALMCLLKSPARRPSMKEVVGMLSGEMEPPLLPPEYSQQAKFTFKSRLRCGLAVGD

SEQ ID NO: 148229 - protein, 32 aa, Glycine max
  Coding DNA Sequence Number=SeqID_56544
MVVGSVATTLLPFAASSREGTTCTLYILLSSS

SEQ ID NO: 148230 - protein, 138 aa, Glycine max
  Coding DNA Sequence Number=SeqID_56545
  Homolog annotation: Hit_ID=Q8GEG1; Match level="QueryCoverage=81%, HitCoverage=83%, E-value=9e-62, Identity=97%"; Hit description =Putative uncharacterized protein
MGTELEFVIMNQGITQERTCEQKASKRPGTVKRPRCWRFSIGSAPLTSITKIDAQVRGGETRQDYKDTRRFPLEAPSCALLFRPCRLPDTCPPFSLREAWRFLIAHAVGISVRCRSFAPSWAVCTKPPVQPDRCAFIR

SEQ ID NO: 148231 - protein, 384 aa, Glycine max
  Coding DNA Sequence Number=SeqID_56546
  Gene Ontology: Mol. function=carboxylesterase activity; Cellular component=nucleus; Biological process=metabolic process
  Homolog annotation: Hit_ID=Q0ZPV6; Match level="QueryCoverage=78%, HitCoverage=96%, E-value=9e-94, Identity=54%"; Hit description=CXE carboxylesterase
  Pfam annotation: Domain name=Abhydrolase_3; Domain location=78-306; Score=231.6; E_value=1.7e-66; Accession=PF07859.4; Description =alphabeta hydrolase fold
  Subcellular localization annotation: CTP_CleavageSite=64; ConfidenceScore=5.14e-01
MSMMSSKVDPFQHLKLVPNSDGTITRQRDDPPISPSLNPTLPVLTQDATINRSNNTFARIFLPREALDSSPSNNLPLVVYFHGGGFVLFSAASDFFHDACVNLADDTNSIVVSVEYRLAPEHRLPAAYEDAVEALHWIKAQSNDWLRNHADFSNCYLMGSSAGANIAYHVGLRVAAELNVYGDNYLAPLKIRGLILSQPFFGGTKRVPSEVRLVDDPVLPPHVCDLLWELSLPLGVDRDHEYCNPTAGDGPVILDRVRQLAWRVLVSGCHGDPLLDHQMALARLIEEKGVAVVTRFDQGGCHGIEVRAQREIKEESENELFNNVTELKVNNGITVIDAFFVNRVVFVITFVVIVVVTWERQGSMVVLQDSTQCRCRTSIIVDVT

SEQ ID NO: 148232 - protein, 147 aa, Glycine max
  Coding DNA Sequence Number=SeqID_56547
  Gene Ontology: Mol. function=intramolecular transferase activity, phosphotransferases; Cellular component=chloroplast; Biological process=carbohydrate metabolic process
  Homolog annotation: Hit_ID=Q9SM59; Match level="QueryCoverage=100%, HitCoverage=27%, E-value=4e-71, Identity=78%"; Hit description =Phosphoglucomutase, chloroplast precursor
AVLAWLSIIAHRNKDKKPGEKLISVSDIVTEHWATYGRNFFSRYDYEECESEGANKMIEHLRDIVSKSKPGDQYGSYVLQFADDFAYTDPGTGSAGATVRVYIEQFEPDVSKHDVDAQIALKPLIDLAISMSKLKDFTGREKPTVIT

SEQ ID NO: 148233 - protein, 712 aa, Glycine max
  Coding DNA Sequence Number=SeqID_56548
  Homolog annotation: Hit_ID=A7QZE0; Match level="QueryCoverage=88%, HitCoverage=88%, E-value=4e-66, Identity=35%"; Hit description =Chromosome chr16 scaffold_271, whole genome shotgun sequence
KGISLPIMGKEWHRDGRSSKRGGGAQTEIPSGCMCAMFQVFDFHPFHFSIDQQQSSFKSRTPEDHTVPKGVEAPRSSLESETVSYDDFDHLSNLMILEMQKNIRIKTRGSTRSRTESFSDFSSEIGASPGTKTPTLVARLMGLDLLPDAHSSSSPCLSTPNLHKPQQHIKIIKHRNSTGSNALPETPRMSSARRSDVEHRQSLQINKENNTVPYEDSESPRFSFSKRKYDENNFRSPSHYARQIVKQIKESVSRKVGLDITNTVKNREQGREESVGQFKFKKKSKTSVNESSPVKHSNSSYSPRLNRFIDTKHKPSTTTQSPTTPKNQNIHILKPPSTTTPKNLNTHSVLKPPSPPPVVNIETQLSRVSTKPKPQASPEKEVHNQKSVTKGKNTGSGKLSSRVNKPPQTSIRNKQEESFITRPPSATKANDIKTKSKRTHPLSSNLLNNLNTVPNLLPVKTGPSPQKQVRDDDARDERRSAQLFSSSRPTYKQEAPRSHPPRGATTSSDDDKLHGTSATTTGADDDEGPEYQYITSILTRSTTTGPHNSNSATALIPHLQFQWFSPTHPLDPSVFHCLEHYPTSNSFVSFPGDNKDCIFQRKQHLGPRCNRRLLFDLVDELLSEILVRPRRYREALLETTVWERVRRFPRAKCEVLEDIDALIEMEEMREEEKEEVEGLVKEIERSMFEMLVDETFTVMVGGVDKYVEDDVV

SEQ ID NO: 148234 - protein, 200 aa, Glycine max
  Coding DNA Sequence Number=SeqID_56549
  Gene Ontology: Mol. function=oxidoreductase activity, acting on paired donors, with incorporation or reduction of molecular oxygen, 2-oxoglutarate as one donor, and incorporation of one atom each of oxygen into both ...
  Gene Ontology: Mol. function=donors; Biological process=protein metabolic process
  Homolog annotation: Hit_ID=A7QZE3; Match level="QueryCoverage=100%, HitCoverage=82%, E-value=2e-66, Identity=66%"; Hit description =Chromosome chr16 scaffold_271, whole genome shotgun sequence
MTEKSTRKRKMGDTEETAPKKPAAKWPLIKPKKNLQISHLLDFDLFSVQNFFSSAESKAFVKIAEEIGFAHQGSRGGEAYRDNDRISVDDPVLADTIWESGLSKLFSDIKIRGKVAVGLNPNVRFYRYKVGQRFGRHFDASVDLGDGKRTYYTLLVYLSGGPGELKSKPKNDSSNPSVSSVDPLVGGETVFYGRRNKTVA

SEQ ID NO: 148235 - protein, 88 aa, Glycine max
  Coding DNA Sequence Number=SeqID_56550
MVRAPLIRMEERDPHAQSSVFIFHSEIESMAGYTPRVNWATGIVPRRESRFYCEFTVPVPVLCLIDDNLRISMLKKEKTSKFSVFVAG

SEQ ID NO: 148236 - protein, 486 aa, Glycine max
  Coding DNA Sequence Number=SeqID_56551
  Homolog annotation: Hit_ID=A7R6B3; Match level="QueryCoverage=94%, HitCoverage=100%, E-value=1e-89, Identity=45%"; Hit description =Chromosome undetermined scaffold_1216, whole genome shotgun sequence
  Pfam annotation: Domain name=IQ; Domain location=144-164; Score=27.5; E_value=4.9e-05; Accession=PF00612.18; Description=IQ calmodulin -binding motif
  Pfam annotation: Domain name=IQ; Domain location=166-186; Score=21.4; E_value=0.0034; Accession=PF00612.18; Description=IQ calmodulin -binding motif
  Pfam module annotation: Pfam domain module=IQ::IQ; Domain location =144-164::166-186
  Subcellular localization annotation: CTP_CleavageSite=85; ConfidenceScore=5.34e-01
MGKTGKWLRNLLTTGKKDKEKEKSTIKLNSSSNGTENSTTPTSSTPKEKKRWSFRRSSASATATTATTTPTTTSKELNFVETNVTASQTVQTDTDIQNEQRKHVMAVAAATAAAADAAVAAAQAVAAVIRLTSTSNATSKSIEEAAAIKIQSAFRSHLAKKALCALRGLVKLQALVRGHLVRKQAKATLRCMQALVTAQARARAQRIQMGSEGKANQKHRNAAEDDLLRHIYNEMDRGLEDNIKIVEMDVCESKVNSRSSSVYHHGHQEQYDNRFSTHYSTNGSYTKEEKYKVSPAPSALTESSPRACSGHFDDCFSTAQSSPHPQFYSAVSRSEDSKHPFAFHRPAYAESMSYDYPLFPNYMANTESSRAKVRSHSAPKQRPDSFERQPSRRRASVEGRNVPRPMRMQRSSSHVGATVHNYHYPWSIKLDRSAVSLKDSECGSTITWRWVLTTESAPCATPNSSHFARTPKSRVENFSLLSFSPF

SEQ ID NO: 148237 - protein, 363 aa, Glycine max
  Coding DNA Sequence Number=SeqID_56552
  Homolog annotation: Hit_ID=A7NWT2; Match level="QueryCoverage=89%, HitCoverage=64%, E-value=2e-81, Identity=53%"; Hit description =Chromosome chr5 scaffold_2, whole genome shotgun sequence
  Pfam annotation: Domain name=DUF828; Domain location=2-182; Score =91.7; E_value=2.3e-24; Accession=PF05703.2; Description=Plant protein of unknown function (DUF828)
  Pfam annotation: Domain name=PH_2; Domain location=224-358; Score =211.5; E_value=2e-60; Accession=PF08458.1; Description=Plant pleckstrin homology-like region
  Pfam module annotation: Pfam domain module=DUF828::PH_2; Domain location=2-182::224-358
  Subcellular localization annotation: CTP_CleavageSite=30; ConfidenceScore=5.13e-01
MPSTKSSLQVHRTNNIASTLSLNFRTTAPGAAPGGAGGGKTVGRWLKDRKEKKKEETRAHNAQLHAAVSVAGVAAAVAAIAAATAATSGTGKDEEMAKTDMAVASAATLVAAQCVEAAEAMGAEREHLASVVSSAVNVRSAGDIMTLTAAAATALRGAATLKARALKEVWNIAAVIPVEKNLAAGGVNNNNASNGNSNSSFSGELVPEENFLGICSRELLARGCELLKRTRKGDLHWKVVSVYINRMNQVVLKMKSRHVAGTITKKKKNLEVGLVPFWGFVKVIAKVVKDQKDVVLEVIKDVPAWPGRHLLEGGEDRRYFGLKTVMRGVVEFECRNQREYNVWTQGVSRLLSIATEKNNKNRI

SEQ ID NO: 148238 - protein, 674 aa, Glycine max
  Coding DNA Sequence Number=SeqID_56553
  Gene Ontology: Mol. function=helicase activity; Biological process =viral genome replication
  Homolog annotation: Hit_ID=Q9LX60; Match level="QueryCoverage=98%, HitCoverage=40%, E-value=1e-173, Identity=45%"; Hit description =Putative uncharacterized protein F4M19_60
MWYNERISKHKNSTSLRFNLCCGDGKVELPLLQNPPKYLHRLLFDHNSADGRNYQQNIHTYNMMFAFTFAGIKLDKSINHSRGPPTIRIQGQPCHRIGSLLPMSGKEPKFAQLYIFDTDNEVQNSINAISQHDGIQPQIVSSLGEMLDEHNAHAKSFRMARDRLADSDVDNVRLRLIATREKDGRTYNVPTVSEVAALIVGDFNPNSRRDIIVETQNGQLQRIHELHSSYLGLQFPLLFPYGEDGYRSDILHYATPDSKKRKRNRLTMRERFAYRLQSRPNEAQTLLHSRRLFQQFIAEAYTMVESERLNYIRNNQKKLRVNKYCSLQNSLDVGTSQGLNKGKRVIFPSTFVGSPHYMDQLYFDGMAICSHVGFPNLFITLTCNPNWPEIHRLLAPLNLKAADRPDIISRVFKLKYEEMLSDLSKNHLLGKAVAYNKYPTSDEIDQIISAEIHSKVDDPKLYTLVQNHMVHGPCGIIRSESPCMKEGKCSRFYPKMFQPYTLLDANGYPVYHRRNDGRTISKNGVIIDNRHIVPYNPKLLKKYQVHVNIEWCNQSTSIKHLFKYINKGYDRVTDVMVYDGNDEIQNATNQKDEIKEYIDCRYISPCEAAWRIFGFPIHARKPAVERLYFHLPVQHNVLYEDHDDIDDVLSKPSISDSKFLAWMNANCLRPGVTC

SEQ ID NO: 148239 - protein, 103 aa, Glycine max
  Coding DNA Sequence Number=SeqID_56554
MVEGDIIYKLKVQVINFSSIWVQRINHFIRKESINLVTGPVVGPDPWHPPHQSDSAQACLLVIPAGCHIGNWKGGLVPYLEEFESRSKGPTTLRAIGLRSTPN

SEQ ID NO: 148240 - protein, 138 aa, Glycine max
  Coding DNA Sequence Number=SeqID_56555
MEESNRENNKDHISQSRGSALDGEEHIGEWRNPIGKITKITFPSQEGPLLTVKNTLENGGFNRENNKDHISQSRGSVLDGEEHIGEWRNSIGKTTNITFSSQEGPLLTVKNTLENGGNPIGENKKYHITQVKKGSALD

SEQ ID NO: 148241 - protein, 42 aa, Glycine max
  Coding DNA Sequence Number=SeqID_56556
MADALATLASMFQLTPHGDLPYIEFWCHGRPAHCLSGGRGMG

SEQ ID NO: 148242 - protein, 37 aa, Glycine max
  Coding DNA Sequence Number=SeqID_56557
CHIGNWKRGLVPSLEEFELRTKGPSTLRAIALRSTPN

SEQ ID NO: 148243 - protein, 40 aa, Glycine max
  Coding DNA Sequence Number=SeqID_56558
MARARTKKVKEALQQVLTMPKLVLKWMSILLGFAPPMGLF

SEQ ID NO: 148244 - protein, 83 aa, Glycine max
  Coding DNA Sequence Number=SeqID_56559
AKLHDESRLIQRCFDDIKDDDNGDEKKLKGKLKNTSRFKRKVDFKDQESRFKDQASKNQDSRIKLPRIKIKIQDSRFKNQEKT

SEQ ID NO: 148245 - protein, 163 aa, Glycine max
  Coding DNA Sequence Number=SeqID_56560
  Homolog annotation: Hit_ID=A5AK77; Match level="QueryCoverage=47%, HitCoverage=9%, E-value=3e-07, Identity=37%"; Hit description =Putative uncharacterized protein
MTRGNPSDLQPFDPEIDRKFHRLVRHHFIPFDHSEHSITGESVHSVIGDFEHPDLEHYNFEHSDSEHSDFAHSENMAQPPPRERTLREMAAPDFTYESLCIQYPDEDVPYVLKTGLIHLLPKFHGLAGEDLHKHLKEFHIVCSSMKPPDVQEDHIFLKAFPHS

SEQ ID NO: 148246 - protein, 209 aa, Glycine max
  Coding DNA Sequence Number=SeqID_56561
  Homolog annotation: Hit_ID=UPI000069F178; Match level="QueryCoverage =41%, HitCoverage=23%, E-value=8e-08, Identity=35%"; Hit description =Mitochondrial antiviral-signaling protein (Interferon-beta promoter stimulator ...
  Homolog annotation: Hit description=protein 1) (IPS-1) (Virus-induced- signaling adapter) (CARD adapter inducing interferon-beta) (Cardif) (Putative NF-kappa-B- activating protein 031N).
TDRARNRAGNPRALLDFFGSTGCLVGAIPANNRWGRLALRSLGRMLLSSNVIYICVRVVMLVRMIRTRLFTAARMKSCPGMHSSCVIASLSGCARTVGPPPISGGGPGTVWIWSPPKVRTRSPLKARACSLLKARTCSPLKVRACSPTKVKAHDPLTARTCSPLKLKVHDPLKARTCSPLKVKVRACSPLMVRTCSPLKVRACSPLTVR

SEQ ID NO: 148247 - protein, 90 aa, Glycine max
  Coding DNA Sequence Number=SeqID_56562
GNPKREKKNNYLRNLILVTSNIRDPPFVLHSKVVFEKLVAAREGVKLVLLVAHHLNHSKGVNAMKMMHHVLTRKGVKLRSKEKTSLEGSA

SEQ ID NO: 148248 - protein, 108 aa, Glycine max
  Coding DNA Sequence Number=SeqID_56563
  Gene Ontology: Mol. function=microtubule motor activity; Cellular component=microtubule associated complex; Biological process =microtubule-based movement
  Homolog annotation: Hit_ID=A5AP36; Match level="QueryCoverage=93%, HitCoverage=12%, E-value=3e-37, Identity=74%"; Hit description =Putative uncharacterized protein
  Pfam annotation: Domain name=Kinesin; Domain location=1-107; Score= -137.2; E_value=3.5e-06; Accession=PF00225.14; Description=Kinesin motor domain
METSGPKTSTHVALVLFLGQKHSFTFDKVFTPEASQEEAFVEISQLVQSALDGYKVCFFAYGQTGSGKTYTMMGRPGHLEEKGFIPRSLEQIFQTKQSQQPQVWKYEM

SEQ ID NO: 148249 - protein, 168 aa, Glycine max
  Coding DNA Sequence Number=SeqID_56564
MGGFHQQTLLPRIRRSKSLAFVDHTAFCYHDPRSGNPRRHLTVIRTLVSSRGGGPDDTRRYLTVIHTLLSSRGGGPDDTRRHLMVIRTLVSSRGGGPDDMRRYLTVIRTLLSSRGGGPDDTRRYLTVIRTLLSSRGGGPDDTRRYLTVIRTLLSSRGGGPDDTRRYLA

SEQ ID NO: 148250 - protein, 73 aa, Glycine max
  Coding DNA Sequence Number=SeqID_56565
FYGVPVTPSKVIKPPINQVFIKKYCAPRQAQGETPQQPGDGRQRAISAPPPPPEPLSSSTKRLEYCLRHMVDK

SEQ ID NO: 148251 - protein, 91 aa, Glycine max
  Coding DNA Sequence Number=SeqID_56566
MIMRGQDIYSSQDEVITSTSSSETEEAKGEESSEEIYPQEEGDLLMVRRLLGDQSCDLTQSQRENIFQTSTRLVSKLSLAITPHPKPYKLQ

SEQ ID NO: 148252 - protein, 58 aa, Glycine max
  Coding DNA Sequence Number=SeqID_56567
MNALLELKLLHPRKTMNFLQPSLITSLESPSDSNCEKMKNKKVEASGVSLSEAYALSE

SEQ ID NO: 148253 - protein, 109 aa, Glycine max
  Coding DNA Sequence Number=SeqID_56568
  Homolog annotation: Hit_ID=B0HC01; Match level="QueryCoverage=30%, HitCoverage=70%, E-value=3e-11, Identity=100%"; Hit description =Putative uncharacterized protein
MRKRHASRREKGGQGGGAYGKTPATRPFYGSWPFAGLLLTCSFLRYPLILWITVLPPLSELIPLAAAERPSAARNSYDHDYEFELGTSWKPMDVVTGKLQNIERLRKLY

SEQ ID NO: 148254 - protein, 109 aa, Glycine max
  Coding DNA Sequence Number=SeqID_56569
MCLSGKEKEALGPTKIEENHSKCINLTQCGARKSLPHRILVGNQRERTTLGRGQGLTFSPWVKVYDKLGFWLKACRTAGHDICQGLASGSGIKGMSPHYFHDITCNNDD

SEQ ID NO: 148255 - protein, 98 aa, Glycine max
  Coding DNA Sequence Number=SeqID_56570
MVDPWVLVPITFRGLYVVAIRGLHILACRGLYALAFRGLRVLIFSVLHIHTLREYKDRAHKTPSGPEEVQQGPGVSSSGYGPLSVLQGARPPSEVMPS

SEQ ID NO: 148256 - protein, 361 aa, Glycine max
  Coding DNA Sequence Number=SeqID_56571
  Homolog annotation: Hit_ID=Q84VH5; Match level="QueryCoverage=99%, HitCoverage=54%, E-value=1e-164, Identity=81%"; Hit description =Envelope-like protein
MDKKIRSIVSNILKNASVPDADEDVPTSSTPNVSVPDAEKDVPTSSTPNAEVLSSPSKEDSTEEEDQATEETPAPRAPEPAPGDLIDLEEVESDEEPIANKLAPGIAERLQSRKGKTPVKRSGRIKTMAQKKSTPITPTTSRRSKVAIPSKKRKEISSSDSDDDVELDVPDIKRAETSGKKVPGNVPDAPLDNISFHSIGNAERELGRAALDCKEIMDLIKAAGLLKTVTKLGDCYESLVREFIVNIPSDITNRKSDDYQKVFVRGKCVRFSPAAINKYLGRPTEGVVDIDVSEHQIAKEITAKRVQHWPKKGKLSAGKLSVKYAILHRIGAANWVPTNHTSTVATGLGKFLYAVGNQVQI

SEQ ID NO: 148257 - protein, 131 aa, Glycine max
  Coding DNA Sequence Number=SeqID_56572
  Homolog annotation: Hit_ID=A5BTN0; Match level="QueryCoverage=99%, HitCoverage=56%, E-value=2e-26, Identity=50%"; Hit description =Putative uncharacterized protein
MLTKVTDFRWTRSQRVFKSVGEQRNESKVTEAFANFDSLLSKAVKGELAAYLLYPRVLARLVLRALLLPSPSPRSFYRPKQGRMEYSQVVRHRFLVPACKGSNPFTPDYEHPIGSVKNELTTTGEAADCSP

SEQ ID NO: 148258 - protein, 153 aa, Glycine max
  Coding DNA Sequence Number=SeqID_56573
MQSQGLAPPPDPLVGPFGPRVNTKGSCVNPSGNDPETGDSDRCGLYIEADPASLVAMGRVYEGFTVVHNNPLLPGQVKVSGEEVTDADAPVPVPTNEGSLVGQTLHTFLAWPTHLVKSLSQHVVVSPAKPPPKPDPEVNDPLYLMILTIQSFS

SEQ ID NO: 148259 - protein, 66 aa, Glycine max
  Coding DNA Sequence Number=SeqID_56574
MPLYAKFLKDMLTKKNRYIHSDRIVVEDIEEDTDIPLILGRTFMSTTSCVVDMGKKILQMGIEDQL

SEQ ID NO: 148260 - protein, 88 aa, Glycine max
  Coding DNA Sequence Number=SeqID_56575
MIGERVCFHVGPILLKRQPSGVYQMLDLVFKGQAFFGRVARGFPMVCASCVRVVATCPFAGVRGEAHWCAFQRRKDARSSHQRLKFIF

SEQ ID NO: 148261 - protein, 250 aa, Glycine max
  Coding DNA Sequence Number=SeqID_56576
  Gene Ontology: Mol. function=2,3-bisphosphoglycerate-dependent phosphoglycerate mutase activity; Cellular component=phagocytic vesicle; Biological process=metabolic process
  Homolog annotation: Hit_ID=A1JRT1; Match level="QueryCoverage=92%, HitCoverage=92%, E-value=1e-120, Identity=87%"; Hit description=2,3 -bisphosphoglycerate-dependent phosphoglycerate mutase
  Pfam annotation: Domain name=PGAM; Domain location=5-191; Score =164.4; E_value=3e-46; Accession=PF00300.13; Description =Phosphoglycerate mutase family
MAVTKLVLVRHGESQWNQENRFTGWYDVDLSDKGRTEAKAAGQLLKKEGFVFDFAYTSVLKRAIHTLWNVLDELDQAWLPVEKTWRLNERHYGALQGLDKAETAAKYGDDQVKQWRRGFAVTPPELDRNDERFPGHDPRYKSLTDAQLPTTESLALTIDRVIPFWNESILPRIKSGEKVIVAAHGNSLRALVKYLDNMSEDEILELNIPTGVPLVYEFDENFKPIKHYYLGDADEIAAKAAAVANQGKAK

SEQ ID NO: 148262 - protein, 396 aa, Glycine max
  Coding DNA Sequence Number=SeqID_56577
  Gene Ontology: Mol. function=succinate-CoA ligase (ADP-forming) activity; Cellular component=mitochondrion; Biological process =tricarboxylic acid cycle
  Homolog annotation: Hit_ID=P0AGF1; Match level="QueryCoverage=68%, HitCoverage=93%, E-value=1e-106, Identity=73%"; Hit description =Succinyl-CoA ligase [ADP-forming] subunit alpha
  Pfam annotation: Domain name=CoA_binding; Domain location=1-86; Score= 133.0; E_value=8.8e-37; Accession=PF02629.10; Description=CoA binding domain
  Pfam annotation: Domain name=Ligase_CoA; Domain location=119-260; Score=216.9; E_value=4.8e-62; Accession=PF00549.10; Description=CoA -ligase
  Pfam module annotation: Pfam domain module=CoA_binding::Ligase_CoA; Domain location=1-86::119-260
GFTGGQGTFHSEQALAYGTQLVGGVTPGKGGTTHLGLPVFNTVREAVEATGATATVIYVPAPFCKDGILEAIDAGIKLIITITEGIPTLDMLTVKVKLDEAGVRMIGPNCPGVITPGECKIGIMPGHIHQPGRVGIVSRSGTLTYEAVKQTTDIGYGQSTCVGIGGDPIPGSNFIDILKMFQDDPQTEAIVMIGEIGGSAEEEAAAFIKEHVTKPVVGYIAGVTAPKGKRMGHAGAIIAGGKGTADEKFAALEAAGVKTVRSLADIGDAVKAGKEACFFPSASRRLAGKEEFVPGVVISILSPPHLTPARNRLKRSVFRGIFTTVTRSLRAAVRIVLSDEFMRGARSHHVRYCRAVAFTVCPDGDVPFPVRALNAGYGVFTGDHGNGLCPVGKTDL

SEQ ID NO: 148263 - protein, 439 aa, Glycine max
  Coding DNA Sequence Number=SeqID_56578
  Gene Ontology: Mol. function=transferase activity, transferring acyl groups, acyl groups converted into alkyl on transfer; Cellular component=cytoplasm; Biological process=cellular carbohydrate metabolic process
  Homolog annotation: Hit_ID=O68883; Match level="QueryCoverage=94%, HitCoverage=96%, E-value=0.0, Identity=90%"; Hit description=Citrate synthase
  Pfam annotation: Domain name=Citrate_synt; Domain location=46-409; Score=786.1; E_value=2.2e-233; Accession=PF00285.12; Description =Citrate synthase
MTDKKVTLTLQDNNSVELDVMQGTLGQDVVDVRALGSKGLFTFDPGFTSTASCESKITFIDGDEGILLHRGFPIDQLATHSNYLEVCYILLNGEAPTQAQYDEFRTTVTRHTMIHEQITRLFHGFRRDSHPMAVMCGVTGALAAFYHDSLDVNIERHREIAAFRLLSKMPTMAAMCYKYSIGQPFVYPRNDLSYAGNFLHMMFATPCEEYKVNPVLERAMDRILILHADHEQNASTSTVRTAGSSGANPFACIAAGIASLWGPAHGGANEATLRMLEEISTVDHIPEFVRRAKDKNDSFRLMGFGHRVYKNYDPRATVMRETCHEVLNELGMKDDLLEVAMELEHIALNDPYFIERKLYPNVDFYSGIILKAMGIPSSMFTVIFAMARTVGWIAHWKEMHDEGMKIARPRQLYTEPCLAEPRFRRPRAADAVPSHPSSV

SEQ ID NO: 148264 - protein, 288 aa, Glycine max
  Coding DNA Sequence Number=SeqID_56579
  Homolog annotation: Hit_ID=Q84VH5; Match level="QueryCoverage=100%, HitCoverage=48%, E-value=1e-103, Identity=64%"; Hit description =Envelope-like protein
MATSPKEISASGSPSVPSSPHQEQPEFNIQPIQIIPGQASAPEKLAPRRQQGVKISENPSLATSPREVDPEMDKKIRSIVSSILKDASVPDAEKDESTEEEDQATEETPAPRAPEPAPGDLIDLEEVESDEEPIANRLAPGIAERLQSRKGKTPITRSGRIKTMAQKKSTPITPTTSRWSKVAIPSKKRKEISSSDSDDDVELDVLDIKRAKKSGKKVPGNVPDAPLDNISFHSIGNVERWKFVYQRRLAVERELGRDALACKEIMDLIKAAGLLKTVTKLGDCYESL

SEQ ID NO: 148265 - protein, 319 aa, Glycine max
  Coding DNA Sequence Number=SeqID_56580
  Gene Ontology: Mol. function=signal peptidase activity; Cellular component=integral to membrane; Biological process=signal peptide processing
  Homolog annotation: Hit_ID=A5FJ70; Match level="QueryCoverage=71%, HitCoverage=39%, E-value=1e-52, Identity=48%"; Hit description =Signal peptide peptidase SppA, 67K type precursor
  Pfam annotation: Domain name=CLP_protease; Domain location=2-173; Score=-89.0; E_value=0.036; Accession=PF00574.14; Description=Clp protease
  Pfam annotation: Domain name=Peptidase_S49; Domain location=33-186; Score=184.2; E_value=3.4e-52; Accession=PF01343.9; Description =Peptidase family S49
  Pfam module annotation: Pfam domain module=CLP_protease::Peptidase _S49; Domain location=2-173::33-186
MEMENDKVKAVVFRINSPGGSANASDEILFELQQLKKKKPLIVSFGDYAASGGYYIAMAADKIYSEPNTLTGSIGVFGVIPYFKDIANKNGIRSDIVATNANSQYYSGLNGVTPYGVSMITKSVEGTYKRFVHFVTQNRKQTFEQIDNIGGGRVWSGVRAKQIGLVDELGTLNDAVKFAAQKAGLKSYNVASYPKKMSPFEQIFKDLNEDDISARVIKSKIGKANYEILQQITEEKLRSELFFEAIPKIQRTISEPPTANNMLLKSKFSTVPQPIKLPTNPPTKAPTIPSIMVISQPPPCVPGIISLAIAPAIRPKMIQ

SEQ ID NO: 148266 - protein, 276 aa, Glycine max
  Coding DNA Sequence Number=SeqID_56581
  Homolog annotation: Hit_ID=Q6WAY4; Match level="QueryCoverage=62%, HitCoverage=30%, E-value=4e-12, Identity=29%"; Hit description =Putative uncharacterized protein
MAEVSTEAIASLTQYYDQPLRCFTFGDFQLTPTVEEFQEILGCPLGGRKPYLFSGFYPSLARISKIVKISTQGLDRGKQVENVLVGVPRKCLEAKARVLASQGEWAPFMDILVLLIFGVVLFPNVDGLVDRAAIDAFLAFYDRKEIPFVVILADLYDTFGRRCEKNNARIVCYMSAFYVWGCINYNPVLAIRQLGYPMREAPSEEGLIPFITRGFNSTNVGVLQRVHKAWEMSQRKDNELRGSSNGPIGGYHRWLKAYAQDMDWLSSLRNTNGGGG

SEQ ID NO: 148267 - protein, 117 aa, Glycine max
  Coding DNA Sequence Number=SeqID_56582
  Subcellular localization annotation: CTP_CleavageSite=58; ConfidenceScore=5.04e-01
IAPTRHPVDLKKSNRALGFPTLVMGLCQSYRVPVPPARDRARKTPSGPEEVQQGPGVSCSDYGPLQAQGMTPQQPGDGRQRAIEAPPPSLEPLILSTKARTLPTTCGRPAGDQVQSQ

SEQ ID NO: 148268 - protein, 121 aa, Glycine max
  Coding DNA Sequence Number=SeqID_56583
STLEDPRARALSPLMDRLVHEAAQSGSVDSVIDLPSRVRHHVKWKMARTKKTGEMTTEAAKEISEKIDVLTAAIGRPENPRRVCAAEAGVTIKQYFGSAPRMSRSSSSLPPEELQQLTHQI

SEQ ID NO: 148269 - protein, 70 aa, Glycine max
  Coding DNA Sequence Number=SeqID_56584
MDDFSEDEDQQFFDHINEDSNDQSDDQSDDEGVGRPMTPPSPPLQYHQPRCPVDLNFDHLPHYIDRHHFF

SEQ ID NO: 148270 - protein, 83 aa, Glycine max
  Coding DNA Sequence Number=SeqID_56585
MSENENTQNLDIGDVGMSREHLKTSYPIAQRLFAMRRYGGGILYAALPLHMQRGCFWIRTHDQQVTKAQLYRCTRARPRLGNT

SEQ ID NO: 148271 - protein, 173 aa, Glycine max
  Coding DNA Sequence Number=SeqID_56586
AKSSVGDSCYEVATDSSSSTENKKLEGKLDALITIQIFILLCSNLESMSNLKPMLQTFTIDLLNSKTNNNRIIMTFQAIDTIQNVAGPSKPYVPPPIQQQQQQSQQGQQASEAPPQPSLEEFDENHETGQIQAKGPSGEGRRQQGQNTNQDKLQRKIIGKDRTCIKSRSSDTR

SEQ ID NO: 148272 - protein, 99 aa, Glycine max
  Coding DNA Sequence Number=SeqID_56587
MLAGSATIEKPRADWTEEERRLVQYNLKAKNIITSALGIDEYFRVSNCKSAKDMWDTLQEHEMELLRLNQHEETDKKKKGIALKASSAIQEDSDKRRFN

SEQ ID NO: 148273 - protein, 336 aa, Glycine max
  Coding DNA Sequence Number=SeqID_56588
QYDTRRFSSLDAWARYIDNVLGRNILPERKVEIYHTELDEFKAELKRHNFHKRLTNLVDGSIDLALVKDLNTFLETPVVLAERETLRAYSRYCRLPIDYTEIEGHPGKILRKDLTTLAQVWSVLSYSNLTPTSHTSNLTVDRARLIFGLVSRMDMDIGVLISGQMTSIAQSNTSRLGARARPAELPSTSAAPTPASTSAAPSVVAPPGSIPSIEQFRELVDWPEIQSSLHREDKGPTAQVPKHMENVSFEATIPKPFTIEEEAGDTQTTQVVAATPERSLKAISEPPAPTMDPSSPQHAADPSTPVLEIPEGQTTPVLALHISPPATPMLHLTDEE

SEQ ID NO: 148274 - protein, 376 aa, Glycine max
  Coding DNA Sequence Number=SeqID_56589
  Homolog annotation: Hit_ID=Q6WAY6; Match level="QueryCoverage=77%, HitCoverage=60%, E-value=5e-35, Identity=30%"; Hit description =Putative uncharacterized protein
MGTNQNGKRFYQVKVKGLDVTSLKELGRLKGPLQRQAFRKVYGKILDLAAAEVFTEAVVSLAQYYDQPLRCFTFGDFQMVPTIEEFDEILGFPLGGRKPYLFSGFLPSLSKIAAVVGDSAKELDRMKRIQNGVVGLPRKYLEDNARDMASQEKWGPFADVLALLIFGVVLFPNVDGLVDLAAIDAFLAYHHSKESPVVAILAGGSAINWFPRWKEGKEGVLFSCGDYPNVPLIGTRGCINYNPALAIRQLGYPMRGAPTEESLSPFLVRDQGAQGLKVIQRIHKAWRSPLRKDKELRGIRNGVIGGYHGWLRIHTRGLGWLSKLKVINEENFEAPEEDEEVRALKLELGKARLAKEKFKSAATHIWNECTELQEEN

SEQ ID NO: 148275 - protein, 33 aa, Glycine max
  Coding DNA Sequence Number=SeqID_56590
MATKMKRCQFEALGSIAPITSIPHIEKGHGAAN

SEQ ID NO: 148276 - protein, 190 aa, Glycine max
  Coding DNA Sequence Number=SeqID_56591
  Homolog annotation: Hit_ID=UPI0000DC1FFC; Match level="QueryCoverage =97%, HitCoverage=92%, E-value=2e-12, Identity=14%"; Hit description =UPI0000DC1FFC related cluster
LDALAFRGVHILPLRGLHALTFVGLHTLTFKGVHILNFRGLYIVAIRGLHILAFRGLHVLPFRGQHDLPFRGMQALALTGLHVLIFRGLHNLAFRGLDALAIRGVHILPLRGLHALAFVGLDTLTFKGVHVLNIRGLYIVAIRGLHVLAFRGLHSLTFRGLHMLAYRGLHAFAFVGLHALTFRGLHILVF

SEQ ID NO: 148277 - protein, 189 aa, Glycine max
  Coding DNA Sequence Number=SeqID_56592
RGKIKLKTPEEATELIENMSTNALLAQNKLLSKQLEILTETLGHCIPIEEHTQEVHYMGNQQRQGYNQGGFLGFQQGPYNQPPQQGPNIFQRTTKLEETLAQFMQVTMSNHKSTESALKNLEIQVGQMAKMLAEKSSNSFGANTKKNTKEECKAVMTRSMKLVAAEDKDVVALKEQVSLKDTTVKKKNR

SEQ ID NO: 148278 - protein, 103 aa, Glycine max
  Coding DNA Sequence Number=SeqID_56593
MAIGWHISDIKGISLHHIVCTKSIWKPIISLCDNPEKIESYNEGGNKKRSAQVIRGRPYLSNFRQLMEQSQDGECALIIESLMKPQENITTHFPSWIKCLRDL

SEQ ID NO: 148279 - protein, 118 aa, Glycine max
  Coding DNA Sequence Number=SeqID_56594
MLLFFSPLNKAKRNCYAKPLLCVKEVELSAPCCAKLNSLTDFELLCAKRSSRAKWTLWAQRTSTAKHSFSVLSVTRESRRAQGSRPHAKCEISLLSETFVSCQAQRMTGTKPKSTNSR

SEQ ID NO: 148280 - protein, 127 aa, Glycine max
  Coding DNA Sequence Number=SeqID_56595
MGTNQTGKRFYQVKVKSLDTTSIKELGRLMEPLQMQAFRKTYGKILELTIAEVSIETIASLTQYYDQPLRCFTFEDFQLGKKTIPFLRVSPLFEQNCNCGQGFSKRFGPHKTDSKRHSGPTTEVPRR

SEQ ID NO: 148281 - protein, 233 aa, Glycine max
  Coding DNA Sequence Number=SeqID_56596
  Homolog annotation: Hit_ID=Q84VI1; Match level="QueryCoverage=83%, HitCoverage=32%, E-value=1e-100, Identity=82%"; Hit description =Envelope-like protein
MDCKEIVDLIKAAGLLKTVSKLGECYEGLVREFIVNIPSDISNRKSDDYQRVFVRGKCIRFSPAVINKYLGRPTDGVIDINVSEHQIAKEITAKRVQHWPKKGKLSAGKLSVKYAILHRIGAANWVPTNHTSTVATESFAVKLPIAFPTVLCGIMLSQHPNMLNYTDSVMKRESPLSLHYKLFEGTHVPDIVSTSGKAAEEDKEAVEEEEEAAEEEEDAAEETESDDDSEATP

SEQ ID NO: 148282 - protein, 157 aa, Glycine max
  Coding DNA Sequence Number=SeqID_56597
REKERKPQEANINLPYFHGKDNVEAYSDWEIRVEQQLKRKSTSISYRSHSYPKKDQGQGILGVTPSKTKDDNGKTIEKQPLKANTCSIATPLRLEFIPQVKELLDEDLVRKSLNPCAFLVPKIGVPMNPKRIKVIPEWPAPPSVLRKKAQSFKNLGI

SEQ ID NO: 148283 - protein, 368 aa, Glycine max
  Coding DNA Sequence Number=SeqID_56598
  Homolog annotation: Hit_ID=A5B5V0; Match level="QueryCoverage=73%, HitCoverage=59%, E-value=2e-15, Identity=26%"; Hit description =Putative uncharacterized protein
  Subcellular localization annotation: CTP_CleavageSite=36; ConfidenceScore=5.02e-01
MTEPSKKRKGTSSRSQWHSGSQEAPIPPSIPFGSLFSSEEQCIRYTNLFSSRFIVDPKFIDMEFFSNENFECFQAFENSNLIPFMSLKLPVYSELVKAFYSNLEIHEGTLMSEVYGIKMVIDQSLFYDLTKLPSEGVPFEGALIDEWKFDFSVHDARRLVCTNQADMTGRLLAGSLAFESRILHYLIVCILLPRSSNLAQVSEEDLIVMWAFHKGLQIDWAHLVRYRMHKALRLNAPLPYPHLITLFLQHFNIPLNSEPYVPIKRSFLIGTSVIASFGYIKEHDGSWVKKGARNVGEEGHEGEDSSLLSKILERFDGLQTFVDERFDTLELQVDMCFNEMESRMTKVEEDVSYIRSSFDLLPPPPPSS

SEQ ID NO: 148284 - protein, 16 aa, Glycine max
  Coding DNA Sequence Number=SeqID_56599
NMLWGGGPTYGVKSIR

SEQ ID NO: 148285 - protein, 110 aa, Glycine max
  Coding DNA Sequence Number=SeqID_56600
MASMMDAMLGMKQLMESNTTIVAAVSLAVEADPTLLTAAHHPIPNMVGQERSTPGHISNPHPGYNQGTYPYCLPPNYTPPAIHDDVGHVPPLVLEGEPPRHPYGVHENPR

SEQ ID NO: 148286 - protein, 70 aa, Glycine max
  Coding DNA Sequence Number=SeqID_56601
WSRQLSQRALRGRARARLTGALPKGGKMRGVATNEGISTSYVDKSGAFAPTYPPLERKSDLRSSSLCVNQ

SEQ ID NO: 148287 - protein, 178 aa, Glycine max
  Coding DNA Sequence Number=SeqID_56602
  Homolog annotation: Hit_ID=Q8TGM5; Match level="QueryCoverage=23%, HitCoverage=61%, E-value=9e-08, Identity=70%"; Hit description =Uncharacterized protein ART3
IPASPDYNSDAEGDDFHGGLFPRVAPPDLRSRWERACTQRVVDGSRTDRLARDWSRAWLIHHFITAKSAMNPDFNQPRGGRALGLMASGATCVQRLDGSRDSAIHTKYRISLRSSSMQEPRYPLPRVIDEEAGRTGRRGHPLPPDGSVDFSQRRGQRTAHVAAIRTLHRTIQSVGATG

SEQ ID NO: 148288 - protein, 35 aa, Glycine max
  Coding DNA Sequence Number=SeqID_56603
MASYGETKDSIDEEDPRPTSSNGATSCGIRASSSR

SEQ ID NO: 148289 - protein, 117 aa, Glycine max
  Coding DNA Sequence Number=SeqID_56604
MYRYPFEGHGTDMSASEYSFGGVAETHPHFSWPTMTLSQQHDAPMATPNAPLGPQWDVPGAIPDMGDLLGFDLRHEFFAKAKQQGRRQRARRNSDRQARRWDQPCGTSLRHHGHHND

SEQ ID NO: 148290 - protein, 166 aa, Glycine max
  Coding DNA Sequence Number=SeqID_56605
MEGKKAIQIKRRISFNALKKKLEIRFLVSGKYVAFQICDDEDVETILESFQQQDQMSDMELYIEKDVAGGSMFHSANSLTSCGNNLSNNEAQPPRNVSNLHGDEDDDDDYLVSNSYVEESLDEDDSVDGISDTDDEVTDMIQPVRIVHPAEVRIVHPNPKPLTPKP

SEQ ID NO: 148291 - protein, 167 aa, Glycine max
  Coding DNA Sequence Number=SeqID_56606
MSIHKSTESTLKNLEVQVRQLAKQIADKSSNSFVANTEKNPKEECKAVMTRSKRFVEVKDEDSVVYKNKAAEKKGTDEKKEDVIGESNQEKQKQIMVKKKEFNDQEKEKEGEKEKENENEKIEKDEKNKNEERSKSEQAREKQREKVVHVNCKLHSLYGEKEAGAGL

SEQ ID NO: 148292 - protein, 205 aa, Glycine max
  Coding DNA Sequence Number=SeqID_56607
MTEGCGEGFCPCKPFPVMLLVYGGNFFEAKKQMMADAKFAGLLGLGKPLVEILPPGQLRGFCPLLAWLGSAVLGYGPVLSFGLVGPLLPPVISFVARILPTLACAPLAKSVPRAESQWIVAARPLCHLQYPVAYLSRLQRILPAARWELRFKASRRANPPHEGHQRHVPLGGRGPLLLVGKRTAGARVASSPDSDLEAFSHNPTH

SEQ ID NO: 148293 - protein, 128 aa, Glycine max
  Coding DNA Sequence Number=SeqID_56608
MTHHNFQVQAIGLFAQATCALEFGLPRPFNQRLLVLHVGGGAVKQRGSRPQDAQWARRSPTGPWGFQLWLRASVVLQGARSPSEESHPQRHPVDPEKSNRALGFPALVTGLCSPTGYPFPPARSHHHR

SEQ ID NO: 148294 - protein, 105 aa, Glycine max
  Coding DNA Sequence Number=SeqID_56609
MLAIITKYREELNLATTHEHRVADEYAQVYVEKEARGRVIDSLHQEATMWMDRFALSLNGSQDLPRLLAKAKAMADTYSAPEEIHRLLGYCQHMIDLMAHIIRNR

SEQ ID NO: 148295 - protein, 260 aa, Glycine max
  Coding DNA Sequence Number=SeqID_56610
  Gene Ontology: Mol. function=aspartic-type endopeptidase activity; Biological process=RNA-dependent DNA replication
  Homolog annotation: Hit_ID=Q6WAY3; Match level="QueryCoverage=78%, HitCoverage=9%, E-value=5e-09, Identity=25%"; Hit description =Gag/pol polyprotein
METCLGVEELLQWMIDQGRLEVGSEGKEEQHICMQSTDGSSVAKPKLLVIYFTKSAASQKPGHPLAAKPVPFPYQSSHAVPWRYTPPREKEEEATNVSSLSAKVTNITGLSGVTRSGRVFAPPDLPVQPADVKEKGKVVEEQDGEAPHASNKDIPAKGLPEKKDGKKEVSLEEASEFLRIIQQSEFKVIEQLNKTPSRVSFVGVTYELQASSGSTSKSSERGPCGPRFLGRKFRRAGQQYHCQQLSCLRRRRNPRRGERA

SEQ ID NO: 148296 - protein, 74 aa, Glycine max
  Coding DNA Sequence Number=SeqID_56611
KSFLIGVVVVASFGYRKERRDDSWVKKGAQPNDDEGHLPVEGDSFLLQGILDRFDGLKTYAGERFDSLKSQVDT

SEQ ID NO: 148297 - protein, 106 aa, Glycine max
  Coding DNA Sequence Number=SeqID_56612
DAGSRQARQGASAGVGGCRGWLNYAASEQIVLRVHHLRAIGAGLFAITPAGERGMCCKAIKLGNARVFPVTTFMHGPVWRTLENGPVISPTHKDVCRLIDQMKEGQ

SEQ ID NO: 148298 - protein, 67 aa, Glycine max
  Coding DNA Sequence Number=SeqID_56613
  Homolog annotation: Hit_ID=O64438; Match level="QueryCoverage=53%, HitCoverage=15%, E-value=4e-12, Identity=88%"; Hit description=ARG10
SFYSTVVGGLRCYENPKNKITAVPAEEEQIWGAFFRVILELKKLELNIHYVTRIASCNKISPRWKGQ

SEQ ID NO: 148299 - protein, 69 aa, Glycine max
  Coding DNA Sequence Number=SeqID_56614
MEGQAAVVVEDLSISDLDDSSNLDCICCLKDHNYFVVVGFSAKGIAAKKDKDLYGDLQKNIDHKLLQQV

SEQ ID NO: 148300 - protein, 26 aa, Glycine max
  Coding DNA Sequence Number=SeqID_56615
EFDETLGLIRILVVDLKRANKAALTL

SEQ ID NO: 148301 - protein, 55 aa, Glycine max
  Coding DNA Sequence Number=SeqID_56616
MTKARQKGVRKEKEGEARHQARPGELGFFLQKAPPSGELPGRSKWAWLVFAPPFY

SEQ ID NO: 148302 - protein, 62 aa, Glycine max
  Coding DNA Sequence Number=SeqID_56617
MDHFKVQRLKNDHLSSKKELLDSRLRKNYVGLISLFDGGLLSFETNVRGANTFLKRKYNSRT

SEQ ID NO: 148303 - protein, 252 aa, Glycine max
  Coding DNA Sequence Number=SeqID_56618
  Gene Ontology: Cellular component=provirus
  Homolog annotation: Hit_ID=Q9MCS1; Match level="QueryCoverage=100%, HitCoverage=100%, E-value=1e-145, Identity=98%"; Hit description=Gp18
  Pfam annotation: Domain name=Phage_tail_L; Domain location=24-250; Score=534.9; E_value=8.7e-158; Accession=PF05100.3; Description =Phage minor tail protein L
MSLNADYQKLESGNDVRLIEVDGSSFGLTDVLRFHNYNIPHTEAEIIAAGGDESKLPAKPIWWQGNEYAAWPYQLEGLEKSTSGSNATPSLTVANIESSISALCLAYDDLLQAKVTIHDTKEKYLDARNFADGNPTADPTQEKLQVWYIDGKTGELAGETVEFALSSPMDLQGQMIPTRQLHSLCTWCIRNKYRTGDGCDYAGTRYFDKNNNPVSDPSLDECNGTLTACKLRFGENNELSFGGFPGTSLIRS

SEQ ID NO: 148304 - protein, 202 aa, Glycine max
  Coding DNA Sequence Number=SeqID_56619
MQSQELALPLEPEVGPSTARVNTKESCVDPSGNNPDTGDSDKCELYIEENPPRMVALERVYEGSTIVQNIPMLHDQVKVGVEEVRDADAHIPMPIEEVKLVGQALNTFLAWPTHLVKRLSEKGVVGPTKLADMPDHEVDDPLYLMTLTIPQLFLKPLQVMWDATVFGVFNEDFPLYIKHEDLSEIAHGAQCLSISVIQLWIL

SEQ ID NO: 148305 - protein, 129 aa, Glycine max
  Coding DNA Sequence Number=SeqID_56620
  Homolog annotation: Hit_ID=A5C8M0; Match level="QueryCoverage=91%, HitCoverage=12%, E-value=7e-09, Identity=31%"; Hit description =Putative uncharacterized protein
MLANNQDQPWSRILISKYGGWKELICGGRRNFTSQWWQDLKSIFQQHHNECLTDNLKWRVGMGSNINFWKHKWMEDNYTLQGKYPQLYLISKQQNSSINYMGDFVEGRWEWKLSWRRTSKCTLISGQPI

SEQ ID NO: 148306 - protein, 183 aa, Glycine max
  Coding DNA Sequence Number=SeqID_56621
MASISEVMLKLQKTIEDKATATASSTVREAEPVLQPALNPGLDRNTAVFDRRYSPQAYPYGLPPDFTPRATPEDLSLAPTFEGQLPPYEDYPGQDDGEGDTHLGPLLHLKDPSPHELPQPNIVRHIPASPTPVKESVPFAEDKGKIEALEERLRAVEGLGNYPFSDLADLCLVPNIVILPKFK

SEQ ID NO: 148307 - protein, 56 aa, Glycine max
  Coding DNA Sequence Number=SeqID_56622
LVGLGSSSSMDSFASWKINGRGMEKEERERRRHFKEKMSLEETHHHSVRQVASNIL

SEQ ID NO: 148308 - protein, 128 aa, Glycine max; identical to SEQ ID NO: 146771
  Coding DNA Sequence Number=SeqID_56623

SEQ ID NO: 148309 - protein, 145 aa, Glycine max
  Coding DNA Sequence Number=SeqID_56624
  Gene Ontology: Mol. function=protein dimerization activity; Biological process=DNA integration
  Homolog annotation: Hit_ID=Q2R1C3; Match level="QueryCoverage=93%, HitCoverage=20%, E-value=2e-28, Identity=44%"; Hit description=HAT family dimerisation domain containing protein
EDDVAKAKFVKDTLLDDNWWDKVDYILSFTSPIYDVLRRTDTEASSLHLVYEMWDSMIEKVKNVIYQYEGKEEGEGSTFYELSEDSNPVPPHQDMELTRERLKCFKRFFLDVDVRRKVNIEFANFSDGREGLDSLEVKWIQKHGG

SEQ ID NO: 148310 - protein, 142 aa, Glycine max
  Coding DNA Sequence Number=SeqID_56625
  Homolog annotation: Hit_ID=A0ST23; Match level="QueryCoverage=33%, HitCoverage=95%, E-value=9e-12, Identity=72%"; Hit description =Putative reverse transcriptase
MTVKTSDTCSSRRRSQLVCKRMPGADKPVRARQRMRKEKIPHQAPFAIQAAQLLGRAIGAGLFAITPAGERGMCCKAIKLGNARVFPVTTFPVAYEGTELEFVIMVIAVSFGKPVVPAALMNRPTRGERRFAYWALFRFLAH

SEQ ID NO: 148311 - protein, 155 aa, Glycine max
  Coding DNA Sequence Number=SeqID_56626
  Gene Ontology: Mol. function=phosphoprotein phosphatase activity; Biological process=intracellular signaling cascade
  Homolog annotation: Hit_ID=A7R8Y3; Match level="QueryCoverage=76%, HitCoverage=35%, E-value=3e-22, Identity=41%"; Hit description =Chromosome undetermined scaffold_3090, whole genome shotgun sequence
MGTLHDFGSKENSSYNGKQTTRTQFVWEPYPATVMSMLPPICLVGSVAWCAVVPLICFHVVEWHQPDRVLRQFGMQQPILESPSQPQNIHGLTLKGKQDENWFQLLGPFISQWNNRAEFRVDIYPRQEGLLSFNSDYMVWVKLWDPLESTCRHAS

SEQ ID NO: 148312 - protein, 270 aa, Glycine max
  Coding DNA Sequence Number=SeqID_56627
  Homolog annotation: Hit_ID=Q6WAY6; Match level="QueryCoverage=98%, HitCoverage=61%, E-value=2e-11, Identity=24%"; Hit description =Putative uncharacterized protein
MANQEEWVPFMDVLALLIFGVVLFPNMDGLVDLAAIDAFLAYHHSKESPVEGKEGVLFSCGDYPNVLLIGTRGCINYNLALAIRQLGYPMRPAEESLSPFFVRDFSAQSFKIIQRVHKAWESPLRKDKELRGIRNGIIGGYHEWLKVRTRGLDWLSKLIIINEENFEAPEEDEEVRALKTKLGKTRLVKEKFKLVTTDIWKECAELREENAATARALEQETKRARKEEHGRDKFRGALWGSNSELKLRKEERDQSRAHSMILKEELAACS

SEQ ID NO: 148313 - protein, 54 aa, Glycine max
  Coding DNA Sequence Number=SeqID_56628
MEIIRYKKRLEEKNQVEQMPRKIEVAALGLSFFLFAESVLGKQRQPKTLRMVMS

SEQ ID NO: 148314 - protein, 177 aa, Glycine max
  Coding DNA Sequence Number=SeqID_56629
MTEREMITTMVDTLPTLYYKKLIGYMLANFADLVFAGERIESRLRKGKFEYASNVAPNNNRRAPVVGARKKEGDAHAVTTAPTWMKAPQNIQTSYQPVATYPSAGGRRVTRGMRVPRKEYARSRHQRLFEENVGKTGKDAIYELLSERFGSCIYARGRVFPFAPTYSSIWDEKIRPT

SEQ ID NO: 148315 - protein, 166 aa, Glycine max
  Coding DNA Sequence Number=SeqID_56630
MGTRGCISYNPVLAIRQLDYPMRGALLEDELTPVISRGFNKTNMETLQKVRKAWEVLQKKDKELRGNNNGPIGGYRKWLKAHVQGLDWLPSLRTAKREEVEAPEEDEEVQALRTELEQAQTVKERFKSVALRIRKENAKLRDVATTKALEQETKRARREEHGWNKF

SEQ ID NO: 148316 - protein, 126 aa, Glycine max
  Coding DNA Sequence Number=SeqID_56631
MEVPCCSPLPEAKDGVEPSFQDLQSDTFPLCYPAKPATSCAKVKRLFFLPRSLFFYICGRSTLYDRRRVTREEGTTSFSLALLHFPFLIESRKPLHYWYRGQKVASSICSGKEHLEASFCLVSNHA

SEQ ID NO: 148317 - protein, 61 aa, Glycine max
  Coding DNA Sequence Number=SeqID_56632
MVKNDEEFPHNAYRSVWKSDLTRSSFRNFTVKHYMLILCFDTESHVNRLKTKRSRLSAVGS

SEQ ID NO: 148318 - protein, 212 aa, Glycine max
  Coding DNA Sequence Number=SeqID_56633
MSILTLGSKKRKEGKFPIKEKAKKKERRKISNQRESKKKERRKISNQRESKKRKEGKFPIKEWEKAKRKERKFPIKEWEKVKKEEEEGKKAPDQGSKENRRNVQKACLHFSGENTETFSSLTSYPKLRRSEFLNGGYVGERASLLSTTPPFVAMTQELVIRGDPLQLSAPRHSVTPSVIDEQRPIWSFAPFPEMSTSSGGDFFKSHKLSRTT

SEQ ID NO: 148319 - protein, 121 aa, Glycine max
  Coding DNA Sequence Number=SeqID_56634
  Subcellular localization annotation: CTP_CleavageSite=41; ConfidenceScore=5.84e-01
MRRNSPASFSDTSFLPQPSFFSGRPFTGISSLGVRIVLSFCSSTIFAFPLTFAGCVGRFNYRGLSGRLGSCVFGEIYHHRLRPSKTSLICGLHTYMLLFTPLIADFQSASIYHLLQQVLHC

SEQ ID NO: 148320 - protein, 240 aa, Glycine max
  Coding DNA Sequence Number=SeqID_56635
  Gene Ontology: Mol. function=protein kinase activity; Biological process=protein amino acid phosphorylation
  Homolog annotation: Hit_ID=Q2A9E0; Match level="QueryCoverage=93%, HitCoverage=15%, E-value=1e-51, Identity=47%"; Hit description =Putative uncharacterized protein
  Pfam annotation: Domain name=DUF889; Domain location=83-240; Score =64.1; E_value=4.8e-16; Accession=PF05970.5; Description=Eukaryotic protein of unknown function (DUF889)
VDSRGSPTAHSKFKIPVPVFEDSTCNIHQGTQLAELLNQTSLIIWDEAPTTHKFCFEALDHSLRDIIKHNSKDSKIFGGKVMVFGEDFWQILPVIPRGSHSDIVNATINSSYLWDHYQILRLTKNVCLQNNMQATNQEETAAFAQWIIDIGDDIIGDENDGYATIEIPQELLITEYNDPIHSIISSTFPDLSHHHNDPEYFQTRAILASTNEIVQQVNDYMLTMIPGNHIVNYLILFFIF

SEQ ID NO: 148321 - protein, 154 aa, Glycine max
  Coding DNA Sequence Number=SeqID_56636
IGPWDFPPLITRLCQSFGVPVTPSKVIRPPITRAFIEKYCTQRQVQGDSPQAADAPPRHQAGPAGSFDTEQYLQHLVPQQAANHRAHSQGFTSFPRPTLDQFRAEVAWPGDWPEARAGEAPAEAPAEAPDEADEAREDEEMTDLLDFLGGGGAT

SEQ ID NO: 148322 - protein, 130 aa, Glycine max
  Coding DNA Sequence Number=SeqID_56637
MAANFADLSLGRRRKVLNPDYEKEFKYAANMAPNNTKSPSSGREEKGRRCPRVGNSLPTQVKGPPAAERAPAQRTTAAAPRPVNNTALGATYKYAQHPPPKDNFPPIPMAYSELWPSLLDNHLVVAIPGK

SEQ ID NO: 148323 - protein, 315 aa, Glycine max
  Coding DNA Sequence Number=SeqID_56638
  Homolog annotation: Hit_ID=Q6WAY6; Match level="QueryCoverage=38%, HitCoverage=21%, E-value=2e-12, Identity=33%"; Hit description =Putative uncharacterized protein
STLEDPTCTEKRRIDWDQLLAGIGGRTISWFPRWKEGKEGVLFSCGRYPNIPLIGTRGYINYNPALAIRQLGYPMRGAPTEESMSPFLVRDFGAQNSKTIQRIHKAWETPLRKDQELRGIRNGIIGGYHEWLKERRKLAKEKFNLAATHIPKECVGLREENATTTALEQETKRARKEEYGRNKFRGALWGSNNELKLRREERDQSRAHSMVQKKLVSAFMRDGDQHASYHAKYQEELGLATAHEHRIADEYAQVYAEKEARGRVIDSLHQEATMWMDRFALTLNGSQELPRLLAKAKAMADTYSAPEEIHGLLGY

SEQ ID NO: 148324 - protein, 80 aa, Glycine max
  Coding DNA Sequence Number=SeqID_56639
MLLSSNVIYICVRVVMLVHMIRSRLFAAARVKSCPGMHSSCVIVLCCDSHSCLLLTGVRNRKTTGPLRECRVLVRRTEDV

SEQ ID NO: 148325 - protein, 150 aa, Glycine max
  Coding DNA Sequence Number=SeqID_56640
MTPTRHPLDPDKSNRALGFPALITGLCQSFGVPVTPSKRQVQGDAPQAADAPPPHQAGTAGLFDTKQYLRHLVRQQAANHRAHSQGFTYFLCPTPDQFRAEVAWPGDWPEARAGEAPAEAPAEAPDEADEAREDEEMTDLLDFLGGSGAT

SEQ ID NO: 148326 - protein, 127 aa, Glycine max
  Coding DNA Sequence Number=SeqID_56641
MTGFNRRYSPQAYPYGLPPDFTPRTAPDDLSQAPTFEGQLPPHADYPLQEDDEGDAHLGPLLPLKESVRHELPQPNIVRHVPSPSAPVKELVPIAKDKGKIDLLEESLRVVEGLDNYSFSDLSDLCL

SEQ ID NO: 148327 - protein, 114 aa, Glycine max
  Coding DNA Sequence Number=SeqID_56642
AADAPPPHQAGPAGLFDTEQYLRHLVRQQAANHRAHVQTHDCLYQMSLSLQSQGFTSFSCPTPDQFRAEVTWPGDWPEAQAGEAPAEAPDEADEACEDEEMTDLLDFLGGSGAT

SEQ ID NO: 148328 - protein, 59 aa, Glycine max
  Coding DNA Sequence Number=SeqID_56643
KKNQQKRQGVYLVKRGVQIATRPTWAFQDVPPEGGCFWRKQPSSPGRVGWQAPPPFSYK

SEQ ID NO: 148329 - protein, 88 aa, Glycine max
  Coding DNA Sequence Number=SeqID_56644
MAFMGLRKKVENGELANSATSITSRGSRLVSGGCINSARQWHLWGSEKKARLENCTKQSLRIAPNSLVGGGCMNSARQWHSWGSEKKA

SEQ ID NO: 148330 - protein, 66 aa, Glycine max
  Coding DNA Sequence Number=SeqID_56645
MDISEDTDIPVILGRPFMLTTSLLQNTMFAYSPFAKRKPRAKRISVHALSCESQVLSAQALHLRLI

SEQ ID NO: 148331 - protein, 131 aa, Glycine max
  Coding DNA Sequence Number=SeqID_56646
MDSGRFKVSVPGNSYPRYATNCLPFNGIFVVGHFMRLPHGLRDMCMIRLRLLAFNEYGSGVIDILTGSVCHIGWCIVGRQAIWWEGVATCPSRASEGEAHVCAFQRRKDARSRHQRLFVENVRKTEGNRSK

SEQ ID NO: 148332 - protein, 88 aa, Glycine max
  Coding DNA Sequence Number=SeqID_56647
  Homolog annotation: Hit_ID=Q2HW90; Match level="QueryCoverage=71%, HitCoverage=13%, E-value=3e-08, Identity=42%"; Hit description =Putative uncharacterized protein
MGPFQRQAFRKVYGKILDLTAVEVFTEAVVSLAQYYDQPLRCFTFGDFQIVPTVEEFEEILGCPPGGRKPYFFSGFLPSLRKIFTLSF

SEQ ID NO: 148333 - protein, 104 aa, Glycine max
  Coding DNA Sequence Number=SeqID_56648
MEDNCTKKTGQMMSQAIKEIADKIASQGSFVAHGHQDVLTTAFGRPERLGHLRAIGVGVTIKQYFGPTQRTSCTSSSMALEDMEQLTQQIRDQLEVSIIEKVTR

SEQ ID NO: 148334 - protein, 53 aa, Glycine max
  Coding DNA Sequence Number=SeqID_56649
MHLCDQGSLLYNKEKNKMKDCKNTTGEDVSFTSRISQSHKLISSSQNGSCFKF

SEQ ID NO: 148335 - protein, 46 aa, Glycine max
  Coding DNA Sequence Number=SeqID_56650
MKISVKTSAKARGNWKGGLVSSFEESESRSKGPTTLRAIGLRSTPN

SEQ ID NO: 148336 - protein, 40 aa, Glycine max
  Coding DNA Sequence Number=SeqID_56651
MSRNFTDCLTMGVKFLEAVKRRLHAIKQWSPDEIRKIGGK

SEQ ID NO: 148337 - protein, 40 aa, Glycine max
  Coding DNA Sequence Number=SeqID_56652
  Subcellular localization annotation: CTP_CleavageSite=32; ConfidenceScore=5.00e-01
MRTTKGKGRRSLPPSSPRRARLLPPEATVTTRLVATVSTL

SEQ ID NO: 148338 - protein, 38 aa, Glycine max
  Coding DNA Sequence Number=SeqID_56653
MDSFASWKMNGSKMEKCPQIQGLKNPTFLGYPTYIMEP

SEQ ID NO: 148339 - protein, 162 aa, Glycine max
  Coding DNA Sequence Number=SeqID_56654
MAPTRHPLDPDKSNRALGFPALITGLCQSFGVPVTPSKVIRPPITRAFIEKYCTQRQVQGDAPQAVDAPPPHQAGPAGSFDTEQYLRHLMSLSLQSQGFTSFPCPTPDQFRAEVAWPGDWPEAQAGEAPAGAPAEAPDEADEAREDEEMTDLLDFLGGSGAT

SEQ ID NO: 148340 - protein, 151 aa, Glycine max
  Coding DNA Sequence Number=SeqID_56655
MAASDHAILHDRSHIPTKRSLLELSSQDALLAHNKLLSKQLEALTKTLTKLPTQLHAGQPLPSFVLRVAGCVICGGAHDSGCCIPTKDIAHEVNYMGNQPRPNFNADQGGPSNRPQQQGPSLYDRMMKLEETLSQFMQVSISNQKSTESAI

SEQ ID NO: 148341 - protein, 373 aa, Glycine max
  Coding DNA Sequence Number=SeqID_56656
  Homolog annotation: Hit_ID=Q6WAY6; Match level="QueryCoverage=36%, HitCoverage=21%, E-value=3e-13, Identity=33%"; Hit description =Putative uncharacterized protein
RCEKNSARIVCCLPALCVWLVSHLFQQDTRYPCPLQSYRSCSEKGRVDWDQHLAGIGGNTINWFPRWKEGKEGVLFSCGDYPNVPLIGTRGCINYNPALAIRQLGYPMRGAPTEESLSPFLVRDLGVQSLKVIQRVHKAWRIINEENFEAPEEDEEVQALKLELGKARLAKEKFKSAATHIRKECTELQEENAATARALEQETKRARKEEYGREKFRGALWGSNSELKLQREERDRSRVHGMILKEELAACARSKRSLAQHLEATEQSMLAIIGQYKEELNQSVSHEQKLVEDFAQVYAEKEARGRVIDAFHQEATMWMDRFALTLNGSQDLPHLLATAKAMAEVCTAPEEIHGLINYCQHMIDLMANIIRNR

SEQ ID NO: 148342 - protein, 48 aa, Glycine max
  Coding DNA Sequence Number=SeqID_56657
MENCTKQSLRIAPNSKKTQFMGLRKRLRMENCTKQSLRMAPNSKVEDT

SEQ ID NO: 148343 - protein, 83 aa, Glycine max
  Coding DNA Sequence Number=SeqID_56658
MENKDHNEEERNRRGNDGVPRPNRIDGIKLNIPPFKGKNDPEAYLEWEMKIESHSPILGYGEFVPNSQPLNPTLFQFTKRKST

SEQ ID NO: 148344 - protein, 52 aa, Glycine max
  Coding DNA Sequence Number=SeqID_56659
MENASNAAFLRFLAFCWPFAHIRTTERSESVSEEAEERPIRKPPLPARWPIH

SEQ ID NO: 148345 - protein, 156 aa, Glycine max
  Coding DNA Sequence Number=SeqID_56660
MLDQFHPCIHDSTENVIHVKVDGNYGYHAIVALLCMSEDSWSLVRNHLLKELAKWSYQYINLLGDIDRFEKLKRSLLVDGLSMVTMDKWINITSMRYEIASSLHQPQKREKPTKREETLTMAKHNTMTTALAETDSMNDGNVAERTSNEERRREST

SEQ ID NO: 148346 - protein, 133 aa, Glycine max
  Coding DNA Sequence Number=SeqID_56661
MDISKDTDIPVILGRPFMLTTSCIVDMGKRKLELGFEDQKIDFDLFVESKPALEHNVYLQVTEGGQEVLKKSSPFAKHKPRTKRVSIHALSRESQALSAQPLHLRLIHSTKQAKAKLSLIKFDLNLAKRQPNL

SEQ ID NO: 148347 - protein, 157 aa, Glycine max
  Coding DNA Sequence Number=SeqID_56662
  Subcellular localization annotation: CTP_CleavageSite=69; ConfidenceScore=5.13e-01
MYIYVWKWLRESFMQRDPGRTKRLKGPVSLLSMTAIVSGVLSTSSVSRPSKDGHFMEEIARRRWTSLVTPMAKFDPDIVLEFYANAWPTQEDVRDMRSWVRGQWIPFDADALSQFLGYPLGLEEGQECEYGQRRNRADGFDEEAIAQLLCIAGQDFA

SEQ ID NO: 148348 - protein, 479 aa, Glycine max
  Coding DNA Sequence Number=SeqID_56663
  Pfam annotation: Domain name=RRM_1; Domain location=39-109; Score =8.7; E_value=0.023; Accession=PF00076.13; Description=RNA recognition motif. (a.k.a. RRM, RB
MKVMQKSSLAGRQSQNLEIGDNNKHYRLNWRNNADITSFYFTHFPDEANAELLWRHFKKWGDVREVYIAKRLNKDGKRYRFMRFKGVSDAKGLEVRLDNIFINDCKLFVNLPRFDRPVRNTELLKKNPIGRKYTDEASKPCGVTTGALRRSYVDVVTKGGCQGDKRTDEAQTPTILINPDEGGEYWCNETWVGMLKKVMEVETLEDRITWELGYNVRTKFLGDDMVLLPGMSDDKAKLLIQSETESDDSLFYSLEKWTPKCRPNNRVVWLQLWGFSIQVWEMKNLRRAVAAIGDVIESDDDTEDRRRLDRARVLVRTPLPPLIRSEVIVRVGELEYRVWIVEETGFEGGSNRKGSSSSDGWSEMITSDDGGEVGDVLDDTNTNFSFSSELPNQKLSPSRTQRAEGGTDVRCCDLRPLGNIQADVTPKEKSKGTVEGMLGSSFGKLNLADNFAGTEEEAANTKEVTCYIPYRMIKGTGIT

SEQ ID NO: 148349 - protein, 122 aa, Glycine max
  Coding DNA Sequence Number=SeqID_56664
  Subcellular localization annotation: CTP_CleavageSite=39; ConfidenceScore=5.57e-01
NADSMQGLTQSSAPFVPPGTTKSFTCGNFMVARDSRQPRGAKLVSYTDFRFPHLCDMSDHSLVLVRCRWHAETKFWSICHDLRGDKSTVSAPLCHSDTVVSREAAETLVSFAHMIFGRYLTA

SEQ ID NO: 148350 - protein, 151 aa, Glycine max
  Coding DNA Sequence Number=SeqID_56665
  Homolog annotation: Hit_ID=Q6WAY6; Match level="QueryCoverage=92%, HitCoverage=24%, E-value=2e-13, Identity=31%"; Hit description =Putative uncharacterized protein
MGSSQMPSLKKRFYQVKVKSTGITSLKELGKLMGQLQQQAFRKAYGKIWDLAMVEVSTEAIASLAQYYDQPLRCFTFGDFQLSPMVEEFEEILGCPLRGRKPYLFSGFYPSLARIAKIVQISAQELDHRKQVENGVVGIPRKCLEAKILAG

SEQ ID NO: 148351 - protein, 41 aa, Glycine max
  Coding DNA Sequence Number=SeqID_56666
MASMDTSAMVNSKNLSVVSRPFNLDLVKPLAGLICPPCLLK

SEQ ID NO: 148352 - protein, 35 aa, Glycine max
  Coding DNA Sequence Number=SeqID_56667
MENWRTALLNNFAGLRTRGGCMNSAWRDVRGAQLQ

SEQ ID NO: 148353 - protein, 161 aa, Glycine max
  Coding DNA Sequence Number=SeqID_56668
MPSLKKRFYQVKVKSLGITSLKKLGQLMGQLQRQAFRKAYGKIWDLAMVEVSTEAIASLAQYYDQPLRCFTFGDFELSPMVEEFEEILGCPLGGEETIPLHREASRKWGGRDTEKIFGVLFPNVDGLVDLAAIDAFLAYHNHKESPVVAMLADLYDTFDRR

SEQ ID NO: 148354 - protein, 191 aa, Glycine max
  Coding DNA Sequence Number=SeqID_56669
  Homolog annotation: Hit_ID=Q6UUU1; Match level="QueryCoverage=70%, HitCoverage=91%, E-value=1e-36, Identity=62%"; Hit description =Putative uncharacterized protein
MLALMKVSVKCFMWQEKKAAPVRQQICDTGYIPLPPLTDSLRSVVRLRRAEMAYERGGDFLEDARKILNREVRGPRQSRFSIGSAPLTSITKSDAQISGGETRQDYKDTRRFPLAAPSCALLFLPFGLPVSFRCYGRVCLIPRLTLSSGPTAAPYPVTIVLSPTRKDMQKHHWQQPLVIDLEELVLKSCAG

SEQ ID NO: 148355 - protein, 207 aa, Glycine max
  Coding DNA Sequence Number=SeqID_56670
EAIAQLLCIPGQDFARTAAGRRVRIMRTNMTTLTQIWMTLLLSNIQPSDHNSDLPLPKYGATRHPLDPDKSNRPLGFPALITGLCQSFGVPVAPSKVIRPPITRAFIEKYCTQRQVQGDAPQAADAPPPHQAGPAGSFDTEYLQSQGFTYFPCPTPDQFRAEVAWPGDWPEARAGEAPAEAPDEADEAREDEEMTDLLDFLGGSGAT

SEQ ID NO: 148356 - protein, 43 aa, Glycine max
  Coding DNA Sequence Number=SeqID_56671
MAFQIRCVYLVVALDVIAMVDEVVEDERSIVILLTHGRIKEAQ

SEQ ID NO: 148357 - protein, 17 aa, Glycine max
  Coding DNA Sequence Number=SeqID_56672
GVTGTKKYGISRYLSIK

SEQ ID NO: 148358 - protein, 164 aa, Glycine max
  Coding DNA Sequence Number=SeqID_56673
MVKKESETFKEYAQRWRDLATQVAPPIVKRKMITMMGSDYSPLSSTNARRIGATGAKRKEGVPMLVTSALRMDNATQTSHGHPSVRATSPELLSSRKGDLFQFSTRELQPRAPQRPCQREPPKLRFSNPDSPGRQRQHLAPVPTAIRNIPAQGQLCLEVHRRPQ

SEQ ID NO: 148359 - protein, 116 aa, Glycine max
  Coding DNA Sequence Number=SeqID_56674
MLQACPIASECTLGLRPSLTTPQFNKNKQQFEDKSLTFFSKYMQFRAPKYINGKLESPRMRVQDKNQEEFKIQEESLETRIKIQGSRSQESRSRLKIQESREDSIKISIKRVLNST

SEQ ID NO: 148360 - protein, 195 aa, Glycine max
  Coding DNA Sequence Number=SeqID_56675
MVPKKPPVKSSRKDTAREGSSAAPQEDVDFDRHSWSFLKERRVQLRDGEYVEFQEEIAQRQWTQLVSPMAKPVNPFDEDAINQFLGHPLVLEEGQHYEFSQRRSQASGFDDEAINQLLCISGQDFSQSVVGKWVQIMRTSMTTFTQIWMTLMLSNILPSDHNLELPLLKWIAPPRHPVDPEKSNRALGFPALITG

SEQ ID NO: 148361 - protein, 71 aa, Glycine max
  Coding DNA Sequence Number=SeqID_56676
MGVQIATRPTWAFQNIPPEGGCFWRKQPGSPGRAGGRSEEERGSALLAFRNHLKLVRKIVSVKKIQAEALP

SEQ ID NO: 148362 - protein, 32 aa, Glycine max
  Coding DNA Sequence Number=SeqID_56677
EKFYTDLANFEAISAEGEQVKFGLTTTRNLPD

SEQ ID NO: 148363 - protein, 63 aa, Glycine max
  Coding DNA Sequence Number=SeqID_56678
MEFKQPEVLLVNKVHQFEGRKRPLEALADMGLNGEYNLKDLMTLVDSVKLKKKGSTGQSTMKE

SEQ ID NO: 148364 - protein, 175 aa, Glycine max
  Coding DNA Sequence Number=SeqID_56679
MERSMIDAASGGALGDMTPAEARNLIEKMASNSQQFSARNDAIVIRGCMRVCGLCSSTDHHTDLCPSMQQPGAIEQPEAYAANIYNRPPQPQQQNQPQQNNYDLSCNRYNPGWRNHLNLRWSSPQQQQQQPAPSFQNVAGPSRPYIPPPIQQQQQPQKQPTVEAPPQPSLEELVR

SEQ ID NO: 148365 - protein, 219 aa, Glycine max
  Coding DNA Sequence Number=SeqID_56680
  Homolog annotation: Hit_ID=Q0ZCD0; Match level="QueryCoverage=83%, HitCoverage=16%, E-value=5e-08, Identity=25%"; Hit description =Integrase
MERSMIDAASGGALGDMTPAEARNLIEKMASNSQQFSARNDAIVLRGVHEVATDSSLFAENKKLEGKLDVLVNLVTQLAMNQKSASVPVARVCGLCSSADHHTDLCLSLQLSGVNEQPEAYAANIYNRPPQQQNQQQQTNYDLSSNKYNPSWRNNPNLRWASPPQQQQPVPPFQNVAGPRKPYVPPPMQQQQRQQATEALPQPSLEELVRKMTIQNMQF

SEQ ID NO: 148366 - protein, 328 aa, Glycine max
  Coding DNA Sequence Number=SeqID_56681
  Homolog annotation: Hit_ID=Q6WAY6; Match level="QueryCoverage=87%, HitCoverage=49%, E-value=9e-23, Identity=29%"; Hit description =Putative uncharacterized protein
MDVLALLIFGAVLFPNVDSLVDLAAINAFLAYHHSKESLVVAVLANLFDTFDRRCKKSSARIICCLPALCVWLVSHLFQQDIRHPCLPLSHRLCVKKRRVDWDQHLAGIGGKTISWFPRWKEGREGVLFSCGEYPNIPLIGTRGCINYNPALAIRQLGYPMKGASTEESLSLFLVRDFGAQSFKIIQRVHKAWESLLRKDEEHRGIRNGIIGGYHEWLKVRTRGLDWLSKLKIINEENFEAPEKDEEVRALKNGLGKARLAKEKFKLVATNVRKECTELREENAATARALEQETKRARKEEHGRDKFRGALWGSNNELKLRREERDQS

SEQ ID NO: 148367 - protein, 344 aa, Glycine max
  Coding DNA Sequence Number=SeqID_56682
  Homolog annotation: Hit_ID=Q9UAY0; Match level="QueryCoverage=39%, HitCoverage=30%, E-value=4e-07, Identity=34%"; Hit description =Putative uncharacterized protein
HLAGPGQAHRPVADAGRHRLGPAQPQRARHHRRTGQPGRAAGRAAERQHRGGGIAAHAGTIRQHSAAGATGRRHAAPEGRGAGGTGRHRLHVPVARQRHDGHRPGHQAGAGLERGRDHPPHPRNHARTGAVLPAGRELGHPVRDLHLRRDLDPEGADDAAGGGGPGVLRDRRHRRHHGGAGVGVRADGVLRRRGRQHLSPVRRDAGGVDRLLGLPGAVADAGAVRQPVETDPGRPPREARLLRLVQSRLRAPDHALYGARGRRAGAAGALRAGLRAGDRRGGAAVRAAAVVVPARRGPGQLHGHGDPAAGFAAGRDHGRGQGRRALHDGARAGAVRVFGQRLQP

SEQ ID NO: 148368 - protein, 66 aa, Glycine max
  Coding DNA Sequence Number=SeqID_56683
AHKNPRAFSCISSPIYLEFSIQCPCGVGLHHSLPLEKDLTSNPEVRSENSFLGHLPMKEHGSSPTQ

SEQ ID NO: 148369 - protein, 166 aa, Glycine max
  Coding DNA Sequence Number=SeqID_56684
  Homolog annotation: Hit_ID=Q2HW90; Match level="QueryCoverage=66%, HitCoverage=22%, E-value=2e-10, Identity=31%"; Hit description =Putative uncharacterized protein
MGSSQAPPLKKRFYQVKIKSLGVTGLKELGQLMDQLHRQAFRKAYGKIWDLTMVEVSTEAIASLAQYYDQPLRCFTFGDFQLIPTVEELEEILGCPLGGRKPYLFSGFYPSLARISKIVKISTQELDRGKQIENKVVWVPRKCLEVKRLMLFSPFTIARKTHLSLS

SEQ ID NO: 148370 - protein, 77 aa, Glycine max
  Coding DNA Sequence Number=SeqID_56685
HSITGESVHSVIGDFEHPDLEHYNFEHYNFEHSDSEHSDFAHSENMAQPPPRERTLREMAAPDFTYESLCIQYPDED

SEQ ID NO: 148371 - protein, 150 aa, Glycine max
  Coding DNA Sequence Number=SeqID_56686
  Homolog annotation: Hit_ID=A4WBC0; Match level="QueryCoverage=47%, HitCoverage=93%, E-value=2e-12, Identity=49%"; Hit description=ChaB family protein
  Pfam annotation: Domain name=ChaB; Domain location=8-73; Score=43.8; E_value=6.1e-10; Accession=PF06150.3; Description=ChaB
MPYSSNRELPDSVRHVLPGHAQTIYQKAFNSAWDQYKDEDDRRGDESREQVAHKVAWAAVKKEYAKGEDDKQPMLFTDNFPFVIGVNLETFMANALLSCLKSTPRAPPVKSQIQGAITTGSGLQTSFGDIDEALLWSCEKRAASLCATLA

SEQ ID NO: 148372 - protein, 132 aa, Glycine max
  Coding DNA Sequence Number=SeqID_56687
  Homolog annotation: Hit_ID=Q59296; Match level="QueryCoverage=25%, HitCoverage=6%, E-value=3e-08, Identity=85%"; Hit description =Catalase
MDNEEGVQEQMKADLSDLKDQMASISEVMLKLQKTIEDKATATASSTVREAEPVLQPALNPGLDRNTAVFGRRYSLQAYPYGLPPDFTPRATPEDLSQVPRYRARIRNHGHSCFLCEIVIRSQFHTTYEPEA

SEQ ID NO: 148373 - protein, 154 aa, Glycine max
  Coding DNA Sequence Number=SeqID_56688
GRLRHPFAIQTQLCPMARRDKLWSFCALLSSRGGGPDDMRRQIMVIPHTLLPFKRSCVRWHAETNYGHSAPFCDPEAAGPMTCGDKLWSFRTPFCHSDAVVSDGTQRQIMVILAPFCDPEAVGPMTCGDKLWSFRTPFCHSDAVVSDDMQRQIM

SEQ ID NO: 148374 - protein, 86 aa, Glycine max
  Coding DNA Sequence Number=SeqID_56689
MNQQKKAKRGVFSKKGVQIAIKPTWAFQGVPTEGDAFWWKQPSSEKNCFREENPRRSASVTLPRRFSERFREDSSPFFVRSSVFNR

SEQ ID NO: 148375 - protein, 140 aa, Glycine max
  Coding DNA Sequence Number=SeqID_56690
  Gene Ontology: Mol. function=transferase activity, transferring phosphorus-containing groups; Cellular component=intracellular; Biological process=two-component signal transduction system (phosphorelay)
  Homolog annotation: Hit_ID=A7MED8; Match level="QueryCoverage=100%, HitCoverage=20%, E-value=1e-62, Identity=90%"; Hit description =Putative uncharacterized protein
  Pfam annotation: Domain name=CheW; Domain location=2-127; Score=82.4; E_value=1.5e-21; Accession=PF01584.10; Description=CheW-like domain
MSVRVADEVFILPLNAVMESLQPTAEELKPLAGGERVLEVRGEYLPLVELWNVFDVQNAKTDATQGIVVILQSAGRRYALLVDQLIGQHQVVVKNLESNYRKVPGISAATILGDGSVALIVDVSALQSLNREKRVAGAAA

SEQ ID NO: 148376 - protein, 172 aa, Glycine max
  Coding DNA Sequence Number=SeqID_56691
MTTLTIIWMSIHVAQLIADVIYLFAVPVAPSKVIRPPITRAFIDKYCTQRQAQGDAPQAADAPPPHQAGPAGSFDTEQYLRHLVRQQAANHRANVQTHDCLYQLSLSLQSQGFTSFPCPTPDQFRAEVAWPGDWPEAWAGEAPAEAPDEADEAREDEEMTDLLDFLGGSGAT

SEQ ID NO: 148377 - protein, 267 aa, Glycine max
  Coding DNA Sequence Number=SeqID_56692
  Gene Ontology: Biological process=transposition, DNA-mediated
  Homolog annotation: Hit_ID=Q6UUU1; Match level="QueryCoverage=22%, HitCoverage=40%, E-value=3e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPVTTLVLLCHQAGVQWHDLLGSQPPLPPIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 148378 - protein, 100 aa, Glycine max
  Coding DNA Sequence Number=SeqID_56693
  Homolog annotation: Hit_ID=A2ZKM0; Match level="QueryCoverage=35%, HitCoverage=3%, E-value=1e-07, Identity=68%"; Hit description =Putative uncharacterized protein
MTGTDSHTTMINGLGVAGWGVLPQKRRDIYGAWEQYLGLKHDDSAPKKSYAVNQEINCCFVEWMCKLRCNISKKVDAQYQQKLLWEISLSFKLQLKAGLR

SEQ ID NO: 148379 - protein, 141 aa, Glycine max
  Coding DNA Sequence Number=SeqID_56694
MTQSLAFSKGWTLGGLHALTFRGLHALAFRGLHVLAFRGLHVLHLRRPHVLAIRGLNILAFRGLHILAFRGLHAFAFRELHALTFKGLHALNFRGLHVFALRTTCPHLQTTICPHTKRATRPRLLRTTRPRLEEYTSTPSR

SEQ ID NO: 148380 - protein, 321 aa, Glycine max
  Coding DNA Sequence Number=SeqID_56695
  Gene Ontology: Mol. function=isomerase activity; Cellular component =membrane; Biological process=carbohydrate metabolic process
  Homolog annotation: Hit_ID=A4WDR4; Match level="QueryCoverage=100%, HitCoverage=100%, E-value=1e-156, Identity=89%"; Hit description =KpsF/GutQ family protein
  Pfam annotation: Domain name=CBS; Domain location=203-320; Score =79.8; E_value=8.7e-21; Accession=PF00571.19; Description=CBS domain
  Pfam annotation: Domain name=SIS; Domain location=38-170; Score =138.4; E_value=2e-38; Accession=PF01380.13; Description=SIS domain
  Pfam module annotation: Pfam domain module=CBS::SIS; Domain location =203-320::38-170
MSDFLLNAGRQTLMLELQEASRLPERLGEEFVRAANTIIQCEGKVIVSGIGKSGHIGKKIAATLASTGTPAFFVHPAEALHGDLGMIESRDVMLFISYSGSAKELDLIIPRLQEKAVALLAMTGKSRSPLALAAKATLDISVEREACPMHLAPTSSTVNTLMMGDALAMAVMQARGFNEEDFARSHPAGALGARLLNKVHHLMRTDDAIPQVKLDTSVMDAMLELSRTGLGLVAVCDNEGFVKGVFTDGDLRRWLVGGGKLESQVSEAMTQGGLTLNAESRAIEAKESLMKRKITAAPVVDDAGKLCGAINLQDFYQAGII

SEQ ID NO: 148381 - protein, 105 aa, Glycine max
  Coding DNA Sequence Number=SeqID_56696
MLESFKQQEQMSVLELYIEKGVASGSMFHSANSLTSCGNYLSNDETQPTTNMSNLHIDEDDDDYLVSNSYVEESLDEDDSVDGVSESDDEVTNIPQTVRIVHPAE

SEQ ID NO: 148382 - protein, 83 aa, Glycine max
  Coding DNA Sequence Number=SeqID_56697
MEYLLVGDEQKRKTESKNAKKDDPRAANSSIPWVWLLKGGKRVKKAAKYKGYGAALQRHSLLVSHREGQRSVGRDPIPACVHP

SEQ ID NO: 148383 - protein, 46 aa, Glycine max
  Coding DNA Sequence Number=SeqID_56698
MLEGNDAIAAAPTVDKGSSRCFDDAKRSHASQSFIQDKAIKDIQDG

SEQ ID NO: 148384 - protein, 121 aa, Glycine max
  Coding DNA Sequence Number=SeqID_56699
MTTLTEWMTLLFSNILPSDHNANLPLQMDRAHKTPSGPEKVQQGPGVSSSGYGPLLVLQGARSPSEESHPQRHPADPEKSNRALGFPALVTSLCSPTGCPFPPARSRHNDIGKYTHRSTDF

SEQ ID NO: 148385 - protein, 199 aa, Glycine max
  Coding DNA Sequence Number=SeqID_56700
MIMRGQDIYSSQEEATTPSSSESEEAKGEDSSEEIYPQEEGQPLMVNEECKETLVTTPTPLGLEVIPQVKKLLDEGLGRRRQTHKSFYTGSATTCAYIQSPSDLRSLRFLFNLVKAFTSKDPQGMYPPLFSLNNLVDVPSTRTDPQEMYPLLFSVTTTQVDVPSTCTTKDVPSNVLRQSSQAVSPLKHCEGETREFSGG

SEQ ID NO: 148386 - protein, 165 aa, Glycine max
  Coding DNA Sequence Number=SeqID_56701
  Homolog annotation: Hit_ID=UPI00016621D1; Match level="QueryCoverage =95%, HitCoverage=43%, E-value=1e-13, Identity=32%"; Hit description =UPI00016621D1 related cluster
MYNFPLHCINAYEVCIYRISRESTLTFRGLHTLDFRGLHALAFRGLHVLAFRGLQVLAFRGLHVLTLRGLSTLTFRGQHALAFRGLHVLTLRGLCTLTFRGLHALAFRGLHVLTFRGLHALAFRGLHVLAFRGLHALAFRGLHALTFRGLHVLAFRRLHALALQR

SEQ ID NO: 148387 - protein, 70 aa, Glycine max
  Coding DNA Sequence Number=SeqID_56702
MFGSKARVLAGKGEWAPFMDILALLIFGVVLFPNVDGLVDRAAFDAFLAFHDRWENRLIATSNNLYDTFD

SEQ ID NO: 148388 - protein, 93 aa, Glycine max
  Coding DNA Sequence Number=SeqID_56703
MECNICGVNKKYEGPVDKGAGSAGVSGAAEVVGTSDLLPLAFLGPPNDTVNPLALHKAVIKAGNPSLDVSCYAVTLDVWDVGIRLEKERTLHV

SEQ ID NO: 148389 - protein, 72 aa, Glycine max
  Coding DNA Sequence Number=SeqID_56704
MGIQKNSQAGEGRRETQKEFKRLVLGKFFLAKGEENEKMNSTSFQDLENQKTSENFWYKEEEVQRDSRLVKD

SEQ ID NO: 148390 - protein, 53 aa, Glycine max
  Coding DNA Sequence Number=SeqID_56705
MGESKKEEEEGKKAPDQGSKENRRNVQKGNNLQSQVMTYLWFGIRKKHLPVRD

SEQ ID NO: 148391 - protein, 81 aa, Glycine max
  Coding DNA Sequence Number=SeqID_56706
MPLGVGLHQFVVQVEGTSTWVVVTENKRGYISCGLVLVEGTSTRLFKENKGGYIPSGSLLIKDFTWLKRNLKDRRSLGDWM

SEQ ID NO: 148392 - protein, 70 aa, Glycine max
  Coding DNA Sequence Number=SeqID_56707
MTKLGLCVPTDTTVSEWQRGADNHKVSPRIMVGVVDKSVRLYAPTYPPCGRNSDLLVVSAITCDDCLNAK

SEQ ID NO: 148393 - protein, 122 aa, Glycine max
  Coding DNA Sequence Number=SeqID_56708
MGETHEVPQGHTLVDFEPHLGCATEGKAFFSVPLPNALGGGGGAGAQYHPQPQLLHLAIGGRPPAMVERQEFDHIEEWLMVIEGGRNYAFAGMAELCLVPDVVIPPKFKVSDFDKYKGTSCP

SEQ ID NO: 148394 - protein, 119 aa, Glycine max
  Coding DNA Sequence Number=SeqID_56709
GCHHQKGGIVEASFMVMNQVDSSSFDDDKDDDKMPKRMISRLSQQGTSFVVQVEGTSTWVVVTENKRGYISSGSVQAKGTSTWLFKENNGGYIPCGSLLVKDFTRLKRNLKDRMLRLGS

SEQ ID NO: 148395 - protein, 146 aa, Glycine max
  Coding DNA Sequence Number=SeqID_56710
MGEAEEVQEKMKAEMEAMKEQMATMMEAIISMKKRREVDMVAVAATNAIAKVNPTSPSGINQMNHPNMIGKDLGSTDDPMMCKFKTSTPSHHMACLPTIHHPMWHTLSMKISITPLRYSLRTNNLNLIRHISLKPRRRHMKFPTTI

SEQ ID NO: 148396 - protein, 125 aa, Glycine max
  Coding DNA Sequence Number=SeqID_56711
  Homolog annotation: Hit_ID=A5AV98; Match level="QueryCoverage=81%, HitCoverage=13%, E-value=1e-19, Identity=48%"; Hit description =Putative uncharacterized protein
MLEEKFVTIIDASSNEEKVHYKTWARSDRLSLMLMRMTVADNIKTTLSKIESAKRFIGLVGEYSQTADKSVVGTLMSTLTTMKFDGSHTMYEHVIEMTNITEETRLKNQGSHLVHYVSHQGNQGA

SEQ ID NO: 148397 - protein, 197 aa, Glycine max
  Coding DNA Sequence Number=SeqID_56712
  Homolog annotation: Hit_ID=Q6WAY4; Match level="QueryCoverage=85%, HitCoverage=30%, E-value=2e-21, Identity=37%"; Hit description =Putative uncharacterized protein
MGTNQIRKRFYQVKIKGLDVTSLKELGRLMGPLQRQAFHKVYGKILDLTTTEVFTKVVVSLAQYYDQPLRCFTFGDFQIVPTVEEFEEILGCPLGGRKPYLFSGFLPSLSKIADVVGDSARELDCMKQTRNGVVGLPRKYLEGKARDMASQEEWVPFADILALLIFGVVLFPNVDGLVDLAAIDAFLAYHHSKESPV

SEQ ID NO: 148398 - protein, 93 aa, Glycine max
  Coding DNA Sequence Number=SeqID_56713
  Homolog annotation: Hit_ID=Q949K7; Match level="QueryCoverage=44%, HitCoverage=46%, E-value=5e-09, Identity=58%"; Hit description =Putative gag polyprotein
MGAYAKDEKLLMHFFQESLTGAAVTWYTNLEASRVHSWKDLMLPSLGSISTILIWLRIGCNYRTWMNGSRMEKEEREETPLQGEDESRRSSPL

SEQ ID NO: 148399 - protein, 104 aa, Glycine max
  Coding DNA Sequence Number=SeqID_56714
MPAGVEGVTSNSYVEESLDEDDSIDGISDTDDEVTDIIQPVYKEFKIHFGMMLCIIIISTGVILMRRTFVVWRCHRVLMLAKNYMLAWILIVKMRSRMQSNNML

SEQ ID NO: 148400 - protein, 69 aa, Glycine max
  Coding DNA Sequence Number=SeqID_56715
MESARHMATPMSTGCYLDKDESSQSIDMKEYRVAMQPKNNQFERKIVGTQLEAIRMLLASWHPVMNFKL

SEQ ID NO: 148401 - protein, 89 aa, Glycine max
  Coding DNA Sequence Number=SeqID_56716
TAYLAVTQPVDQRKTKMAGARRSSDMGTSTVPHDAVTGTGGELIFLRLHANRRVIEPGVQHGGIRIPTQAPPRHYTPRHRATNLPMPHL

SEQ ID NO: 148402 - protein, 288 aa, Glycine max
  Coding DNA Sequence Number=SeqID_56717
  Homolog annotation: Hit_ID=Q84VI1; Match level="QueryCoverage=100%, HitCoverage=46%, E-value=1e-103, Identity=67%"; Hit description =Envelope-like protein
MASSPKETSASGSPAVPSSPHQEQPEFNIQPIQIIPGQASVPEKLIPRRQQGVKIAENPSLATSSREVDKEMDKKIRSIVSSILKDAPVPEADEDVPTSSTPNVSVPDEDDQATKETPAPRAPEPAPGDLIDLEEVESDEEPIANRLAPGVAERLQSRKGKTPIKRSGRIKTMAQKKSTPITPTTSRRSKVAIPSKKRKEISSSDSDEDVELDVSTSKRAKKSGKKVPENVPDAPLDNISFHSIGNVEKWKYVYQRRLAVERELGRNALDCKETMDLIKAAGLLKTVT

SEQ ID NO: 148403 - protein, 69 aa, Glycine max
  Coding DNA Sequence Number=SeqID_56718
MGEKSWSLVRNHLHKELTSWSEEYINLLGDIKRFEELKCSLLVDGLSMVRYHRQVDEYYGYGICHCFTI

SEQ ID NO: 148404 - protein, 58 aa, Glycine max
  Coding DNA Sequence Number=SeqID_56719
KFKKIANNLTFRKTFFRKLLSPIPEEGLPEALLPELAFVTSGRPSSGSGHSGPSSFCA

SEQ ID NO: 148405 - protein, 91 aa, Glycine max
  Coding DNA Sequence Number=SeqID_56720
QGSRVRLPKEENVRSRHQRLFVENVRKTEGKSVMKNIPDSGVVFTFEEGISTSHVDKSGALTPTYPPSKRKSDLRSSFKSANQAILFTWKE

SEQ ID NO: 148406 - protein, 88 aa, Glycine max
  Coding DNA Sequence Number=SeqID_56721
MAYTHIPDSTSDSPQISASPYQLDLAPYASEPYHAQWNAPGLLRDKHTLRSSRILGEMEVDEPWLGLWLPLNYQLDMGASQHRTLELG

SEQ ID NO: 148407 - protein, 188 aa, Glycine max
  Coding DNA Sequence Number=SeqID_56722
  Homolog annotation: Hit_ID=A2Q1Z1; Match level="QueryCoverage=95%, HitCoverage=67%, E-value=8e-13, Identity=26%"; Hit description =Homeodomain-like
MTTCIKSGQFCERSWTQLKSRWNMIHPPFQKFNGCYKQADKHRRSGSSEKDVLADAHMIYSQDTEFMSKCSKRTKVSASGNYSSSSNPETPVEVKECDTSSPMSRPIGQKAAKRKSKGKESRNTLDLFGIESVMKDKNMNTSKLIQLKKAHEWRMEYEILMKDTSNMSEQQCKDHEKYCDHIRKKLGY

SEQ ID NO: 148408 - protein, 58 aa, Glycine max
  Coding DNA Sequence Number=SeqID_56723
MYPPLELIHKRMYPLLFSVQQPQVDVPSTYVTKDVPSNVLGQRILRRGREKSKEFSGG

SEQ ID NO: 148409 - protein, 165 aa, Glycine max
  Coding DNA Sequence Number=SeqID_56724
  Subcellular localization annotation: CTP_CleavageSite=56; ConfidenceScore=5.25e-01
MVKVGTSYVPINVSFSPKVGPGLPGLPAFHSGNHVGAQLHYESATGRSRRPLRITPAALGGVCILAYYVGTVTPGCSSEVLHVAGEKAAPVRQSEYVIQDSYSASSLTDSLPLGRHCGERKALRTGRRFPPESAGIDILLNQGSERAAAKPFFHRLRPPDKHHEI

SEQ ID NO: 148410 - protein, 271 aa, Glycine max
  Coding DNA Sequence Number=SeqID_56725
  Gene Ontology: Cellular component=membrane
  Homolog annotation: Hit_ID=A7Q7B8; Match level="QueryCoverage=22%, HitCoverage=17%, E-value=4e-16, Identity=66%"; Hit description =Chromosome chr18 scaffold_59, whole genome shotgun sequence
MHSEVEALEHMKKIDTGHQSVSLENKTGDSTMLKIGDSAKVVIKQDMKGGEHKYGFNNNKREKPQKDNNLGVLLVEYGILLSEVKIEKKEKNCFTFDILGLRRIEWNLQGSWPAATNTVPAITFIMAVLIRMESISIKCVHGLAKILGSVLSLAGAITFSLVKGPHLGFMKWYPENQNHTSHPLTIVHSKDLELSHAVLLNPYHPPCHHAETQEGQQMHNEVNHDVKESKGKIHLQLAQYNCSLIFQLIKLHKINDFATYSMEEKAQASYG

SEQ ID NO: 148411 - protein, 90 aa, Glycine max
  Coding DNA Sequence Number=SeqID_56726
MLECDEHDAQMQTGTFKHPWLHKYFSMQGSRCACRNVPFCGRAKARLTGALSKGGKMRGVATNVYLWKTSEKSKEIGQDENSKFGSCIYA

SEQ ID NO: 148412 - protein, 152 aa, Glycine max
  Coding DNA Sequence Number=SeqID_56727
  Gene Ontology: Mol. function=glutamate-ammonia ligase activity; Cellular component=chloroplast; Biological process=nitrogen compound metabolic process
  Homolog annotation: Hit_ID=P08281; Match level="QueryCoverage=49%, HitCoverage=17%, E-value=3e-35, Identity=90%"; Hit description =Glutamine synthetase leaf isozyme, chloroplast precursor
  Pfam annotation: Domain name=Gln-synt_C; Domain location=2-149; Score= -132.4; E_value=0.019; Accession=PF00120.15; Description=Glutamine synthetase, catalytic domain
MLFSYLLSRLALEQKRMQPNPCQGPYYCSAGTDKSFGRDISDAHYKACLYAGINISGTNGEIMPGQWEYQVGPSVGIEAGDHIWASRYILELIARGIEEVCCSAIWCRGIVTSTVKGKEKKIVREKEEKDDCGRGSHLPPCERLYSRQIKAF

SEQ ID NO: 148413 - protein, 81 aa, Glycine max
  Coding DNA Sequence Number=SeqID_56728
MENALKSVAYNPQPERHVGILVAAENQDSGGDGDEGEVLENVQDDDGLGIGLIALPLFELPLTRRDDVTLRLSRYHLTDVD

SEQ ID NO: 148414 - protein, 294 aa, Glycine max
  Coding DNA Sequence Number=SeqID_56729
MGREDYGSKLVECLPIPDGEAPEELALTKGGHQVHVVSGLDSLACKVEEWTGVEDINGIALVDEDLEHHKVHYDEGDNHGVILVDGVDALEVRVRKVSELVRQPSIGNVASNGCVYVAVVGVFVYLSLLLFFCMLPGSYFAPLGVLQVLLLLGDCLASKCSSRSIVPSYCLRLSGFHPKVLPVRQGCDSSWVRLGKVWADCLSPWERLTRASSRSWSSFSFVNSSSWRCSISAMRFWNCCRVSMSIIVVGQGWESVRGVLCLRPDQMLTMDKCERIKERPRGFRTSHVGLERCL

SEQ ID NO: 148415 - protein, 594 aa, Glycine max
  Coding DNA Sequence Number=SeqID_56730
PGVRAPVAGLTWRVGTCLRVPLGMPRRFYGPGQYISPLSFEPACGRKRLFNVEVDCLASKESVWCMGLDECESCRSMRLVKPPSLNMCCLGYLCQVVRDEHIFGVPVGACSTRAILLYACHTQSRHVLPSIIMSYFLSDSTTGLGDSDFGGSIEQPNMDQEVISISGSSSKDTCRGASDRVLLALTEGHDFLLMPGSQSWYYDAFRGARRASGEKDVRMSPRVRPSMCGGSSSSPSGVADYEWVKDDGLKYKSCLTTTASVAALQHQVKLVNPEGSCPMDHFSLDHLLVCSVGALECGPFLAPPKQLDNGMASPTSRSTSNLIPPAILSLPLVSNPLAALDGIMGDFAWRPFVKQVGPVGETVPSFAATPFAREGGGRWMMFLDWKKSKAPMSVRALRQAAGLGPTAGYLTTTQDVPPAPPVVKAPPTAAATLTTFAPSPPLVAMVQEVSPTIVEAIVLAAQAESVVVSSSTVAAPLLSAGVATTSAPTVLLLSSLASVVMPIVVFEDMASPSSSLRPRISLDHLYTSSDADSMWGATYKLEQNSKRTYWNYEEARLARLRRSTQSIGSMGTTRLVAGSRTNLGKQVNSGKRRA

SEQ ID NO: 148416 - protein, 407 aa, Glycine max
  Coding DNA Sequence Number=SeqID_56731
  Gene Ontology: Mol. function=adenosylmethionine decarboxylase activity; Cellular component=cellular_component; Biological process =spermidine biosynthetic process
  Homolog annotation: Hit_ID=Q8S3F8; Match level="QueryCoverage=87%, HitCoverage=100%, E-value=0.0, Identity=100%"; Hit description=S -adenosylmethionine decarboxylase
  Pfam annotation: Domain name=AdoMetDC_leader; Domain location=1-53; Score=108.6; E_value=1.9e-29; Accession=PF08132.2; Description=S -adenosyl-l-methionine decarboxylase
  Pfam annotation: Domain name=SAM_decarbox; Domain location=57-388; Score=755.5; E_value=3.4e-224; Accession=PF01536.7; Description =Adenosylmethionine decarboxylase
  Pfam module annotation: Pfam domain module=AdoMetDC_leader::SAM _decarbox; Domain location=1-53::57-388
MESKGGKKKSSSSSSKSIFYEAPLGYSIEDVRPNGGIKKFRSAAYSNFLYCYMAMAVSAIGFEGFEKRLEISFFQPGLFADPEGRGLRALTKSQLGEILTPAACTIVSSLKNDNVDSYVLSESSLFVYAYKIIIKTCGTTKLLLAIPPILKFAEMLSLNVKSVNYTRGSFIFPSAQPYPHRNFSEEVAILDGYFGKLGAGSNAYILGGQDKAQNWHVYSASADSVTQCDNVYTLEMCMTGLDREKAQVFYKEQSASAAMMTVNSGIRKILPDSEICDFDFEPCGYSMNSVEGAAVSTIHVTPEDGFSYASFETVGYDFKAVNLNEMVQRVLACFLPTEFSVAVHVDGASKSFEQTCFLDVKGYCREERSHEGLGMGGSVVYQKFGKTSDCGSPRSTLKCWNEEDEEE

SEQ ID NO: 148417 - protein, 32 aa, Glycine max
  Coding DNA Sequence Number=SeqID_56732
MDMDYQNEEECGVNEPHVDCSDAFNTYQVFES

SEQ ID NO: 148418 - protein, 31 aa, Glycine max
  Coding DNA Sequence Number=SeqID_56733
MAFQGGPGGRPDFGRGSGGYGSPCNFGCHWS

SEQ ID NO: 148419 - protein, 227 aa, Glycine max
  Coding DNA Sequence Number=SeqID_56734
  Gene Ontology: Mol. function=sequence-specific DNA binding; Cellular component=endoplasmic reticulum membrane; Biological process=lipid biosynthetic process
  Homolog annotation: Hit_ID=A7PND6; Match level="QueryCoverage=92%, HitCoverage=75%, E-value=7e-72, Identity=60%"; Hit description =Chromosome chr1 scaffold_22, whole genome shotgun sequence
  Pfam annotation: Domain name=LAG1; Domain location=33-222; Score =217.4; E_value=3.4e-62; Accession=PF03798.7; Description=Longevity -assurance protein (LAG1)
MDFQTLERKKKISKFKESAWKCVYFLSAEIFALAVTYDEPWFTDTRYFWVGPGNQIWPDQKIKEEGMLEAIEVSIEVTRRKRRKGAGGSFILIPFVRVGSVVLALHDASDVFIETGKMSKYSGAETTASIAFILFVLCFTVTRIIYYPFWILRSTSYEVVHALKMDLVDGPLYYYVFNSLLYFLQVLHIYWWVLMLRMLVKQIQEKGKVSEDIRSDSEDEDEHKHEE

SEQ ID NO: 148420 - protein, 80 aa, Glycine max
  Coding DNA Sequence Number=SeqID_56735
MSMPILDQFHPCIHDSIENIVDVKPDGMSEDSWSLVRNHLLKELAKWSYEYIYMLCGRDKFEELKWYLLVDGLSMVTMDK

SEQ ID NO: 148421 - protein, 110 aa, Glycine max
  Coding DNA Sequence Number=SeqID_56736
  Subcellular localization annotation: CTP_CleavageSite=20; ConfidenceScore=5.51e-01
MSFGKNQLYIFSFFRRAGKSSAAKWQAAKATNVAVPSSSSRVFPFRAWQTPWIKISNGCSIACPPHSTPTPRFAVSRKLPSIKPLANQVSFFTSVLFGENLIECGFLSVM

SEQ ID NO: 148422 - protein, 317 aa, Glycine max
  Coding DNA Sequence Number=SeqID_56737
  Gene Ontology: Mol. function=hydrolase activity; Cellular component =cytoplasm
  Homolog annotation: Hit_ID=A7P2Y6; Match level="QueryCoverage=53%, HitCoverage=58%, E-value=1e-45, Identity=58%"; Hit description =Chromosome chr1 scaffold_5, whole genome shotgun sequence
  Subcellular localization annotation: CTP_CleavageSite=75; ConfidenceScore=5.46e-01
MAIIHYSAASRCCMPSLHRASPSRSVLAPSIFFFRDAAPTLRLDVSVRSQPPGSDGFGEPINNKHASRDASVGLSASSSSSVIDFLTLCHRLKGMHGSVDEETTGVSQLTELETNPARVPSGYRIIAEECTLGTLFIDIVLISMCLRGLITKRKGWVNHGIKGAESIADHMYRMALMALIAGDVPGLNRERSVRHFFVCEICNFVLSLDGISKSIVGDITPSDGVPKAEKSRMELEALNKMCELLGGGMRAEEIKELWEEYENNSSVEANLVKDFDKVMDYFCSSRIVSFREVDIGSRKGDVLVVFIHFLLRGGSGK

SEQ ID NO: 148423 - protein, 95 aa, Glycine max
  Coding DNA Sequence Number=SeqID_56738
  Gene Ontology: Cellular component=endoplasmic reticulum membrane; Biological process=lipid biosynthetic process
  Homolog annotation: Hit_ID=A7PND6; Match level="QueryCoverage=66%, HitCoverage=20%, E-value=4e-25, Identity=74%"; Hit description =Chromosome chr1 scaffold_22, whole genome shotgun sequence
MDFQTHERKKKIRKFKESAWKCVYFLSAEIFALAATYDEPWFTDTRYFWVGPGNQIWPDQKIKEERILEAIEVSIEVTRRKRRKGAGGSFILIPY

SEQ ID NO: 148424 - protein, 260 aa, Glycine max
  Coding DNA Sequence Number=SeqID_56739
MVQVFLQGGVVDEYIVEEDCNKAVEEGAKGSFVDVVGRHGNLMEALMENAVVGGPLVPERGEHIGGGGADAGKRETSVVSWTGEPNNVKDIVREGKPSSIRECRHHQPLLEEDQCLWRAMRGIPYVQKVAGAGMPARALRINWGVSGKGVEGSLLSRRDKGSVGGVVLSSEMTSCKRGRETGGATAIMELILLKFSESNSLRQRNLLQRLDLAAELGVQARNEIAQKEGMREPDGTVGQALKVREVIIDGTSLLELEQGA

SEQ ID NO: 148425 - protein, 84 aa, Glycine max
  Coding DNA Sequence Number=SeqID_56740
MATIRSRFGRISEVNDQFGNITFKFELEVNKDSIKGCGIDRKKDVREEEARRTYTRKKQECPTGMRANSRCEILSMHPMNTQGH

SEQ ID NO: 148426 - protein, 111 aa, Glycine max
  Coding DNA Sequence Number=SeqID_56741
MGEGIDLGRECSRKPTTPTKTANENSPFLVMIYQSVTHSEEHGNGENGDKSVEQRLGLDLAFFIGRALPFRRIQICATFPRCHGKMGHPKTMELINGNRQLSLSLENFTAN

SEQ ID NO: 148427 - protein, 86 aa, Glycine max
  Coding DNA Sequence Number=SeqID_56742
  Homolog annotation: Hit_ID=Q2HS44; Match level="QueryCoverage=95%, HitCoverage=36%, E-value=2e-08, Identity=37%"; Hit description =Hemopexin
MIEDMELLMECWTFFPDATLTNHMALKSDHSPIHVNVYGFVNKRFRFENMRLAEADLEKVVHGGCTRELNGPLPDKLKACADDLEC

SEQ ID NO: 148428 - protein, 108 aa, Glycine max
  Coding DNA Sequence Number=SeqID_56743
MLQPYGINIGLKEHSNRVTPKAYTPKSPSGPLPPDSVYLVALKGLSINSSSLKGLSINLSPLKGLSINSSPLKGFSINSSPLKGVSINSSPLKGVSINSSPLNGLIVV

SEQ ID NO: 148429 - protein, 126 aa, Glycine max
  Coding DNA Sequence Number=SeqID_56744
MLILIISIVRSSSLYTARSTSARHLTAIVERVTNYNKLISTCLIATHLHVLLVGLQQMDRLLVDIISQITGFSYCASRPRRGDSRKTTFIVVKGGMDAVGANNTCVIQKIAKFVSFSSFLVAQARN

SEQ ID NO: 148430 - protein, 429 aa, Glycine max
  Coding DNA Sequence Number=SeqID_56745
  Gene Ontology: Mol. function=lyase activity
  Homolog annotation: Hit_ID=Q2HRF2; Match level="QueryCoverage=96%, HitCoverage=96%, E-value=5e-64, Identity=38%"; Hit description =Cyclin-like F-box; FBD
  Pfam annotation: Domain name=F-box; Domain location=15-62; Score =33.1; E_value=1e-06; Accession=PF00646.24; Description=F-box domain
  Pfam annotation: Domain name=FBD; Domain location=339-389; Score =20.5; E_value=0.0018; Accession=PF08387.1; Description=FBD
  Pfam annotation: Domain name=LRR_1; Domain location=144-164; Score =4.1; E_value=53; Accession=PF00560.24; Description=Leucine Rich Repeat
  Pfam annotation: Domain name=LRR_1; Domain location=190-212; Score =7.1; E_value=15; Accession=PF00560.24; Description=Leucine Rich Repeat
  Pfam annotation: Domain name=LRR_1; Domain location=321-344; Score =7.7; E_value=11; Accession=PF00560.24; Description=Leucine Rich Repeat
  Pfam module annotation: Pfam domain module=F-box::FBD::LRR_1::LRR _1::LRR_1; Domain location=15-62::339-389::144-164::190-212::321-344
MTARFHKIVVADPMDRISDLPSHLIDFILQRLQLQDVVRTSLLSSKWRYKWTSVPKLDFSNDFFQKCRDLELHEVSSTITEILLIHDGPLDEFVLCIPENVPIKIESLNKWILCLSRKGIKELELWNLQTDPCETPSHIFSCQGLTYLQLQNFKLSTVPNFSSFKSLVYLILVDIIFESSAIDLMFGCPSLEMLSISYCSGFECINVSSPALEVLHVQGEQVIKSIYLEKAKRMTDVSLMADNPGDNFDMDTISNLIKGLSEVESMCFTEGYIQIFSTAYTLPKSLQKPLNCLESLELEGVNFDDTTELLFVISLLKSSPNLEKLFIQGNYIAGVDLPQILEKSKYNGCCLSHLLTVHIKAYKPCENTMNFIRFLLANSTSLELLTFYIVPAHDHQQHQYSISSVGRELKQMARASKSAVVEFIDLSFD

SEQ ID NO: 148431 - protein, 78 aa, Glycine max
  Coding DNA Sequence Number=SeqID_56746
MMVTITMTTTTIDDGSGDGENHGDECNDSHGGDSDDDESHDGRAVDDSDDGGDDYSGGCSGAHGGDNDNHDDELIEIF

SEQ ID NO: 148432 - protein, 77 aa, Glycine max
  Coding DNA Sequence Number=SeqID_56747
MDIEYVIGKKEPPAITDESSPIMLYERMKRSKDFLKAIDDQFITSDKAFQPEEKHEECQGTIRDAAIATGTHVSPLR

SEQ ID NO: 148433 - protein, 142 aa, Glycine max
  Coding DNA Sequence Number=SeqID_56748
  Subcellular localization annotation: CTP_CleavageSite=54; ConfidenceScore=5.29e-01
MVVTTGNKKNFKRSRGLAWTLVLSNIIKVSHFKPLFTSPASIHVRPRSPSLLCRCRALQLIIKLRKHTLPSTPILLPTGVRLDHEGPNLASGKSTLLPMSNSRYRSTLLSDHGDFLRGVTDQQKKGASGKWGAMLGREGGVG

SEQ ID NO: 148434 - protein, 96 aa, Glycine max
  Coding DNA Sequence Number=SeqID_56749
  Subcellular localization annotation: CTP_CleavageSite=36; ConfidenceScore=5.06e-01
MSANSAQGCLPRQCRRAEAATPPSTWLGWSTPTAARSMMTKKTKMKNECAAAKARKKMNEGQEEEERGREETNEEEAKMERKKQEHGIGRERKENE

SEQ ID NO: 148435 - protein, 592 aa, Glycine max
  Coding DNA Sequence Number=SeqID_56750
  Gene Ontology: Mol. function=phosphoenolpyruvate carboxylase activity; Cellular component=cytoplasm; Biological process=carbon utilization by fixation of carbon dioxide
  Homolog annotation: Hit_ID=A6YM33; Match level="QueryCoverage=76%, HitCoverage=43%, E-value=0.0, Identity=86%"; Hit description =Phosphoenolpyruvate carboxylase
  Pfam annotation: Domain name=Chromo; Domain location=86-136; Score =21.6; E_value=0.0011; Accession=PF00385.15; Description='chromo' (CHRromatin Organisation MOdi
  Pfam annotation: Domain name=PEPcase; Domain location=1-592; Score =22.0; E_value=0.0022; Accession=PF00311.8; Description =Phosphoenolpyruvate carboxylase
  Pfam module annotation: Pfam domain module=Chromo::PEPcase; Domain location=86-136::1-592
MDGQTKVLNRVHEYGAPPSGTGFSPFVVIYGKPLSSIPHYLQGSPPVEASDTLFPPEPPFMRHYNGPLASQPAHLPPTNVDHHPVVEPLSVLDWKWDNSVSPPTKLVLVQWSGLAPEDTTWESYDALHESYNLVDKVILPGEGDVAPDVREVLDTFRTAAELGSDSFGAYVISMASNASDVLAVELLQKDARLAVSGELGRACPGGTLRVVPLFETVKDLRGAGSVIRKLLSIDWYRQHIIKNHNGHQEVMVGYSDSGKDAGRFTAAWELYKAQEDVVAACNEYDIKVTLFHGRGGSIGRGGGPTYMAIQSQPPGSVMGTLRSTEQGEMVQAKFGLPQTAVRQLEIYTTAVLLATLRPPQPPREEKWRNLMEDISKISCQCYRNVVYENPEFLSYFQEATPQSELGFLNIGSRPTRRKSSTGIGHLRAIPWVFAWTQTRFVLPAWLGVGAGLKDACEKGQTEELKAMYREWPFFQSTIDLIEMVLGKADIPIAKHYDEVLVSQKRQELGKQLRNELISTGKFVLAVSGQEKPQQNNRSLRKLIESRLPFLNPMNMLQVEILKRLRCDDDNLKARDALLITINGIAAGMRNTG

SEQ ID NO: 148436 - protein, 678 aa, Glycine max
  Coding DNA Sequence Number=SeqID_56751
MELLQQQCGKDRVCRKPDFALMKNKIPLNGKLRSINPSQFSESLSNVAIFCFSTRPGSIDQNVIEEHSDELLEKGLQSVIRCGLKSGQCIAGCHSLWPEKWNWPRLLDDGLEVSDLLDVGQLGEAFEDDPYPAFFYIGHTVNIKGPLVWGGFVISDEFCQKVNHELCLHGTTWLSQNLLDGVVHLDYHLMTLEVGPKSLGRGSSFFPFSCTRTELMASLAIERYRSTSAPSTGQLKTGGVAMVFLKVRKACSQAVHLQYGNAFVGVCFNPPMCDHEAEELVTAYPEITFYRIEAHVDAFRSSCIQSRRLGSLALGTRPFYRLLSMLDRGIELQLDKLFNGFQASVGGVISRIYVKFTAQAGMVDGQGSDLSYVHCHDLWSLVHVTSGLDSLACKAEEWTGVRVDNVSGTTLDEKDPGHHEIRYDDGDNHRVFLVDGIDAPEVPVRKGLAGLSAIGKAASNGINYTSDVLGRCPSSLAPTWWLFGLLTNWAKYPTYGYLQVKGFLENRGTIGHQGCVMLIPGSYGERQTLVWLVPLVRLVQVSHGACFALAVVMSGLTDFISEFRHFFIPLGSFAQLVHAPGPASGVLRTKSFDDGVEAVYGPWFTCVRKASKCSSESVFPSYRSRLSGFHPKDMSASIMRSTKGCRWTVRAAGCVGDVIPLGCIQARWGRIACRSKDV

SEQ ID NO: 148437 - protein, 120 aa, Glycine max
  Coding DNA Sequence Number=SeqID_56752
  Gene Ontology: Mol. function=phosphoenolpyruvate carboxylase activity; Cellular component=cytoplasm; Biological process=carbon utilization by fixation of carbon dioxide
  Homolog annotation: Hit_ID=A6YM33; Match level="QueryCoverage=42%, HitCoverage=4%, E-value=2e-15, Identity=76%"; Hit description =Phosphoenolpyruvate carboxylase
  Subcellular localization annotation: CTP_CleavageSite=62; ConfidenceScore=5.36e-01
EGGSEYPRHVPGADHKQPNHKGGETSSSTESNGGSQNVRSSIPISPNSSSSLVSMTRSPSFNSSQLVAQRKLFAESQIGRTSFKRLLEPKVPQVPGIAPYRVVLGYIKDKACTKCVLCRL

SEQ ID NO: 148438 - protein, 109 aa, Glycine max
  Coding DNA Sequence Number=SeqID_56753
  Subcellular localization annotation: CTP_CleavageSite=38; ConfidenceScore=5.53e-01
MAFLFRNSFLLHFQKAFFSFSTFSYGIVSAVKVKFPVSSFAVVGDSKQESCGANEPHVDCSDAFKTSQVFECREDVLRWARSVAHENGFVAVILRSDTNTGSRGRSTLC

SEQ ID NO: 148439 - protein, 132 aa, Glycine max
  Coding DNA Sequence Number=SeqID_56754
  Subcellular localization annotation: CTP_CleavageSite=37; ConfidenceScore=5.64e-01
FVTAPLSSSSISPPTTSQALPPVVFNTCTSLQSFDISSNLFVDVLPMDILTQMKSLNELAMALNWHPLVPKFPTPRVEEEELELGSSTARRSQRHEGHKPVKFSCGYGGGCNMVGVGEAAAATETAVPEKVK

SEQ ID NO: 148440 - protein, 99 aa, Glycine max
  Coding DNA Sequence Number=SeqID_56755
QVIEVSSSEEDPEEDPEELPPEPVMDALDFPKDDEDPLPEVDSPEDIMSASEADSTEESGPGGTANRLLQVEATTRLGELQINYVPLFPINRREGAEGK

SEQ ID NO: 148441 - protein, 116 aa, Glycine max
  Coding DNA Sequence Number=SeqID_56756
MGKLDHLEERLRAIEGGEDYAFANLEELFLIPKHGHSQVQGAGLWQVQGDYSLQESSKDEPSRVHSWKDLMVAVVRQYQYNFDMVLDRMQLRNMCKKGDGSFKEHAQKVEGSGGSG

SEQ ID NO: 148442 - protein, 72 aa, Glycine max
  Coding DNA Sequence Number=SeqID_56757
  Gene Ontology: Mol. function=serine-type D-Ala-D-Ala carboxypeptidase activity; Cellular component=plasma membrane; Biological process=cell wall organization and biogenesis
  Homolog annotation: Hit_ID=P08506; Match level="QueryCoverage=54%, HitCoverage=9%, E-value=2e-14, Identity=100%"; Hit description=D -alanyl-D-alanine carboxypeptidase dacC precursor
MTSLRSLAAGSALLFLFAPTLYAAEQAAPEAPPVDARAWILMDYASGKVLAEGNADEKLDPASLTKIMTSYV

SEQ ID NO: 148443 - protein, 158 aa, Glycine max
  Coding DNA Sequence Number=SeqID_56758
MASGNRLPRVCNRLQGLEMVIDYRALEMVSMCRSCVTRVWALIAMAAQLIHDRVVMECLEGVWETLEGNERCRFRGTIRLTATSLVHPKEPAHTLQQTVEWVLPTPTPELVQVIEVSSSEEDPEEDLEELPLELAVDALDFPEDDEDPLPDVDSPEDI

SEQ ID NO: 148444 - protein, 269 aa, Glycine max
  Coding DNA Sequence Number=SeqID_56759
  Gene Ontology: Biological process=transposition, DNA-mediated
  Homolog annotation: Hit_ID=Q6UUU1; Match level="QueryCoverage=22%, HitCoverage=40%, E-value=3e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPVTTLANWSSTAVAAALELVDPPGCRNSMFDSYKIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 148445 - protein, 246 aa, Glycine max
  Coding DNA Sequence Number=SeqID_56760
  Gene Ontology: Biological process=transposition, DNA-mediated
  Homolog annotation: Hit_ID=Q6UUU1; Match level="QueryCoverage=24%, HitCoverage=40%, E-value=3e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPVTTLIPIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 148446 - protein, 125 aa, Glycine max
  Coding DNA Sequence Number=SeqID_56761
  Homolog annotation: Hit_ID=A5BKB9; Match level="QueryCoverage=64%, HitCoverage=9%, E-value=4e-10, Identity=35%"; Hit description =Putative uncharacterized protein
  Pfam annotation: Domain name=RVT_2; Domain location=36-125; Score= -194.9; E_value=0.089; Accession=PF07727.5; Description=Reverse transcriptase (RNA-dependent DNA pol
MSYKKHCKVLGNDEISGSTVLSRKWKFKEVRRWLNAMKEEIDSMEHNGVWDLVELPKGCKRVGCSIMTLELHHRCENRLSEQRFRGECLSKLEMGFSVEGNEHMVCILKKSVDTVLNEKMEIKRS

SEQ ID NO: 148447 - protein, 107 aa, Glycine max
  Coding DNA Sequence Number=SeqID_56762
MRRPRLFRFSRRFPQINVGGDSARIPFLEHRTRESRVALLPKEYISESEVEKGEKSEDDEEEVEKTPEGELLMIRRLLGVIPNFVWGPLLDDMQLLFDPYKVLGTHH

SEQ ID NO: 148448 - protein, 44 aa, Glycine max
  Coding DNA Sequence Number=SeqID_56763
MGEEEKKPKENKVKEKKANEEEKKEEKKPEESKDDKESKEESAP

SEQ ID NO: 148449 - protein, 98 aa, Glycine max
  Coding DNA Sequence Number=SeqID_56764
MHEMAPRKLASKRSRKDKAAEGTSSAPEYDSHRFKSAVHQQRFEAIKGWSFLRERRVQLRDDEYTDFQEEIGRRWWASLVTPMAKLWDPLESTCRHAS

SEQ ID NO: 148450 - protein, 196 aa, Glycine max
  Coding DNA Sequence Number=SeqID_56765
MVKVGTFLRADQSFIPEESSHGSQSSIASSSNQIKLIFEYPSPQVFGQRPSWRIMVSISCPSCSATDGIVVSASQFGTQAYRRNISAGKWLRPFAIRETCRQLLRSANPGDRVRAFVLPAALKGGCVHTGDYYVGLITPGCSVECVRGEKKRRLSRICDTTHIRANSSELLPLGLDAATEALELVGNSPGKLQELI

SEQ ID NO: 148451 - protein, 273 aa, Glycine max
  Coding DNA Sequence Number=SeqID_56766
  Gene Ontology: Biological process=transposition, DNA-mediated
  Homolog annotation: Hit_ID=Q6UUU1; Match level="QueryCoverage=21%, HitCoverage=40%, E-value=4e-18, Identity=78%"; Hit description =Putative uncharacterized protein
MVKVGTSYVPINVSFFAKSWPRASRYQQGHQDLFILRSDLPSQWLLFLSAVPPVQLLTGWCVTAKAPPDISAGKCSGHAARRVPFAIQAAQLLGRAIGAGLFAITPAGERGMCCKAIKLGNARVFPDGQPIDYQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 148452 - protein, 110 aa, Glycine max
  Coding DNA Sequence Number=SeqID_56767
MDPSSRSGTVSRTLSDVRKKAQAIQKQNTAPHKLLAEKTKKKLEEAAQSGSVDGVIDPPSPVRCHVKWKMARTKKTGEMTTETAKEIAKKINAMYHCVFSVLDSFEEQAT

SEQ ID NO: 148453 - protein, 165 aa, Glycine max
  Coding DNA Sequence Number=SeqID_56768
MELAWDGAKFGLPNASNGFFITHADVTEIILGDKCLNISVLQLWMMFMNDWSTSIGFSPVYGFLEPQSIRCTKDTCEECQKAHWQLLVLCPRENIIVWFCSVRRKPDVHIKFAVNNAMKKICSNLQGKDNAPPPPPQWIEAKHLLSAYIACRAMYNKEHMSLDIM

SEQ ID NO: 148454 - protein, 118 aa, Glycine max
  Coding DNA Sequence Number=SeqID_56769
MSGFTRNSPQISASPHQLDLAPYASEPYHAQWNAPGLLRDKHTLRSSCILGEMEVNEPWLGLWLPLNYQVDMGASQHMTTEFGVNPTGFLLQNSFLLVFLVCAKGGVRHWKCGRQTLW

SEQ ID NO: 148455 - protein, 46 aa, Glycine max
  Coding DNA Sequence Number=SeqID_56770
MELTQVADKSCLVQEKKRNWKGGLVPYLEEFESRRKGPTTLRAIED

SEQ ID NO: 148456 - protein, 79 aa, Glycine max
  Coding DNA Sequence Number=SeqID_56771
IPLVKRAFSGGALVLTNMDGEELPSPGQDHLELPSGVGTKRGQQKPIKERMQVGMGSRPTDRCPFYALDKQRTSLQGSP

SEQ ID NO: 148457 - protein, 193 aa, Glycine max
  Coding DNA Sequence Number=SeqID_56772
MFNYHENGKAPDLESVLADFMTYQASSKEWQPYYHNEAEGLSNLDDLLMQFKGTVDSMQQAFKRAETQIGKLVDDMIKLWSEEKKSMQRLKPIKKAFFNVEDQKISFDLFEAMKHTDISDACFEEEEVEQEIELSASTMVLQFPLEKDPNYVIDCLVCDEELDDPKDNPIGHDNETKPVIISSSLLKEEDDQL

SEQ ID NO: 148458 - protein, 123 aa, Glycine max
  Coding DNA Sequence Number=SeqID_56773
  Homolog annotation: Hit_ID=A0PAV3; Match level="QueryCoverage=30%, HitCoverage=17%, E-value=5e-07, Identity=76%"; Hit description =Restriction endonuclease
MVKVGTSYVPINVSFSPKVGPGLPGINRDTRIYLFCEVIFRHSCPPVQLLTGWCVTAKAPPDISGGKCSGHAAWRVPFAIQAAQLLGRAIGAGLFAITPAGERGMCCKAIKLGNARVFPVTTL

SEQ ID NO: 148459 - protein, 77 aa, Glycine max
  Coding DNA Sequence Number=SeqID_56774
  Homolog annotation: Hit_ID=A0ST23; Match level="QueryCoverage=32%, HitCoverage=51%, E-value=3e-07, Identity=100%"; Hit description =Putative reverse transcriptase
MAYTRTQLKTTYKGCIWLLFPLVRVNFELGVIMVIAVSFGKPVVPAALMNRPTRGERRFAYWALAECILAYYVGTDE

SEQ ID NO: 148460 - protein, 58 aa, Glycine max
  Coding DNA Sequence Number=SeqID_56775
  Subcellular localization annotation: CTP_CleavageSite=49; ConfidenceScore=5.01e-01
MGVQITPRPTWALQNIPPEGSEALPKRFRNVFREEFRKGFNRSSTFFIRSSSFFDLQR

SEQ ID NO: 148461 - protein, 51 aa, Glycine max
  Coding DNA Sequence Number=SeqID_56776
MDKFDIFVPHPLTNTSLLIQLPPECEYKPLRLLVLHVGGGCRKTTSKVQNK

SEQ ID NO: 148462 - protein, 181 aa, Glycine max
  Coding DNA Sequence Number=SeqID_56777
MSVLELYIEKDVAGGSMFHSANSLTSCGNYVSNDYTQPSTNMSNLNLDEDDDHDDDDYLVSNSYVEESLDEDDSVDGISDTDNEVPDMIPPVRIVHPVEGVQAIENPFWNDALHYNNINWSHPDEEDICGLEMPSTFNVGQELYVGMEFDSKDAVKNAVKQYVMRVHQSFKVVESKWDKYV

SEQ ID NO: 148463 - protein, 140 aa, Glycine max
  Coding DNA Sequence Number=SeqID_56778
  Homolog annotation: Hit_ID=Q2HW90; Match level="QueryCoverage=80%, HitCoverage=23%, E-value=2e-07, Identity=28%"; Hit description =Putative uncharacterized protein
MGSSQTPSLKKRFYQVKVKSLGITSLKELRQLMGRLQRQAFRKAYGKIWDLAMVEVSIEAIASLVQCYDKLLRCFIFGDFQLSPMVEEFEEILGCPLGGRRPYLFSGFYPSLARISKIVQISAQELAHRKQVEANEPRSP

SEQ ID NO: 148464 - protein, 47 aa, Glycine max
  Coding DNA Sequence Number=SeqID_56779
AEVAWSGDWPEAQAAEAPAEAPNKADDAHEDEEMTDFLDFLGGSGAT

SEQ ID NO: 148465 - protein, 71 aa, Glycine max
  Coding DNA Sequence Number=SeqID_56780
  Subcellular localization annotation: CTP_CleavageSite=19; ConfidenceScore=5.04e-01
MPKGGSTHLRLQVVPSVARLMKQANVFPLKKTLKKFIICVSQPTLRREGDARLAGASSKKGIRAESPPTFI

SEQ ID NO: 148466 - protein, 122 aa, Glycine max
  Coding DNA Sequence Number=SeqID_56781
CAGLREESAATAKALEKETKRARREEHGRDKFRGALWGSNSELKLRREERDRSRAHNMVLKEELVVCSRSKRNLSQRLCETETNMLAIITKYQEELSLATAHEHRVADEFAQVYAEERLEEG

SEQ ID NO: 148467 - protein, 67 aa, Glycine max
  Coding DNA Sequence Number=SeqID_56782
MVFSDFLRTKLDLRKEGGGCRPARPGEQGCFHQKAPPSVGTPWKAQVGSVAICTPFFTKYTPFVFFC

SEQ ID NO: 148468 - protein, 146 aa, Glycine max
  Coding DNA Sequence Number=SeqID_56783
  Pfam annotation: Domain name=Transposase_23; Domain location=23-93; Score=3.6; E_value=0.00048; Accession=PF03017.5; Description =TNP1ENSPM transposase
MLPLIRNPDSWSCVDPSGNDLETGDSDRCGLYIEADPARLVAVGRVYEGSTLVHNTPLLPGQVKVSVDEVKDAYAAVPVPTVEVSLVGQTLHTFLAWLTHLIKSLSNQVAVSPPKPPPKPDPEVDDPLYLMTLTIPKLFLRPYQVR

SEQ ID NO: 148469 - protein, 147 aa, Glycine max
  Coding DNA Sequence Number=SeqID_56784
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=35%, HitCoverage=50%, E-value=4e-24, Identity=100%"; Hit description=LacZ protein
  Subcellular localization annotation: CTP_CleavageSite=41; ConfidenceScore=5.01e-01
MARRFASWVRACRPCWTRRRPSRSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 148470 - protein, 167 aa, Glycine max
  Coding DNA Sequence Number=SeqID_56785
ELCTHKRKFKGNERISMGRNVLALIGKSVPHIPEKCKDPDVVIHMRGQDIYSSQDEATTSPSSNENEEAIGEESREEIYPQEEGQPLMVKEECKETLVSTATPLGLEVIPQVKELLDEGLVRKSLNPCALLVPKIGVKGRSPEYEEPRDLRSNPFQGGGDDAILPRK

SEQ ID NO: 148471 - protein, 115 aa, Glycine max
  Coding DNA Sequence Number=SeqID_56786
MGAYSADEKLLVHFFQDSLAGAAVAWYTNLEASQIRSKTLEDLATADFIWRTSTIRWILTVVISLGIQLQSRLKESSPLGIPKDGEHSIAQVIPPMMKRARDHNWDTLPTFYYKS

SEQ ID NO: 148472 - protein, 90 aa, Glycine max
  Coding DNA Sequence Number=SeqID_56787
MGETHEVPRDHTLVNLEPHLGYVSEGQAFGGIPLSNTLGGPQYCPQPLPLHFALERLPPAMVEREKFDHIEERMRAMFNDRQVHRIAQVV

SEQ ID NO: 148473 - protein, 180 aa, Glycine max
  Coding DNA Sequence Number=SeqID_56788
  Gene Ontology: Cellular component=mitochondrion
  Homolog annotation: Hit_ID=A6H5B3; Match level="QueryCoverage=37%, HitCoverage=84%, E-value=1e-27, Identity=88%"; Hit description =Putative ribosomal protein S3
MSAVRVRLSPTPPLGWHSLKVKGEVQTKKGLWWIPRHPETRKGVVSDEMLRGVENKRRSGDSRYRSTFRTAAESTGRQETTCLNRENGVVGELYKCRAARRSSRECCTLDGESPVAESITSLRSDPSSMGHVESRVNQQGPPCKAKYSWVTDSEVVPETTGAVAKASLHRAIVTAYGPEP

SEQ ID NO: 148474 - protein, 268 aa, Glycine max
  Coding DNA Sequence Number=SeqID_56789
MRGTVHEPQANLRADQKFLTSHVQSFECGMIGPLDESISYKGGPLGTSTYRLQRTTRPRLQRVACPCLQRNTRPYLQRVTGPRLQRTIRPPLQRTTRPRLQRTTRPRLQRTTRPRLQRATRLLLQRTTCPHHQRTTHPCHQRATRHHLQRTTRPRLERVARPRLQKDTRPRLQRTAHPRLQRATCPRLQRTACPRLQRAARPRLQRATRPPLRRATRPHIQRATRTRLQRATRSHLQRTTRPRHQRAARPSLQRTARPLPLRTTRPRL

SEQ ID NO: 148475 - protein, 361 aa, Glycine max
  Coding DNA Sequence Number=SeqID_56790
  Gene Ontology: Mol. function=zinc ion binding
  Homolog annotation: Hit_ID=A5C6C9; Match level="QueryCoverage=58%, HitCoverage=18%, E-value=6e-30, Identity=35%"; Hit description =Serine/threonine protein phosphatase
  Pfam annotation: Domain name=DUF1723; Domain location=202-251; Score =55.8; E_value=1.5e-13; Accession=PF08330.1; Description=Protein of unknown function (DUF1723)
MEEGASPPRGALDKKLGEDASMEEKKEGEKERGGSTKLKEEKGREVGLPLDLWPNLLRVFYPMPLRGKIASASARRQWVPVTVANDEPVVPADLPVVVAADPMVAADEPMVDADVQDTVADTGAKVAADESERFPSGPTDPSVLTKYAEHVAASVWTGKEHPELKLASHGRKVQKLGRIVPAIEGLVAGTGLSPLIACSVDIDDRGLISSFVERWHRETSSFHLPMGEVTITLDDMASLLHLPIIGDFKTFQPLHVDEAVLMLVDLLLARHWTAAARAYLLHLLGCTFFANKNATHVHVVFIDALHDLSQTRRYAWGVAALVHMYDHLNDACISTSRQLAGYITLLQCNADPDYDEVSSRA

SEQ ID NO: 148476 - protein, 58 aa, Glycine max
  Coding DNA Sequence Number=SeqID_56791
EDCHAIAERLERHLNLGIVTPGTSTHEVIEQCLRIAKGVTEDRIVYVRSRHRRRTDQP

SEQ ID NO: 148477 - protein, 328 aa, Glycine max
  Coding DNA Sequence Number=SeqID_56792
  Gene Ontology: Mol. function=motor activity; Cellular component=cell projection
  Homolog annotation: Hit_ID=UPI00016621D1; Match level="QueryCoverage =75%, HitCoverage=41%, E-value=6e-16, Identity=29%"; Hit description =UPI00016621D1 related cluster
LHVLAIRGLHVLAFGGLHILTIEGLHVLALRGLQVLTFRGLHSLAIKGLRVLVFRGLRALAFVGLHVLNFRGLHVLAFRGLHTLAIRPLHVLTFTGLYVVAFRELQVLAFGGLDAIAVRGQHVLAFRGQHVLTFRGIHILTFRGLHVLAFSGLHVVTFKGLHDWTSSPSKGYTSSPSDDFTSSPLEGCTPSSSEDYTGLHSLTIIGLDVLPFEGLHVLNFRGLHVLTFGGLHVLSFRGLHVLAFRGQHFLAFRGLHPLAFRGLHVLAFRGLHVLTLGGVHVLAFRALHVHTFRGLHALAMRGLGVLAFRGLRALAFVGLHVLNFRGLH

SEQ ID NO: 148478 - protein, 219 aa, Glycine max
  Coding DNA Sequence Number=SeqID_56793
  Gene Ontology: Mol. function=calcium ion binding
  Homolog annotation: Hit_ID=UPI00016621D1; Match level="QueryCoverage =96%, HitCoverage=40%, E-value=1e-15, Identity=30%"; Hit description =UPI00016621D1 related cluster
GLHLVTIIGLHALTFKGLHVLTFGGLHALTFRGLRALAIRGLLVLAFSGLHALAIRGLGVLAFKGQHALALRGLHILAFRGLHALAFTGLHVLAFRGMHALAVGGLHVLTFRGLHVLTFRGLHALAFKGLHALAFKGLHVLAFRGLHVLTFKGLHVLTFRGLHALAFRGLDVLSFRGLHALALRGQLILAFSGLHTLAFRGLLVLAFRVLHALAFGGLH

SEQ ID NO: 148479 - protein, 181 aa, Glycine max
  Coding DNA Sequence Number=SeqID_56794
MASLKKRFYQVKIKSLGITNLKELGQLMGQLQWQAFRKAYGKIWDLAMVEVSTEAIASLAQYYDQPLRCFTFGDFQLSPMNFQDSPNLGAGIRPQEASRKWGGEWALFIDILALLIFGGVLFPNVDGLVDLAAIDAFLAYHDHKESPVVAMLADLYDTFDRRCPLMVIFHNGDAAEDKAEE

SEQ ID NO: 148480 - protein, 53 aa, Glycine max
  Coding DNA Sequence Number=SeqID_56795
MKHSSKLEGGGHMNTLGNYIHGAPKKVDNGGLHLKAIMKHSSKLEGGGHMNKR

SEQ ID NO: 148481 - protein, 237 aa, Glycine max
  Coding DNA Sequence Number=SeqID_56796
  Gene Ontology: Mol. function=transferase activity; Cellular component= integral to membrane; Biological process=lipopolysaccharide core region biosynthetic process
  Homolog annotation: Hit_ID=A8AR47; Match level="QueryCoverage=100%, HitCoverage=42%, E-value=1e-118, Identity=86%"; Hit description =Putative uncharacterized protein
MMPRVLARLQPFGLPCIVVDDGSDSSTRQQLERLAAETANLTLIRLPQNAGKGAAVIRGLQAAAQAGFSHTVQVDADGQHAIEDIPQLLALAQAHPEALISGQPIYDDSIPRSRLYGRWITHVWVWIETLSLQLKDSMCGFRVYPVTPTLQLAQRVSLGQRMDFDTEVMVRLYWQGNTSYFAPTRVTYPPDGLSHFDAIKDNCRISLMHTRLFLGMLPRIPSLLFRRASPHWARQQE

SEQ ID NO: 148482 - protein, 85 aa, Glycine max
  Coding DNA Sequence Number=SeqID_56797
MMIGCGITWMLWKLGRIDGDPALRGTRIRATWEYVSSVGGGQQGMVEWYLEICRGGQETLGTSGGVLLPKTKLDQSRPNPGVVSQ

SEQ ID NO: 148483 - protein, 73 aa, Glycine max
  Coding DNA Sequence Number=SeqID_56798
VFTRLKEISRTAGCLGTGGRHGQLRCTSLYKGYPKEQLPCISAALSKVSQKLQISHWHPFAAFVNKHHASYES

SEQ ID NO: 148484 - protein, 122 aa, Glycine max
  Coding DNA Sequence Number=SeqID_56799
MVKVGTSYVPINVSFSPKVGPGLPGSKDTRIYLFCEVIFRHSCPPVREIGVYPLTIGNKHQPDISAQVAARFPFGKPCRCQLIKGRPRDRGEAFRIGRKAECIRLNVGTDEGVSEVLSMWQE

SEQ ID NO: 148485 - protein, 107 aa, Glycine max
  Coding DNA Sequence Number=SeqID_56800
  Homolog annotation: Hit_ID=A5C6P3; Match level="QueryCoverage=52%, HitCoverage=4%, E-value=2e-07, Identity=44%"; Hit description =Putative uncharacterized protein
DMNQQKIGTVEMVERLYRLEMILIKSKYKSDFAANRKKLDPKAVTSVFLSFKLNTKGFIMFDLKTKAISAFRNVIFYKDFFPFIGQDKPDVVIVLPIPSSHAIDQPD

SEQ ID NO: 148486 - protein, 158 aa, Glycine max
  Coding DNA Sequence Number=SeqID_56801
GTLIAPQRLFAEVGEGIGNEGLTIHLFDIRHLELSLLFSTEELLSVIGKSYRRTSALASVKRCTPTRAIECGPLRIAGERAECILQAYYVGCNARVFPSEVLHVAGKKGCTVPAEYVNTDSLFRRIPRSLTPTARSFMRRRKAYELGRNSRSCRNYDE

SEQ ID NO: 148487 - protein, 46 aa, Glycine max
  Coding DNA Sequence Number=SeqID_56802
MQKEKEKAKTLKACSHFGEENTETIFSLTVVKNYVGLSSSSQIEDT

SEQ ID NO: 148488 - protein, 58 aa, Glycine max
  Coding DNA Sequence Number=SeqID_56803
MGTLHDFGPKEDWGTFSVGALHSNCFVDVASHLFGWYCGVVRSGATHLFPCCRVAPTR

SEQ ID NO: 148489 - protein, 181 aa, Glycine max
  Coding DNA Sequence Number=SeqID_56804
  Homolog annotation: Hit_ID=A7QG40; Match level="QueryCoverage=33%, HitCoverage=10%, E-value=2e-17, Identity=68%"; Hit description =Chromosome undetermined scaffold_91, whole genome shotgun sequence
MKHFTDTLISANIGTKAGTGPPLEVDGIDKLDISLTSASASNRRPAGNSPQNTTALGVNQDASSSNPSTPAPWGSPLEGFKGREGSVLPSDDIEFLQPGGSTSSRAAATAVELQFALYWRNSEEARTDRPSQQLRSLNGEWDAPCSGALSAAGVVVTRSVTATLASADVRRCFCRYAPPRQ

SEQ ID NO: 148490 - protein, 68 aa, Glycine max
  Coding DNA Sequence Number=SeqID_56805
  Subcellular localization annotation: CTP_CleavageSite=46; ConfidenceScore=5.41e-01
MATLPVGTSCCRVPVTPWRRYARSQTSFSLDSVSSPSQRYATRGPPAAADQSRHASFPLSILGCPLNQ

SEQ ID NO: 148491 - protein, 159 aa, Glycine max
  Coding DNA Sequence Number=SeqID_56806
  Homolog annotation: Hit_ID=Q2HW90; Match level="QueryCoverage=63%, HitCoverage=20%, E-value=1e-08, Identity=33%"; Hit description =Putative uncharacterized protein
MGTNQTGKRFYQVKIKGLDITSIKELGRMMGPLQMQAFRKAYRKILDLTIAEISTEAVVSLTQYYDQPLRCFMFGDFQLVSTVEEFEEILGCPLGGRKPYLFSGFLPSLSKIVVVVRDSARELDRVKQTRNGVSGPTTEVLRRQGKGYGESRGVGPVYG

SEQ ID NO: 148492 - protein, 99 aa, Glycine max
  Coding DNA Sequence Number=SeqID_56807
MAIAPTKTPSGTEEVQQGPGVSSFGYGPLSALQGARFPQQDCARKTPSGPEEGQQGLGVAISKYGSLSVLGSACRPQQGHQAPPTNRAFIKKYCAPRQA

SEQ ID NO: 148493 - protein, 55 aa, Glycine max
  Coding DNA Sequence Number=SeqID_56808
MRRGLGDEEERFQFGISSAKWEMLQTLQPTVALSTTKAEYMALEEAVQEETKGPD

SEQ ID NO: 148494 - protein, 130 aa, Glycine max
  Coding DNA Sequence Number=SeqID_56809
  Subcellular localization annotation: CTP_CleavageSite=46; ConfidenceScore=5.27e-01
MGMFAPGMTKGAGNHKLTKVAGNHKVTLACHLTSRVGQQKVQKTILVSARQRGLVCPLLRKGAGNHKGRQKLQKTMLVSASTGSFAPSLTKGASNQKVTPHVTCLHGSGRQKVQKTMISLCASTDSFAPG

SEQ ID NO: 148495 - protein, 274 aa, Glycine max
  Coding DNA Sequence Number=SeqID_56810
  Gene Ontology: Biological process=transposition, DNA-mediated
  Homolog annotation: Hit_ID=Q6UUU1; Match level="QueryCoverage=21%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPEFDVNFSVLIYKETYLAWPHRKMGGLLEVSSLSIPSTSRGGPVPAFVPFSEVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 148496 - protein, 62 aa, Glycine max
  Coding DNA Sequence Number=SeqID_56811
MKLEAYLDRRCFVEINRRCQKDAQMQCASIWEREIVSANRRTHRVVQMKILATLAKPGSWPA

SEQ ID NO: 148497 - protein, 96 aa, Glycine max
  Coding DNA Sequence Number=SeqID_56812
MIHLVKARRGHWVHLSNSAGSGNCNRIGFHYLLHAHHGLHHCGHSLFHGLHVSLPLFLHLLYFTHYSSSSTSSAPHTPVSPSSIKHERKLGSEAIN

SEQ ID NO: 148498 - protein, 285 aa, Glycine max
  Coding DNA Sequence Number=SeqID_56813
  Gene Ontology: Mol. function=hydrolase activity, hydrolyzing O -glycosyl compounds; Cellular component=extracellular region; Biological process=carbohydrate metabolic process
  Homolog annotation: Hit_ID=A9MR71; Match level="QueryCoverage=98%, HitCoverage=40%, E-value=1e-136, Identity=82%"; Hit description =Putative uncharacterized protein
  Pfam annotation: Domain name=Glyco_hydro_18; Domain location=56-284; Score=51.7; E_value=2.5e-12; Accession=PF00704.19; Description =Glycosyl hydrolases family 18
ELTVTTSKLIKGDTLTETSNAADGFNPATEVSNYSYTSDRVAKPVYNKYKSATNKPKVFGYYTDWSQYDGRLQGSDAKDNRGRGYDLTNVSPTAYDKIIVGFVGVTGFHKVDGLYRDVVAEGAEQCGKVKYEPTFLDPWGDFQSYVNVGHSVSGWDVDPKTVTQTNTKGLLGGLRDLQAKAKQQGHNLVLSMSIGGWSMSNGFHETAASDSSRKIFAKGVVKLFKQFPMFSEVDIDWEYPNAEGAGNPYGPEDGENYALLIAELRKQLDSAGLSDVKISIASSAV

SEQ ID NO: 148499 - protein, 243 aa, Glycine max
  Coding DNA Sequence Number=SeqID_56814
DVLTAAIGRPEHPGRVRVAGAGVTIKQYFRSAPRMSHSSSSLPPEELQQLTQQIRDQLEESITEKVTRQLMASFILVQSQMQSQGLALPPEPLVGPSGPQVSTKGSCVDPSGNDPETADSDRCGLYIEADPARLVTLGRVYEGSTVVHNTPLLLSQVKMGVEEVVVSLAKPPPKPDPEVDDPLYLMTLTIPELFLRPYQVTWDATVFGVFNPDFLLYIKHEDLSKIAHGGQCLNISVLQLWIL

SEQ ID NO: 148500 - protein, 348 aa, Glycine max
  Coding DNA Sequence Number=SeqID_56815
  Homolog annotation: Hit_ID=Q84VH5; Match level="QueryCoverage=85%, HitCoverage=47%, E-value=1e-140, Identity=80%"; Hit description =Envelope-like protein
VSTSKRAKKSGKKVPENVPDAPLDNISVHSIGNAERWKFVYQRRLALERELGRAALDCKEIMDLIKAAGLLKTVTKLGDCYESLVREFIVNIPSDITNRKSDDYQRVFVRGKCVRFSPAVINKYLGRPTDGVMDIAVSEHQIAKEITAKRVQHWPKKGKLSAGKLSVKYAILHRIGAANWVPTNHTSTVATAFRIICCQITIAFPTVLCGIMLSQHPNILNYTDSVMKRESPLSLHYKLFEGTHVPDIVSTSGKAASGAVSKDALIAELKDTCKVLEATIKATTEKKMELERLIKRLSESGIDDGEAAEEEEAAEQEEEEAEEEEEEADDEDAAEDTESDDDDSEATP

SEQ ID NO: 148501 - protein, 65 aa, Glycine max
  Coding DNA Sequence Number=SeqID_56816
MDGFIEPMCRNLPFCGRARRGSRVDKSGALAPTYPPLKRKSDLHSSFLRVNQVVLFTWKVSILRR

SEQ ID NO: 148502 - protein, 141 aa, Glycine max
  Coding DNA Sequence Number=SeqID_56817
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=60%, HitCoverage=72%, E-value=3e-24, Identity=67%"; Hit description=LacZ protein
MKHFTDTLISANIFELPSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 148503 - protein, 93 aa, Glycine max
  Coding DNA Sequence Number=SeqID_56818
MYPPLFSLNLVDVPSTRTDPQEMYPLLLSVKPKEWEESKEFSDYVVLNSLTREKGDTKEFRRLVIGEFFLAKGEENEKMNSTSFQGLENQKTS

SEQ ID NO: 148504 - protein, 146 aa, Glycine max
  Coding DNA Sequence Number=SeqID_56819
MYMMRLSTLNEYGSGVIDILIGSVRHIGWYIVERQAIWREGVLVLNLHIMGPFVLPKSLPTISERKTQGSCMSKHENKRQESPKNYLFLLAHSGMQCPMCVVKKVIWTFRLPVTKDETNIQHMRDDMMQMRKSATGRCTQHGNILK

SEQ ID NO: 148505 - protein, 98 aa, Glycine max
  Coding DNA Sequence Number=SeqID_56820
MSLATLFGKLQEHEMELLRLHQNEENDKKKKGIALKASSSIQEESDQDNDADDDDDLSFFKKMEKSEKKNHSEKKLKKAYITWDENDLNPLMILKMKR

SEQ ID NO: 148506 - protein, 25 aa, Glycine max
  Coding DNA Sequence Number=SeqID_56821
MEGNSQTPRTSKEHAALSEFIHTHL

SEQ ID NO: 148507 - protein, 271 aa, Glycine max
  Coding DNA Sequence Number=SeqID_56822
  Gene Ontology: Mol. function=NAD(P)+ transhydrogenase (AB-specific) activity; Cellular component=integral to membrane; Biological process=electron transport
  Homolog annotation: Hit_ID=A6T8N6; Match level="QueryCoverage=100%, HitCoverage=52%, E-value=1e-116, Identity=78%"; Hit description =NAD(P) transhydrogenase subunit alpha
  Pfam annotation: Domain name=AlaDh_PNT_C; Domain location=1-79; Score= 39.7; E_value=2.8e-09; Accession=PF01262.12; Description=Alanine dehydrogenasePNT, C-terminal domain
MELFAAQAKDVDIIVTTALIPGKPAPKLITREMVDSMKPGSVIVDLAAQNGGNCEYTVANQVTTTANGVKVIGYTDLPGRLPTQSSQLYGTNLVNLLKLLCKEKDGNVTVDFDDVVVRGVTVVRDGEITWPAPPIQVSAQPQAAPKAAPEPKEPAKPASPWRKYAIMALVIILFGWLADVAPKEFLGHFTVFALSCVVGYYVVWNVSHALHTPLMSVTNAISGIIVVGALLQIGHGGWISFLSFIAVLIASINIFGGFTVTQRMLKMFRKG

SEQ ID NO: 148508 - protein, 173 aa, Glycine max
  Coding DNA Sequence Number=SeqID_56823
MDNEEGVQEQMKADLSALKDQMASISEVMLKLQKTIEDKATATASSTVREAKPVLEPALNLGRDRNTAVFGRRYSPQAYPYGLPLDFAPCAAPEDLSQAPTFEGQLPPYNDYPVQEDEEGDTHLGPLLHLKNPSPHELPQPNIVRHVPASPAPVKESVPFAKIKERLGRLKRG

SEQ ID NO: 148509 - protein, 89 aa, Glycine max
  Coding DNA Sequence Number=SeqID_56824
MKIQKKGVPVDPKRLKVISEWPTPLSVEGRSLELQEPLDLRSNPFQGGGMMQSYPLRALDRRLQEDWARDAREGPRVLMSLRVDFGPMG

SEQ ID NO: 148510 - protein, 118 aa, Glycine max
  Coding DNA Sequence Number=SeqID_56825
  Subcellular localization annotation: CTP_CleavageSite=31; ConfidenceScore=5.41e-01
MSISPYGSINWGRAHKTPSGPGEVQQGPGVSSSGYGPLSVVQGVCPSQQGSRPKTPSGPGEVQQGLGVSSFDYGPLSLGPPLTGFSSRSTAPLGRRRARHHSSLGMADSGQQAHRHHL

SEQ ID NO: 148511 - protein, 56 aa, Glycine max
  Coding DNA Sequence Number=SeqID_56826
MDASVSGVVNPDLPVQPKSEDLFSLQVAIVSEVLNINRHTTECGSTMSCTGCPPSF

SEQ ID NO: 148512 - protein, 254 aa, Glycine max
  Coding DNA Sequence Number=SeqID_56827
  Homolog annotation: Hit_ID=Q6WAY4; Match level="QueryCoverage=92%, HitCoverage=45%, E-value=1e-09, Identity=25%"; Hit description =Putative uncharacterized protein
RQHNQLVPRWKEGKEGVLFSCEDYPNVSLIGTRGCINYNRALAIRQLGYPMRGEPTEESLSPFLVRDFGAQSFKIVQRVHKAWESPLRKDKELRGIRNGIIGGYHEWLRVHTRGLDWLSKLKIINEENFEAPEEDEEFQALKTELGKARLAKEKFKLVATNIQKECAELREENAATARALKRETKRARKEEHGRDKFQGALLGSNNELKLRREERDQSRVHGMVLKEELAACSRSKRSLAQHLEATEQSMLAII

SEQ ID NO: 148513 - protein, 335 aa, Glycine max
  Coding DNA Sequence Number=SeqID_56828
  Gene Ontology: Mol. function=ATP-dependent helicase activity; Cellular component=cytoplasm; Biological process=regulation of translation
  Homolog annotation: Hit_ID=A7QIS9; Match level="QueryCoverage=83%, HitCoverage=62%, E-value=1e-109, Identity=70%"; Hit description =Chromosome chr2 scaffold_105, whole genome shotgun sequence
  Pfam annotation: Domain name=DEAD; Domain location=88-248; Score =72.3; E_value=1.6e-18; Accession=PF00270.20; Description=DEADDEAH box helicase
LGLECFVSHLDVTLTSSVGPECVELISIVQRAISGCIQWLLDLRTNTILVDFLPGLDVMKTKGNEFEDYFLKRELLMGIYAKGFERPSPIQEESISIAFTGSDILARAKNGTGKTAAFCIPALDKIDQDNNVSQGSAGVAVTSRTFKFEGHINCYTGPNPRIGIVDFSSVQRAWKALENSSYGYNRILDLAKKGVCILKDCAMLVMDEADKLMSPEFQPSIEQLIHFLPTTRQILMFLATFPVTVKDFKDRYLRKPYVFVEERQKVHCLNTLFSKLQITQSIIFCNSVNRVELLAKKITELGYSCIYIHAKMLQDHRNRVFHDFRNGACRNLVCT

SEQ ID NO: 148514 - protein, 140 aa, Glycine max
  Coding DNA Sequence Number=SeqID_56829
MTRGNPGVLKPFDPKIDRTFHRLVRHSVHPGHSVHFEHSAHSVEGDSEYSDFEHSTTNFHTKNMDQPAPRERTLREMAAPDFTYESLCIQYPDEGVPYCRNLPFGGRATHGSRVRVPRKEYAQSRHQRLFEENVGKPEKT

SEQ ID NO: 148515 - protein, 167 aa, Glycine max
  Coding DNA Sequence Number=SeqID_56830
  Gene Ontology: Mol. function=exodeoxyribonuclease V activity
  Homolog annotation: Hit_ID=A5FMQ9; Match level="QueryCoverage=74%, HitCoverage=74%, E-value=2e-31, Identity=49%"; Hit description =Deoxyinosine 3'endonuclease (Endonuclease V)-like protein
MIYAFDTYYYENYAYTVCLAFKDWEDDLETAAYSEKTPITSDYESGAFYKRELPCILSLLSKIDLKNGDILLVDGYVTLNNEGKIGLGGYLYEKLEEKYPVVGIAKNEFSAPDSQRRTIYRGETILLLNPKNLAKIPIKAALKVTFGGAEETINDTIGTNKTPVETP

SEQ ID NO: 148516 - protein, 86 aa, Glycine max
  Coding DNA Sequence Number=SeqID_56831
MGAEDDVSLRVLPGFSSYRQQKRMFIRITTRIAKKNVYTDNHSGISARQRDSNVSMTDLVRAEDDVNLRVSTGLSAAIDEGRRRRR

SEQ ID NO: 148517 - protein, 174 aa, Glycine max
  Coding DNA Sequence Number=SeqID_56832
LFILQTAKKNVYTDNHSGISARQRDSNVSMTDLVSAEDDTAKKNVYTDNHSGISARQRDSNVSMTDLVSAEDDTAKKNVYTDNHSGISARQRDSNVSMTDLVSAEDDVNLRVSTGLSAAIDEGPEDDVSLCVLSRLFVLQTAKKNVYTHNHSGISARQRDSNVNMTDLVSVEDD

SEQ ID NO: 148518 - protein, 326 aa, Glycine max
  Coding DNA Sequence Number=SeqID_56833
NAELRDINIATTKALEQETKRAHKEEHGWNKFRGALWGSNRELKLRREERDQSRVDGMILKDELKTCLSKYKEELNLATAHEHKVADEYARVYAKKEARGRVINLIHQEATIWMDRFALTLNGSQELPRLLAKAKAMANAYSTPEEVHGLLSYCQHMIDFAITKRTPRHPYHTRSKSRMMGDLEEVQEQMKADMSTLEEQMASMMEAMLGMKQLMESNGATAAAVSMAAEADPTLSTTTHHPVPNIVGRRKSTPGHVSNPHPRYNRGAYPYDLPPNYSPPAMHEDVGHVTPFILEGEPPRHPNRVHENPRERTQGDVDSYSPFHAE

SEQ ID NO: 148519 - protein, 92 aa, Glycine max
  Coding DNA Sequence Number=SeqID_56834
MALACDFCKETTHGVLEIPRCAHVQFLAPQNALSMHVCKFSQGDVCDVVCHFCFKSSVPLVKLTFQMFAFAGNGPKEACLKEVQEGQGSRRN

SEQ ID NO: 148520 - protein, 139 aa, Glycine max
  Coding DNA Sequence Number=SeqID_56835
  Homolog annotation: Hit_ID=A2Q1D6; Match level="QueryCoverage=65%, HitCoverage=15%, E-value=8e-10, Identity=40%"; Hit description =Ovarian tumour, otubain, related
MNEDQWTYDYAMSQEVHMDYDYDNEEECGVNEPHFDCSNAFNTSQWARTVAHENGFVAVIMRSDTDTGSRGRSSFVLIGCEMSGTYKCWNKEFVRKDTGSRKCGCPFRLRGKPVHGGEGWMVKLICGIASLLLLSLTET

SEQ ID NO: 148521 - protein, 77 aa, Glycine max
  Coding DNA Sequence Number=SeqID_56836
  Subcellular localization annotation: CTP_CleavageSite=45; ConfidenceScore=5.45e-01
MSPPPLEPHNHSQTHPMLSGRLPLLAQFSRMNSSSALSGISPWPANMHNSSFYQIHPRTQLQEWCAQRMAHQASRLA

SEQ ID NO: 148522 - protein, 19 aa, Glycine max
  Coding DNA Sequence Number=SeqID_56837
VFAPTYPQFVMRNSDLRSS

SEQ ID NO: 148523 - protein, 91 aa, Glycine max
  Coding DNA Sequence Number=SeqID_56838
MAANLPNHQRSERGQPQKSTKLIYLQTAPTSLGSPYPLPCLPTAILLKEGSKPEKRYGFLPLRGHPNISSNSSIDGTIWKSPNVKHLNGWS

SEQ ID NO: 148524 - protein, 60 aa, Glycine max
  Coding DNA Sequence Number=SeqID_56839
MPKDRGTCLDFRDCHHQKGGDCRQRIKLNVLMMRKFHMSLKVLFKTKKLKIFKMDDQDSL

SEQ ID NO: 148525 - protein, 38 aa, Glycine max
  Coding DNA Sequence Number=SeqID_56840
MEKGVEGRSLEYEEPRDLSSNPVQGGGDDAILPPKGIG

SEQ ID NO: 148526 - protein, 156 aa, Glycine max
  Coding DNA Sequence Number=SeqID_56841
MAPKKLSTKRSRRDVAAEGSSATPEFDSHRFRSAELQQRFEAIKGWSFHKERHVQLREDQYTDFQEEIARWRWTSLEGQQCEFSQRRNRADGFDEEAIAQLLCTPGQDFARTAAGRRVRIMRTSMTTLTQTWMTLQLSNVLPNDHNSDLPLPKCQL

SEQ ID NO: 148527 - protein, 73 aa, Glycine max
  Coding DNA Sequence Number=SeqID_56842
  Homolog annotation: Hit_ID=A5BBI1; Match level="QueryCoverage=60%, HitCoverage=6%, E-value=3e-07, Identity=56%"; Hit description =Putative uncharacterized protein
MVSFVNQSKYCKELIHKFDMENAKHMATPMSTACYLDKDETSQSIDVKQNREAEVYVEHYQVLKLLDEAKSCL

SEQ ID NO: 148528 - protein, 147 aa, Glycine max
  Coding DNA Sequence Number=SeqID_56843
RAFTKRDTQWLSARKNPEEDELSGSLSAPPQVIKCTALAHPLSEISTLSQKSLTCTKHTSTNKATYLSLKSDLQIEFGVFLEEASACTRFWPWLEAFSCLGCSREIKVQVPKSSERFCCVKICRDASSKRKPFPDYGKLNPLLDLPC

SEQ ID NO: 148529 - protein, 33 aa, Glycine max
  Coding DNA Sequence Number=SeqID_56844
MVRGKRAMKERIREAQRVFKKTNMLWLGGGSKG

SEQ ID NO: 148530 - protein, 145 aa, Glycine max
  Coding DNA Sequence Number=SeqID_56845
  Gene Ontology: Biological process=transposition, DNA-mediated
  Homolog annotation: Hit_ID=Q1J7G7; Match level="QueryCoverage=22%, HitCoverage=47%, E-value=7e-12, Identity=100%"; Hit description =Transposase
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPEFDIHFSAYTMLGEAELQLYLA

SEQ ID NO: 148531 - protein, 141 aa, Glycine max
  Coding DNA Sequence Number=SeqID_56846
  Pfam annotation: Domain name=G-patch; Domain location=2-41; Score =21.3; E_value=0.00051; Accession=PF01585.14; Description=G-patch domain
MARVMLGNGYEPGMGLGKDNGGITSLIKNQGNRGKYGLGYKPTQADIKRSIAGRKNSGQVFAICEDDVPSTLDLVRPCPPDFQLGNWRVEERSGIYATSIISDDESPKGTNTWDPPIDFEQEMNQTEDEGNEDVGLPPPQN

SEQ ID NO: 148532 - protein, 85 aa, Glycine max
  Coding DNA Sequence Number=SeqID_56847
MTSFARSFQIIIVTHALWNNVEVRPETDTSSPKFVLPQISRLGSHDERLHQNTTLDLFEPWPVKKGILILSPEAKDSGISSRESE

SEQ ID NO: 148533 - protein, 134 aa, Glycine max
  Coding DNA Sequence Number=SeqID_56848
MVLKLSFPGHQSTIGSTASIGRHRKRSFTQIDPSRIRWQPHVLEQQRQAWHDRQLRHKPISKATRLGTKEMNYNKGLQLKNKDNQESEQNSPSSSVLSRKVAWVQSPKLGGRPASENSSNAAKEGLGRLGIRLT

SEQ ID NO: 148534 - protein, 122 aa, Glycine max
  Coding DNA Sequence Number=SeqID_56849
MTALAFDEDLHALTLEDTRPALRVMYPHLQRTARPRLQKSLYLHLRGPHALAFKGLHRPHLQRTTRPCLQRVMDYTPSPSEDYTSSPSEDYTVPTFRGLHAFAFRGLHVPLFKGLHALALKG

SEQ ID NO: 148535 - protein, 38 aa, Glycine max
  Coding DNA Sequence Number=SeqID_56850
MATKMKRCPLEALGSVAPITSMPHIENGQGAAKMFNGT

SEQ ID NO: 148536 - protein, 154 aa, Glycine max
  Coding DNA Sequence Number=SeqID_56851
MRKRRKLNIIQNDGQSQAKEQSIESSTEVNQNNNSILEENAQFEGEQHIQEDSHVQSHTSLESASERSTKGKKRTRGYTHMLDVWDLPDGEFILVEVDHWGNPMGWEGKTILNAIGSLVRRHQCAPINFLSWKDMPKDYITDMVESIQVWYKTL

SEQ ID NO: 148537 - protein, 212 aa, Glycine max
  Coding DNA Sequence Number=SeqID_56852
  Homolog annotation: Hit_ID=Q5XM22; Match level="QueryCoverage=58%, HitCoverage=89%, E-value=5e-28, Identity=44%"; Hit description =Resistance-like protein HAAS-2
MLVDLLMVFTEAAKAETGQCRGPYVRLQWVRDIYERRCQEGHWTAAVHAYLLHLLGCTLFANKSATNVHVVYLEALRGLSQTGRYTWGVAALVHMYDQLNDALSAAADSLACWIYEHFPSVAESTADQDYDEDSPHARRWIATKKIVKSIKRVVRQFGCTQTILAPPVDSWVLYDDIHDRWMHYSDHMLPAGEVCAVPATTWTGSSASPILS

SEQ ID NO: 148538 - protein, 45 aa, Glycine max
  Coding DNA Sequence Number=SeqID_56853
GRLRQLVTPLGIVMQSYPARALDRNLQVDWARYAREGPRVLMSLR

SEQ ID NO: 148539 - protein, 80 aa, Glycine max
  Coding DNA Sequence Number=SeqID_56854
MQQGQANILIARFPDPNYGVKTGSSRCGFSMENNDGLWWLMVDVGDGESTWNFRNGFGRKKEEEMAFFLSYKKAKAEMLK

SEQ ID NO: 148540 - protein, 87 aa, Glycine max
  Coding DNA Sequence Number=SeqID_56855
MIQELVARGDTLRLSAPRHSVTPSVIDEQRPMWSSAPFPEMSASSSGDFLKSHKLSRTTGGGPDDTQRYLTVICTLVSSRGGGPDDT

SEQ ID NO: 148541 - protein, 75 aa, Glycine max
  Coding DNA Sequence Number=SeqID_56856
MVVTARPERVVSADYMEWFFRISHPFMIPTQAGDQPRDAPATDLEDYIQLPNPQVPVAFDPPPHVDDYEGYEAIA

SEQ ID NO: 148542 - protein, 118 aa, Glycine max
  Coding DNA Sequence Number=SeqID_56857
  Homolog annotation: Hit_ID=UPI00016621D1; Match level="QueryCoverage =83%, HitCoverage=39%, E-value=9e-09, Identity=39%"; Hit description =UPI00016621D1 related cluster
GLRVLTFVGLQALTFKGLHALAIRGLHVLTFVGLDALTIRGLHALTIRGLHVLTIRGLHVLTFRGLHVLTLRGLHVLTLRGLHALTFRGLHVLTFRGLHVLTSEDYTSSPSEDYASSP

SEQ ID NO: 148543 - protein, 119 aa, Glycine max
  Coding DNA Sequence Number=SeqID_56858
MRGVLIPSPCVNTTPEPFTLKNRRPHLFRFFRHFPRINVGGDYVRFPPLEDAPVSPRVALPPKGRPIGVREQIHDASLDICETPRFRTKMPSICEQAEVDGVHAIRQNHGEGLWENNAL

SEQ ID NO: 148544 - protein, 115 aa, Glycine max
  Coding DNA Sequence Number=SeqID_56859
MINLVEVAVLHCPSSPISALESINIQAWQFIQSFLLELRQPQCFSNNSLDCITRYKLKISGPVQCGPGDGMGVVPCVPAPYSFKQGNAKASCASVALKWVKLLTSLQQLQFEGIL

SEQ ID NO: 148545 - protein, 128 aa, Glycine max
  Coding DNA Sequence Number=SeqID_56860
  Subcellular localization annotation: CTP_CleavageSite=78; ConfidenceScore=5.40e-01
MVLISSAPVAYHGFYQLFPPVQLLTGNGVIRSNSAHKHTSRSIAAPLSIRTMSGCATALMGIGQRDRCGPGVPVDSASCGRKNDGQSEYVNTGLTIGSASSLTELLPRVDGGERSELVAYPNGAEISG

SEQ ID NO: 148546 - protein, 293 aa, Glycine max
  Coding DNA Sequence Number=SeqID_56861
MAKFDPEIVLEFYANAWPTEEGVQDMRSWVRVLEEGQECEYGQRRNRSDGFDEEAIAQLLCIPGQDFARTAAGRRVWIMRTKMTTLTQIWMTLLLSNILPSDHNSELPLPKCQLVYAILTRMSIHVAQLIMLMPSIYLQDSASRLESLVAPSKVIRPPITRAFIEKYCTQRQVQGDAPQAADAPPPNQAGPAELFDTKQYLRHLVRQQVANHRAHVQTHDCLYQMSLSLQSKGFTSFPCPTPDQFRAEVAWPGDWPEARAGEASTEAPDEADEAREDEEMTDLLDFLGGSGAT

SEQ ID NO: 148547 - protein, 136 aa, Glycine max
  Coding DNA Sequence Number=SeqID_56862
MAGAGDNGGVYHQLDGSQRLLLDPMTIQMQRLLNRNKEELYMRIVKSSLFTLKPLSPREVCDAQIRMREKREQEKENSEAPQRNRKKKSDTPEGKSDTHKRESDTHERKFNYFAEASEVRKVLPAHEPLYLQYAKT

SEQ ID NO: 148548 - protein, 224 aa, Glycine max
  Coding DNA Sequence Number=SeqID_56863
VDPWVLVPIFFRGLHVLAFRGLHVLAFRGLHTLAFRGLHALAFRGLDVLAFRGMHALTFKGRHVLNVRGMHTLTFKGRHILNFRVLHALAFRGLRVLAFIPRPPPDPGGGPTMQVQLEEEAIVQLLCILGQDFTRVAAKRRVRIMRTNMTILTQIWMTLLLSNILSSDRNTNLPLQKYQLGSCPQGTQWTRRSPTGPWGFQLWLRASVSPIGCPSPQQGHAIMT

SEQ ID NO: 148549 - protein, 159 aa, Glycine max
  Coding DNA Sequence Number=SeqID_56864
MAPTRHPLDPDKSNRALGFPTLITRLCQSFGVPVAPTKVIRPPITRAFIEKYCTQRQAQGDAPQAAGTPPPPHQAGQAGAFDMEQYLRHLLSLSMQSQGFASFSCPNPDQFKAEVAWPGDWPEAQAGEAPPEAPGGGEEAHEDEEMADLLDFLGGSGDT

SEQ ID NO: 148550 - protein, 71 aa, Glycine max
  Coding DNA Sequence Number=SeqID_56865
  Homolog annotation: Hit_ID=A5AWG3; Match level="QueryCoverage=88%, HitCoverage=11%, E-value=1e-07, Identity=42%"; Hit description =Putative uncharacterized protein
MNIDEQDSKGNDKGNKKSPPEEVKSNDELPRAWKASRDHPLDNIIGDISKGVTTRHSLKDLCNNMDFCIYD

SEQ ID NO: 148551 - protein, 152 aa, Glycine max
  Coding DNA Sequence Number=SeqID_56866
  Subcellular localization annotation: CTP_CleavageSite=57; ConfidenceScore=5.46e-01
MVRLLPLQDSLTSYTPSPSSMSIPVRPPDVAHTPSPPPIEARPSSSHVNARGPSLVPASTPSPSSIDACGPSPIPTSTPSPSSPMGNMPIDEAVVNLAMEDPSLNNCPMVTFRPSKVVAKAVTLSIRQQFGQPWPTWGAIPKEHQKLFFSVL

SEQ ID NO: 148552 - protein, 150 aa, Glycine max
  Coding DNA Sequence Number=SeqID_56867
METCPAVEELLQRLMDCGQLEVSIGGGKNHKFACSRKRRRFLLTPKALVICFTRKGIGSTPIYPRTTPKPTPFAYQSNKAVPWKYTPPASSEKVATEVDSLSAKVTNITGLSGVTRSGRVFASPHPAELPSKGKAPMVQEPTDVATPSKE

SEQ ID NO: 148553 - protein, 67 aa, Glycine max
  Coding DNA Sequence Number=SeqID_56868
MLTSPERAQMTILVSAYQSHLGIDEVRITVRCLRGLPALGHGNRKRCRSTKARLLLLRILHEELIPT

SEQ ID NO: 148554 - protein, 381 aa, Glycine max
  Coding DNA Sequence Number=SeqID_56869
  Homolog annotation: Hit_ID=Q6WAY6; Match level="QueryCoverage=80%, HitCoverage=56%, E-value=4e-35, Identity=29%"; Hit description =Putative uncharacterized protein
ILELTIAEVSIEAIASLTQYYDQPLRCFTFGDFQLVPTIEEFEEILGCPLGGRKPYLSSGCLPSLSRIATVVKDSARGLDRIKQTRNGIAGLPQKYLEDKAKGMANQGDWVPFMDVLALLIFGVVLFPNVDGLIDLAAIDAFIAYHHSKESPVVAVLADLFDTFDRRGEKSSARIICCLPALCVWRIDWDQLLAGIGGRTISWFPRWKEGKEGVLFSCGRYPNIPLVGTRGCINYNPALAIRQLGYPMRGAPTEESMSPFLVRDFGAQNSKTIQRIHKAWETPLKKDQELRGIRNGIIGGYHEWLKVHIGGLDWLAKLKVVSKESFEAPEEDEEVQTLKSELGKAKLAKEKFKLAATHVRKECAGLREENAITARALEQET

SEQ ID NO: 148555 - protein, 187 aa, Glycine max
  Coding DNA Sequence Number=SeqID_56870
MASRKRKATTSVSQARCLRSIRKQCAWPKDPFGKECETFDVDSLNTFLHTPVVLEQGESLPAYSRFCRLRSDPQELVARLCIPGRGFELNVDGLPLKILRKNLTTLAQAWSVLSFSNLAPTSHTFDITLDRAKLIYGLIMKMDMNLGSLILGQISLIAQHDSSRLGFPALITALCKARGVHIRFSDP

SEQ ID NO: 148556 - protein, 66 aa, Glycine max
  Coding DNA Sequence Number=SeqID_56871
GEEVAAQLAQATLARPGELGGNLLPLFPIKRLKGAVLRIPEPLGYQIREGSSTFFIRSSSFFDLQR

SEQ ID NO: 148557 - protein, 242 aa, Glycine max
  Coding DNA Sequence Number=SeqID_56872
  Homolog annotation: Hit_ID=A5BLZ2; Match level="QueryCoverage=46%, HitCoverage=9%, E-value=2e-08, Identity=33%"; Hit description =Putative uncharacterized protein
  Subcellular localization annotation: CTP_CleavageSite=30; ConfidenceScore=5.67e-01
MASPPASPPPPPPAPSDASASPSAMKRTHKASRLRSLSTRPPGAERPVVHVDPAIGKADGPHRKKLRTYLGIVARDKVDVTYENWKEVPTPQKDLIWEDIKRLLTVGRKGSYFRPWARDGADLDGVEDTVCEKYGIRKEKWAQFCQTRRDPSWEDVRKKAQAIQKQNTTPHVLSRGGYDYLEQKLLAEKTKKKLEEVAQTGSVDGIIDPPSPVRCHVKWKMARTKKSGDMTTEAAKEIVAKI

SEQ ID NO: 148558 - protein, 237 aa, Glycine max
  Coding DNA Sequence Number=SeqID_56873
MEVSHVQVQDISEEDYNEQMKVVYPQAEEELIDFLNRCKLENKIVMLCPRCSAICDKELLRASRNTKLLTRGQSRTNVSIKKSGRRNTFAPPGSVPVEKWMHQGLIRFNKGIMEVGGSSGTKQVGPQEANKYSYRNNYKGKNPMTRTQWRRFQRQKKLAQQNLQTGQYKEVSRRPVKERLLPPVDEDKMEDEDLLDSEPDFDVICVVSILPSEYDVQSEVTEIESEFDHFDMADPKP

SEQ ID NO: 148559 - protein, 500 aa, Glycine max
  Coding DNA Sequence Number=SeqID_56874
  Gene Ontology: Mol. function=nucleoside-triphosphatase activity
  Homolog annotation: Hit_ID=P39342; Match level="QueryCoverage=97%, HitCoverage=97%, E-value=0.0, Identity=75%"; Hit description =Uncharacterized protein yjgR
  Pfam annotation: Domain name=DUF853; Domain location=3-500; Score =1224.5; E_value=0; Accession=PF05872.3; Description=Bacterial protein of unknown function (DUF853)
MTTPLLIAQTPDLQLHLLPAMANRHGLITGATGTGKTVTLQKLAESFSAIGVPVFMADVKGDLSGIAAAGDGSEKLLARLAKIGVTDWQAQKNPVMLWDIFGQQGHPVRATVSDLGPLLLARLLSLNEVQSGVLQIIFRIADDQGLLLLDFKDLRAMTQYIGDNAKAFQTQYGNISSASVGAIQRGLLALEQQGAEHFFGEPMLDIRDWMRCDADGKGFINILAAEKLYQQPKLYATSLLWLLAELYEQLPEAGDLEKPKMVFFFDEAHLLFNDAPPVLLEKVEQVIRLIRSKGVGVYFVTQNPADIPDNVLGQLGNRVQHALRAFTPKDQKAVKSAAETMRANPAFNTVEAIQALGTGEALISFLDEKGSPSMVQRAMVIAPGSRMGPATPDERNSLINHSPLYGKYDSAVDRESAFEMLQQGVQAAPQQADAPPGKGNSVAVDDGILGGLKEILFGSTGPRGGKRDGVVQSVAKSAARQVTNQIIRGVLGSLLGGRRR

SEQ ID NO: 148560 - protein, 206 aa, Glycine max
  Coding DNA Sequence Number=SeqID_56875
MILKEELVACARSKRSLAQHLEATEQSMLAIIGQYKEELNQSVTHEQKLVEDFAQVYAEKEARGRVIDALHQEATMWMDRFALTLNGSQDLPRLLAKAKAMAERIKPRQPPPVQLGEAEPVLQPVLNPGRDRNTAVFGRRYSPQAYPYGLPPDFTPRVTPEDLSQAPTFEGQLPPYDDYPKQDDEEGDTHLGPLLHLKDPSPHELP

SEQ ID NO: 148561 - protein, 166 aa, Glycine max
  Coding DNA Sequence Number=SeqID_56876
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=51%, HitCoverage=72%, E-value=3e-24, Identity=69%"; Hit description=LacZ protein
MALQLADRTMKHPYGIVEDVFVRLTNFSFELTLWVQDDEVQFNVSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPP

SEQ ID NO: 148562 - protein, 115 aa, Glycine max
  Coding DNA Sequence Number=SeqID_56877
MQSADEEGPKKPKPLVIHFTRDMTPQRPQHPLAVSGGRSVPYPYENSRAVPWRYAPPSGRKEEATDISSLSAKVTNITGLSGITCSGRVFVPPSLPIQPAITKGKARMAEGKNVK

SEQ ID NO: 148563 - protein, 42 aa, Glycine max
  Coding DNA Sequence Number=SeqID_56878
YEMRKSRFEAKLLAMQAEFPQATYWLDQIPKSKWTQAYDEGK

SEQ ID NO: 148564 - protein, 203 aa, Glycine max
  Coding DNA Sequence Number=SeqID_56879
  Subcellular localization annotation: CTP_CleavageSite=52; ConfidenceScore=5.69e-01
MTTPPNSPHPPPPPTDATSQSLSSLKRTRKATQLRSLVTRPAGAERLVVHVNPATKKADGPHKKKLKTYLGIITRDKVDVTYENWKQVPTAQKHLIWQDIQDMRKNALAIQKQSTAPHVLTPQSCACCWNWCDDQAILWTGSKVLSHIFLHGSLRLGVADSTNQGLVGGVDHRKTDLIANVILQPYAIPVSVTDAITGTCTTS

SEQ ID NO: 148565 - protein, 70 aa, Glycine max
  Coding DNA Sequence Number=SeqID_56880
SHDVAEVRNVVDVRVGTGDENVALPSTGSFVSFKFSSIGKEFDCVGWRDEAVAPTLRLRNGGIWGLGFRV

SEQ ID NO: 148566 - protein, 142 aa, Glycine max
  Coding DNA Sequence Number=SeqID_56881
MKTKARSRITDNIVSETEQEAPYQDDELMADRGRGGGRRTFNCGRRHGLSLGAPITTNPSTSSIHISTLELMIHVVAPTPNTLPTAQDQPNTTFVRESIPITPITDASPSAPNDSLTPEYPPDPNCEHIVDQRPFIRAYKEE

SEQ ID NO: 148567 - protein, 72 aa, Glycine max
  Coding DNA Sequence Number=SeqID_56882
PSTDVLLEDGGIRKRKSAYLWKTSEKPKEPVMKNIPDSGVVFSFEEGISTSHVDKSGALAPTFPPSKRKSDL

SEQ ID NO: 148568 - protein, 50 aa, Glycine max
  Coding DNA Sequence Number=SeqID_56883
MTPVLDNSLFTLNRQSLKACNPPSSHSRTPLHSIRSHIRIILILPNEDNH

SEQ ID NO: 148569 - protein, 125 aa, Glycine max
  Coding DNA Sequence Number=SeqID_56884
MVRTQAAGKGGTCRQRFRADRVWPGRISQCFTSAGIVSEEEVAAIEEEFPQNPPSFVQPCHPDSQVGNWRVINQSEIYTADSICEGRFFEEPSNEGLSIDFDRDISQTINEEEEEEEDVLSPELE

SEQ ID NO: 148570 - protein, 96 aa, Glycine max
  Coding DNA Sequence Number=SeqID_56885
  Subcellular localization annotation: CTP_CleavageSite=52; ConfidenceScore=5.25e-01
MVKVGTSYVPINVSFSPKVGPGLPGINRDIQDLFMRTRMCSVTAVPPVQLLTGMAERNCWEGRSVRAFAITPAGERGMCCKAIKLGNARVFPVTTL

SEQ ID NO: 148571 - protein, 312 aa, Glycine max
  Coding DNA Sequence Number=SeqID_56886
  Gene Ontology: Biological process=transposition, DNA-mediated
  Homolog annotation: Hit_ID=Q6UUU1; Match level="QueryCoverage=19%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPEFDVRGCATDEIWAMKEYKVDSSWTKSIVIPNNGFSPICITKDGGIIGSKEVDQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 148572 - protein, 241 aa, Glycine max
  Coding DNA Sequence Number=SeqID_56887
  Gene Ontology: Mol. function=calcium ion binding; Cellular component =extracellular region; Biological process=pathogenesis
  Homolog annotation: Hit_ID=Q8XQP2; Match level="QueryCoverage=95%, HitCoverage=85%, E-value=8e-32, Identity=36%"; Hit description =Probable hemagglutinin/hemolysin-related protein
MNQILNATYRYTDDPRRGYSGTSPQARNGFAEIAIDGQPPYTVKVDAEGRWSWTPPADWTPGEHIVSVRMIDAAGNIGDPAQFIQVVDYTAPDAPRLLNMYDDQGDITGSFDAGRMTDDRRPTLTGVAEKGTVVYLKEGDTVIGSAQADAKTGIWTLEPDADLSDGTHQLTLVAVETFNGKLREGEPSEPFELLIGRDGSAATVISHAVDDAGPVTGSLLSGALTDDATPQLHGSAPAGST

SEQ ID NO: 148573 - protein, 262 aa, Glycine max
  Coding DNA Sequence Number=SeqID_56888
  Homolog annotation: Hit_ID=Q6WAY6; Match level="QueryCoverage=51%, HitCoverage=26%, E-value=8e-14, Identity=34%"; Hit description =Putative uncharacterized protein
SEYQGSVWRKGQRTWQIKVNGLSFIDILALLIFGVVLFPNMEGLVDLAVIDAFLAFHHGKESPVVAILAKYDTFNRRCEKSDTRIFFVVHWLSMCGWFHTLFSKKVGLSIRYKEGRIRILSSCEGCPNVPLMGTRGCINYNPVLAIRQLGYPMRGVPSDESITPFIARVSVTTTRGYSKEFARHGMRREERTESLGEATVRDDKVKASEESDEVQALKAKLERARVVKEKFKAAIVSSSSEEVKGIITGQRHDLEERAKGLP

SEQ ID NO: 148574 - protein, 142 aa, Glycine max
  Coding DNA Sequence Number=SeqID_56889
MVEEFEEILGCPLGGRRPYPFSGFYPSLARISKIVQISAQELDHRKQVENGVVGIQRKCLEAKARILAEIDAFLTYHDHKESSVVAMLADLYDTFDRRCEKSSTRIVCCTSSLYVWLVSHLFRQEVRHACLIESHLFRQELP

SEQ ID NO: 148575 - protein, 130 aa, Glycine max
  Coding DNA Sequence Number=SeqID_56890
MKENRAKLAVLSMRMSMCGKGKLSLGTGPIQVPIIHTHSYFPILLRDRYNVGDPFLGTERRPENQRQIASSLLLFIFQRCFGLHPSQFLLYPGNTRDLEVNPVLYNVRTQTGHILVRPSKDVLVVSQQGY

SEQ ID NO: 148576 - protein, 189 aa, Glycine max
  Coding DNA Sequence Number=SeqID_56891
  Gene Ontology: Mol. function=hydrolase activity; Biological process =viral reproduction
  Homolog annotation: Hit_ID=Q66FE6; Match level="QueryCoverage=97%, HitCoverage=21%, E-value=4e-49, Identity=49%"; Hit description =Enhancing factor
VGASWVEAQVNAVSVPFIDTPYGQGEPALEFEYSDAAKALPVYRRGENEAAFFARWDDRDAEFALVDAEYAVLLVPKIIKPALKSLGEAKNIDGLIAYYDRIFTFYNALTGVSFEAEHESDRNIRNRYFMKADKHGAGAAYYGGRWTAETSNSVSSFWLTPKDSNWGSLHEIAHGYQGHFMGDKYFLHR

SEQ ID NO: 148577 - protein, 210 aa, Glycine max
  Coding DNA Sequence Number=SeqID_56892
MVIDQSLFHDLTKLPSDGVPFEGTLNDDWKFDFSAHDARQLVCTNNADMTGRLLAGSLAFESRILHYLIVRILLPRSSNLAQLVTLFFRHFQIPLDSEPYVPIKRSFLIGAVVIASFGYRKERDGSWVKKGVPPADDEGHIPVEDNSTLLQRLMDKFDGLQTFVGDKFDAMELQVDMRFDAMESRITRVEEDVSFIRTCFDPPPPPPSSS

SEQ ID NO: 148578 - protein, 68 aa, Glycine max
  Coding DNA Sequence Number=SeqID_56893
  Subcellular localization annotation: CTP_CleavageSite=26; ConfidenceScore=5.60e-01
NGARNMFSNHVSFSAAPLRAFSGGTSSSNSWHNSSQCLHRSTNAVINAGSILHCLIKAICWNPVDDNN

SEQ ID NO: 148579 - protein, 82 aa, Glycine max
  Coding DNA Sequence Number=SeqID_56894
MELLRFYTILHEENDKKKNGIALKASSSIQEECDKENDLDEDDDLSLFVKRFNKFLKVRGNQRRPNFKSKRRINFFLYSKVL

SEQ ID NO: 148580 - protein, 135 aa, Glycine max
  Coding DNA Sequence Number=SeqID_56895
MGKAEEVQEKMKADMKAMKEQMATMMEAMMSMRKIMEANAVAVAATRAVSKVNPMPPSDLNQMNHPTSDMAGKDLGSTGGPHDVQIQNEHAFPTYGLPLNYTPPNVAYTPNKNVNYSTHIPIESQQPQTDHAHVS

SEQ ID NO: 148581 - protein, 33 aa, Glycine max
  Coding DNA Sequence Number=SeqID_56896
LFLDGGKGYNSAVECHLDVVEVISSSLIINKTN

SEQ ID NO: 148582 - protein, 240 aa, Glycine max
  Coding DNA Sequence Number=SeqID_56897
  Homolog annotation: Hit_ID=A2Q6B4; Match level="QueryCoverage=62%, HitCoverage=83%, E-value=2e-07, Identity=24%"; Hit description =Ribosomal protein L33; Nucleic acid-binding, OB-fold
MACIVDKIKTIDGSKETLKLAIRITDLWFVGTPGRSEQAEMIIVDSDSDQIHVVYKQDQLKSWKMDLKEGCDFSDIIAGQLQFDLLVDIIGVVDEVVFHQISPRSKRVVFKLMNLSNELVLCTLWDDYCVQFMECLDQHENEGPLIMLLTNARIKEGQGSYPCSISNSLKASKLTINEPLTPIEEFNQKLSELGIEIRSVLTRHSQWSSQPSGSVQLSSRETFISKSEAKSIYEINNLCE

SEQ ID NO: 148583 - protein, 92 aa, Glycine max
  Coding DNA Sequence Number=SeqID_56898
MTVCILGQDFTRAAAKRRVRIMRTNMTTLTWIWMTLLFSNILPSDYNANLPLQMDRAHKTPSGPKEVQQGPGVYSSGCGPLSVLQGARSPSE

SEQ ID NO: 148584 - protein, 299 aa, Glycine max
  Coding DNA Sequence Number=SeqID_56899
  Gene Ontology: Mol. function=metal ion binding
  Homolog annotation: Hit_ID=A7P3V3; Match level="QueryCoverage=19%, HitCoverage=16%, E-value=6e-11, Identity=54%"; Hit description =Chromosome chr1 scaffold_5, whole genome shotgun sequence
GKGKPFHLGSSVASAKYANAQWMTRRLRILAWTTCGHGHIGLLCPRCGAIGLVREKKSSCMNSPQRLDDHIEWYLGNDRMEGPSLGVWHQVVALSHTPTWQPQLNVRHYLVGESLPLYHGEGLNGVATLSTTTEDGLAYGRRTFRGYLMILDELRSHSAVVQETVARELEEHHSNWTYSKSMVVLDMTWNMAFIVVWAVMLAYTVKDNPNMPIHWDKEFATNLQYDDVNDSDKDDVGTSESSSSSSMSTSCSHTRIACNCPCATSSRLYVDVILTMSGFLDTGHRVWMTLLPGREDKSG

SEQ ID NO: 148585 - protein, 176 aa, Glycine max
  Coding DNA Sequence Number=SeqID_56900
  Gene Ontology: Mol. function=aspartic-type endopeptidase activity; Biological process=proteolysis
  Homolog annotation: Hit_ID=A5CA85; Match level="QueryCoverage=57%, HitCoverage=16%, E-value=3e-12, Identity=39%"; Hit description =Putative uncharacterized protein
MTRGNPGDLQPFDPEIDRTFRRLVRHSVHPDHSVHFEHSEHSVEGDSEYSNFEHSATNFYTENMAQPPPRKRTLREMAAPDFTYESLCIQYLDECVPYVLKTGLIHLLPKFYGLAGEDPLKHLKEFHIVCSTMKPPDVQEDHIFLKAFPHSLEGVAKDWLYYLAPSSIFSWDDLKR

SEQ ID NO: 148586 - protein, 140 aa, Glycine max
  Coding DNA Sequence Number=SeqID_56901
  Subcellular localization annotation: CTP_CleavageSite=14; ConfidenceScore=5.39e-01
LASVAVTLRVTTTPAALNAPLQGASHSPFRLRNCWEGRSGFPSHDVVKRRPVNCNTTHYRANWSSTAVAAALELVDPPGCRNSMEFGDIVVHFNILVGLGSSSPMDSFASWKMNGSGMEKEEREETPLQGEDESRRNSPP

SEQ ID NO: 148587 - protein, 41 aa, Glycine max
  Coding DNA Sequence Number=SeqID_56902
MSHFQEFFKGTSNDSLWWPKVVVDGGGGVVRDWVGVWREKE

SEQ ID NO: 148588 - protein, 126 aa, Glycine max
  Coding DNA Sequence Number=SeqID_56903
  Homolog annotation: Hit_ID=UPI00016621D1; Match level="QueryCoverage =76%, HitCoverage=39%, E-value=9e-09, Identity=39%"; Hit description =UPI00016621D1 related cluster
MTGPLDESISLFLIRVDPWVLVPIFFKGLHVLAIRGLQVLTFRGLQVLTFRGLHVLAFRGLHVLAIRRLHVLVIRGLHVLTFRGLHVLTFRGLPVLTFRGLHALTFRGSCIFTFRGLHVLTSRGLH

SEQ ID NO: 148589 - protein, 162 aa, Glycine max
  Coding DNA Sequence Number=SeqID_56904
LPSPLRGLHVLALRGLHVLTIRGLHALTSRGPHVLALRGLHALTLGTSYPHRERTTRPRLERTTCPHHQRAARPHLQRTTCPRLERATALTLGLHVLAIRGLHALTSRGPTCPRLERGYTPSPWVLVTLTLRGLNVLALRGLHVLTIRGLHALPPEDYTSSP

SEQ ID NO: 148590 - protein, 103 aa, Glycine max
  Coding DNA Sequence Number=SeqID_56905
MAFIIGGASVNATKEDGPSRAKSLGEVATSRRFIYQSLQAACMVSRGGGERDECLFHLGESHDMETCPAVEELLQRFMDCGQLEVSIGGREEPQICMQSEEKK

SEQ ID NO: 148591 - protein, 64 aa, Glycine max
  Coding DNA Sequence Number=SeqID_56906
MIEDEWERVQLDEWRWIQMRSDLRQQQRNQEEQRELKGNLEEGIWESEGVEAETGGDRSGLRLK

SEQ ID NO: 148592 - protein, 114 aa, Glycine max
  Coding DNA Sequence Number=SeqID_56907
MDKSLKDEKDEWRERKRRSTKFCASIEGLLLHLWPNLLGVFYPMPLRGRIASHIPYYYEIELMDKLQWLRQGSMSVEVSRQQMELLLLRVGLREEERTSISRFLSGLNMEVKDK

SEQ ID NO: 148593 - protein, 81 aa, Glycine max
  Coding DNA Sequence Number=SeqID_56908
MHKKRSSASDLIPIDLEINTTCRRHNQERIINFLQDLEAAAIPEEEPQSSEASSSFPIAEHSHLDPSEDYIMAEEPKKSLL

SEQ ID NO: 148594 - protein, 362 aa, Glycine max
  Coding DNA Sequence Number=SeqID_56909
  Gene Ontology: Mol. function=motor activity; Cellular component=cell projection
  Homolog annotation: Hit_ID=UPI00006A16D8; Match level="QueryCoverage =77%, HitCoverage=77%, E-value=3e-14, Identity=29%"; Hit description =UPI00006A16D8 related cluster
MEVSPSEDYMSSPSEDYTGVGIRGRHVLTIRGFHALAFRGLPVLTFRGLHVLLFRGLHVLLFRGLHTLAFRGMDIFTFRGLHALTFRGLHVLAFRGLHVLTIKGQHVLVIRGLHALVLRELHAHAFKGIHFLTFRGLHVLAFRGLHALPSRGGLHVLPCRGLHVLPCRGLHILDFRGLHVLAFRGMDVLTLRGLHALTFRRLYVLPFRGLHALAFRGLHALISRGLHVLTFRGLHALNFRGLHVLAIRGLHALTIRGLHVLDIRGLHVLAFRGLHNLAFRGLQVLTFRGLHRTTRPRHQRIGRPDLKRATRPHIKRTGRPNLLRATRPHLQRTIRPPFQRATSPHLQRATRPRHQRAACPHH

SEQ ID NO: 148595 - protein, 16 aa, Glycine max
  Coding DNA Sequence Number=SeqID_56910
MARHDTCRGLVWLKDN

SEQ ID NO: 148596 - protein, 168 aa, Glycine max
  Coding DNA Sequence Number=SeqID_56911
  Homolog annotation: Hit_ID=Q2HW90; Match level="QueryCoverage=54%, HitCoverage=18%, E-value=3e-10, Identity=37%"; Hit description =Putative uncharacterized protein
MGTNQTGKIFYQVKIKGLDVTSLKELGRLMGPLQMQAFRKAYGKILDLTIAEIFTEVVVSLTQYYDQPLRCFTFGDFQLVPTVEELEEILGCPLGGRKPYLFSGFLPSLSKIADVIRDTARELDHKYLEGKARKSMAETNSVELSGAAIVSSSFEGKRETNHEHIAWS

SEQ ID NO: 148597 - protein, 198 aa, Glycine max
  Coding DNA Sequence Number=SeqID_56912
NILPNDHNSDLPLPKCQLVYAILTRMSVHVAQLIADAIYLFAGMPPTRHPLEPDKSNRALGFPALITGLCQSFGVPVTPSKMIRSPITRAFIEKYCTTRQAQGGDPQAPDAPSPPPQADPAGSFDTERYLRHLVRQQAANHRAHVQTHDCLYQLSLSLQSQGEAPAKATAEAPDDADEARMDEEMTDLLDFLGGSGAT

SEQ ID NO: 148598 - protein, 178 aa, Glycine max
  Coding DNA Sequence Number=SeqID_56913
MFIRITTRVFPPVSVTQNVSMTDVVSAEDDRAKKKAYTDNHSGISARQRDSIVSMTDHTAKKNVYTDNHLGISARQRDSNVSMTDLVIAEDDVNLRVSTGLSAAIDEGRRRDVSLCVLFRLFVLQTAKKNVYTDNHSGISAHQRDSNVQYDRCVSAEDDVNLRVPTGLSAEIDEGGIL

SEQ ID NO: 148599 - protein, 193 aa, Glycine max
  Coding DNA Sequence Number=SeqID_56914
  Homolog annotation: Hit_ID=Q2HTA0; Match level="QueryCoverage=92%, HitCoverage=31%, E-value=2e-14, Identity=31%"; Hit description=IMP dehydrogenase/GMP reductase, related
CNYVHVVYLDAFRDLGQSGGYAWGVAALVHMYNQLDEASRTTTRQIVGYLTLLQAHMKGITGAPYRARCDALTVIDVSWLPYTEHRGVRAFELISSFQSIPPPPVSARLSHDDIDDRWMHFVDHVLAVGELCLVHGQVSADYMERFFRISHPFMIPIQAGDQPRDAPAADPEEYMQPPSPQVPVAFDPPPHAV

SEQ ID NO: 148600 - protein, 113 aa, Glycine max
  Coding DNA Sequence Number=SeqID_56915
LGRIDGDPVLRETRIWATWEYVSSDGGGQQGMETLGDVSGVLLPKTKLDQSRPTPGHSRSVRTCDVPKQASSWQSTDKRKTRPQSKEACGGWPAEAKMVSGNRLPRGVIDYQA

SEQ ID NO: 148601 - protein, 231 aa, Glycine max
  Coding DNA Sequence Number=SeqID_56916
  Gene Ontology: Biological process=transposition, DNA-mediated
  Homolog annotation: Hit_ID=Q6UUU1; Match level="QueryCoverage=25%, HitCoverage=40%, E-value=3e-18, Identity=78%"; Hit description =Putative uncharacterized protein
DLPSQWLLFLSAVPPVQLLTGWCVTAKAPPDISAGKCSGRVPFAIQAAQLLGRAIGAGLFAITPAGERGMCCKAIKLGNARVFPEFDRTNESDCKCCFVAGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 148602 - protein, 106 aa, Glycine max
  Coding DNA Sequence Number=SeqID_56917
  Homolog annotation: Hit_ID=A5C4I3; Match level="QueryCoverage=33%, HitCoverage=14%, E-value=6e-10, Identity=86%"; Hit description =Putative uncharacterized protein
MVAQARAVDMLVETSSSRLWMAARALGVPRHLRAPGVGLWAPHSARLETRTKESDMCASQRASKPGSSESIPVGTPKDGELCPEPGRSQRKLWWRPAAILTCKSFV

SEQ ID NO: 148603 - protein, 92 aa, Glycine max
  Coding DNA Sequence Number=SeqID_56918
MEVEEPWLGLWLPLNYRVDMGSSLAYDNGIWGEPYRLFAAKFLYVGVFWFVLKVVFVIGSAVDRLCGMAVTAWACPSFSPSSFAPVFSFVLV

SEQ ID NO: 148604 - protein, 231 aa, Glycine max
  Coding DNA Sequence Number=SeqID_56919
MKLPFYPELVKAFYSNLEIQEDSLIFEVYGIKMVIDQSLFFELTQLSSDGVPFEGTLDDEWKFDFSVFDARRMVCTNQADMTGRLLAGSLAFECRIMHYLIVRILLPRSSNLAQPFVKVKRSFSIGANVVSYFGYCKERDGSWVKKDALVQATEDRSPSSPPQRDDSSSLMHNILDRLNGLHTFVGESFDLLDSRIDAMDARFAGMDTRITKLEEDVSYVHQCFDLPPPSS

SEQ ID NO: 148605 - protein, 114 aa, Glycine max
  Coding DNA Sequence Number=SeqID_56920
MAVHLIRDRVMMECLEGVWETLEGNERCQFRGTVRLTATSLVSSSEEDPEGDPEELSPEPAMDAPDLPEDDEDPLPNVDSLEDIMPAPEVDSTEESGPRGMANSDDSSSQQKTP

SEQ ID NO: 148606 - protein, 132 aa, Glycine max
  Coding DNA Sequence Number=SeqID_56921
  Subcellular localization annotation: CTP_CleavageSite=42; ConfidenceScore=5.13e-01
WNSYVPINVSFSPKVGPGLPAVPPVQLLTGWCVTAKAPPDISAGKCSGHAARRVPFAIQAAQLLGRAIGAGLFAITPAGERGMCCKAIKLGNARVFPVTTLNSICRKSSWYSLQSDENVSVAQPEWRMGRAL

SEQ ID NO: 148607 - protein, 135 aa, Glycine max
  Coding DNA Sequence Number=SeqID_56922
  Homolog annotation: Hit_ID=Q84VH5; Match level="QueryCoverage=71%, HitCoverage=13%, E-value=4e-34, Identity=82%"; Hit description =Envelope-like protein
MLSQHPNILNYTDSVMKRESPLSLHYKLFEGTHVPDIVSTSGKAADSGAVSKDALIAELKDTCKVLEATIKATIKATTEKKMELERLIKRLSESGIDDGEAVEEEEEAAEEEDAAAEEEADAAEDTESDDSEATP

SEQ ID NO: 148608 - protein, 85 aa, Glycine max
  Coding DNA Sequence Number=SeqID_56923
  Subcellular localization annotation: CTP_CleavageSite=61; ConfidenceScore=5.15e-01
MSSPSEGCTPSPSGGYTSWPLEDYTSSPSEGFTSSPSEGYSPSPSEDSTSPPSEACTPSPSEDYRSSSSKDYTSSPSEGWMPSPL

SEQ ID NO: 148609 - protein, 165 aa, Glycine max
  Coding DNA Sequence Number=SeqID_56924
  Homolog annotation: Hit_ID=A0ST23; Match level="QueryCoverage=15%, HitCoverage=51%, E-value=3e-07, Identity=100%"; Hit description =Putative reverse transcriptase
VPPVQLLTGWCVRAKATPDLNAGKWRVPFPIQAAQLLVSAIGAGLFAITPAGERGMCCKAIKLGNARVFPVTTLNSILGMRLLNSENDEELLFPLVRVNFELGVIMVIAVSFGKPVVPAALMNRPTRGERRFAYWALAECILAYYVGTDEGVSEVLHVAGEKRLH

SEQ ID NO: 148610 - protein, 171 aa, Glycine max
  Coding DNA Sequence Number=SeqID_56925
MTYEDLLPSLIANHLVVVTPGKVLQPPFPKVDRPNVRTNPLANHGGGAVNAVESDRPCRSKPLKDVATPRRFIFEALQKGGVIPHSGHKEDSCLLHSGELHDMETCLGVEELLQRMIDQGRLEVGSEGREEQHICMQSTDGSSVVKPKPLVIYFTKGTASQKPGHPLAAKP

SEQ ID NO: 148611 - protein, 41 aa, Glycine max
  Coding DNA Sequence Number=SeqID_56926
MGTSKGEKRVVVAAQLAQASWVASTRRHHLLLDDPGRPKWA

SEQ ID NO: 148612 - protein, 60 aa, Glycine max
  Coding DNA Sequence Number=SeqID_56927
MSGKAIREILVRWLDDLRQNNKEEVKQKLRRMKPETSLKIKEEVKKQFDIDFLVVVRYPE

SEQ ID NO: 148613 - protein, 294 aa, Glycine max
  Coding DNA Sequence Number=SeqID_56928
  Pfam annotation: Domain name=Transposase_23; Domain location=49-119; Score=11.8; E_value=6.1e-05; Accession=PF03017.5; Description =TNP1ENSPM transposase
  Subcellular localization annotation: CTP_CleavageSite=32; ConfidenceScore=5.30e-01
MTSFSQLQSQMQSQGLVVPPEPLVGPGPSGPRVSTNGSCVDPSGSDPKTGDSDRCGLYIEVDPARLVAVGRVYEGSTLVHNTHLLPGQVKVSVDEIKDADAAVPVPTDEVSLVGQALHTFLAWPTHLVKSLSHQVAVSPPKPPPKPDPEVDDPLYLMTLTIPELFLRPYQVRWDATVFGVVNPDFPLYIKHEDLSEIAHDGRCLSISVLQLWILHLTETCMRAGNSDIYGFLEPQSIQRSGQSQFESESYIKSWMQSSQRDVYLGAYLNGPDNYLKEIINSVIDKKELLSAATM

SEQ ID NO: 148614 - protein, 157 aa, Glycine max
  Coding DNA Sequence Number=SeqID_56929
  Gene Ontology: Mol. function=sequence-specific DNA binding; Cellular component=intracellular; Biological process=response to DNA damage stimulus
  Homolog annotation: Hit_ID=A7MQB5; Match level="QueryCoverage=79%, HitCoverage=22%, E-value=1e-27, Identity=46%"; Hit description=DNA ligase B
MQRSSWQRLLDGGSISHLFSWLTLTPEQIAQAQGISTVRARQIWHRFNLTRQQPLRRWISALGLPLPRTALQALPDTQWSQLLARSADSWQQLPGIGSVLAQRLVMMLQDARLQSLIHFLQQQNIPAQPSVLGVGVIENRQTEAEAQRQQAGEEAEQ

SEQ ID NO: 148615 - protein, 72 aa, Glycine max
  Coding DNA Sequence Number=SeqID_56930
MKSDKASQDIHFISQACSELQNKERETKLKRAIKGINSRKHQQESSQGYCASNQWGKTYQMIMMMDGSNSHK

SEQ ID NO: 148616 - protein, 60 aa, Glycine max
  Coding DNA Sequence Number=SeqID_56931
MSPKRIKVIPEWPTPPSVERRSPEYEEPRDLRSNPFQGGGNDANPIPQRALDRKTPSRLG

SEQ ID NO: 148617 - protein, 368 aa, Glycine max
  Coding DNA Sequence Number=SeqID_56932
  Subcellular localization annotation: CTP_CleavageSite=41; ConfidenceScore=5.41e-01
MVESYKKRKGSSSTTAAAGHRRQGTSRDTTAPIPPSISSPRSSTLFSSDDQRQRYYSQFCNRVILDPKYLDLEFFDGETFDCYQVFQNSALTDFMSLELPYFPELVKVFYNNLKIQDGIIYSEVHNIPIIIDQSLFFSLTKLPNQVVPFEGTLVDDWKFDYSSHDARRMVCNDQADMTDRLLVGSLTFDCLIMHYIIVRILLPRSSNLAQASEEDLILMWAFQTGRQIDWAIWFDIECIRHYEPMHLSLTLNWSLCFSVIFKFRLMMNHFFKSSVPLLLVLVQSFLLDTKNALPPQDERTPSPPPPRDDSALMTEVLSELRGLRTYVGERFDSLDNRFVRMDICLTQLEEDVGYIRQSFDLPPPPPPS

SEQ ID NO: 148618 - protein, 127 aa, Glycine max
  Coding DNA Sequence Number=SeqID_56933
MAASDHAILRDRAHVPTKRSLLELSSQDALLAQNKLLANQLESLTETFTANEVNYMGNQHRLGFNAGGFTSYQQGSNFNQNQGQWRSHPGNQFNKDKGGSSNMPQNQGSSLYERTTKLLETLAQFMQ

SEQ ID NO: 148619 - protein, 376 aa, Glycine max
  Coding DNA Sequence Number=SeqID_56934
  Gene Ontology: Mol. function=unspecific monooxygenase activity
  Homolog annotation: Hit_ID=Q9AVH2; Match level="QueryCoverage=54%, HitCoverage=78%, E-value=7e-61, Identity=56%"; Hit description =Putative senescence-associated protein
LGKPLVEILPPGQLRGFCPLLAWLGSAVLGYGPVLSFGLVGPLLPPVISFVARILPTLACAPLAKSVPRWQNEREPTNGSLFWPNIVEEERDTGLIGEGRIKATRAESQWIVAARPLCHLQYPVAYLSRLQRILPAARWELRFKASRRANPPHEGHQRHVPLGGRGPLLLGKTNLSHDGLNPAHVPYWWVNNPTLGEFCFTMIGRADIEGSKSNVAMNAWLPQASYPCGNFSDTSSFKFRRTKGSIGHAFTVRIRTGNQNQTSFYPFVPHEISVLVELILGHLRYLLTDVPPQPNSPPDNVFRPDRPAEADLGSKKRGSAPLPIHGITPTYPTPLKSFHKVGLESSSTGSSFPADSAKPVPLAVVSLDSRQGQWES

SEQ ID NO: 148620 - protein, 138 aa, Glycine max
  Coding DNA Sequence Number=SeqID_56935
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=62%, HitCoverage=72%, E-value=2e-24, Identity=68%"; Hit description=LacZ protein
MKHFTDTLISANIASNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 148621 - protein, 109 aa, Glycine max
  Coding DNA Sequence Number=SeqID_56936
MSCIVCRDRARKTPSEPEEGQQGLRVASSKYGFLSVLGSACHPQQVLCPQAGAGRNTTATLGWPVAGIRHTATTSRVHLSSSTKRLECCLRHMADQQATKSKAKDKQKY

SEQ ID NO: 148622 - protein, 150 aa, Glycine max
  Coding DNA Sequence Number=SeqID_56937
  Homolog annotation: Hit_ID=A5C169; Match level="QueryCoverage=86%, HitCoverage=11%, E-value=8e-07, Identity=25%"; Hit description =Putative uncharacterized protein
MVYNDHADMTGRLLAGSFTIKCRIMHYVLCRVLLPKSTNLAQVSEEDSILLWAFQTGRQIDWAHLVRYRVHKALWANAPLLYPHLVTLFLQHFNVPLKDEPFVKVKRSFAIGVGAVTSFGYRKNMDGQWVHKQDLPPLIPNECTPSPPPQ

SEQ ID NO: 148623 - protein, 37 aa, Glycine max
  Coding DNA Sequence Number=SeqID_56938
MGYEMRKPQFETKLLAMRTEFPQAADWLDQIPKSKWI

SEQ ID NO: 148624 - protein, 243 aa, Glycine max
  Coding DNA Sequence Number=SeqID_56939
MRIMRTSMTTLTQTWMTLLLSNVLPSDHNSDLPLPKCQLVYAILTRMRVHVAQVIADAIYLFTGMPPTRHPLDPDKSNRALGFPALITGFCQSFGVPVTPSKVIRPPITRAFIEKYCMPRQVQGDAPQAVDAPPPPHQGDPAGSLGMERYLQHLLRQQATNHWGQVQIHECLYRFSLSQQGQGFTPFACPTPEQFGAEVAWPEDWPEAQAGEAPTGSPGDAEEARMDEEMTDLLSFLGGSGAT

SEQ ID NO: 148625 - protein, 44 aa, Glycine max
  Coding DNA Sequence Number=SeqID_56940
MPPIVVMTLEGIGHILDLTPIGEKRKESLRRLTLTSHTSKGRTM

SEQ ID NO: 148626 - protein, 74 aa, Glycine max
  Coding DNA Sequence Number=SeqID_56941
MSGPEGGRLLVAAPNRKLLNMTACGSLDWLSEETSLRVAGRGAVGEGFICDDQLVLRVLVGPRHTDIFAGYVDC

SEQ ID NO: 148627 - protein, 199 aa, Glycine max
  Coding DNA Sequence Number=SeqID_56942
  Homolog annotation: Hit_ID=A5BSR3; Match level="QueryCoverage=57%, HitCoverage=31%, E-value=8e-11, Identity=35%"; Hit description =Putative uncharacterized protein
MATRLVGAERPLVHVDPATRKADGSHRKKLRTYLGIITRDKDVQKKAQTIQKQNTALHVLSLRGYEYLENKLMDKKRKRKLEEVAQSRSTDTVINPPSPIRRHAKWKMARTKKTSQMMSEATKEIAEKIDSLEEEASQGSFVAHGRQDVLTTAIGQPEHPGLVRVVEAGLTIKQYFGPAPRTSNTSSSMTPEDLEQLTQ

SEQ ID NO: 148628 - protein, 119 aa, Glycine max
  Coding DNA Sequence Number=SeqID_56943
MSGFTHDSPQFSASPHQLDLAPYASGPYNAQWNAPGLLHDKHTLRSSRILGEMEVDEPWLGLSRCKIHFLVGVLVYAKGGVCHWKCSSNDIVGLVGNMAVLEWQSQHGLLLHPHPLHLP

SEQ ID NO: 148629 - protein, 155 aa, Glycine max
  Coding DNA Sequence Number=SeqID_56944
MAEEQPRRVTLEDYSSIAVPQFFTSIARPERSQEVAAFIQRLHVVLFVVVLMSQAAVFPLRIMHMKLTTWETNLDKILMQVDSQDFSRAKIITSSMDSGELILVSISNHKSPESATKNLEIQVGQLAKQIANTSSNKFGANTENNPKEECKAVMT

SEQ ID NO: 148630 - protein, 73 aa, Glycine max
  Coding DNA Sequence Number=SeqID_56945
KKSEAGPAQHVRHALSVQGSTGAKRGVKLEDAESITRAKRGPHAKRAIQQKHTLSLQLTLSARSKRAKREVSR

SEQ ID NO: 148631 - protein, 104 aa, Glycine max
  Coding DNA Sequence Number=SeqID_56946
MGSYIAHGPKIYPKAHENPRAFSCISDSIFLESSIQCPWGLSLAHQWAKRASSAKRSFSALSATEEFGRASISSPRAKHEISALSVVVVFNQAQRTAGTKLKST

SEQ ID NO: 148632 - protein, 114 aa, Glycine max
  Coding DNA Sequence Number=SeqID_56947
MITKGDDKNLKGQSKNEFKMFKIESRTLQDSRGKLKNTSRFKRKVEFKNQESRFKDQASRIKIKIQESREDLIKISMKRFFQKLSSTWIFLKTCLPKSFYPLVIDNQIVVIDYQ

SEQ ID NO: 148633 - protein, 184 aa, Glycine max
  Coding DNA Sequence Number=SeqID_56948
MAYNASSKENQNVMNSQEIDVAKSYSIEKSQGTLELELYNQGEAEKGANLDNLLMQFRETTESTQLAFTSVEIQVARIEEDLVETEAQEEIPTKEHGLREKDEMKGKEKAQQWEEYLQQDIQQESMLQINTLPHQLIVKKQRHGEQKRALSVFLSQITNPSSAMSWHTIPKYMKFMEFLAKKWN

SEQ ID NO: 148634 - protein, 71 aa, Glycine max
  Coding DNA Sequence Number=SeqID_56949
MASYGGEWHLQSSFFLHHSGYIDIKEAKDSIDEEDPRPTSSTWSYIMQYQEHLRLGDVLLLPLSFCLVNSL

SEQ ID NO: 148635 - protein, 92 aa, Glycine max
  Coding DNA Sequence Number=SeqID_56950
  Pfam annotation: Domain name=zf-CCHC; Domain location=20-37; Score =31.8; E_value=2.4e-06; Accession=PF00098.14; Description=Zinc knuckle
MERSHNFNNEKRSQEVSPTLKCYKCNQLGHIKANCPSNESWLEKNEKKSYKERRSKKVYIAWDDNDSSDGSEKEINLLSKDYESDENISQEF

SEQ ID NO: 148636 - protein, 127 aa, Glycine max
  Coding DNA Sequence Number=SeqID_56951
  Homolog annotation: Hit_ID=UPI00006A2D9E; Match level="QueryCoverage =98%, HitCoverage=76%, E-value=6e-11, Identity=16%"; Hit description =UPI00006A2D9E related cluster
GLHALAFKGLHALTFRGLHVLTFRGLHVLTFKGLHVHTFKGLHAITFRGLHFLTFRGLQVLTFRGLHVLAFRGLHAFAFRGLHVLAFRGLHVLAFRGLHALSFIGLYALAFRGLRICAFKELKILSP

SEQ ID NO: 148637 - protein, 127 aa, Glycine max
  Coding DNA Sequence Number=SeqID_56952
ELKLRRAERDQLRVEGMILEDKLKACQRSKRSLSDQLSKMEENMGAIIDQYKEKLSLAATHEQKLENEYAKVSVLFAFTLNGSQELPRLLAKAKAMADVYSAPEEVHGLLDYCQHMIDQMAHIIRSH

SEQ ID NO: 148638 - protein, 390 aa, Glycine max
  Coding DNA Sequence Number=SeqID_56953
  Gene Ontology: Mol. function=protein kinase activity; Cellular component=chromatin; Biological process=protein amino acid phosphorylation
  Homolog annotation: Hit_ID=A2Q378; Match level="QueryCoverage=100%, HitCoverage=24%, E-value=1e-95, Identity=45%"; Hit description =Putative uncharacterized protein
  Pfam annotation: Domain name=DUF889; Domain location=247-390; Score =102.8; E_value=1.1e-27; Accession=PF05970.5; Description=Eukaryotic protein of unknown function (DUF889)
MNKPEQVWEKTWHWLSDDIVYSHCRSLNTPGLHIDDSNLMNLVLLEVEQLLQANQRSLKDYPSMSYPENANLLTHADNDLILSELNFNNEELRSEFLNLFSQMTDQQAKIYNQIIQAVNKNEGGMFFLYGYGGTGKTFIWKTLAASLRADNKIVIMVASSNIASLLLPGGKTTHSKLKILVPIFEDSTCNIHQGTQLAELLNETSLIIWDEAPMAHKFCFEALDQSLRDVIKAKSSSDKIFGGKVMVFGGDFRQILPVILRGSRSDIVNATINSSYLWNHCHVLTLSKNMRLEANTDATDREETTAFAEWILNIGDGIAGQQNDGYGSIEIPKDLLITEYDDPLSTIVNSTFPNLSHHHTNPEYFQTKAILASTNETVQRINDYILSLIP

SEQ ID NO: 148639 - protein, 136 aa, Glycine max
  Coding DNA Sequence Number=SeqID_56954
  Subcellular localization annotation: CTP_CleavageSite=75; ConfidenceScore=5.64e-01
MKDCKNTSGKDVSFTSRISQSLTNSSQAVKPAPASSSGGLVRAHALSARMDRLAHVSDFGLSVPFSLSGLTEVPRSVALSGLLAKPVDWLSEKTTVVLGALISRLVCIHHIDALLDSSVALSALKLRLAVDERLAH

SEQ ID NO: 148640 - protein, 75 aa, Glycine max
  Coding DNA Sequence Number=SeqID_56955
MASSTTITMQALKAKLKKTRVVKEKLKTTFTRVRKECDELKDINMTMVEALEWETKRARKEEWSKKKFRGALWGS

SEQ ID NO: 148641 - protein, 68 aa, Glycine max
  Coding DNA Sequence Number=SeqID_56956
MGEMLATQLAQASSARPGELGCFLQKQPPSGGIYWKAQNFTDCDTMLSFDFRHVTELHELPNDGCQVP

SEQ ID NO: 148642 - protein, 92 aa, Glycine max
  Coding DNA Sequence Number=SeqID_56957
MGSQDCLKAYENSKIYKEKVKRFHDSMILRKEFHIDQKVFLFNSCLKLITVTGKVFKVNGHQLNLFHEGPQVEEECVADLSLVLPILCHDVP

SEQ ID NO: 148643 - protein, 243 aa, Glycine max
  Coding DNA Sequence Number=SeqID_56958
  Homolog annotation: Hit_ID=A5C2P6; Match level="QueryCoverage=56%, HitCoverage=17%, E-value=1e-10, Identity=36%"; Hit description =Putative uncharacterized protein
MEASSGKYSYGQGNPFELEISQQLTHKSENHEQTSHALDIQSERKLSSSIVQNFDPMKASQLGYLTVKPGKEKGIRRKRKSLGAKLVALSKVSSSQSGNSTPSSPLSPTPSATPKCNWPMSLDKGQPPEALSSMTQVATQHSANDQASATVVVSNILKPASTQRCANNCGKATKVIDNYEGFAISRTMQQLKEEVVRQFQRGLLHPFLTQAVCDSHTNLNGGLSGTMRRRGQAGGDRSFEPER

SEQ ID NO: 148644 - protein, 174 aa, Glycine max
  Coding DNA Sequence Number=SeqID_56959
MPPTRHPLDPDKPNKALGFSALIMGLCQSFGVPVTPSKVIRPPITRAFIEKYCMPRQAQGDAPQAAGALPPPHQANPTGSLGMERYLQHLVRQQAANHRGQVQIHECLYQLSLSQQGQGFAPFACPTPDQFRAEVAWPRDWPEDQTEEALAGAPDDAEDARMDEEMTPLSTIKR

SEQ ID NO: 148645 - protein, 89 aa, Glycine max
  Coding DNA Sequence Number=SeqID_56960
MDFEICPIMQKIAVKFVQQNFCSCVENACALLVMGKLVGVDGDPVLRGTRIRATWEYVSSVEGGQLGMVGSCLICESGRVDLRHRPIAT

SEQ ID NO: 148646 - protein, 58 aa, Glycine max
  Coding DNA Sequence Number=SeqID_56961
MAFGGPKARPGELRLSHEVTGSPRQAGYLTWKSFGGLGKLGASLVRLARIKTSVNDSP

SEQ ID NO: 148647 - protein, 102 aa, Glycine max
  Coding DNA Sequence Number=SeqID_56962
MATMMEAMMSMKKIMEVNAAVVAITSAVAEVDPAPPSGLNQINHPISDMHAFPSYGLPPNYTPPNVVHTPNENVNDSTPILIESQQPQSDHAPIPQPMGGDT

SEQ ID NO: 148648 - protein, 75 aa, Glycine max
  Coding DNA Sequence Number=SeqID_56963
MELIQNMAASDHAILHDRTQIPTKRSLLELSSQDALLAQNKLLSKQLETLTETLSKLPNQLQVGGCSILLVDEYN

SEQ ID NO: 148649 - protein, 76 aa, Glycine max
  Coding DNA Sequence Number=SeqID_56964
MAAEWRRKRERRIHFKEKMSLEEVHHHRRPWIRAWRKKEMNEGRGREQHEILCSKRALKSKPTNPRSSPRLSTKCA

SEQ ID NO: 148650 - protein, 99 aa, Glycine max
  Coding DNA Sequence Number=SeqID_56965
MVHIEKLSKNMCSLGKDRREKVSIGAWRPKIFFINRFLCFLEDEWQQNGERERERRRHFKEKMSLEEAHHHRRPWIRAWRKKEMNEGRRREEHEILCSK

SEQ ID NO: 148651 - protein, 88 aa, Glycine max
  Coding DNA Sequence Number=SeqID_56966
MESKRVGKKKTNTQEFLYWFGNNPSLPPGPKRPAVLEISFNLWMYPPLELIHKRCTLSCSQSNPSRCTLYLYHKGCTLQCVKTKITGC

SEQ ID NO: 148652 - protein, 36 aa, Glycine max
  Coding DNA Sequence Number=SeqID_56967
MTPTSLRRLGGSLSESYSLHLATVILLPRTRFVIIT

SEQ ID NO: 148653 - protein, 381 aa, Glycine max
  Coding DNA Sequence Number=SeqID_56968
MEANLRLRASAKRNTPALSARKNSEEDELYRFAKRTASVHPLSEKGVLSQKSLTLDWDSELCMSRVSRERKVQVPKSFERFCCVKICRDQILKQEPASWYGKLNPLLDLPCRAELLCFHEELGCDKLVEYVCLNAVLVEFSLTRGIYGRCLIRIRLNYHEESGSPSVRYSVLTVLYYLCDPVHLPESRTVVLMLAKNSVKEGSPFFISISKTPPNTMEEFLKRTKTNKPPKSDERLTYKTKLRYDEYTPLNASQGRILNEIMNVKLQDVSLDVKKRITDLDMTDHIAMNNAKGQEVTTVTRDKVVLENARQDINIKLQKGRQKLIYRPFKQCVKEARKGSLNRYTWQKTPTFDLRQQGYGHADFEYPESCNLDSSFGHEVP

SEQ ID NO: 148654 - protein, 74 aa, Glycine max
  Coding DNA Sequence Number=SeqID_56969
MGHSANSEVAKLPFSNSSSGNFPEKFFPELFRKNLLPEEEFVSSGSTHRQLPEERHPECFRKKLLPESVGGPVK

SEQ ID NO: 148655 - protein, 140 aa, Glycine max
  Coding DNA Sequence Number=SeqID_56970
  Homolog annotation: Hit_ID=A7Q9A6; Match level="QueryCoverage=47%, HitCoverage=9%, E-value=2e-13, Identity=65%"; Hit description =Chromosome chr19 scaffold_66, whole genome shotgun sequence
MSIWHTSVHVSNPMWQNGEFVPPEKPVMMSRRSEIENREIAGERWKKGEAERGEFVSGKWRKEELLLVAKIRQSATESPNPKPEVGEIDTSPPFQSVKDAVSLFGEGAFSGEKPIFKKAKPYSAEETLDSVNSAYLLSLS

SEQ ID NO: 148656 - protein, 367 aa, Glycine max
  Coding DNA Sequence Number=SeqID_56971
MVQKAIDKGRLKFKEKPMKVDTNPFHIQANYIEPMQIMMMGALIGTPKMSTPLSKEEGNEGSSSRFKAFEVSDLELRRGGTTEGSKKGFYEYRNSPWVNRNMSITQWRRHQRMTRDAILEMQQRNDSLEAIYGVIWILPAEYAEDDQNRHILRDYVKEDYFDDPCLRPKNATVFDPPSDDMSYHMKSLHLTTMVEDQVINKILVDGGDAFNILPRSMLWRGVICLDVSIGSRRRPTMLLKLFFWNKDGKLEMVEAGSGQVVARTALFKVEDSFYVNNKVMTSLEAYSNYMARLSAYIIDNKKQAATTTVENKEITIAVVEIGETSTETVEIKEKMDIKAIERSIEIERKMDTDAIEEKKKMLDKKEK

SEQ ID NO: 148657 - protein, 122 aa, Glycine max
  Coding DNA Sequence Number=SeqID_56972
  Subcellular localization annotation: CTP_CleavageSite=41; ConfidenceScore=5.86e-01
MGSPPASTPPPLPPPSPPSPPPPPPTSDASASPSAVKRTCKASRLRSLSTRPPGAERPVVHVDPATGKVDGPHRKKLRTYLGIVVRDKVDITYENWKEVPTAQKNLIWEDIQADLISQRLLT

SEQ ID NO: 148658 - protein, 145 aa, Glycine max
  Coding DNA Sequence Number=SeqID_56973
  Subcellular localization annotation: CTP_CleavageSite=3; ConfidenceScore=5.05e-01
MMKDAIYGHNSAVPRLHFQLSSSLPQLLTFFFSATGCPFHLHLHGYLQKRAKRCRQICPSVLMITMMTTKDDDKGDEQKAQRSKNNSSESKNISSESRTSQEFKNQEEFKTQEESLESRIMIQDSRSQESRSRSRFKTQDSRMKK

SEQ ID NO: 148659 - protein, 113 aa, Glycine max
  Coding DNA Sequence Number=SeqID_56974
MVEPSKKRTGSSTRSQRHSEAQETQIPSSISSSSLFSSEEQRIRYTNLFSSHSIIDPKFIDMDFFSNESFERIQAFQNSNLIPFMSLKLPVYSELVNAFYSNLEIQENTLISE

SEQ ID NO: 148660 - protein, 455 aa, Glycine max
  Coding DNA Sequence Number=SeqID_56975
MTPLPRPQSALGREALIKKGRVEDLSILHKFVRFHLMENLPFNLPHTIYINILRNPKGLGGVDDIYYVALINNMLWDQRVFHVFEKMDNDSKHTVITKAEEKSIPQRLIDLSETIDDKEEMHKLFSRSESNKESVASSSSGNESFEGSHVSPLRKRPFSTPKQCPTPSPIHLENPSTKVTPAIAWRNLQKYKDKRSTQNNIPKDLFEKYRRDPSQEVEPLKNYSMLGGPHAQMYIRNKASVYQPGLYISKATEIKVVVDMVSIWDTAKKKGFKLYYNKEMPSRKVKVELTYHFGDACACFTKDANNYTFIKCLMSLPIVQHKTTYDLSKMDKHEVIDHVTKLHDTQKEKKDEEVELAATTTKGKFAFIQVEAFAKTMDNNIVHEVIIDLTNTGVMDKTPKACNAALADKDQMTMLGAIVALIPILASAPAPSPLKPIPLPPPSSPPPSQPPPPPQ

SEQ ID NO: 148661 - protein, 260 aa, Glycine max
  Coding DNA Sequence Number=SeqID_56976
MKKKKQATTKPSGEFSSIDSPSPEKPLVIDSMARRGGEGNIPAMRTLGDYAYQQGPKHYNKIVIPPFSNKGCSTMGASDEDAEAIYLRAFLFFLADSSVQNQPLLLFPKGLMNLFVKHGRDLSLHCEGTMMSKGPEEAILIINSIATSDYQSHHDRALIQRKEEAHYLQNQTRPHQNFQGNYQGYKGPSNNFDAGPSNTGPQQQQQAQLDRMAGLTGALSKGGKMRGVATNVDKSGAFAPTYPPLERKSDLRSSSLCVDQ

SEQ ID NO: 148662 - protein, 139 aa, Glycine max
  Coding DNA Sequence Number=SeqID_56977
MAVRLLPAAGHPQAAVVFCPEPAWRRSPCWRAGNPGPCWTSPGPLGVFVGAIPANNRWGRLALWSPGRMLLNSNVIHVRVVMLVRMVRTHLFAAARGKSCPGMHSRCVIASLSGCARTIGRSLISGGGPGTDKRKLLAP

SEQ ID NO: 148663 - protein, 168 aa, Glycine max
  Coding DNA Sequence Number=SeqID_56978
  Gene Ontology: Mol. function=amino acid binding; Cellular component =membrane; Biological process=pathogenesis
  Homolog annotation: Hit_ID=A6VC28; Match level="QueryCoverage=95%, HitCoverage=68%, E-value=8e-63, Identity=74%"; Hit description =Putative uncharacterized protein
  Pfam annotation: Domain name=MgtC; Domain location=10-140; Score =183.2; E_value=6.7e-52; Accession=PF02308.7; Description=MgtC family
MDWKIFLLRVTVALILGALIGSERQLRQRLTGLRTNALVSTGACLFVLMTQSVPGIAADASRVAAYVVSGIGFLGGGVIMRDGLNVRGLNTAATLWCTAAIGVLCSMGLLLEAGIGCVVILCANILLRELAQGINRQSIITAEDASQYYKVQIICLAADECSAQPDAA

SEQ ID NO: 148664 - protein, 1014 aa, Glycine max
  Coding DNA Sequence Number=SeqID_56979
  Gene Ontology: Mol. function=oxidoreductase activity; Cellular component=integral to membrane; Biological process=electron transport
  Homolog annotation: Hit_ID=Q8X6J4; Match level="QueryCoverage=71%, HitCoverage=99%, E-value=0.0, Identity=71%"; Hit description =Putative xanthine dehydrogenase yagR molybdenum-binding subunit
  Pfam annotation: Domain name=Ald_Xan_dh_C; Domain location=319-423; Score=90.0; E_value=7.7e-24; Accession=PF01315.13; Description =Aldehyde oxidase and xanthine dehydrogenase, ab hammerhead domain
  Pfam annotation: Domain name=Ald_Xan_dh_C2; Domain location=430-950; Score=512.7; E_value=4.3e-151; Accession=PF02738.9; Description =Aldehyde oxidase and xanthine dehydrogenase, molybdopterin binding domain
  Pfam annotation: Domain name=FAD_binding_5; Domain location=1-202; Score=291.3; E_value=1.9e-84; Accession=PF00941.12; Description=FAD binding domain in molybdopterin dehydrogenase
  Pfam module annotation: Pfam domain module=Ald_Xan_dh_C::Ald_Xan_dh _C2::FAD_binding_5; Domain location=319-423::430-950::1-202
MQHPGARFIAGGTNLLDLMKLEIETPSHLIDVNGLALDSIEPIAGGGLRIGALVRNTDLAADARIRRDYAVLTRALVAGASGQLRNQATTAGNLLQRTRCPYFYDVNQPCNKRQPGTGCAAREGFSRQHAVVGVSEACIATHPSDMAVAMRLLDAVIETVSPDGSQRAIPIAEFYCAPGDTPHIETVLQPGELIVAVTLPAPLGGTHIYRKVRDRASYAFALVSVAAVILPEGGGRVAVGGVAHQPWRSAAADAELPHGAQAVCDVLFADAPHARLSDRGSEEQRMKFDTPATANPIDRQRVVGQPLARIDGPLKTTGSAHYAYEWHAEAPDAAYGYVVGAPVAKGNIISIDTHAAAQAPGVLGIVTGVTAGKLNKAERNTATLLANNKIEHYHQAVALVVAETFEQARAAAQLVKVNCQAETGAYDLEAAQPEVTTSPEGEPDKTLGDVDAALHSAAFTLDATYTTPDQSHMAMEPHASMALWQDDHLTVWTSNQMINWCHTDLAHTLDMPMEKVRVLSPYVGGGFGSKLFLRSDALLAALGARAVGRAVKVMVPRPMIPNNTTHRPATRQRIRLATDAHGHLTAIAHESWSGNLPGGTPETAVQQTELLYAAANRLTGLRLAELDLPEGNAMRAPGEAPGLMALEIAMDEMAAIAGIDPVEFRIINDTQVDPLHPERFFSRRQLVQCLRTGASKFGWAERCAKPGQRREGRWLVGMGVAAGFRNNLLAPSAARVQLDAQGTITVETDMTDIGTGSYTIIAQTAAEMMGVPIEQVSVRLGDSAFPVSAGSGGQWGANTSTAGVYAACVRLREKVAAQLGLDAESAEFADGHIHANGQRLPLTAAGPLMAEETMEFGDLDKTFQQSTFAGHFVEVAVDSATGEVRVRRMLAVCAAGRILNPKTARSQVIGAMTMGLGAALMEELAVDTRLGYFVNHDMAGYEVPVHADVPEQEVIFLDDTDPVSSPMKAKGVGELGLCGVGAALVNAVYNATGVRVRDYPVTLDKLLAALPDQP

SEQ ID NO: 148665 - protein, 267 aa, Glycine max
  Coding DNA Sequence Number=SeqID_56980
  Gene Ontology: Mol. function=hydrolase activity
  Homolog annotation: Hit_ID=A7MRM2; Match level="QueryCoverage=98%, HitCoverage=84%, E-value=7e-96, Identity=64%"; Hit description =Putative uncharacterized protein
  Pfam annotation: Domain name=Lactamase_B; Domain location=72-238; Score=25.0; E_value=0.00029; Accession=PF00753.18; Description =Metallo-beta-lactamase superfamily
MITICTACGTSYQQQQPALTQCRICQDERQFVPPGGQQWIDQSALRASHQNQWQQLAPGLLSLQTVPDFAINQRAFVLQTPHGNILWDCIAHLDDATVTLLRALGGLHAIAISHPHYYSTMQDWADAFDAPVYLHASDSEWIMRASPRLQPWHGDSCDLLPGVRLLRLGGHFAGGTVLHWAHDGGVLLSGDILQVTPGASAVSFMWSYPNMLPLAGATVAAMLQRLQGVKFTRLYGAFAGREILARADEAVQQSGRRYLACLQHPQP

SEQ ID NO: 148666 - protein, 110 aa, Glycine max
  Coding DNA Sequence Number=SeqID_56981
MDGILISSVVLLADSRFTRPDMGFHPTKLNFVPSDADEAPLDVSICLHAFGIVGVWVRLVVSSLANVRVLTIGSCVAYLPNGIRVASQTHSIQASLLGTLEDFKVPHVNH

SEQ ID NO: 148667 - protein, 75 aa, Glycine max
  Coding DNA Sequence Number=SeqID_56982
MRRVSSKLRYDFEILNGENVRNWVANMILKFHDNPTVNGFEIVVFLRQVWWAAGKRKGFERRGKTKMKPKRRQLT

SEQ ID NO: 148668 - protein, 77 aa, Glycine max
  Coding DNA Sequence Number=SeqID_56983
MGTISKIVMDNHSWCYPACIQCHRKNDIQTGPFTCGCGKDNDQPVMRYRVEVMDGDLDLNASPQALDKLLGYVLAFK

SEQ ID NO: 148669 - protein, 110 aa, Glycine max
  Coding DNA Sequence Number=SeqID_56984
  Subcellular localization annotation: CTP_CleavageSite=53; ConfidenceScore=5.88e-01
MGSPPASTPPPPPPPPPPPSPPPPTSDASASTSAMKRTRKASRLRSLSTRPPRVERLVVHVDPATGKADGPHRKKLRTYLGIVARDKVDITYENWKVVPTAQKDLIWEDI

SEQ ID NO: 148670 - protein, 267 aa, Glycine max
  Coding DNA Sequence Number=SeqID_56985
MASSEVISWMAKNSHARENFEAPEEDEEVRALKLELGKARLAKEKFKSAATHIWKECTELQEENAATARVLEQETKRTRKEEYGREKFRGVLWGSNNELKLRREERDRSRVHGMILKEELVACARSKRSLAQHLEATEQSMLAIIGQYKEELNQSVAHEQKLVEDFAQVYAEKEARGRVIDALHQEATMWMDRNFIITKKAQRYPYNTRSRKMDNEEGVQEQMKADLSALKDQMASISEVMLKLQKTIEDKAKANASSTAREAEPVL

SEQ ID NO: 148671 - protein, 124 aa, Glycine max
  Coding DNA Sequence Number=SeqID_56986
  Gene Ontology: Biological process=transposition, DNA-mediated
  Homolog annotation: Hit_ID=Q1J7G7; Match level="QueryCoverage=24%, HitCoverage=42%, E-value=2e-10, Identity=100%"; Hit description =Transposase
GHQDLFILRSDLPSQWLLFLSAVPPVQLLTGWCVTAKAPPDISAGKCSGHAARRVPFAIQAAQLLGRAIGAGLFAITPAGERGMCCKAIKLGNARVFPEFDGQLSRPNQPQMQGLGAKRLRLAA

SEQ ID NO: 148672 - protein, 84 aa, Glycine max
  Coding DNA Sequence Number=SeqID_56987
MTTLTQTWMTLLLSNILPSDHNSDLPLSKCMPPTRHPLDPNKSNRALGFPALIMGLCQSFGVPVTPSKVIRPPITQAFIESDAA

SEQ ID NO: 148673 - protein, 141 aa, Glycine max
  Coding DNA Sequence Number=SeqID_56988
MKWKIGRTKKTDRMTSEAAKEIAEKIERFIGGAGLTWFLCRPWTLGCTDCCHWATRTRWSCACCWSRCHHQAILWTDSKDLLHVFLHGSRRPGVANATNQGPAGGVDHIKSDSTANIILQPDAIPVLVTDAITWTRTASRA

SEQ ID NO: 148674 - protein, 175 aa, Glycine max
  Coding DNA Sequence Number=SeqID_56989
  Gene Ontology: Biological process=entry of virus into host cell
  Homolog annotation: Hit_ID=P03749; Match level="QueryCoverage=74%, HitCoverage=11%, E-value=3e-68, Identity=97%"; Hit description=Host specificity protein J
MGHTEGGEGREFPAPSDRNSGRRQLTVRAVNAWGQQGDPASVSFRIAAPAAPSRIELTPGYFQITATPHLAVYDPTVQFEFWFSEKQIADIRQVETSTRYLGTALYWIAASINIKPGHDYYFYIRSVNTVGKSAFVEAVGRASDDAEGYLIEFLQPGGSTSSRAAATAVELQFAL

SEQ ID NO: 148675 - protein, 168 aa, Glycine max
  Coding DNA Sequence Number=SeqID_56990
TLLPPLAILLSCHSHPFSPKDHSLGYSRLEWGSFVILFFRYLCLSFNICGLCRQVRRCDHATAACHATQPHDIGYLGRQRADVGGFFLPIAWRRIPPWDCVAVLVWKRNKFNYQWVSRRLGSSVSGEIYHQRLRPSKTSLICGLHTYMLLFTPLIVDFQPASVYHLLQ

SEQ ID NO: 148676 - protein, 81 aa, Glycine max
  Coding DNA Sequence Number=SeqID_56991
  Gene Ontology: Mol. function=aspartic-type endopeptidase activity; Biological process=DNA integration
  Homolog annotation: Hit_ID=A5BCY8; Match level="QueryCoverage=74%, HitCoverage=6%, E-value=1e-19, Identity=68%"; Hit description =Putative uncharacterized protein
MDVQLRQGLISQMKGNWTLEVSNYFIGYSERSRGYKFYDPKLKTIFETGTATFFEDIEFGGKNKEYEKNNGMMEDDPVNFH

SEQ ID NO: 148677 - protein, 95 aa, Glycine max
  Coding DNA Sequence Number=SeqID_56992
MEIFHMKVKLWLINFLCPKEEEEETKTSSSEIYDENLNLIQQDDQLSSTDDDDGQVNTLTREQDLLFEAINSIPDPQEKKVFLEKLKKTLEVKPR

SEQ ID NO: 148678 - protein, 107 aa, Glycine max
  Coding DNA Sequence Number=SeqID_56993
  Subcellular localization annotation: CTP_CleavageSite=60; ConfidenceScore=5.47e-01
MHTQSFTIPHFPKIGLTHKNNPQWSRQLPQPTLLRASEARLTGVSSKGGKCAESPPTFICGKRQKNQRKPVMKNIPDSGVVFTFEEGRQKRGSYSYVPSIEEEIRPT

SEQ ID NO: 148679 - protein, 126 aa, Glycine max
  Coding DNA Sequence Number=SeqID_56994
  Gene Ontology: Mol. function=metal ion binding; Biological process =histone H3-K9 demethylation
  Homolog annotation: Hit_ID=A7Q7J4; Match level="QueryCoverage=82%, HitCoverage=9%, E-value=1e-14, Identity=43%"; Hit description =Chromosome undetermined scaffold_60, whole genome shotgun sequence
MVNNSSSTINALDRQSSVEVMEQEGGLCDGIEVDQFHQPSGSNEVAIANEDGISYGSELIEVDKVKINQGDLLFGGDASDGALWDIFRRQDVPKLQEYLKKHFREFRHVHCCPLKQDWVKDQAANN

SEQ ID NO: 148680 - protein, 34 aa, Glycine max
  Coding DNA Sequence Number=SeqID_56995
PRSEEEQLILAKRIFQGREIVEGFFDGLSQMTPM

SEQ ID NO: 148681 - protein, 279 aa, Glycine max
  Coding DNA Sequence Number=SeqID_56996
  Gene Ontology: Mol. function=transferase activity, transferring phosphorus-containing groups; Cellular component=membrane; Biological process=two-component signal transduction system (phosphorelay)
  Homolog annotation: Hit_ID=A1G173; Match level="QueryCoverage=97%, HitCoverage=57%, E-value=5e-86, Identity=97%"; Hit description =Sensor protein
  Pfam annotation: Domain name=KdpD; Domain location=1-138; Score =247.9; E_value=2.2e-71; Accession=PF02702.8; Description =Osmosensitive K+ channel His kinase sensor domain
MDLDAVLARHPALVLVDELAHRNAPGSRHERRWQDVMELLDAGIDVWTTVNIQHLESLNDVVMRITGVRVSETVPDGVLDRLHDIVLVDLPPRELIARLQQGKVYVPEQAAQALQAFFSPANLTALRELAMQEAADRVDSSLREARAARGESNLPVPARGVLVAVDGGGIRVNTWCRQPPCAWQAHRQRRRRGRRGGAGATPLDRPWTAGVRSSAIPHLAAPAWDTIGRRRLGAAPRIQLPCGRFTDTLAGAQWWFLPLLDGEDRAIGVAGCTARRAAC

SEQ ID NO: 148682 - protein, 72 aa, Glycine max
  Coding DNA Sequence Number=SeqID_56997
MAILIANTSTTFHRDERLGNTHAMHGKFKKTIWIFQLPTTKDETHIQRMCDGMMQMRKSATGGFTQHGNILK

SEQ ID NO: 148683 - protein, 209 aa, Glycine max
  Coding DNA Sequence Number=SeqID_56998
  Subcellular localization annotation: CTP_CleavageSite=41; ConfidenceScore=5.60e-01
MAEPSKKRKGSSSTATAAAHRRHGPSGAPTAPIPPSLSSPRSSTLFSSDDQRLRYLSQFSSRIILDPKYLDVEFFNDETFDCYQVFQNSGLVDFMSLKLPYYPELVKVFYCNLKIQDGIIMSEVHGTSMVIDQSLFFSLTHLPSPGAPFEGTIVDDWKFDYSSHDARRMVCNDQAEMTGRLLAGSTGPIWFGTECIRHYGPMHLFLIHI

SEQ ID NO: 148684 - protein, 85 aa, Glycine max
  Coding DNA Sequence Number=SeqID_56999
MESPTVATYPSAGGRCKTHGCVFQERKMCGVATNVYSRKTSEKPEMTWSTNFKCERFGSCIYARGRCFPCSYVFLNYDKEIRPIF

SEQ ID NO: 148685 - protein, 103 aa, Glycine max
  Coding DNA Sequence Number=SeqID_57000
MARRDQVWSFCTHDTRRYLTVIRTPLPFRHSRVRWHAETKFGHSAPMIRGDTLWLFCTHSFAICKTESLMSMQRLTQSSAPFDTPGTTKHTLHAEIICTPFAR

SEQ ID NO: 148686 - protein, 272 aa, Glycine max
  Coding DNA Sequence Number=SeqID_57001
  Subcellular localization annotation: CTP_CleavageSite=42; ConfidenceScore=5.19e-01
MPSLQRPHGSSPRRPLMPKAPIQREAPQALALTTTRPADNSNAMRKLSPEANSRIHPTPNDVRRPLAVPYRQPNGRNNSRKDLPIPFPNVDVATPRRFIFEALQKGGVIPHGGHKEDSCLLHPGELHNMETCLAVEELLQQMMDQGRLEVGDEGREEHHIYMQSADARSFGRPKPLRYTPPSEREEEEAIDISSLSAKETNITGLSGVTRSSGVFAPSDLPTQPANIKGKAKMVEEQNDKTTLTPNEDIPVKGLSEKRDGCGKKEVSLEEAS

SEQ ID NO: 148687 - protein, 183 aa, Glycine max
  Coding DNA Sequence Number=SeqID_57002
MKEFYANLYDPEDKSPKQLLRKDLTTLAQTWSVLSYSNLAPTSYTSDLNLDRARFHSLLSPTPRGLDFQPLSLPCARPEESPQIFSLMSLLAQASLRLGQLLVMQSLQDVVQQRPVMSMEEFSQRVTWPGVQPSPLGGGEASAAQEPQPNQEDDSSEATLTPPEPFIFEDDLVADPVTAEGTQ

SEQ ID NO: 148688 - protein, 104 aa, Glycine max
  Coding DNA Sequence Number=SeqID_57003
FPKQFQHINITSIIIKTLKLNGNLAKLPIISPKTQYPRKSSEKEVYPNLKFRGPTRRDALHDFENAFLSRFGAEMGTKGWSFNGVSMEDEEEENGNVRERKELF

SEQ ID NO: 148689 - protein, 81 aa, Glycine max
  Coding DNA Sequence Number=SeqID_57004
MREAKGLQEARSIRPKRKAIISAQYDMNENNKASFLSSSSEGTGNLETSLSSPSSSLFLEVLTLEVQQQAQHVTSFLRIAR

SEQ ID NO: 148690 - protein, 229 aa, Glycine max
  Coding DNA Sequence Number=SeqID_57005
  Gene Ontology: Mol. function=transporter activity; Cellular component= cell outer membrane; Biological process=transport
  Homolog annotation: Hit_ID=Q8X7W7; Match level="QueryCoverage=48%, HitCoverage=14%, E-value=6e-54, Identity=93%"; Hit description =Catecholate siderophore receptor fiu precursor
DAGSRQARQGASAGVGGCRGWLNYAASEQIVLRVHHMRAIGAGLFAITPAGERGMCCKAIKLGNARVFPVDSRGSPSASIGSAWFRRGTLDVNQVIGDTTAVRLNVMGEKTHDAGRDKVKNERYGVAPSVAFGLGTANRLYLNYLHVTQHNTPDGGIPTIGLPGYSAPSAGTAALNHSGRETCRASCINESANARGEAVCVLGALPLPRSLTRCARSFGCGERYQLTQR

SEQ ID NO: 148691 - protein, 122 aa, Glycine max
  Coding DNA Sequence Number=SeqID_57006
MSLATLFGKLQEHEMELLRLRQHEENDKKKKGIALKASSSIQEESDKENDLDDDDDLSLFVKRFNKFIKKKMEKSEKKNLSEKKLKKAYITWDENDMESFEDSENEEINLCLMAKSYESDEE

SEQ ID NO: 148692 - protein, 142 aa, Glycine max
  Coding DNA Sequence Number=SeqID_57007
  Homolog annotation: Hit_ID=A6FJQ2; Match level="QueryCoverage=26%, HitCoverage=84%, E-value=2e-11, Identity=92%"; Hit description=50S ribosomal protein L5
MTVKTSDTCSSRRRSQLVCKRMPGADKPVRARQRMRKEKIPHQAPFAIQAAQLLGRAIGAGLFAITPAGERGMCCKAIKLGNARVFPVTTLIPDDTIDNWKHVPASQKDLIWEDIQTEFDIPEAFDSRTKKNILQTVAEWWR

SEQ ID NO: 148693 - protein, 156 aa, Glycine max
  Coding DNA Sequence Number=SeqID_57008
  Gene Ontology: Mol. function=chitin binding; Cellular component =extracellular region; Biological process=chitin metabolic process
  Homolog annotation: Hit_ID=UPI000069F178; Match level="QueryCoverage =98%, HitCoverage=53%, E-value=9e-12, Identity=32%"; Hit description =Mitochondrial antiviral-signaling protein (Interferon-beta promoter stimulator ...
  Homolog annotation: Hit description=protein 1) (IPS-1) (Virus-induced- signaling adapter) (CARD adapter inducing interferon-beta) (Cardif) (Putative NF-kappa-B- activating protein 031N).
MARTCSPLKVKMCSPLKVRVCSPTKVKAHDPLTVRTCSPLKLKVHDPLKARTCSPLKVKARTYSPLEVRACSPLVVRTCSPLKARTACSPLVVRTCSPLKARTCSPLTVRVTSTQGRVALSRRGHVVLWRVRACSPLMVRTCSPLKARTCSPLNGE

SEQ ID NO: 148694 - protein, 129 aa, Glycine max
  Coding DNA Sequence Number=SeqID_57009
  Subcellular localization annotation: CTP_CleavageSite=72; ConfidenceScore=5.36e-01
SRAKSSFLGQAHFIAASAEPSEPRSLSSQYLMASRKRKSIGSRPTSQYDTRRFSSLDAWTRYIDNVLGRNILPERKVEIYHSELDEFKAELERRNFHKHPTNLVDGSIDVTLVKEFYANLYSSEDHPPK

SEQ ID NO: 148695 - protein, 319 aa, Glycine max
  Coding DNA Sequence Number=SeqID_57010
  Gene Ontology: Mol. function=peptidase activity; Cellular component =membrane; Biological process=protein homooligomerization
  Homolog annotation: Hit_ID=Q2P4S7; Match level="QueryCoverage=99%, HitCoverage=98%, E-value=1e-122, Identity=72%"; Hit description =Putative uncharacterized protein XOO1695
  Pfam annotation: Domain name=Band_7; Domain location=24-196; Score =201.4; E_value=2.2e-57; Accession=PF01145.16; Description=SPFH domain  Band 7 family
MFPTMFFTVVLAFVAVVILFKAVRMVPQGYEWTVERFGRYTHTMTPGLHFLIPIVYGVGRKVNMMEQVLDVPSQEVITKDNAAVRVDGVVFFQVLDAAKAAYEVANLEVAMIALVQTNIRTVIGSMDLDESLSQREVINAQLLSVVDHATNPWGVKVNRIEIRDIQPPRDLLDAMARQMKAEREKRAQILEAEGSRQSEILRADGEKQATVLEAEGRREAAFRDAEARERLAEAEAKATQMVSAAIAEGDVQAINYFVAQKYVEAFKELASSPNQKLVLMPMEASGVIGSIAGVAELAKQALGDQNTKAAGKRPPPIGG

SEQ ID NO: 148696 - protein, 123 aa, Glycine max
  Coding DNA Sequence Number=SeqID_57011
MRGIVHEPQVNIGADQKGLHVLTFRGLHVLTFRGIHALAIRGLHALPFRGLHVLAFRGSCTFTFRGLHVLAIRGLHALASRGLPVLAFRGLHVLAFRGLHALAFRGLHVLTIRGCWIEWPQNN

SEQ ID NO: 148697 - protein, 144 aa, Glycine max
  Coding DNA Sequence Number=SeqID_57012
RDGSAVDPCRVVMECLEGVWQTLEGNERCRFRGTIQLTATSLVHPKEPARTLQQPVEWILPTPTPYRLVEPVQVIEVSSSEEDPEEDLEELPPEPTVDALDFPEDDEDPLPDVDSPEDIMSASEADSTEESGPGGTANSEDSSS

SEQ ID NO: 148698 - protein, 45 aa, Glycine max
  Coding DNA Sequence Number=SeqID_57013
MDTSEPYTGAMRGTMHEPQANLGADEKFSPISNPEWEPPLNRREE

SEQ ID NO: 148699 - protein, 101 aa, Glycine max
  Coding DNA Sequence Number=SeqID_57014
MATMIEAMMSIKKIMEANAVTVAATSAVAKVNPMPPSGLNQMNHPTSAMVGKDLGSTGGPHYAQIQNKHAFPPCGSPPKEDVNNSAPILIESRQPHHAHVS

SEQ ID NO: 148700 - protein, 96 aa, Glycine max
  Coding DNA Sequence Number=SeqID_57015
MGPDGCRETRGTGTREMARKPRQDFSISKEKIQKLSSPSHVAFLLPFSSTIVAQQSCKLCSPFLLQIAKGSHFQSRETHLYVVGLQISGLGRLLLT

SEQ ID NO: 148701 - protein, 54 aa, Glycine max
  Coding DNA Sequence Number=SeqID_57016
MEVEETWQALWLPLHYQVDKGARMAFMDNWVVGKEKGCYWLSNDIVRLVGNLAV

SEQ ID NO: 148702 - protein, 98 aa, Glycine max
  Coding DNA Sequence Number=SeqID_57017
MLWKLGGIDGDPVLRGTRIRATWEYVSSVEGGQLGMVDLFVDVESRLAPSPDRHLVQHMTGTPKSYKLEASTWQSTDKRTKTTKQGGLCGGWPAMDLE

SEQ ID NO: 148703 - protein, 61 aa, Glycine max
  Coding DNA Sequence Number=SeqID_57018
MAPDAYNLLDAAFINASLARQVSRPEHPLTRPDGIVCSLGIPGFTTLCCAGLRGSCECVRG

SEQ ID NO: 148704 - protein, 127 aa, Glycine max
  Coding DNA Sequence Number=SeqID_57019
  Homolog annotation: Hit_ID=A6FJQ2; Match level="QueryCoverage=29%, HitCoverage=84%, E-value=3e-11, Identity=92%"; Hit description=50S ribosomal protein L5
MTVKTSDTCSSRRRSQLVCKRMPGADKPVRARQRMRKEKIPHQAPFAIQAAQLLGRAIGAGLFAITPAGERGMCCKAIKLGNARFSLHQYPNFVNINQCTLRVRLIASEPNLRSCLMDEGLTGVCGA

SEQ ID NO: 148705 - protein, 310 aa, Glycine max
  Coding DNA Sequence Number=SeqID_57020
  Pfam annotation: Domain name=RRM_1; Domain location=5-72; Score=19.1; E_value=0.0026; Accession=PF00076.13; Description=RNA recognition motif. (a.k.a. RRM, RB
VDSRGSLPDEANEELLWRHFKNWGDVREVYIAKRLNKDGRRYRFMRFKGVSDAKGLEVRLDNIFINDCKLFVNLPRFDRPVRNTELQKKNPIGRKYTDEASKPCGVITGALRRSYVDVMTKGGCQGDKRADEAQTPTILINPDEGGEYWCNETWVGMLKKVMEVETLEDRITWELGYNVRTKFLGDDMVLLPGMSDDKAQLLIQSETESDDSLFYSLEKWTPKCRPNNRVVWLQLWGFPIQVWEMKNLRRAVAAIGDVIESDDDTEDRRRLDRARVLVRTPLPPLIRSERQGSKVGRTGKEARRPMGGRR

SEQ ID NO: 148706 - protein, 152 aa, Glycine max
  Coding DNA Sequence Number=SeqID_57021
MRLACNNKNLEDRVLALLNNVIGLEMCTLNVVALARSQDNEIARLRSVVADANKETKDANVKKEGIQQKAFDDVYNAHETGFNHCLWQVLHMCDVSDPSVFDINKDVHERELMLIDDISEDDAAVNVCIHDFDDVKEESNKAASNDKHLLQE

SEQ ID NO: 148707 - protein, 108 aa, Glycine max
  Coding DNA Sequence Number=SeqID_57022
HPGRVRVAEAGVTIKQYFGPTPRTSYTSSSMTHKYLEQLMQKIRYQLEESIIEKGLALPPEPEVDPSVASVSTKESCLDLSRNNPDAVKVGVEEVRDVDAPIPVPNEE

SEQ ID NO: 148708 - protein, 114 aa, Glycine max
  Coding DNA Sequence Number=SeqID_57023
LCPSVQQSEAIEQPEAYAANIYNRPPQPQQQNQSQQNNYDLSNNRYNPGWRNHPNLRWSNPSQQQQQQQQQQQQPQKQQIVEAPPQPSLEELVRQMTMKNMQFFKERPEPPFRA

SEQ ID NO: 148709 - protein, 162 aa, Glycine max
  Coding DNA Sequence Number=SeqID_57024
MWAFHTGRQLDWAHLVRYRMNKALRLNAPLPYPQLVTLFLRHFEIPLDSESYIPIKRSFLIGATAIVSFGYHKERDGSWVKKGTQPADEEGNLPDEDNSTLLRRLMDKFDGLQTFVGDKFDAMELQVDMRFDAMESRITRVEEDVSFIRTCFDPPPPSPSSS

SEQ ID NO: 148710 - protein, 177 aa, Glycine max
  Coding DNA Sequence Number=SeqID_57025
TIVEAILTPVFPGRLRPARRAAAAAGILGRVDFAGAHLAAVRDGRRFARAGRKLAGAILSGYPTFLVRHAARPAGGAGVFAERPPPPMAAAVARLALGAGCLPAGVARRLAVQPVAPGRRCAGAGTGVGAARRAGAKLSVAECAPESLLCAGGARRLIAEKCGTFRIFRTPSWQPLA

SEQ ID NO: 148711 - protein, 86 aa, Glycine max
  Coding DNA Sequence Number=SeqID_57026
MSSHSTSLEPKSRLTINLDPGGENTETFSSLTSNPELRRSEFLIGGYVGARASLLSTTPPFVAMTQELVARGDTLRLSAPRHSVIP

SEQ ID NO: 148712 - protein, 167 aa, Glycine max
  Coding DNA Sequence Number=SeqID_57027
MSFLGETSSQIIANSILAFIFLNGSITHNQTGVYFQSPTPTPMRVPNDCSFDTLKRRMHNTLQLTNDQLVDEIYYRQPFIDAELLCTIIRTPDVILNLLQSTITPTHDALMYYNGKWNIPRQGQFLGYSFTRTNPIRFGIPSGCSMDKLKDLIKQVAPIGNSRITIG

SEQ ID NO: 148713 - protein, 155 aa, Glycine max
  Coding DNA Sequence Number=SeqID_57028
  Homolog annotation: Hit_ID=Q6WAY6; Match level="QueryCoverage=55%, HitCoverage=15%, E-value=3e-08, Identity=37%"; Hit description =Putative uncharacterized protein
MGTRGCINYNPVLAIRQLGYPMRGAPLEEELTPVISRGFNETNVETLRKVRKAWVLMQKKDKELKGSNNGPIGGYFRWLKAHVQGLDWLPSLRTAKGEEFEALEEDEEVQTLRAELEQAQIVKERFKSAALRIRKENAKLRDVNIGLGTRDQEGS

SEQ ID NO: 148714 - protein, 116 aa, Glycine max
  Coding DNA Sequence Number=SeqID_57029
DAGSRQARQGASAGVGGCRGWLNYAASEQIVLRVHHMRAIGAGLFAITPAGERGMCCKAIKLGNARVFPVTTFVKTAESVTQPAGASNHYRELGMGFLSGILNPKNALFWVPSSNS

SEQ ID NO: 148715 - protein, 208 aa, Glycine max
  Coding DNA Sequence Number=SeqID_57030
MAKSSHARVRLALQVEKLGKARLAKEKFKSAATHIRKECTELQEENAATARALERETKRACKEEHGREKFRGALWGSNNELKLRREERDRSRMHGMILKEELAACARSKRSLAQHLEATEQSMLAIIGQYKEELNQSMAHEQKLVEDFALVYAEKEARGRVIDALHQEATIWMDRFAWTLNGSQDLPRLLAKAKAMAEVCRPPRRFMG

SEQ ID NO: 148716 - protein, 103 aa, Glycine max
  Coding DNA Sequence Number=SeqID_57031
TARREKVQGDAPQAADAPPPHQAGPAELFDTEQARALLLFRALLSYPNFVRGPLLDDMRPFFGPCESKCFCNASVSDSVEILHRSSSFFTVLHPFFVRSSFFN

SEQ ID NO: 148717 - protein, 261 aa, Glycine max
  Coding DNA Sequence Number=SeqID_57032
  Homolog annotation: Hit_ID=Q6WAY6; Match level="QueryCoverage=25%, HitCoverage=11%, E-value=5e-08, Identity=45%"; Hit description =Putative uncharacterized protein
MGTRGCINYNPVLAIRQLGYPMRGEPLEEGLTPFIARGFNSTSARVLHRVHKAWEMVQKKDEELRGSSNGPIGGYHRWLRAYAQGLHWLPNLRTTKEVEGEALEEDEENAELRDINIATTKALEQETKRAHKEEHGWNKFRGALWGSNRELKLRREERDQSRVDGMILKDELKTCLSKYKEELNLATAHEHKVADEYARVYAKKEARGRVINLIHQEATIWMDRFALTLNGSQELPRLLAKAKAMANAYSTPEEVHGLLSY

SEQ ID NO: 148718 - protein, 166 aa, Glycine max
  Coding DNA Sequence Number=SeqID_57033
YATTRHPLDLDKSNRALGFPALITGLCQSFEVPVTPSKYCTPRQAQGDAPQAAGSPPPPHQADPAGSFGMERYFQHLVHQQAANHRGQVQIHECLYQLSLSQQSQGFTLFVCPTPDQFRAEVTWPGDWPEDQTEEAPAGAPDGVEDARMDEEMTDLLDFLGGSGAT

SEQ ID NO: 148719 - protein, 295 aa, Glycine max
  Coding DNA Sequence Number=SeqID_57034
MDDFTVYGSSFDAFIAYHHSKEISVVAILADLYDTFDRRCVKNGTRILCCMPALYVWLVSHLFRQESRPTCPLHRHRLCTEKGKANWEQLLASVVGASINWFPRWKEGKVGVLSSFRKAWDAAQRKDKELRGSSNGIIGGYHKWLRVRTQGLDWLPKLRAARKEEAETPEESEEVQALKAELEQARAVKEKFKSTAIKVRKEYDELKDINMATTEALEQETKKALKEEHDRNKFRGALWGRYNELKLQRDEKDQSRVEVMILKDELKDCHRSKRSLSQQLSKTEGNIWAIINDYK

SEQ ID NO: 148720 - protein, 195 aa, Glycine max
  Coding DNA Sequence Number=SeqID_57035
MIRGDPLWLSAPLDRQTQLCPMASRDQVWSFCTQDTRRYFMADTVVSDGKQRPSLVILHPRYAEIPYGYLHPFARQTQLCPMASRDQVWSFCTQDTRRYLTVICTPLLGRHSCVRWQAETKFGHSAPNDTRRYLTVICTPLLGRHSCVRWQAETKFGHSAHMIRGDTLRLSAPLCHSDTVVSNGTQRPSLVILRT

SEQ ID NO: 148721 - protein, 43 aa, Glycine max
  Coding DNA Sequence Number=SeqID_57036
MELEQGCAGCYYLGGLDMDLWMLFGVAYGIVVVVAKVKKKKKR

SEQ ID NO: 148722 - protein, 137 aa, Glycine max
  Coding DNA Sequence Number=SeqID_57037
MTLRKLASKRSRKDKAAEGTSSAPEYDSHRFRSAEHQQHFEAIKGWSFLRERRVQLRDDEYTDFQEEIVRQRWASLVTPMAKFDPDIVLEFYANAWPTEEGVRDMRSWVRGQWIPFDADAIGQLLGYPLVLEEGQEC

SEQ ID NO: 148723 - protein, 87 aa, Glycine max
  Coding DNA Sequence Number=SeqID_57038
  Homolog annotation: Hit_ID=A6FJQ2; Match level="QueryCoverage=43%, HitCoverage=84%, E-value=3e-11, Identity=92%"; Hit description=50S ribosomal protein L5
MRKEKIPHQAPFAIQAAQLLGRAIGAGLFAITPAGERGMCCKAIKLGNARRVIWQLQILTKEAGSLNLHLLRFNSHIRLSCASPHPS

SEQ ID NO: 148724 - protein, 148 aa, Glycine max
  Coding DNA Sequence Number=SeqID_57039
  Homolog annotation: Hit_ID=A0ST23; Match level="QueryCoverage=31%, HitCoverage=93%, E-value=3e-20, Identity=100%"; Hit description =Putative reverse transcriptase
DAGSRQARQGASAGVGGCRGWLNYAASEQIVLRVHHMRAIGAGLFAITPAGERGMCCKAIKLGNARVFPVDSRGSPTVVAERFVPLRQRLEAHFVEESSDPGLTHINCVALTARFPVGKPVVPAALMNRPTRGERRFAYWALFRFLAH

SEQ ID NO: 148725 - protein, 50 aa, Glycine max
  Coding DNA Sequence Number=SeqID_57040
MFAYSPFAKRKPHAKRISVHVLSHESQALSTQPLHLRLIWSAKLAKVELS

SEQ ID NO: 148726 - protein, 88 aa, Glycine max
  Coding DNA Sequence Number=SeqID_57041
MAAEWRRKRERRCHFKEKMSLEEAHHHKRPWIRAWKKKEMNEGRGREEHKILCSKRDLKSKLWFSPLIQDKVQDSPLSVLRCHEACKA

SEQ ID NO: 148727 - protein, 66 aa, Glycine max
  Coding DNA Sequence Number=SeqID_57042
MEKSEKKNHSEKKLKKAYITWDENDMESSEDSENEEINLCLMAKIYESDEEKRTWHINLLLQEKLQ

SEQ ID NO: 148728 - protein, 290 aa, Glycine max
  Coding DNA Sequence Number=SeqID_57043
  Homolog annotation: Hit_ID=UPI00016621D1; Match level="QueryCoverage =98%, HitCoverage=42%, E-value=2e-18, Identity=31%"; Hit description =UPI00016621D1 related cluster
GEPLGTSTLTSRELGVLAIRGLHVLTFVGLHALTFRGPHVLTFRGLHALAIRGLHVLTFRGLHALTFRGPHVLTFRGLHALAIRGLHVLTFVGLHALTFRGPHALTFRGLHALAIRGLQVLTFRGLHALAIRGLHILAFRGLHVLTLRGLHVLALRGLHVLTIRGLHAFTSRGLHVLALRGLPALALGLHALTFRGPHVLTFRGLHALAIRGLHVLTFVGLHALTFRGLHVLTFVGLHALTFRGLHVLANRGLHALTLRGLHALTFRGLRVLIFCVLHIYTLREFKVLCP

SEQ ID NO: 148729 - protein, 19 aa, Glycine max
  Coding DNA Sequence Number=SeqID_57044
MADQQATKSKAKVDTPSCS

SEQ ID NO: 148730 - protein, 98 aa, Glycine max
  Coding DNA Sequence Number=SeqID_57045
MAENTHSQASLREMEERLSSKMESRFVELVASMQQIIHGMFQQRQQDSPAASNPLRGLENLPSGMNIRSWYLIILEMFVKIPWRNLMKLRQTGSIRVS

SEQ ID NO: 148731 - protein, 91 aa, Glycine max
  Coding DNA Sequence Number=SeqID_57046
MPMLDQLHPLIHDFIENIMDVKADGMSEDSWSLVRNRLLKELSKWSDEYINLFGGTERFEELRRSLLVDGLSMVTMDKWMNIIKMGYVIAS

SEQ ID NO: 148732 - protein, 178 aa, Glycine max
  Coding DNA Sequence Number=SeqID_57047
MAPTRNPLDPDKSNRALGFPALITGLRQSFGVPVTPSKVIRPPITRAFIEKYYTQRQVQGVAPQAADAPPPHQAGPAGLFDTEQYLRHLVRQQAANHRAHVQTHDCLYHMSLNLQSQGFTSFPCPTPDQFRAEVAWPGDWPEAQAGEAPAEAPDEADEARKDEEMTDLLDFLGGSGAA

SEQ ID NO: 148733 - protein, 203 aa, Glycine max
  Coding DNA Sequence Number=SeqID_57048
  Homolog annotation: Hit_ID=UPI0000ECBAF8; Match level="QueryCoverage =20%, HitCoverage=48%, E-value=2e-16, Identity=100%"; Hit description= UPI0000ECBAF8 related cluster
VGTGERTRELPGGNAWYLIVLSGFATSDLSVDFCDARQGGGAYGKTPATRPFYADTARRSRTTERSESVSEEAEERPIRKPPLPAPDNNFTQETAMTMITNSSSVPLEGLYSGYRKAQDYGKGCWHDFDSITITNNDVIVARVAKGNSYGGMQAWHWPSFYNVVTGKTLALPNLIALQHIPLSPAGVIAKRPAPIALPNSCAA

SEQ ID NO: 148734 - protein, 107 aa, Glycine max
  Coding DNA Sequence Number=SeqID_57049
MIKVQPKFKNSPVLKCSTDSSLINVVMDMLADVETSSKMNIPISDSNHSAQHESQSVSVTVDHHPLLGLPLTPTKRQAFQDCDDEAGTSQISHAQLSSNKLKKHGTI

SEQ ID NO: 148735 - protein, 132 aa, Glycine max
  Coding DNA Sequence Number=SeqID_57050
MELQRLNQNEETDKKKRSIALKASTSIQEEEEEEESDDEEDFSLFVKKFHKFVKNRRIERSHNFNNGKRSQEANCPSNESWPEKNDKKNYKERRSKKVYITWDDNDSSDGSEKEINLLSKDYESDENISQEV

SEQ ID NO: 148736 - protein, 95 aa, Glycine max
  Coding DNA Sequence Number=SeqID_57051
MGTGVERNEDMGYVGVRELSWRWATGDGGFMRGRIVDVESLLCTIARPPPSTTCELLAVQIKENKITARRLVVAGTAVKFCEYVGWVYSGNRLGG

SEQ ID NO: 148737 - protein, 107 aa, Glycine max
  Coding DNA Sequence Number=SeqID_57052
KVVDDEMRKGKSEVNIDKKKDTTPNEGKEVPYPLVPSREEKERHLARFLDIFKKLEITLPFGEALQQLSLYAKFLKDMLTKKNRYIHNDIIVVERVGSSGLRIIKKG

SEQ ID NO: 148738 - protein, 55 aa, Glycine max
  Coding DNA Sequence Number=SeqID_57053
MYETDDDITFEGPKKAIQIKCGKYIALQICDDEDVETMIQSFEQQQEMSVIELCV

SEQ ID NO: 148739 - protein, 148 aa, Glycine max
  Coding DNA Sequence Number=SeqID_57054
QLEVGNRGWWVYARFVDVENLWCTIARPPPSTTCDGVVPGDMSRGSGDLGDVRRAPGSQQIKGIETTKQGGLCGGWPAVNLAVEASGNRLPVCVIDYTEEWVTGNRLPKRCNRLPGLKAMRAVEASGNRLPVCVIDYTEEWVTGNRLP

SEQ ID NO: 148740 - protein, 181 aa, Glycine max
  Coding DNA Sequence Number=SeqID_57055
MLESFKQQDQMSVLELYIEKDVVGGSMFHSANSLTSCGNYLSNDETQSTTNMSNLHIDEDDDDDDYLVSNSYIEESLDEDDSVDGISDTDDEVTDIPQPVRIVHPAEGAQRIENPFWDDALHYNNINWSYPDEEDICGLEMSSTFNVGQELYVGMEFDSKDAVKKCSQTICYEGALKFQSC

SEQ ID NO: 148741 - protein, 111 aa, Glycine max
  Coding DNA Sequence Number=SeqID_57056
IALTRHPVDPKKSNRVLGFPALIMGLCQFYRVPVAPSKVIRPPINRSFIKKYRAPRQAQGEAPQQPRDDQQWAIDTPPPPPKSTSAHLRRLECCLRHVADQQATKSKAKGK

SEQ ID NO: 148742 - protein, 150 aa, Glycine max
  Coding DNA Sequence Number=SeqID_57057
  Homolog annotation: Hit_ID=A0ST23; Match level="QueryCoverage=30%, HitCoverage=91%, E-value=1e-11, Identity=73%"; Hit description =Putative reverse transcriptase
MTVKTSDTCSSRRRSQLVCKRMPGADKPVRARQRMRKEKIPHQAPFAIQAAQLLGRAIGAGLFAITPAGERGMCCKAIKLGNARVFPVTTLSWSYPDLCCLPLWGTELEFVIMVIAVSFGKPVVPAALMNRPTRGERRFAYWALFRFLAH

SEQ ID NO: 148743 - protein, 121 aa, Glycine max
  Coding DNA Sequence Number=SeqID_57058
EFDAQVAWPGAQPSPFGGGGASAAQEPTPEEPAAAAVEGVHMSQKEETSTDQIPEPSLAPIPDDVVPSALASELEQPISQDSPAAQPLEENEHVIGSMTENVSQFVRLIVKECIDRIPVRV

SEQ ID NO: 148744 - protein, 140 aa, Glycine max
  Coding DNA Sequence Number=SeqID_57059
MDNEEGVQEQMKANLSALKDQMASISEVMLKLQKTIEDKATATASTYPYGLPPDFTPRATPEDLSQAPTFEGQLPPYDDYPGQDDEEGDTHLGPLLHLKDPSPHELPQPNIVRHISASTKPVKESVPFVEDKGKIEALEE

SEQ ID NO: 148745 - protein, 99 aa, Glycine max
  Coding DNA Sequence Number=SeqID_57060
MLRASVFNFERLDILRDSVRYPRKKLLSFEYAQSFGIQFRASRYITGLSQISEASVFNFERLDILRNSIRHPSKNLLSFEFAQSFFIQFRASRYIAGLN

SEQ ID NO: 148746 - protein, 163 aa, Glycine max
  Coding DNA Sequence Number=SeqID_57061
MVGYTPSSFADLDFAGRRIKAGLKRGKFNHPTWTNEKTGANEEGENEGEAHAVTAIPIQPSFPPTQQCHYSANNQPSPYPPPSYPQRPSLKQPQSLSTALPMTNITFSTIQKHQPRNEFCSEKACRIHPNSSVLLSYPNFVRGPLLDDMRLLFGPCKVLGTHH

SEQ ID NO: 148747 - protein, 103 aa, Glycine max
  Coding DNA Sequence Number=SeqID_57062
MGDQEETQEQMKADMSALKEQMASMMEATLGMRQLMEKNVATAASISSAAEADPTLLATAHHPPPNAVGQGRSTLGHNNNPHLGYKRLAYPYGLPPNYTPPVM

SEQ ID NO: 148748 - protein, 177 aa, Glycine max
  Coding DNA Sequence Number=SeqID_57063
  Homolog annotation: Hit_ID=A5BQX5; Match level="QueryCoverage=64%, HitCoverage=34%, E-value=1e-12, Identity=36%"; Hit description =Putative uncharacterized protein
MTRGNPSDLQPFDPEIDRTFHRLVRHHFIPFDHSEHSITGESVHSVIGDFEHPDLEHYNFEHSDSEHSDFAHSENMAQPPPRERTLREMAAPDFTYESLCIQYPDEDVPYVLKTGLIHLLPKFHGLASEDPHKHLKEFHIVCSTMKPPHVQEDHIFLKAFPHSLEGVAKDWLYTLLQ

SEQ ID NO: 148749 - protein, 114 aa, Glycine max
  Coding DNA Sequence Number=SeqID_57064
MTLLLSNILPSDRSADLPLRKGSAHKTPSGLGGAQQGPGVSDSGITPARHSVDPEKSNRVLELPALITGLCWFYGVSVAPSKVIRPPTNRAFIKKYCAPRQAQGETPQQPGDGQ

SEQ ID NO: 148750 - protein, 77 aa, Glycine max
  Coding DNA Sequence Number=SeqID_57065
MSILTLGSKKRKRRKISNQRESKKKRMGESKKEGKKAPDQGSKETRRNVQKSLWTRQYLNNTELSPNEQKEEKESMT

SEQ ID NO: 148751 - protein, 247 aa, Glycine max
  Coding DNA Sequence Number=SeqID_57066
  Pfam annotation: Domain name=CbbQ_C; Domain location=2-74; Score= -19.9; E_value=0.0051; Accession=PF08406.1; Description=CbbQNirQNorQ C-terminal
MEGASVNAVGGNEPSRAKRLGEVATSSRFIYQSLQAACMVSRGGDERDECLFHLGESHDMETYPAVEDLLQRLMDCGQLEVSIGGREEPQICMQSEEKKVPLTPKALVMCFTRKGTGSTPMYPRTAPKPTPFAYQSNKAVPWKYTPPASSERVATEVDSLSAKVTNITGLNGVTRSGRVFASPHPAELSSKGKAPMIQEPIDVATPSKEVDPPVVRGAEKKEGLQGKTVTLEEAHEFLRLIQQSEFK

SEQ ID NO: 148752 - protein, 146 aa, Glycine max
  Coding DNA Sequence Number=SeqID_57067
MGQTLNTFLAWLTHHVKHLSKQTAVSLAKPPDRPDHKPLQVMWDATVFEVFNEDFPLYIKHKDLSEIAHSGQCLSLSVIQLWILHLTETSMRAGNSDVYGFLEPQSIQRSGQLQFELESYMKSGMQSSKRDVYLGAYLNGLNNYLK

SEQ ID NO: 148753 - protein, 202 aa, Glycine max
  Coding DNA Sequence Number=SeqID_57068
MVCVENADMSGRLLAGSLTFECHIMHYILYRVLLPRSTNLAQASKEDLIVMWALQNGCQIDWAYLVHYRMHKALRENAPLPYPHLVTLFLKHFKTPFTNEPFVKIKHSFEIGATAVASFGCKKDLDGQWVHKEDYQANAPNERTPSPPPRDLSSTLLTDVLNEIRDLRTFLGERFDSMDSHITHLEDDMGFIRYCFYPPTNP

SEQ ID NO: 148754 - protein, 132 aa, Glycine max
  Coding DNA Sequence Number=SeqID_57069
  Gene Ontology: Biological process=histone H3-K9 demethylation
  Homolog annotation: Hit_ID=A7Q7J4; Match level="QueryCoverage=70%, HitCoverage=8%, E-value=5e-12, Identity=45%"; Hit description =Chromosome undetermined scaffold_60, whole genome shotgun sequence
MEQEGGLCDGKEVDQFHQPSGSNEVAIANEDGISYGSELIEVDKVKVNQDGALWDIFWRQDVPKLQEYLKKNFREFRHVHCCRLKQGYVIDPCHRDSTKFNVGCRKPNTTLSFYPGLGPAKNSKATLGRIHL

SEQ ID NO: 148755 - protein, 135 aa, Glycine max
  Coding DNA Sequence Number=SeqID_57070
MVDTLPTFYYEKLIGYMPANFADLVFAGERIESGLRKGKFEYASNVAPNNNRRAPVVGARKKEGDAHANHLVVAIPGKVLQPPYPKWYDPGAKCAYHSGVPGHNIDSCIPFKYKRECRRRGWAIAGKEIKRGGYF

SEQ ID NO: 148756 - protein, 80 aa, Glycine max
  Coding DNA Sequence Number=SeqID_57071
  Subcellular localization annotation: CTP_CleavageSite=71; ConfidenceScore=5.21e-01
MGVQIATRPTWALQKAVASGGSNLACLGELGGKLLPQFSINRGRSEPRRFRNVSVSDFAKVFDRSSMFFIRSSSFFSLQR

SEQ ID NO: 148757 - protein, 67 aa, Glycine max
  Coding DNA Sequence Number=SeqID_57072
MKGRVNLGLEGESMLGRIDGDPVLRETRIWATWEYVSSVGGGQQGMVGLCAHCGCGKLVVHHRPTAT

SEQ ID NO: 148758 - protein, 157 aa, Glycine max
  Coding DNA Sequence Number=SeqID_57073
  Homolog annotation: Hit_ID=A6FJQ2; Match level="QueryCoverage=24%, HitCoverage=84%, E-value=3e-11, Identity=92%"; Hit description=50S ribosomal protein L5
MTVKTSDTCSSRRRSQLVCKRMPGADKPVRARQRMRKEKIPHQAPFAIQAAQLLGRAIGAGLFAITPAGERGMCCKAIKLGNARVFPYVVLGARIPKATVAIAMVWSTDPTALAVHMLHCQTGKKYNIRRTLSPNARIACCASVGRQRPSEQLWAVS

SEQ ID NO: 148759 - protein, 80 aa, Glycine max
  Coding DNA Sequence Number=SeqID_57074
MAWNFLVKCKYVHDEMAPRKLLAKRSRKDKAAEGTSAAPEYDSHRFRSAEHQQHFEAIKGWSFHQERRVQLRDDEYTDFQ

SEQ ID NO: 148760 - protein, 103 aa, Glycine max
  Coding DNA Sequence Number=SeqID_57075
  Homolog annotation: Hit_ID=A5BKB9; Match level="QueryCoverage=95%, HitCoverage=11%, E-value=4e-09, Identity=33%"; Hit description =Putative uncharacterized protein
MKDKWNVHELHSMLVQEETRLKNQGSHSVHYVSHQGNQGAGKKFMKKHDKGRGKSGHFQKDYLKCKSWFEKRSELNTHRFLTIQTISPNEKFVFMGNKVKALV

SEQ ID NO: 148761 - protein, 113 aa, Glycine max
  Coding DNA Sequence Number=SeqID_57076
GFFGFRTRLYTRTEETIEPRHPPPPHHEEFVEPPIPEVSVATDLPTHSVVHCEGCQGMAQDLGAIAEDLERVINLRMVTEGTDLHDIMTCCLRRARGDTTDGSLRLRQRRRID

SEQ ID NO: 148762 - protein, 161 aa, Glycine max
  Coding DNA Sequence Number=SeqID_57077
MAPTRHPLDPDKSNRALGFPALITGLCQSFGVPVAPTKVIRPPITRAFIEKYCTQRQAQGDAPQAAGAPPPPHQAGQAGAFDMEQYLRHLVRQQAANHRAHGFAPFSCPTPDQFRAEVAWPGDWPKAQAGEAPPEAPGDGEEAHEDEEMADLLDFLGGSGD

SEQ ID NO: 148763 - protein, 98 aa, Glycine max
  Coding DNA Sequence Number=SeqID_57078
VSMDKWMDITDMGYVIASRSRPPANSAAHRIICVGHVYGSHFVQVFLKDRCPLPPMALLWSSNAYLEAKQWPTAYVGRMQQYLSLMTINTTHVDLSGH

SEQ ID NO: 148764 - protein, 314 aa, Glycine max
  Coding DNA Sequence Number=SeqID_57079
  Homolog annotation: Hit_ID=Q2HW90; Match level="QueryCoverage=95%, HitCoverage=58%, E-value=3e-38, Identity=34%"; Hit description =Putative uncharacterized protein
MGTNQTGKRFYQVKVKGLDVTSIKELGRLMRPLQMQAFRKTYGKILDLTIAEVSIEAIASLTQYYDQPLRCFTFGDFQLVSTIEEFEEILGCPLGERKPYLFSGCLPSLSRIATVVEDSARGLDRVKQTRNGIAGLPRKYLEDKARDMANQEDWVPFMDVLALLIFGVVLFPNVDGLVDLAAIDAFLAYRHSKESPVVAVLADLFDTFDRRCEKSSARIICCLPALCVWLVSHLFQQDTRHPCPLQSHRSCTEKRRIDWDQLLAGIGGRTINWFPRWKEGKEGVLFSCGGYPNIPLIGTRGCINYNPALAIRQL

SEQ ID NO: 148765 - protein, 58 aa, Glycine max
  Coding DNA Sequence Number=SeqID_57080
MWYHGDQSGSQCFARMLQPYEINIGLKEHSNRVTPKACTPKSPSGPLPPNSGPTQKIF

SEQ ID NO: 148766 - protein, 185 aa, Glycine max
  Coding DNA Sequence Number=SeqID_57081
  Gene Ontology: Mol. function=helicase activity; Biological process =viral genome replication
  Homolog annotation: Hit_ID=Q9C8V4; Match level="QueryCoverage=96%, HitCoverage=27%, E-value=9e-35, Identity=43%"; Hit description =Putative uncharacterized protein T22A15.15
  Pfam annotation: Domain name=DUF889; Domain location=69-185; Score= -13.4; E_value=1.4e-10; Accession=PF05970.5; Description=Eukaryotic protein of unknown function (DUF889)
MFFLYGFGGTGKTFIWRTLASSLRAENQIVIIVASSGITSLLLLGGRTAHSRFKIPVPIFEDSTCKVIVFGGDFRQILPAIPRGTRSDIVNAAINSSYLWDLCEILTLTKNMRLHSNLESVDEQETATFAKWILDIGDGIIDDENDGYATIQIPTHLLITQYDDPIKLIDTVDLEGGPGTSFCSL

SEQ ID NO: 148767 - protein, 149 aa, Glycine max
  Coding DNA Sequence Number=SeqID_57082
  Homolog annotation: Hit_ID=A6FJQ2; Match level="QueryCoverage=25%, HitCoverage=84%, E-value=2e-11, Identity=92%"; Hit description=50S ribosomal protein L5
MRKEKIPHQAPFAIQAAQLLGRAIGAGLFAITPAGERGMCCKAIKLGNARVFPVTTFATKLLRSAVRQFSILHFIRSSMNLLPSAVHMSSTFESGAPQNRETCRASCINESANARGEAVCVLGALPLPRSLTRCARSFGCGERYQLTQR

SEQ ID NO: 148768 - protein, 167 aa, Glycine max
  Coding DNA Sequence Number=SeqID_57083
MDTYVSPLTAQITETEVTKPTLFEVALERSPPICASSSSISVVFKSKGERKDIELVEEEQTRIGADPSSGSSNNLRIIRRKHGRKHRTEAVEHRNKRDTGHQNVALDNKTGDSTMLKMGDSAKVVIKQDMKGRRHKYGFNNNVHEKAQKKRVVDDETANKHQLDEVL

SEQ ID NO: 148769 - protein, 111 aa, Glycine max
  Coding DNA Sequence Number=SeqID_57084
MIKSIDRVFSCNRRSWTYIRICGEVAQGDQHLPPSNRELMITLDDVSSLFHLPISGTFHSFEALSVDEAVFLLMELLEVSGEEARAETVRGRGAYVCLSWVREIYEMRCQA

SEQ ID NO: 148770 - protein, 245 aa, Glycine max
  Coding DNA Sequence Number=SeqID_57085
  Homolog annotation: Hit_ID=A5AZ88; Match level="QueryCoverage=94%, HitCoverage=25%, E-value=5e-08, Identity=27%"; Hit description =Putative uncharacterized protein
EKPRGGSIHLRGKLQFHQFPDESLSEALERFRGLLRKTPIHGLFEPAQLNIFIDGLRPQSKQLLDASARGKIKRKTPEEVTKLIENISASDHAILRDRVVPYVVVLMNLAFAFLLKSKHKRLATWGINKGRDTIKVDSQVSSRVLTTNKDMEITPWSSQQGPNIFQRTTKLEETLTQFMQVTMSNHKSTEPALKNLEIQVGQLAKQLAEKSSNSFGANIEKNPKEECNAVMTRNKKRLVVEDEDR

SEQ ID NO: 148771 - protein, 68 aa, Glycine max
  Coding DNA Sequence Number=SeqID_57086
  Subcellular localization annotation: CTP_CleavageSite=35; ConfidenceScore=5.06e-01
MRSIGNGRSASSGDASFLNLDRLTFLADVGLNFLRSGSVNHGFLPRLANVFLSEQKDTCRCRPIHNFG

SEQ ID NO: 148772 - protein, 68 aa, Glycine max
  Coding DNA Sequence Number=SeqID_57087
MMTKVMKKKLKRSKNNSSESKNISSKSRTSQEFKNQEEFKTQEESLQSRIKIQDLKNQDQDSRLKIQE

SEQ ID NO: 148773 - protein, 295 aa, Glycine max
  Coding DNA Sequence Number=SeqID_57088
MSPFLVRDLGAQNSKTIQRIHKAWETPLRKDQELRGIRNGIIGGYHEWLKAHIRGLDWLAKLKVVSEESFEAPEEDEEVQTLKSELGKAKLAKEKFKLAATHVRKECAGLREENAITARALEQETKRARKEEYGRNKFRGALWGSNSELKLRREERDQSRAHGMVLKEELVACSRSKRSLSQRLCETETNMLAIIAKYQEELGLAAAHEHRIADEYAQVYAEKEARGRVIDSLHQEATMWMDRFALTLNGSQELPRWLAKAKAMADTYSAPEEIHGLLGYCQHMIDLMVHIIRNR

SEQ ID NO: 148774 - protein, 43 aa, Glycine max
  Coding DNA Sequence Number=SeqID_57089
MLNGHRSKLRTAKKRNLAMALRVEMSSKFSKNFSSKFEVTNSQ

SEQ ID NO: 148775 - protein, 143 aa, Glycine max
  Coding DNA Sequence Number=SeqID_57090
MWAFLTGRQIDWAYLIRYRMHKALRANAPLPYPHLVTLFLHHFKIPLDDEPFVQWVRKQDLPQPIPDERTPSPPPQRASSSSLLNDVLTELHSLCAFLGDRFDAMDTRLDAMDAHFDGMDTRITRLEDNMSFIRRCFDPPADP

SEQ ID NO: 148776 - protein, 91 aa, Glycine max
  Coding DNA Sequence Number=SeqID_57091
ETTAKGTGLAESAGKEDPVELDSSRLRPVDPGGRHCQVGSLAGAAHLLKDNAVRIRTVKAWPIDPLVLRNLKLEVSESYHRDNWLVAAKRS

SEQ ID NO: 148777 - protein, 61 aa, Glycine max
  Coding DNA Sequence Number=SeqID_57092
MSLSSLIGCDFQTLKTRIAWHPLRSQAFWQIYYGPQYAAILSAREVEHAECSINEFVVTRS

SEQ ID NO: 148778 - protein, 108 aa, Glycine max
  Coding DNA Sequence Number=SeqID_57093
  Subcellular localization annotation: CTP_CleavageSite=79; ConfidenceScore=5.31e-01
MLVRMIRTRLFAAAQVKSCPGMHSSCVIASLSGCARTVGPPPISGGGPRTVWIWSPLNVRTRSPLKARACSPLKFRTCRLSKARECSPLKLKVHDPLKARTCSPLKVK

SEQ ID NO: 148779 - protein, 288 aa, Glycine max
  Coding DNA Sequence Number=SeqID_57094
MTVTALGALYTSSASRPSRDGRFSGSDEYTDFQEEIGRQRWTSLVTPMPKEGVRDMRSWVRGQWIPFDADAISQLLGYPLVLEEGQECEYGQRRNRSDGFDEEAIAQLLCIPGQDFARTATGRRVRIMCTNMTTLTQIWMTLLLSNILPSDHNSDLPLPKCQLVYAILTRMSVHVAQLIADAIYIFAGMAPTRHPLDPDKSNRAGFPSLITGLCQSFGVPVAPTKVIRPPITRAFIEKYCTQRQAQGDAPQAADAPPPPHQAGQAGAFDMEQYLRHLVRQQAANHRAH

SEQ ID NO: 148780 - protein, 187 aa, Glycine max
  Coding DNA Sequence Number=SeqID_57095
  Gene Ontology: Mol. function=receptor activity; Biological process =defense response to fungus
  Homolog annotation: Hit_ID=A7PBE2; Match level="QueryCoverage=87%, HitCoverage=25%, E-value=2e-36, Identity=49%"; Hit description =Chromosome chr16 scaffold_10, whole genome shotgun sequence
  Pfam annotation: Domain name=LRR_1; Domain location=121-143; Score =2.7; E_value=96; Accession=PF00560.24; Description=Leucine Rich Repeat
  Pfam annotation: Domain name=LRR_1; Domain location=24-45; Score=8.0; E_value=10; Accession=PF00560.24; Description=Leucine Rich Repeat
  Pfam annotation: Domain name=LRR_1; Domain location=47-69; Score =11.1; E_value=2.7; Accession=PF00560.24; Description=Leucine Rich Repeat
  Pfam annotation: Domain name=LRR_1; Domain location=71-94; Score =10.2; E_value=3.9; Accession=PF00560.24; Description=Leucine Rich Repeat
  Pfam annotation: Domain name=LRR_1; Domain location=96-116; Score =8.9; E_value=6.8; Accession=PF00560.24; Description=Leucine Rich Repeat
  Pfam module annotation: Pfam domain module=LRR_1::LRR_1::LRR_1::LRR _1::LRR_1; Domain location=121-143::24-45::47-69::71-94::96-116
MPNNSLSEEFPMIIHHLSGCARYSLERLYLSMNQINGTLPDLSIFSSLRGLYLEGNKLNGEIPKDIKFPPQLERLDMQSNSLKGVLTDYHFANMSKLDHLELSDNSLVTLAFSQNWVPPFQLRFIGLRSCKLGPVFPKWLETQNQFQGIDISNAGIADMVPKWKDTHIHGISSSSSSIAIEKQQLNR

SEQ ID NO: 148781 - protein, 26 aa, Glycine max
  Coding DNA Sequence Number=SeqID_57096
MHKALRANASLPYPQLSYRASAPMSL

SEQ ID NO: 148782 - protein, 203 aa, Glycine max
  Coding DNA Sequence Number=SeqID_57097
MKADMEPMNEQMATMMEAMMSMKKIMEANAVIVAATSAVAKVNPMLPSGLKQMNHPTSNMVGKDLGSTDDPMMCKFKSSTPSRHMACLPNYTPPNVAYIPNEDVNNSTPILIKSQQPQSDHAHVSRPMEETHGMPHHNLADFEPWLGYATEGQAVGGISFENNFGGPSVSPTTTTIAFCGGKSPSCYGRKGKGGSSKGKAQGH

SEQ ID NO: 148783 - protein, 380 aa, Glycine max
  Coding DNA Sequence Number=SeqID_57098
  Gene Ontology: Mol. function=hydrolase activity, acting on acid anhydrides, catalyzing transmembrane movement of substances; Cellular component=integral to membrane; Biological process =potassium ion transport
  Homolog annotation: Hit_ID=A4W860; Match level="QueryCoverage=58%, HitCoverage=32%, E-value=1e-105, Identity=90%"; Hit description =Potassium-transporting ATPase B chain
  Pfam annotation: Domain name=KdpC; Domain location=205-377; Score =262.8; E_value=7.2e-76; Accession=PF02669.6; Description=K+ -transporting ATPase, c chain
DIVKGGIKERFAQLRKMGIKTVMITGDNRLTAAAIAAEAGVDDFLSEATPEAKLALIRQYQAEGRLVAMTGDGTNDAPALAQADVAVAMNSGTQAAKEAGNMVDLDSNPTKLIEVVHIGKQMLMTRGSLTTFSIANDVAKYFAIIPAAFAATYPQLNALNVMHLHSPASAILSAVIFNALIIVFLIPLALKGVSYKPLTAAAMLRRNLWIYGLGGLVVPFIGIKDRANGSLIMQNGENRGSRLIGQNFTDARYFQGRPSATAESPYNPMASGGSNLAGSNPELDKAVTERVAALRAANPQASQHVPVELVTASASGLDYSLTPAAVAWQIPRVAAARQLTVEQVSQLVAEHTQKPLVSFIGMPVVNIVELNLALDALRKN

SEQ ID NO: 148784 - protein, 73 aa, Glycine max
  Coding DNA Sequence Number=SeqID_57099
GSRLQDTPVGPEEVQQGLGSFQALITGLCQFYKSPCTLQQGHSGPPTDRAFIKKYCVPRQAQGETPQQHWDGW

SEQ ID NO: 148785 - protein, 152 aa, Glycine max
  Coding DNA Sequence Number=SeqID_57100
MGEARLIALCARTPKGNRPAHPGNGSSGGRASGLEEHRTSAWCPVSQGNSLWSIPLWEQSSVAREVGKWIVPREKDGNSEGAGARSPEETLECEARSDTDVQIVRLTWVGRCGCSVEPRHGIESSKWAIFGKQNWRCGMNRKLGYGAQLRAN

SEQ ID NO: 148786 - protein, 105 aa, Glycine max
  Coding DNA Sequence Number=SeqID_57101
  Subcellular localization annotation: CTP_CleavageSite=86; ConfidenceScore=5.24e-01
MRVHCNQASRRPSMITDSPPLLMFPRTRWSYKLSQPTLLRASEVRLTGASSKGGKCAESPPTFICGKRWKNRRKPVMKNIPDLGVVFTLEEGISTSHVCPKGQQP

SEQ ID NO: 148787 - protein, 48 aa, Glycine max
  Coding DNA Sequence Number=SeqID_57102
MGVQIATGPTWAFQKIPPEGGCFWRKQPRSPGRAGWGRSEGKKCSALL

SEQ ID NO: 148788 - protein, 61 aa, Glycine max
  Coding DNA Sequence Number=SeqID_57103
  Subcellular localization annotation: CTP_CleavageSite=39; ConfidenceScore=5.61e-01
WAKRASTAKRSFNALSATKESGRASISRPRAKRKISALSAAVVFSQAKRTTGAKLKSNYLR

SEQ ID NO: 148789 - protein, 196 aa, Glycine max
  Coding DNA Sequence Number=SeqID_57104
AAGPMIRGDTLRLSAPFCYPEATGPITSRDQVWSFCTLVSSRGGGPDDTRRYLTVIRTLLSSRGGGPDDKQRPKAAGPMTSRDQVWSFCTLVSSRGGGPDDTRRYLTVIRILLSSRGGGPDDKQRPKTKFGHSAPLYHPEAAGPMIRGDTLRSSAPFCHPEAAGPMTSRDQVWSFCTLVSSRGGGPMISRDQFGHP

SEQ ID NO: 148790 - protein, 71 aa, Glycine max
  Coding DNA Sequence Number=SeqID_57105
MRIHCYQASRRPSMTTDQPPLPMAHIDPGIGPNISTCVRGDMPKNQKNIDAQSVSFRDTPEIKWKHRCIIK

SEQ ID NO: 148791 - protein, 147 aa, Glycine max
  Coding DNA Sequence Number=SeqID_57106
MMIWPLCRLCSIANKVSEVNEVGPVETEAGTGNGVGAEAGAGNDEAGADGDGAKEAGAIMEGVVDGGISEDGRVSDLFPLALRGPLEATIRSSRFQQFFIYAKLMAGLRLSSVLESEVTPLALHKAVVKVGNPSLEESCWAIVSRSI

SEQ ID NO: 148792 - protein, 190 aa, Glycine max
  Coding DNA Sequence Number=SeqID_57107
MNFAVKKPVELTPIPVSYANLLSYLLDNSMVATPAKVHQPPFLREYDSNATCACHREAPGRSIEHCRALKRKVQGLIDVGWLKFEENRVIFNFHRNWVQAIGLFAQATCAPEFGLPRPFNQRLLVLHIGGGAVKQRGQPFPCVQESSTTRDPRSLNPFSEIRRRKEEISLKRDRLYNEDQSKFLIEYASG

SEQ ID NO: 148793 - protein, 88 aa, Glycine max
  Coding DNA Sequence Number=SeqID_57108
MAKELSISIKHNSLRQTMKPHNFSKKKSSDLTSIIYLVAWYEMCHLAKPIHHHKDRFYTPLGPRNSKDKVYTYIYPRCRWNGKGVYSP

SEQ ID NO: 148794 - protein, 116 aa, Glycine max
  Coding DNA Sequence Number=SeqID_57109
  Homolog annotation: Hit_ID=Q84VH5; Match level="QueryCoverage=56%, HitCoverage=9%, E-value=4e-20, Identity=75%"; Hit description =Envelope-like protein
MLSQHPNILNYTDSVMKRESPLSLHYKLFEGTHVPDIVSTSGKAAASGAVSKDALIAELKDTCKISGIDDGEAAEEEEEAAEQEDEAAEEEVEAAEEEEDAAEDTESDDDDSDATP

SEQ ID NO: 148795 - protein, 47 aa, Glycine max
  Coding DNA Sequence Number=SeqID_57110
  Subcellular localization annotation: CTP_CleavageSite=14; ConfidenceScore=5.15e-01
MNFYRKFSMPPKVSGSSGRGGRTSSNRKDVLLALPEPVTKKTTASSS

SEQ ID NO: 148796 - protein, 20 aa, Glycine max
  Coding DNA Sequence Number=SeqID_57111
VDSRGSPNFLSMTKGLWRDI

SEQ ID NO: 148797 - protein, 147 aa, Glycine max
  Coding DNA Sequence Number=SeqID_57112
MGQNNFEEKLSQASPNFHAFLILKPNFGFLAMSMFSCIKAKKFGFLSLKLHSHHPNFAKPYSYIIGAFHRALGGHTFGHKLQENGGNVACPIDSEHNIGLRPSHSNPQLKKSSIKTTQNCPTNISTFSQIRAPKDEENTPMEAKTHD

SEQ ID NO: 148798 - protein, 119 aa, Glycine max
  Coding DNA Sequence Number=SeqID_57113
LDGGGHMNSARQSNHGSPDKIENGELPKCARECIRGARQSFLGLRIRLENGDLANSARQSIRGAPDSMRLAINSRGSRLDGGGRMNSARQSIHGSPNKFENGELANSARQSIRGAPDSM

SEQ ID NO: 148799 - protein, 162 aa, Glycine max
  Coding DNA Sequence Number=SeqID_57114
MAKFDPDIVLEFYANAWPTQEGVRDMRSWVRVLEEGQECEYGQRRNRADGFDEEAIAQLLRIPGQDFARTAAGRRVQIMRTNMTTLTQTWMTLLLSNILPSDHNSDLPLPKCQLVYAILTRMSVHVAQLIADAIYLFAEKYCIARQAQGGDPQALEASPTPP

SEQ ID NO: 148800 - protein, 141 aa, Glycine max
  Coding DNA Sequence Number=SeqID_57115
MTLLLSDILPSDRNVNHPLLKDQLGCVVPTWGSHPQDTQGTRKSPTGAWGFQLWVRASISPTGWPYPPGKDRTCKTPSGTRRSPTGSWSCQALITGLCQFYRVPVTSSKGIRPPTDRAFIKKYCVPRQAQGETPQQHWDGR

SEQ ID NO: 148801 - protein, 67 aa, Glycine max
  Coding DNA Sequence Number=SeqID_57116
MKMLLIPHDVAPCGACRPWIFFINGVLCFLNIMGVEWRRKKDDWRCHFKEKMSQEEAHHHRKSWIRA

SEQ ID NO: 148802 - protein, 60 aa, Glycine max
  Coding DNA Sequence Number=SeqID_57117
MTIQIAQELPLFNFERLDELCTRIGHPYIRVKRYDHSNSRELPLFNFKRLDELCPRIRHP

SEQ ID NO: 148803 - protein, 166 aa, Glycine max
  Coding DNA Sequence Number=SeqID_57118
  Homolog annotation: Hit_ID=A0ST23; Match level="QueryCoverage=27%, HitCoverage=91%, E-value=1e-11, Identity=73%"; Hit description =Putative reverse transcriptase
MTVKTSDTCSSRRRSQLVCKRMPGADKPVRARQRMRKEKIPHQAPFAIQAAQLLGRAIGAGLFAITPAGERGMCCKAIKLGNARVFPVTTLSTLEDPSKPRLIRWVLLIQEFGIVIKDKKGTELEFVIMVIAVSFGKPVVPAALMNRPTRGERRFAYWALFRFLAH

SEQ ID NO: 148804 - protein, 110 aa, Glycine max
  Coding DNA Sequence Number=SeqID_57119
MELQVDMRFDAMESRITKVEEDVSFILLFDVAKGGENLRDLGDCHHQKGGDCRRSLVLYCHHQKGGDCRCKCLWCFDDDHDEEKQMMQMIQEYKPQHQDDHQYIRKEIPN

SEQ ID NO: 148805 - protein, 118 aa, Glycine max
  Coding DNA Sequence Number=SeqID_57120
  Subcellular localization annotation: CTP_CleavageSite=49; ConfidenceScore=5.36e-01
MVRMCSPLLARACSPLKVRACSPLLARTCSLLMARACSPLKARTCSPLKARTFSPLKGEGMQMHATFVAKFGKCGLHMKQCNIDCPFERGDNSCNLILSFANLFGNSLRVYVLFDLVT

SEQ ID NO: 148806 - protein, 184 aa, Glycine max
  Coding DNA Sequence Number=SeqID_57121
MGWSDPRHGRGRFPDPVQCYVAIGSGMIGRAGAGAICRNNSAMQQLGTLPWHIARISILANVRGQDLGGIGCTLETACRRLARLLESELQRRAVQHRIALDPKRSLFRIDRQRAARLRIVAADDKIRLSAERKRAAADQHAAGSKRIGGRRHQRSLPENGAAAIAVMAAESQRSAARFDETPCP

SEQ ID NO: 148807 - protein, 57 aa, Glycine max
  Coding DNA Sequence Number=SeqID_57122
MMAHHKAFQGYFDDAKESIVKQILKFQESRFKNNQDQDSRLKTQDLRIKRRLNQDKY

SEQ ID NO: 148808 - protein, 226 aa, Glycine max
  Coding DNA Sequence Number=SeqID_57123
  Gene Ontology: Mol. function=motor activity; Cellular component=cell projection
  Homolog annotation: Hit_ID=UPI00016621D1; Match level="QueryCoverage =98%, HitCoverage=40%, E-value=2e-14, Identity=31%"; Hit description =UPI00016621D1 related cluster
GLHPLTFKGLHVLAFRGLQVLAFRGLHVLPLRGAHVLTFRGLHSLALRRLHSFAIRVLHVLAFTGQQDLPFRGLYVLTFRGLHAMAFIGLHALTFIGLNVLTFRELHVPTFKGLHVHAFRGLHVLTFRGGLHALAFRGLHAFAFRGLHVLALRREHALAFRGPHVLTIRGLHILVFRGLHALSFRGKHVLAFRGLGLHVLAFRGLHVLAFRGLHALAFRGLHVLAF

SEQ ID NO: 148809 - protein, 163 aa, Glycine max
  Coding DNA Sequence Number=SeqID_57124
MDNEEGVQEQMKADLSALKDQMASISEVMLKLQKTIKDKATATASSTVREAEPVLQPALNPGQDRNTAVFGRRYSPQAYPYGLPPDFTPRNTPEDLSQAPTFEGQLPPYDYPGQDNEQRDTHLGPLLHLKDPSPHELPQLNIVCHIPASPTPVKEFVPFAEDK

SEQ ID NO: 148810 - protein, 136 aa, Glycine max
  Coding DNA Sequence Number=SeqID_57125
VVVKDPPTTEEELVDDQPEAPVEEGVTDVEGFLGGPHDTSVLSDFENHIALKVWNGDEHSELKLSSHGRKMTKFGRPAPKIEGFVVASGLSPLITCSLDTGDRGLMGVPQLRATSCRRRCRDVDGVTRGQRCKGKS

SEQ ID NO: 148811 - protein, 66 aa, Glycine max
  Coding DNA Sequence Number=SeqID_57126
MCTYAIFGSQCVLSMHEMAPRKLASKRSRKDKAAEGTSSAPEYDSHCFRSAEHQQRFEAIKGWSFL

SEQ ID NO: 148812 - protein, 187 aa, Glycine max
  Coding DNA Sequence Number=SeqID_57127
  Homolog annotation: Hit_ID=A8GGH6; Match level="QueryCoverage=26%, HitCoverage=6%, E-value=2e-07, Identity=55%"; Hit description =Binding-protein-dependent transport systems inner membrane component precursor
MNANNRRLTGALLLGAVALLLLPWYSLEAGFFDSGWLFNLWRDEASAPAAVADRQPSMAGARRGAAGAVRRLRLIARQRAQPVAAAVQRAGRDLPDCGRARDWLQRLELAVAGKSLRRAAAGTASDGRWRASAADRVFAAVLVCAGRTRRAERRCLCGGVAGAADCAGQHLRTLSGAQHVCGVGAGR

SEQ ID NO: 148813 - protein, 175 aa, Glycine max
  Coding DNA Sequence Number=SeqID_57128
MASMMKAMLGMRQLIENNVATATIVSSAAETLPATAHHPLPNAVGREKSTLGHISNPHLGYNRVAYPYGLPPNYTPPVMRDDAGHVPSPILEGESPRQPDEDHREYAQGDVDFYPPVPVEGPAPNTLPQHNLIAQPIFLSTKGPPPAAKERRKLDLIEERLRAVEGFGDYPFVDM

SEQ ID NO: 148814 - protein, 149 aa, Glycine max
  Coding DNA Sequence Number=SeqID_57129
  Homolog annotation: Hit_ID=Q5XM22; Match level="QueryCoverage=79%, HitCoverage=89%, E-value=3e-28, Identity=45%"; Hit description =Resistance-like protein HAAS-2
MHVDEAVLMLVELLEVSGEEARAETTQCHGAYVLLSWLRDIYQSKYEARHWTVAARAYLLHLLGCTLFANKSATHSGSYAWGAAVLVHMYDNLNDVCKSDNQQLAGYITLLQCWIYEHFSSVAESLTDPDYDEMSPRVCRWIASKASSK

SEQ ID NO: 148815 - protein, 170 aa, Glycine max
  Coding DNA Sequence Number=SeqID_57130
MTLTYKNRRITRPFRLARFGDDADAGSRQARQGASAGVGGCRGWLNYAASEQIVLRVHHMRCEIPHRCVRRKYRIRRHSPFRLRNCWEGRSVRASSLLRQLAKGGCAARRLSWVTPGFSQSRRCKTTASAKLACLQVDSRGSLPRGILRTKYQRGPMRAKDSERPGNRGL

SEQ ID NO: 148816 - protein, 58 aa, Glycine max
  Coding DNA Sequence Number=SeqID_57131
DCLALFMCPPPSSAEPPVTGKYEKRRSRDKSRHRLVTERAKTDEISVFIFTFLLSLIK

SEQ ID NO: 148817 - protein, 56 aa, Glycine max
  Coding DNA Sequence Number=SeqID_57132
STLEDPQPYEISIGLKEHSNPVTPKAYTPKSPSGPLPPDSDIAHELYNTHDLTLVF

SEQ ID NO: 148818 - protein, 170 aa, Glycine max
  Coding DNA Sequence Number=SeqID_57133
MCHLTAYVCVYYNGQICNTYEDTTFVSNNTKNFMVNNAITFTQLLGLVHQKLNIDPQQHIQHLHFQCPILESGQRYMYTSFILRDDVDVRQMFNIFYKNLSLPFVELFAIICYNNNPPTNQHGSTSNLEDLSDEYETCWIKNHDSDTDSSSGPEGSNMSASHETIFKRDW

SEQ ID NO: 148819 - protein, 178 aa, Glycine max
  Coding DNA Sequence Number=SeqID_57134
EKYDISKEKWAQFCQTHRDPSWEDVQKKAQVIQKQNTAPHVLSRGGYEYLEQKLLAEKIKKKLEEAAQSGRVDGVIDPPSPVRRHVKWKMARTKKTGEMATEATKEILEKIDSFEERRQRDTSSLMDARMFSPLLLDIQSTLDVSVLLESASPSSNTSYRLHGRPATLPCCLLKNCSC

SEQ ID NO: 148820 - protein, 107 aa, Glycine max
  Coding DNA Sequence Number=SeqID_57135
MQFKGTIDSMQQAFKRAETQIGKDKGQLELNVEDQKNSFDLFEAMKHPDMSDACFEEEEVEQEIALSSLTMVLQFPLEKEPNYVTDCLVCDKELDDPKENSIGSCGS

SEQ ID NO: 148821 - protein, 111 aa, Glycine max
  Coding DNA Sequence Number=SeqID_57136
GSYLTHGPEIYPKAHENPRAFSCISSPIFLESSIQFPCWVGLHHSLSLEKDLTSNPEVLEALGFFPQHLNEDALIPHDVALSGACRPWIFFINGVLFFLKINCNRMEMEER

SEQ ID NO: 148822 - protein, 156 aa, Glycine max
  Coding DNA Sequence Number=SeqID_57137
  Subcellular localization annotation: CTP_CleavageSite=48; ConfidenceScore=5.00e-01
MSISPCGSISWSASFRHRDRARKTLSGPEEVQQGPGASSSDYGPLSVLQGARPPSKRSPTGPWSYTPAHLRLTFRLEWLLHGVPVAPSKVIRPPTNRAFIKEVCAPEAGAEGETPQQPGDGLQRVTNAPPPPSRVHLSSSTKRLEGRCLRQHGLDQ

SEQ ID NO: 148823 - protein, 134 aa, Glycine max
  Coding DNA Sequence Number=SeqID_57138
YIYLGLTENKRGYISCESVLMEGTSTRVSKRTREDTSLVDLCLSHVGVVLILPDEGNHQILLRADPGSFQVSILVPLYLSKSGTFNFGGMTTSGTKHNSTMSANGAEVVTGGVEEPSRHWAEAYHYRSSLSSER

SEQ ID NO: 148824 - protein, 178 aa, Glycine max
  Coding DNA Sequence Number=SeqID_57139
MAPRKLASKRSRKDKAAEGTSSAPEYDSHRFRSVVHQQRFEAIKGWSFLRERRVQLRDDEYTDFQEEIGRRRWAPLVTPMAKFDPETVLEFYANAWPTEEGVRDMRSWVRGQWIPFDADAISQLLGYPMVLEEGQECEYGQRRNRSDGEASANHAHQYDHPDPDMDDVAPQQHPAHRS

SEQ ID NO: 148825 - protein, 68 aa, Glycine max
  Coding DNA Sequence Number=SeqID_57140
VSSSEEDLEEDLEEFPPELAVEAPDFPEDDEDPLLDVNSPEDIMSASEADSTEESGLGGTTNSNDSSS

SEQ ID NO: 148826 - protein, 16 aa, Glycine max
  Coding DNA Sequence Number=SeqID_57141
MSRNSNGHNSSYRCPI

SEQ ID NO: 148827 - protein, 219 aa, Glycine max
  Coding DNA Sequence Number=SeqID_57142
MKELEEEKKQSLQAWKKELKDAIITDLFNGDKDSALTNFDLNVLGACVSTKESNAEIAVNPSGEVHVGRVTPPMGLYVQSQNCTKQVALAKIHDGPSTIHCVAYADDVVRVSVEQVIDGEAEVPLPTSEIKYVRDVVNTFIAWPLPLHSGITPDKVANAAELNNDVPKQDPLRELIKTLVDIYDKPVEFVWDLTEFGIPNRNNIRRQMLEHSHTSIVDH

SEQ ID NO: 148828 - protein, 239 aa, Glycine max
  Coding DNA Sequence Number=SeqID_57143
MTTLTQIWMTLLLSNILPTDHNSDLPLPKCQLVYAILTRMSIHVAQLIADAIYIFAGMAPTRHPLDPDKSNRALGFPALITGLCQSFGVPVTPSKVIRPPITRAFIEKCCTQRQVQGDVPQAADTPPPHQDGPAGLFDTEQYLRHLVRQQAANHRAHVQTHDCLYQMSLSLQSQGFTPFPCPTPDQFRAEVAWPGDWPEAQAAEAPAGAPAEAPDEADEAREDEEMTDLLDFLGGSGAA

SEQ ID NO: 148829 - protein, 96 aa, Glycine max
  Coding DNA Sequence Number=SeqID_57144
  Homolog annotation: Hit_ID=UPI0000ECBAF8; Match level="QueryCoverage =42%, HitCoverage=48%, E-value=1e-16, Identity=100%"; Hit description= UPI0000ECBAF8 related cluster
MVNYMCKSFLHAMNVFIRVHPKQFIFMCKGIDSRSFNISGDFMCMQAWHWPSFYNVVTGKTLALPNLIALQHIPLSPAGVIAKRPAPIALPNSCAA

SEQ ID NO: 148830 - protein, 98 aa, Glycine max
  Coding DNA Sequence Number=SeqID_57145
MGTIKCNGHRQIKAPKHPRSECLDSLTTQVPHEWVIRKGQCTPHEHTQHAHANAFPTSINIPFSYHSPHRHHLVSMTLSTTKTSFHIYIIINNNINSC

SEQ ID NO: 148831 - protein, 281 aa, Glycine max
  Coding DNA Sequence Number=SeqID_57146
MAKFDPEVVLEFYSNAWPIEEGVRDMRSWVRGQWIPFDAYAIGQLLGYPLVLEEGQECEYGQRRNRSDGFDEEAIAQLLCIPGQDFARTAAGRRVRIMRTNMTTLTQIWMTLLLSNILPTDHNFDLPLPKCQNPDADEHPCMAPTRHPLDPDKSNRALGFPALITGLCQSFGVPVAPTMVIRPPITRAFIEKYCTQRQAQGDAPQAAGAPPPPHQAGPAGSFDMEQYLRHLVRQQAANHRAHVQTHDCLYQMSLSMQSQGFASFSCPTPDQFRAKVAWPGD

SEQ ID NO: 148832 - protein, 85 aa, Glycine max
  Coding DNA Sequence Number=SeqID_57147
WRAHRDNQFNKDQSGPSNRPIQQGPNIFQRTTKLEETLTQLMQNPKEECKTVMTRSKRFVEVKDEDSVVHKKKTTDKKSTDGKKK

SEQ ID NO: 148833 - protein, 146 aa, Glycine max
  Coding DNA Sequence Number=SeqID_57148
  Gene Ontology: Mol. function=ligase activity, forming aminoacyl-tRNA and related compounds; Cellular component=cytoplasm; Biological process=alanyl-tRNA aminoacylation
  Homolog annotation: Hit_ID=Q5PF17; Match level="QueryCoverage=25%, HitCoverage=4%, E-value=1e-11, Identity=86%"; Hit description=Alanyl- tRNA synthetase
MRKRHASRREKGGQVSGKRQGRNRRAHEGASRGKRLGGGAYGKTPATRPFYGSWPFAGLLLTCSFLRYPLILWITVLPPLSELIPLAAAERPSAARNSYDHDYEFELGTLRSCAFLIADGVIPSNENRGYVLRRIIRRAVRHGGIL

SEQ ID NO: 148834 - protein, 53 aa, Glycine max
  Coding DNA Sequence Number=SeqID_57149
MSQVKELLEKGWVQESLSPCVVPVLLVPKKDVMPFWAITNHRSHLYEAYASLS

SEQ ID NO: 148835 - protein, 310 aa, Glycine max
  Coding DNA Sequence Number=SeqID_57150
MRSWVRGQWIPFDADALSQFLGYPLVLEEGQECEYGQRRNRSDGFDEEAIAQLLCIPGQDFARTAAGRRVRIMRTNMTTLTQIWMTLLLSNIQPSDHNSDLPLPKCQLVYAILTRMSIHVAQLIVDAIYLFAGMAPTRHPLDPDKSNRALGFPALITGLCQSFGVPVAPSKVIRPPITRALIEKYCTQRQAQGDAPQAADVPPPHQAGPAGSFDTEQYLRNLVRQQVANHWAHVQTHDCLYQLSLSLQSQGFTSFPCPTPDQFRAEVAWPGDWPEALAEAPAEAPDEADEAREDEEMTDLLDFLGGSGAT

SEQ ID NO: 148836 - protein, 234 aa, Glycine max
  Coding DNA Sequence Number=SeqID_57151
MWSWVRGQWIPFDANALSQFLGDPLVLEEGQECEFSQRRNRADGFDEEAIAQLLCISGQDFAQTAAERRVWIMRTSMTTLTQMWMTLLLSNVLPSNHNSDLPLPKCQLVYAILTRMSVHVAQLIVDAIYLFVGMPPTRHPLDPDKSNRALGFSALITGLCQSFGVPVTPSKVIQPPITRAFIEKYCMPRQAQGDAPQAADAPPPPHQADPVGSFGMERYLQHLVRQQVTNHRGQ

SEQ ID NO: 148837 - protein, 131 aa, Glycine max
  Coding DNA Sequence Number=SeqID_57152
LITGLCQSFGVPVTPSKVIRPPITRAFIEKYCTPRQAQGDVPQAANAPPPPHQADPAGSLGMERLSQQDQGFAPFACPTPDQFWAEVAWPEDWPEDQTEEAPAGAPDDAEDARMDEEMTDLFGILGGSGAT

SEQ ID NO: 148838 - protein, 67 aa, Glycine max
  Coding DNA Sequence Number=SeqID_57153
MTVLGGAGHPPSNGVGPTDREWIRLWPLGTLSFSIWKCCGHIEMWVEEVSKSEGRAVGSRDLHRVGG

SEQ ID NO: 148839 - protein, 230 aa, Glycine max
  Coding DNA Sequence Number=SeqID_57154
MLGLQRRVCEICDLGQFLGYPLVLEEGQECEYGQRRNQADGFDEEAIAQLLCIPGQDFARTAAGRWVQIMRTNMTTLTQIWMTLLLSSIQPSDHNSDLPLPKCQLVYAILTQMSIHVAQLIADAIYLFAGMAPTRHPLDPDKFNRALGFPALITGLCQSFGVPVAPSKVIRSPITRAFIEKYCTQRQAQGDAPQAVDAPPPHQAGPAGSFDTEQYLRHLVRQQAANHWVH

SEQ ID NO: 148840 - protein, 96 aa, Glycine max
  Coding DNA Sequence Number=SeqID_57155
MSVKNLVGRLGVHDKTDPTLGDQLGSLCYVRMLQPYGISIGFKEHSNQVYLPPRPILRKVCQGLSLLIQVQPKNHFSTQTLSMNFTKLTTHQLFSK

SEQ ID NO: 148841 - protein, 113 aa, Glycine max
  Coding DNA Sequence Number=SeqID_57156
MASRKRELAHNRPIISMEQFLEKVAWPEAQLPLERAHKVVPPRPIPAKTEPTSVEPQPPVVDPPASLELETLSPPAPPLIIIPDDSVDEATAPPDSPSCNIDNGSDFSDWMDC

SEQ ID NO: 148842 - protein, 307 aa, Glycine max
  Coding DNA Sequence Number=SeqID_57157
  Gene Ontology: Mol. function=helicase activity; Biological process =viral genome replication
  Homolog annotation: Hit_ID=Q2A9E0; Match level="QueryCoverage=97%, HitCoverage=21%, E-value=3e-60, Identity=42%"; Hit description =Putative uncharacterized protein
SDSNFLSENENCQSSANEPTINSEGYSDLGDQAMQCRHCNAKMWYNERISKDKNTTSPKFSLCCGDDKVELPLLQNPPKHLERLLFDDNATDSKNYQYNIRTYNMMFAFTSTGIKLDKSINETKGPPTIRIQGQPCHRIGSLLPMPGKQPKFAQLYIFDTQNEVENRINTMSQHVAIQPHIVSTLSQMLDDHNVHAKNFRMARDRLTNSQVDNVKLRLIVSREKDGRTYNLPNVSEVAALIVGDFDANSRRDIIVETQNGELQRIHELHSSYLGLQYPLLYPYGEDGYRPDILHRSTFDNKKGREIV

SEQ ID NO: 148843 - protein, 125 aa, Glycine max
  Coding DNA Sequence Number=SeqID_57158
MAEQAKQVFYVQDPCDERRKIVTPPSSPPPPPFLDSTSHSPSTMKRTRKATQLRSLATIPIGAERPLVHEDPAIGKADGPHKKKLRTYLGIFAREKAEFDIREASDMRTKKNTSDHGGAMDTVQV

SEQ ID NO: 148844 - protein, 155 aa, Glycine max
  Coding DNA Sequence Number=SeqID_57159
  Homolog annotation: Hit_ID=Q2HW90; Match level="QueryCoverage=83%, HitCoverage=26%, E-value=1e-10, Identity=29%"; Hit description =Putative uncharacterized protein
MGLNQALSFKKRFYHVIIKSLEVASLQELGQRMNLLQRQTFRKTYEKIWDFAMIEVFVKAIASLAQYYDRSLRCFTFGDFQLVPILEEFEGILGCPLGGKKPYLFSGLYPSMKRVAKVVKISAQELDRVKQNRNGVVGIPKKHLEEKAKALVDQG

SEQ ID NO: 148845 - protein, 106 aa, Glycine max
  Coding DNA Sequence Number=SeqID_57160
MEDGSLSFNGDFPPWRCSRRYRRIDERMCHRRGNKPWKKELHHQECALDKKLKEKDSMEEKKDDIRSIRACRPRIFFINGFLCFLEDEWQWNGEGRERGDATLRRR

SEQ ID NO: 148846 - protein, 141 aa, Glycine max
  Coding DNA Sequence Number=SeqID_57161
MEVLSLAEIAYSGWSFASLNLLRKVEEGPQLLVVFVVAALEEEHMACMDQQHSGREGQAVVVVEYLSISDLNDSSNLDYEDESVATSWTPLRTIASFLALNYWELEAIFSIKFLASAGVISPRAPPLAASIILLSMLLSPS

SEQ ID NO: 148847 - protein, 90 aa, Glycine max
  Coding DNA Sequence Number=SeqID_57162
  Gene Ontology: Mol. function=nucleic acid binding; Biological process= DNA integration
  Homolog annotation: Hit_ID=Q1RU49; Match level="QueryCoverage=100%, HitCoverage=74%, E-value=2e-22, Identity=57%"; Hit description =Putative polyprotein, related
MTNDSSKMTSKFAKLDKFEGQDFRRWQKKMHFLLTTLNVVYVLSTPMPVYMEDETLDQTRKRSKWENDDYICRGHILNGMSDFKIDSDQN

SEQ ID NO: 148848 - protein, 65 aa, Glycine max
  Coding DNA Sequence Number=SeqID_57163
MREGGSEKERERLIDGRGTVTGAGVTCLWLSQKVVQGQNRPFRASAGVDSVVQANFRGTGSEFRM

SEQ ID NO: 148849 - protein, 129 aa, Glycine max
  Coding DNA Sequence Number=SeqID_57164
MDCTKKLEKKGWEKEIKWFIGVVEEKEEGEGGRGGAVDFFAHLPLLPHLCPSQNIVFLPHSHPNPLPPPPPPLPPPLLPLSSPSSLPFNTLTPSPSSIVVMLGDRPSKFLISKNQIMGVKDFEYDEARE

SEQ ID NO: 148850 - protein, 419 aa, Glycine max
  Coding DNA Sequence Number=SeqID_57165
  Gene Ontology: Mol. function=galactosyltransferase activity; Cellular component=membrane; Biological process=protein amino acid glycosylation
  Homolog annotation: Hit_ID=A7Q6G0; Match level="QueryCoverage=41%, HitCoverage=64%, E-value=3e-65, Identity=64%"; Hit description =Chromosome chr11 scaffold_56, whole genome shotgun sequence
  Pfam annotation: Domain name=Galactosyl_T; Domain location=241-408; Score=-71.0; E_value=0.093; Accession=PF01762.12; Description =Galactosyltransferase
  Subcellular localization annotation: CTP_CleavageSite=39; ConfidenceScore=5.27e-01
MTVEEAKEQDHGVLCQHPSPSPQFPPPSPCRHHCRLTVVCSSFCRRSRSRRHHNKLSLPTTTSTSSFEPKLEAVIDLTPLTAFQSELRRRFLSSGKDAYQDLQTLVTLDHNRRFSSWHRNTSSHKLVVVRRDRSLGGKEVVVAWVREVTRIRYQCWKLPKCWSTVINSNASVFDANEQEEYKREAYRVVRASNQVQFKDTLRSSLTTTTTTSPQLTNYFSSNSDNNLRILIGILTLPDQHLRRNLLRLVYGTQPAPPGAKINVKFVFCNLTKEDQKVLVALEIMRYGDIIILDCKENMNNGKTLTYFSSLPEMLNDTASSYPPYHYMMKTDDDTYLRLNILVQSLKPLSREDLYYDIVEWIRNSDISRKFEGPEDKVFGEWMREGGKGKHSTGVVSVSDTDTDAFQTPDTTRSWSVCAS

SEQ ID NO: 148851 - protein, 187 aa, Glycine max
  Coding DNA Sequence Number=SeqID_57166
  Gene Ontology: Mol. function=protein-tyrosine kinase activity; Cellular component=integral to membrane; Biological process=protein amino acid phosphorylation
  Homolog annotation: Hit_ID=A7P6F9; Match level="QueryCoverage=79%, HitCoverage=24%, E-value=5e-38, Identity=50%"; Hit description =Chromosome chr9 scaffold_7, whole genome shotgun sequence
MHYLYIILGSSDLPHKNLKSSNVLLGPENEPMLVDYGFSHMVNPSTIAQTLFAYKASEAAQQGQILTGWFPSQYLNNGKGGADVVQWVETAISEGRESKVLDPEIAGSRNWLGGIKQLLHIGASCTKSNPLWRLDMAEAVRRIMEIKFEGGHESRSLADSHHGEQSQRRHGTNNFGSRDISNMAAPR

SEQ ID NO: 148852 - protein, 41 aa, Glycine max
  Coding DNA Sequence Number=SeqID_57167
MAVELGQQTVELSTLALTSASDHEIDGDDDNLDEFLEGMFP

SEQ ID NO: 148853 - protein, 134 aa, Glycine max
  Coding DNA Sequence Number=SeqID_57168
MHLFPYPQLVTLFLCHFQIPLDDEPFVQVKRSFAIGAGVVTSFGYCKDRDGQWLKKDALPPQDERTPSPPSQRDYSLVLMNEVLSELRGLCTYVGERFDSLDGRFEGMDTRIMQLEEDVTYLRRCFDLPPPSLF

SEQ ID NO: 148854 - protein, 171 aa, Glycine max
  Coding DNA Sequence Number=SeqID_57169
MDYQEYQRSLHLSRAYSDKMIATTQDGVNHIFPIAYAIVEGETTSAWVTHTWRRCTDNILGIPMRISQVQLNDLISYKTKLENQSPLLAPRSPPGRFRVMFQSQKYDYGEYQAKHLPCSHVMLPKRDQWGPDPRRKRTAKGCPVSTRISTEMDEDENERKNRKKMWNLPTT

SEQ ID NO: 148855 - protein, 57 aa, Glycine max
  Coding DNA Sequence Number=SeqID_57170
  Subcellular localization annotation: CTP_CleavageSite=17; ConfidenceScore=5.19e-01
MGLKSTLRLMRTLGPSPASLAQSSWTLLAMTLVMGSFWASPHFLGTKSPTRKFLGLT

SEQ ID NO: 148856 - protein, 173 aa, Glycine max
  Coding DNA Sequence Number=SeqID_57171
  Subcellular localization annotation: CTP_CleavageSite=21; ConfidenceScore=5.42e-01
MATPHNSAPPSPLTGAASHLPSNMKRTRKATHLRSLATRPIREETPLVHVDPMTKKADSPHRKKLRTYLGIIARDKVFKSDLTSKLALAVDKDNVDDTICKECRISKENWAQFCQSHRDPSSEKQNNALRELSRGGYEFLENKLMEKKKRKQLEEVAKFGSTDTVIDPPSPIR

SEQ ID NO: 148857 - protein, 43 aa, Glycine max
  Coding DNA Sequence Number=SeqID_57172
MAAIFSSLLFVSSPIPESIKLHNFSGLAPRSSLLQDKEEKVIV

SEQ ID NO: 148858 - protein, 97 aa, Glycine max
  Coding DNA Sequence Number=SeqID_57173
MMDTLEPYTGAMKGTMLEPQANLGEVQGCLGEKSAKNTKIGVYLANRGCVNRLLHPNFFLGSLLITSEGLTPITVESVKFREVSQGKQPKTQKQERG

SEQ ID NO: 148859 - protein, 254 aa, Glycine max
  Coding DNA Sequence Number=SeqID_57174
MHSIGVRSTLEQLPLAYLWKKGGGLREFYGSITEALKAIFQQNWGGGCRPARPGKLGYFLLKQPNFQNVLEGPRFKNFYLHLQIDKFTPPHFCVFGCFSCETSWNFMDSRAMGLKPSEAINSGPQMKLGCNNLFTHPHFAKYTLVFVFLAGFSPKYPITLWIPWRWVLNILKWSNESRMLTNNGPRTKLGYDTHEDNQLVNALATLSSMFALSNDEVMPLIRIQHHESSAHGHLVDEEFDGKPRYFDIKEYIKN

SEQ ID NO: 148860 - protein, 197 aa, Glycine max
  Coding DNA Sequence Number=SeqID_57175
  Homolog annotation: Hit_ID=A2Q454; Match level="QueryCoverage=58%, HitCoverage=61%, E-value=1e-14, Identity=35%"; Hit description =Retrotransposon gag protein
MENQVGALQKVKKVELPTFEGHDPLGWLARAEKFFEVQQVKPSDRLRLAFLSMEGNAIHWFQYWRLKSKNPSWKEFSYSLIRRFGGNTRRMVYERLVSLSVKDQILGYFLAGLVEAMSSKVILMMPKNQELSKDSRFKNNQDQDSRLKIQESREDSIKILIKKFFKTLSSTRSFQKIITKEFYSLVIDYQKVVIDYQ

SEQ ID NO: 148861 - protein, 90 aa, Glycine max
  Coding DNA Sequence Number=SeqID_57176
MATCMACSRYLNNDIASNKKKLKNQQGNNPKKLRLHTSYVLIVLSLSIVNLMQSYPARALDRRLQVDWARDPMEGPRVLMSLRVDFEPIG

SEQ ID NO: 148862 - protein, 105 aa, Glycine max
  Coding DNA Sequence Number=SeqID_57177
MMVNVSTSLCGSNAFQDYFDDAKESSLESKVKQVPRIKESFNQSKFRRIKESFNQSKFQRIKESFNQDSRFKIQCTSFVVQVEGTSTWVAILRTRDGTSLVDQFK

SEQ ID NO: 148863 - protein, 50 aa, Glycine max
  Coding DNA Sequence Number=SeqID_57178
MTGKEMRGGGCIVARLGELVAFSRSNLARPSELVTSSLSFFVAQASQRLA

SEQ ID NO: 148864 - protein, 114 aa, Glycine max
  Coding DNA Sequence Number=SeqID_57179
ARLPLAEKKVWITIRYLRMSSDLSSLDDKGADDDSRPEDADISGKGADDDIANETFSQSQPEDADISGKGADDDGEDGNSHPGSRFMVSWDFGSELVERLDMIYVRVLVWSAVQ

SEQ ID NO: 148865 - protein, 359 aa, Glycine max
  Coding DNA Sequence Number=SeqID_57180
MGQLQRQAFRKIYGKIWDLAMIEVSVEAIPSLIQYYDQPLRWFMFGNFQRKEAVLVFWVLPLHDENSQSGQSLGARIGPRSTRKRKVKAFAEQGEWASFIDVLVLLVFGVVLFPNVDGLVDLAAIDAFLAYNHIKESSIVAILADAYETFDWRCEMSSTRIVCCTPAIYVWLVSHIFCHESRPVSPLQGHRMCAEKGKANWEQLLTGMTTWLPHEKSTIGREYRKPFIARIFSEPKSRVLQRVRKAWNAVHKKDKELKGSNNGIVGGYHKWLRARMQEITWLPKLKISSEEEAETPEESEEVQALKAKLERAQAVKEKFKTTTIKVRKECDKLRDVNMATIEALEQETKRARNKFRGVL

SEQ ID NO: 148866 - protein, 126 aa, Glycine max
  Coding DNA Sequence Number=SeqID_57181
MSPIEVSTVATYPSTRGQVRLKGASSKKGKDEGVATNVYSRKTLEKPRKGSTNFKNKGSGVVYIDKGVALAPTYPQEMRGGGCIAARPGELVAFSRSNLARPSELVTSSLSFLVAQASQGPENVTK

SEQ ID NO: 148867 - protein, 25 aa, Glycine max
  Coding DNA Sequence Number=SeqID_57182
MDTGLKCLEVVKGGSRRKFSGRKPT

SEQ ID NO: 148868 - protein, 88 aa, Glycine max
  Coding DNA Sequence Number=SeqID_57183
MTDICLVSVATYPSAGGRRETRGMRVPRKEYARSRHQRLFEENVRKTGNDAIYELLSERFGSCIYARGRVFPFAPTYSSICDEEIRPT

SEQ ID NO: 148869 - protein, 153 aa, Glycine max
  Coding DNA Sequence Number=SeqID_57184
  Subcellular localization annotation: CTP_CleavageSite=39; ConfidenceScore=5.36e-01
MRPLWVTPLSLMILSLWRNTRCSFSSLLPISSRPWSIIRCNNSSTTENVSISCGAPECINQGSPLCLPRGTTPASCRASKINLLEVVTSFKCLGLCKLHTSIAFTVDPPWLASEFIFIFGSSSWNVNHPTSIKLYTLCLRTMHCSTKCPGVPP

SEQ ID NO: 148870 - protein, 307 aa, Glycine max
  Coding DNA Sequence Number=SeqID_57185
  Homolog annotation: Hit_ID=Q6WAY4; Match level="QueryCoverage=57%, HitCoverage=32%, E-value=5e-14, Identity=29%"; Hit description =Putative uncharacterized protein
MGSNQIPLFKKRYYQVKIKSLEITNLRELVQLMGQIQRQAFRKAYGKIWDLATIEVSVEAIASLTQYYDQPLRCFTFEDFQLVPRVEEFEEILGCPLGGRKPYLFSGFYPSMARVAKVVKISAQELDWVKQNRNGVVEVPWRCLEEKAKALANQGEWTSFIDMLALLIFGDVKRAAQELFVVHRLSMSGWFHTFFAKKVGPFVCYKVTARVPRKERRIRTNSWLAWKRHPLIGSLVGRKEEPRFCPRVKDFQMVSVTPTQGYFKEFVRHRMQCEGRTKSLGEAVMGSSVAIVNGRESGHKDWIGSQS

SEQ ID NO: 148871 - protein, 56 aa, Glycine max
  Coding DNA Sequence Number=SeqID_57186
MSDCESYTTENMARHVSVLWKDIVNFDIDNMGVKTLPSEYLMQLHTCSGLKAETLG

SEQ ID NO: 148872 - protein, 145 aa, Glycine max
  Coding DNA Sequence Number=SeqID_57187
YSVVFKSKGERKDIELVEEEHARIGADPSSGTSNKSENYKEEAWKKTQKHKPKRVESVNADAEAFAEVVEHTNKRDTGHQNVALDNKTGDSTMLKMGDSAKVVIKQDMKGRRHKYGFNNNEREKAQKKRVVDDETGDKHQLDEVL

SEQ ID NO: 148873 - protein, 72 aa, Glycine max
  Coding DNA Sequence Number=SeqID_57188
MLSILSTGCHPPFRINSIGACRTWIFFINGVLCFLKFDSNGMEKEKDDWRRHFKESMSLEEAHHHRKPWIRA

SEQ ID NO: 148874 - protein, 107 aa, Glycine max
  Coding DNA Sequence Number=SeqID_57189
MRGISNYNCKESKRKTFLIHVTVKRLYDVSSIGAYRPRIFFINGFLCFLADEWQRNGERKRERKCHFKEKMSLEEAHHHRRPWIRAWRKKEMNEGKGREEHKILCSK

SEQ ID NO: 148875 - protein, 208 aa, Glycine max
  Coding DNA Sequence Number=SeqID_57190
AADIFHNPLPQHPTNPKTPCRIAFSLPKDHNSLHQKIGRVRWEKLASPSMVELTLPGDSTAEVAKVRAGSQSAPLFADNKPDTSEKRRQMHPSLSRKFSSYVLPTPVHEFPRPLTSFPSNSRLLGLVGHSSPLVSRGQKVSTANNLVASSAASPLPMPPQPMALSFSIPSSGTRVAALHMPRTLESSLDFTLNCLSLDKDKMEMRIRT

SEQ ID NO: 148876 - protein, 85 aa, Glycine max
  Coding DNA Sequence Number=SeqID_57191
PATEGYDKAHAVEIEATKVLNDLIISGVVQEEIPKVSPTVSNVAKDDEVIPTGPSELASNSLTIDNVQALLDMTLVKQKEETQTL

SEQ ID NO: 148877 - protein, 73 aa, Glycine max
  Coding DNA Sequence Number=SeqID_57192
MTPRHCTQVDDGDLLEHADARQDGKTKDLAIEVVNGYNIIKATSRQNDVNLTRSGSLDTVYGDLDDATSGEGR

SEQ ID NO: 148878 - protein, 127 aa, Glycine max
  Coding DNA Sequence Number=SeqID_57193
  Homolog annotation: Hit_ID=Q8LDW5; Match level="QueryCoverage=42%, HitCoverage=14%, E-value=7e-11, Identity=57%"; Hit description =Putative uncharacterized protein
MDCNPSQIAKPLPDKVLPELLDCVVKSLNVCNAVMLGLDAIKNLQHLAEIAVTALAQPPPRPRPRPPRRRSNLPRQEAMPLPREPNTPVARSPQAWRTFVGVRDVDSGYNNSLKTEEWGRDSVLIHA

SEQ ID NO: 148879 - protein, 252 aa, Glycine max
  Coding DNA Sequence Number=SeqID_57194
  Gene Ontology: Mol. function=RNA-directed DNA polymerase activity; Biological process=RNA-dependent DNA replication
  Homolog annotation: Hit_ID=A5C0I4; Match level="QueryCoverage=38%, HitCoverage=9%, E-value=1e-12, Identity=38%"; Hit description =Putative uncharacterized protein
  Pfam annotation: Domain name=Ribosomal_S19; Domain location=196-251; Score=-15.5; E_value=0.031; Accession=PF00203.12; Description =Ribosomal protein S19
MGEFADVPHIPADNLHNLGFPWPFAMWEMDILRPLPKAPGQKSLHGSMSYVGMDSPMPLSLTLKFKAQTYEEFLSRLGVKYLVTSVEHPQTNGQAEASNKSNYSYAYNTLTNVTMSKGSSNPRFCLGPPKASLIKPRRNMFLVKSPEACQTQGPPLVSLAKPKINMFLVKSPKAHQTQGSPMVSLAKPKIDVFLVESPKARQTQDPSLFLKEKTEAPTGEKLEPVCTHIRNMIIVSEMSGSITELYNEKTFK

SEQ ID NO: 148880 - protein, 95 aa, Glycine max
  Coding DNA Sequence Number=SeqID_57195
MWEKERILGEEEERTNLEGRKSVETYLNYKVKDDECSDDASTNIGCLAKGELPGNHITSKTSKRVGLRPQKETTPENLAFHGFKQKTQLKHEAET

SEQ ID NO: 148881 - protein, 174 aa, Glycine max
  Coding DNA Sequence Number=SeqID_57196
MPSIIEEHEVHDIHANCNDHDEGLWENIPIVITTTPKSPTHSSDPLEYTYRRSRQSTRLRSLTVRNLDQLRPTVNVNPSSGRGSGPHKEKFHNYIGVGKFYIPEASNAKKKVMSLVATRWRQFKSSLTTKCVYADNVKENLMEEKRKKRQEEAIPTKDSTMIVDPSSPIERHVK

SEQ ID NO: 148882 - protein, 70 aa, Glycine max
  Coding DNA Sequence Number=SeqID_57197
MKKILGLQAPMELTPVTTNVYSRKTLEKPKRGLQILKRKVRELFTHREGSTRMFPLLLRILRCDEEFRPM

SEQ ID NO: 148883 - protein, 227 aa, Glycine max
  Coding DNA Sequence Number=SeqID_57198
MCFFKEMKWLRKSFPRRGLERTPREKALVPPWSLIVTGFRVPITSSFEAIKGWSFHRERRVQLREDEYPNFQGEVARRHWARLVTPMAKFEPKIVIEFYADAWPTEEGVQDMRSWVRGHWIPFDADAISQFLGDPLILEEDQQCEFSRRRSRADDFDEEAIAQLLCILGQDFAQTAVGRWVRIMHTRMAPTGHPLDPENSKRALGFPALITCLCQYYRVHVTPSKVI

SEQ ID NO: 148884 - protein, 133 aa, Glycine max
  Coding DNA Sequence Number=SeqID_57199
  Subcellular localization annotation: CTP_CleavageSite=58; ConfidenceScore=5.21e-01
MACPLAYVPKEPSWTSPSMLPTSLAFMHQSKTMLWFLLYSMLPLKKKPATNLLNVLLSLSKASAGTWMLKWQAHQPFDFPLEERDGRRSHQKLSQFLDIGLLDVEVNCCLDAQSACFVFSHVIGAVEPQPGRE

SEQ ID NO: 148885 - protein, 55 aa, Glycine max
  Coding DNA Sequence Number=SeqID_57200
MGCSPRRANPVHFFAKKVHVLYGSVFAYSKPRGTTSIPYTKENDVAPVEVRTEVR

SEQ ID NO: 148886 - protein, 91 aa, Glycine max
  Coding DNA Sequence Number=SeqID_57201
MKTWVTFLPLSTKGNLLDILMGSMRILESMLKEMSTPIPRFPLWGRRPMHYLNPTSRESLEATQHNQSFCPWEGHPWQQKERGNSISSKRG

SEQ ID NO: 148887 - protein, 154 aa, Glycine max
  Coding DNA Sequence Number=SeqID_57202
  Homolog annotation: Hit_ID=Q2HW90; Match level="QueryCoverage=48%, HitCoverage=14%, E-value=1e-09, Identity=43%"; Hit description =Putative uncharacterized protein
MGLSQMPWLKRRFYQELDLEKLVENGVVGVPRKCLEAKARVLASQDEWAPFMDILAVLIFRVVLFSNVDGLVDRAAINAFLAFYDRKENPVVVILADLYNTFDQRCKKNNARIVCCTPALYVWLVSHFFCQEMRHVCPLEGHRSCTEKKEANWD

SEQ ID NO: 148888 - protein, 108 aa, Glycine max
  Coding DNA Sequence Number=SeqID_57203
MCDFGEVFVLYVEREVWIKDPEQGGIPCNLWIPHKVFLGQPGGQDLLQCTSHTYLSHSSHDRFMRDQHNSPSCLLEDLRNQPEAPKVVQVPEIASGTETGTASGLMMP

SEQ ID NO: 148889 - protein, 256 aa, Glycine max
  Coding DNA Sequence Number=SeqID_57204
  Gene Ontology: Mol. function=motor activity; Cellular component=cell projection
  Homolog annotation: Hit_ID=UPI00016621D1; Match level="QueryCoverage =98%, HitCoverage=40%, E-value=2e-18, Identity=32%"; Hit description =UPI00016621D1 related cluster
VLTLRGLEVLAIRVLHALAFRGLHGLVFRGLHVLVFRGLHALTFRGLHVLAIRGLHAITFRGLHVLDFRVLHVLYFRGLHALTFRGLHALAFRGLHVLAYRGLHVLIFKGLHALTFRGVHVLSIRGLHVLTFRELHILTFRGLHARSFRGLDVLACRGLDVLTFRGLEVLAIRGLHTLTFRGLHALTIRRPHAIFFRGLHVLHFRGLHILSFRGLHAHTFRGLHALAFRGLHVLAFRGLHVLVLKRLHALTFRGLY

SEQ ID NO: 148890 - protein, 66 aa, Glycine max
  Coding DNA Sequence Number=SeqID_57205
MELVLFVGSQDIFLLSAGDDIIVAVIYQVNVVTDVNKWVVDSRATKHICANKNMFISYIVVRDGEE

SEQ ID NO: 148891 - protein, 55 aa, Glycine max
  Coding DNA Sequence Number=SeqID_57206
MITIENENAWNEYCTSHKSAKPFRFKVLQNWDDIVDLCLLKRSRGPGHLGAVKKR

SEQ ID NO: 148892 - protein, 295 aa, Glycine max
  Coding DNA Sequence Number=SeqID_57207
  Gene Ontology: Mol. function=phosphate acetyltransferase activity; Cellular component=cytoplasm; Biological process=metabolic process
  Homolog annotation: Hit_ID=P0A9M8; Match level="QueryCoverage=100%, HitCoverage=41%, E-value=1e-150, Identity=93%"; Hit description =Phosphate acetyltransferase
  Pfam annotation: Domain name=ALAD; Domain location=81-253; Score= -246.5; E_value=0.028; Accession=PF00490.12; Description=Delta -aminolevulinic acid dehydratase
  Pfam annotation: Domain name=PTA_PTB; Domain location=5-295; Score =533.7; E_value=2.1e-157; Accession=PF01515.10; Description=Phosphate acetylbutaryl transferase
  Pfam module annotation: Pfam domain module=ALAD::PTA_PTB; Domain location=81-253::5-295
LSPPAFRYQLTELARKAGKRVVLPEGDEPRTVKAAAICAERGIATCVLLGNPDEINRVAASQGVELGAGIEIVDPEVVRESYVARLVELRKSKGMTEAVAREQLEDNVVLGTLMLEQDEVDGLVSGAVHTTANTIRPPLQLIKTAPGSSLVSSVFFMLLPEQVYVYGDCAINPDPTAEQLAEIAIQSADSAIAFGIEPRVAMLSYSTGTSGAGSDVEKVREATRLAQEKRPDLMIDGPLQYDAAVMADVAKSKAPNSPVAGRATVFIFPDLNTGNTTYKAVQRSADLISIGPMLQ

SEQ ID NO: 148893 - protein, 98 aa, Glycine max
  Coding DNA Sequence Number=SeqID_57208
  Homolog annotation: Hit_ID=Q84VH5; Match level="QueryCoverage=66%, HitCoverage=9%, E-value=4e-17, Identity=72%"; Hit description =Envelope-like protein
GTHVPDIVSTSGKAAASGAVSKDALIAELKDTCKVLEATIKATTEKKMELERLINRLSESGINDGEAAEEEVEAAEEEEEAAEEEEDAASDDDSEATP

SEQ ID NO: 148894 - protein, 66 aa, Glycine max
  Coding DNA Sequence Number=SeqID_57209
MRKSDLRSSCKSGYSVNDRLEFFLAKGEENEKMNSTSFQGLENQKTSESFWYKEEVQRDSGLVKDC

SEQ ID NO: 148895 - protein, 260 aa, Glycine max
  Coding DNA Sequence Number=SeqID_57210
ALCLGPWEHKEWKHTVSLSLRMVGFTPAPPRGHHSYTEKKEANWDRLLASKEGASVNWFPRWKEGRIGILISCGGFPNAPLMGTGGLTPFIARGFNSTNAGVLQRVRKAWEMVQKKDKEHRGSSNGPIGSYHRWLKAYAQGLDWLLNLRTTKEVEGEAPEEDEEVQALKTELEKAQTAKEKFKLAAVRIRKENAELRDVNIATTKALEQETKRARKEEHDRNKFRGALWGRRIEDLPKVKEEFVSAVMRDRNKHVGHHQQ

SEQ ID NO: 148896 - protein, 229 aa, Glycine max
  Coding DNA Sequence Number=SeqID_57211
DFQMFPYNLVLAIRQLGYPMRGAPLEEELTPIIARGFNNTKVEALQKVHKAWEMVQKKDKELRGSNNGPISGYRRWLKAHMQGLDWLPSLKTTKGVEAEAPEEDKEENAKLRDVNIATTKALEQETKRARREEHGRNKFRGALWGSNSELKLQREERDQSRVDNLILKDELKVCLRSKRSLSQRICETEANMLAIVSKYQEELNQATAHGHKVTDEYARVYAEKEARGK

SEQ ID NO: 148897 - protein, 90 aa, Glycine max
  Coding DNA Sequence Number=SeqID_57212
MHRSPTGNLVPLDLEIEATLRRNRAERRRKLLQDRTVASILEEETHFFYSSSSDSPSSRESVTYLPEVVSMADEHHQRVTLEDYSSNSVS

SEQ ID NO: 148898 - protein, 123 aa, Glycine max
  Coding DNA Sequence Number=SeqID_57213
MSTLNSSPCIEPHTTTSCRPTQIGMTSQHINSGRYTIFNSKLIEHISHDTDDELDITQGDIVTDYSFDDIATKDFAHTDYDGNLEAPYDNENTGFYVHCSNYVVLSFITFDNVIPCLNFCIYM

SEQ ID NO: 148899 - protein, 59 aa, Glycine max
  Coding DNA Sequence Number=SeqID_57214
MALLSWEIPLFLLMRARMEILFLGQGLWWFEVLAQKACRTAEHDICQGVGLASGSGIKE

SEQ ID NO: 148900 - protein, 222 aa, Glycine max
  Coding DNA Sequence Number=SeqID_57215
  Homolog annotation: Hit_ID=Q2HW90; Match level="QueryCoverage=88%, HitCoverage=39%, E-value=8e-27, Identity=34%"; Hit description =Putative uncharacterized protein
MGQLQRQAFRKAYDKIWDLAMVEVSTEAIASLTQYYDQPLRCFTFGDFQLSPMVEEFEEILGYPLGGRKPYLFTGFYPSLAIISKIVQISAQELDHKKQVENGVVGIPRKYLEVKARILADKGEWVPFIDILALLIFGGVLFPNVDGLVDLAAIDAFLAYHNHKESPVVAMLADLYDTFDRRCEKSNTRIVCCTPALYVWLVSHLFCQEVRHACPLESRGIL

SEQ ID NO: 148901 - protein, 81 aa, Glycine max
  Coding DNA Sequence Number=SeqID_57216
MLVLTSRMLRDFMDYTTVGVATYPSAGGRCVTCGMRVPRKEYARSRHQRLFEENVGKTGKDVIYELLSERFGSCIYARGRY

SEQ ID NO: 148902 - protein, 202 aa, Glycine max
  Coding DNA Sequence Number=SeqID_57217
MSLDSSSSINGEGSTPKDPLYKILDELRSLKLWKEKQERKEKGKKRAKEISQDEKEKIREEERRKILKELRKEKHATYSSHNSCKSLSEELRDYYEGRHRSHLRPHSHMRENERKPQEANINLPYFYGKDNVEAYLDWEIRIEQKLKRKSTLKSYGSHSYPKKDQGLSILGAAPSKPNDDKGKTIEKQLLKASMQEKTSSIK

SEQ ID NO: 148903 - protein, 124 aa, Glycine max
  Coding DNA Sequence Number=SeqID_57218
MPHDSKEHAFPSYGLPLNYTPPNVAYTPNKNVNNSTPIPIESQQPQTDHAHISQTMRETHEIPHHNLADFEPWLGYATEGQAVGGIPFENTLEGPQYHPRLHLLHSTAVKNPHDLWQEWESWII

SEQ ID NO: 148904 - protein, 408 aa, Glycine max
  Coding DNA Sequence Number=SeqID_57219
  Homolog annotation: Hit_ID=Q6WAY6; Match level="QueryCoverage=81%, HitCoverage=60%, E-value=1e-20, Identity=25%"; Hit description =Putative uncharacterized protein
LFPNVDGLVDLAAIDAFLAYHNHKESPIVAMLADLYDTFDRRCEKSNTRIVCCTPVLYVWLVSHLFHQEVRHACPLESHCSCTEKGGANWDQLLASKEGASVNWFPRWKEGRTGVLISCGGFPNVPLMGTRGCITYNPVLPIRQLGHPVRGAPLEEEIAPVISRGFNKTNVETLQKVRKAWELPSLRTAKREEAEAPEEDEEVQALRAELEQAQTVKERFKSAALKIQKENTELRDVNVATTKALERETKRAWALWGINNELKLQREERDQSRVDSLILKDELKACSRSKRSLSQRLCETETNMLAIITKYQEKLNLAVAHEHRVADEYAQVYAEKEARGRVIGSLHQEATMWMNRFSLTLNESQELPRLLAKAKAMADTYSAPEEIHGLLGYCQHMIDLMAHIIRNH

SEQ ID NO: 148905 - protein, 121 aa, Glycine max
  Coding DNA Sequence Number=SeqID_57220
SGDWEARYSVVFQIGSFAKRNEEGVETRVVITEKARRTKSVSYLCFPLISDESPETSQKSKGSRLARSVKFRNVAEVEKSWVASSGSNPARLGELGGNLLPLFPKNRLKGAVLRIPNAPGE

SEQ ID NO: 148906 - protein, 44 aa, Glycine max
  Coding DNA Sequence Number=SeqID_57221
  Subcellular localization annotation: CTP_CleavageSite=34; ConfidenceScore=5.20e-01
STLEDPTSLPLGLHPSPLRPSSFSTRGLCPSPLRLSSFSTWAFS

SEQ ID NO: 148907 - protein, 39 aa, Glycine max
  Coding DNA Sequence Number=SeqID_57222
MGLQNLRIRVRELFTCGEVKTYFTKEKRLPMIGEGDEDA

SEQ ID NO: 148908 - protein, 86 aa, Glycine max
  Coding DNA Sequence Number=SeqID_57223
MIVIVNAEACGYMSMNYYQYIDVVYTNEHILKAYSAQWWPLGNETTIPPSDDAWTLIPNPTTIRAKGRPKSTRVRNEMDWVEPSEH

SEQ ID NO: 148909 - protein, 125 aa, Glycine max
  Coding DNA Sequence Number=SeqID_57224
MVRTRGLGRALGAGRGRGISEDAHEADVPRRRRPTASARRQRVLLREDVTERPEDVPQLHEDVSHVSDATPEMTGAADAVQTERVATDGSLGSPAADEGFPSGLRDPSILIDFAEHVAHNIWSGQ

SEQ ID NO: 148910 - protein, 25 aa, Glycine max
  Coding DNA Sequence Number=SeqID_57225
TCKRNLQVSGTLKRVAWGLDVGTLR

SEQ ID NO: 148911 - protein, 268 aa, Glycine max
  Coding DNA Sequence Number=SeqID_57226
RVFCLCSVLLDCDSLCCLNVVLLGCCGSLRGLMGTRGWWVYARIVDVENLLCTIARPPPSTTCDGVKLPAFIVDHRVVPGDMSRGSGDLGDVRRAPGSQQIKGTKTTKQGGLWWLASCGFCVICGVWPLVIDYQGLENEVRKLREPLGNRLPACVIDYTEGWVTGNRLPGCVIDYQRWKALKYPFYLHVVIGMAAQLIRDRVEMECLEGAWETLEGNTRCRFRGTIRFMATSLVHPDEPARTLQRTEFDDCTLVAEATTMDTFALDDT

SEQ ID NO: 148912 - protein, 220 aa, Glycine max
  Coding DNA Sequence Number=SeqID_57227
  Subcellular localization annotation: CTP_CleavageSite=45; ConfidenceScore=5.11e-01
MNSLPSAVHVSSTIESEAPQIHCLALFANSPFSNLIRRPMNSLPSAVHVSSIVESGAPRIHCLALFANSPFSNLIRRPMNLLPSAVHVSSTIESGAPRIHCLALFSNSPFSNLIRRPMNSLPSAVYVSSTIESGAPRIHCLALFANSPFSNLIRRPMNSLPSVVHVSSTIESGAPRIHCLALFANSPFSNIVRRPMNLLPSAVRQFSIFQSYSETHEFIA

SEQ ID NO: 148913 - protein, 100 aa, Glycine max
  Coding DNA Sequence Number=SeqID_57228
  Gene Ontology: Mol. function=aspartic-type endopeptidase activity; Biological process=DNA integration
  Homolog annotation: Hit_ID=A5AQZ7; Match level="QueryCoverage=55%, HitCoverage=6%, E-value=3e-09, Identity=54%"; Hit description =Putative uncharacterized protein
  Subcellular localization annotation: CTP_CleavageSite=44; ConfidenceScore=5.48e-01
MAVLGNGVITSASFSGSSSSSTESESQCDVQPLKGFLLMFRRLMGSVSSQRLIEKLALKTFTHPRPYKLQWLSENRELVVDIQVLICFSIGKYVDEILFD

SEQ ID NO: 148914 - protein, 408 aa, Glycine max
  Coding DNA Sequence Number=SeqID_57229
  Gene Ontology: Mol. function=gamma-glutamyltransferase activity; Cellular component=periplasmic space; Biological process=glutathione biosynthetic process
  Homolog annotation: Hit_ID=A7ME82; Match level="QueryCoverage=96%, HitCoverage=67%, E-value=0.0, Identity=82%"; Hit description =Putative uncharacterized protein
  Pfam annotation: Domain name=G_glu_transpept; Domain location=7-399; Score=489.8; E_value=3.4e-144; Accession=PF01019.12; Description =Gamma-glutamyltranspeptidase
MATGVGVDILKQGGNAVDAAIAVGFALAVTHPQAGNLGGGGFMLLRTAAGRTTAIDFREMAPARASRDMFLDKQGNADSKLSLTSHLASGTPGTVAGFALAAQKYGTLPLSTLLAPAIKLARDGIIVNDALADDLATYGKENLINHDNSRAIFYKADGQPYQKGDRLVQKNLAHSLQLIAQQGPDAFYKGKIADEIAAEMAQHGGLIGKADLAAYRAVERKPVSGSYRGYEVFSMPPPSSGGIHIVQILNILENFDLAKWGFGSADAMQVMAEAEKYAYADRSEYLGDPDFVKVPQQALTSKAYAKTLAQQIDVNKARPSADIKPGKLAPYESNQTTHFSVVDKDGNAVAVTYTLNTYFGSGVVAGNSGILMNNEMDDFSAKPGTPNVYGLVGARAVVGLSPPCCKWW

SEQ ID NO: 148915 - protein, 90 aa, Glycine max
  Coding DNA Sequence Number=SeqID_57230
MSSRVSKRITEQESGQDLLESKREESLKKVFPGSKKYLRSTKLRQERGLRIIGRFELVYTRVEIEAARFLDLAQFPTKLHKINFDFEQDG

SEQ ID NO: 148916 - protein, 27 aa, Glycine max
  Coding DNA Sequence Number=SeqID_57231
MMVARVMLGYGYEPGMGLGNNGGRPSL

SEQ ID NO: 148917 - protein, 158 aa, Glycine max
  Coding DNA Sequence Number=SeqID_57232
MVAGCMTWTSRRIDGNKPEIKQLKAMGAVPLDPHTKLKQIVNEGREGTQARTITVHFCASIGTKPRLIHPVASEPSNLGTSSFNRCGAALGPAAGNEGISGCVCEGLNLLVSRCANLSANDSIFASTVAANFANSSSIFSDDIAFDRVFSAIRPPCAQ

SEQ ID NO: 148918 - protein, 34 aa, Glycine max
  Coding DNA Sequence Number=SeqID_57233
SKCFCNASVSDSVEILHRSLSFFTVLHPFFVLQR

SEQ ID NO: 148919 - protein, 91 aa, Glycine max
  Coding DNA Sequence Number=SeqID_57234
MNDQGILMICMANKWVYNPVATYPFAGERGEAHGCVFQRSKMRGVATNIYLWKHWKNRRKTIMKNIPYSGVVFTFEEGISTSHVCPKGQQP

SEQ ID NO: 148920 - protein, 52 aa, Glycine max
  Coding DNA Sequence Number=SeqID_57235
MARVTGALSRSRHQRLFVENVGKTEGNRSTKAGLLLLRTLLWRGNQTYVVLP

SEQ ID NO: 148921 - protein, 295 aa, Glycine max
  Coding DNA Sequence Number=SeqID_57236
VDSRGSHQGDWGPFMDVLALLIFGVVLFPNVDGLIDLAAIDAFLAYHHSKESPVVAVLADLFDTFDRRMDWDQLLAGIGGRTISWFPRWKEGKEGVLFSCGRYPNIPLVGTRGISGAQNSKTIQRIHKAWETPLRKDQELRGIRNGIIGGYQRMAEVVSEENFEAPEEDEEVQALKSELGKAKLAKEKFKLAATYVRKECAGLREENAITARALEQETKRARKEEYGRNKFRGALWGSNNELKLRREERDQSRAHSMVLKEELIACSKSKRSLSQRLCETETNMLAIIAKYQEEL

SEQ ID NO: 148922 - protein, 80 aa, Glycine max
  Coding DNA Sequence Number=SeqID_57237
SVGDCLDAIFSRSMKYPFFAQFERRCTQDSALLGSLLPSRPGREEEIFAGADLDLGKLGYSEALTKREGFVPLPARGCAP

SEQ ID NO: 148923 - protein, 146 aa, Glycine max
  Coding DNA Sequence Number=SeqID_57238
  Subcellular localization annotation: CTP_CleavageSite=41; ConfidenceScore=5.29e-01
MHLTSTLKCNVIPFIRKWPKRVHATLSLKKTRQQVLRSPCRAQATLLPPPNVDQPKSQGSSKPSDMPPSTSIPPYEKLQGYPSWSLHPSCTYKSHIITMTFSTSTTFHLNVIINIISSQCHSQHQHHLISMTINNNNIFSYQHNHQ

SEQ ID NO: 148924 - protein, 73 aa, Glycine max
  Coding DNA Sequence Number=SeqID_57239
EFNINRKVESKPKAINIPCLKKIVGAGSLDIQTDAILPRKGPITRTMSKRLQEDWARAAEEGPRVLMNLRVDF

SEQ ID NO: 148925 - protein, 117 aa, Glycine max
  Coding DNA Sequence Number=SeqID_57240
  Homolog annotation: Hit_ID=A7NTN3; Match level="QueryCoverage=58%, HitCoverage=30%, E-value=3e-27, Identity=81%"; Hit description =Chromosome chr18 scaffold_1, whole genome shotgun sequence
MTVFHFFNCAILTFGPHVVFYFTTPLSEYDTLRTSIKAAVVYLATTLVKLICLATFLKVSENDRFDPYQTNEDEVVKPNNLYCLWSPLKVLACLWSPLSVRHRIQGGNQVLSKCTEN

SEQ ID NO: 148926 - protein, 69 aa, Glycine max
  Coding DNA Sequence Number=SeqID_57241
MPRRLKVKNVTWDVFKRVFLEKILFPRMLGTRRRWSSWSLKQGSMTVAEYAAKLRSWVRYFPHYSRERW

SEQ ID NO: 148927 - protein, 142 aa, Glycine max
  Coding DNA Sequence Number=SeqID_57242
MVGFNRSLFHLGQRGMPLYMLHRSMLLGKRLPLDPPLEHEGRIHKRLSIVKGLPMALYLPLSAGAYFDKLQDQWLKLLLLQRFSCDLFSFRPCSCTHLKEGLLVITEGMTKELLLRAIDFPTEMERMRSYSLSIADAKTKRA

SEQ ID NO: 148928 - protein, 135 aa, Glycine max
  Coding DNA Sequence Number=SeqID_57243
LLIFGVVLFPNMEGLVDLAVIDAFLAFHHGEESPVVAILAMYDTFDRGCEKSGARIVCCALALYVWLVSHPFLQEGRPVYPLQGHRSCVEKGKANWDQLLASMEGRLLIGSLARRKGRIMILSSCERCHAPPSHI

SEQ ID NO: 148929 - protein, 81 aa, Glycine max
  Coding DNA Sequence Number=SeqID_57244
MILHEIRRPNSLKTVLSGVTNCHNLPFGGRAMRGSRVRLLREENAWSRHQRLFEESIEKTGKVWSTNYKCERFESCIYAWG

SEQ ID NO: 148930 - protein, 63 aa, Glycine max
  Coding DNA Sequence Number=SeqID_57245
MASYGEAKESIDEEDPRPTSSNGACINVALHLGIRVDGRVVVGPSFLHWDELFDELLGQCFNS

SEQ ID NO: 148931 - protein, 293 aa, Glycine max
  Coding DNA Sequence Number=SeqID_57246
  Homolog annotation: Hit_ID=Q84VH5; Match level="QueryCoverage=84%, HitCoverage=39%, E-value=1e-111, Identity=78%"; Hit description =Envelope-like protein
MDLIKAAGLLKTVTKLGDCYESLVREFIVNIPSDITNRKNDDYQKVFVRGKCVRFSPAVINKYLGRPTDGVVDIAVSEHQIAKEITAKRVQHWPKKGKLSAGKLSVKYAILHRIGAANWVPTNHTSTVATGLGKFLIQNPLLSNYPLPSQLYCGIMSSQHPNILNYTDSVMKRESPLSLHYKLFEGTHVPDIVSTSGKAAASGAVSKDALIAELKDTCKVLEATIKATTEKKMELERLIKRLSDSGIDDGEAAEEEEAAEEEEKAEEEEEAAEEEEDAAEDTESDDDDSEATP

SEQ ID NO: 148932 - protein, 61 aa, Glycine max
  Coding DNA Sequence Number=SeqID_57247
  Gene Ontology: Mol. function=phosphoenolpyruvate carboxylase activity; Biological process=carbon utilization by fixation of carbon dioxide
  Homolog annotation: Hit_ID=Q6Q2Z9; Match level="QueryCoverage=57%, HitCoverage=3%, E-value=8e-10, Identity=88%"; Hit description =Phosphoenolpyruvate carboxylase
MAIDLYIREVDGLRFELSMNQCSDKLSELAHEILKVIFVLYHVTSGYCLSRSNTSSCAQAH

SEQ ID NO: 148933 - protein, 67 aa, Glycine max
  Coding DNA Sequence Number=SeqID_57248
  Subcellular localization annotation: CTP_CleavageSite=24; ConfidenceScore=5.14e-01
MENWQTVLHNNFSGSPDSMVGDTRTALGNKFMGLRKKWRMENWRTALRNNFAGSRLEGGGHMNSARQ

SEQ ID NO: 148934 - protein, 94 aa, Glycine max
  Coding DNA Sequence Number=SeqID_57249
MGGETCHAQNEFVGYSFTGKNPQKFDIPSRCTMDELKDLIKQVTPHGIPPYGIHETQTVLIESNYWKKIGPIEILAIFSKPVMEMEDELSLSQN

SEQ ID NO: 148935 - protein, 80 aa, Glycine max
  Coding DNA Sequence Number=SeqID_57250
MMAHQNPPYLAFCTPGQNETKNKIQGYQREANENIHIFLNEHQGMKGMVNQLKNEKVIKPHKIYTLSLKCLGYYLPSKHP

SEQ ID NO: 148936 - protein, 158 aa, Glycine max
  Coding DNA Sequence Number=SeqID_57251
MVPRKLSAKRSRMDAAAEGTSAAPEFDSHCFRSTEHQQRFEAIKGWPFHRERRVQLRDDEYTDFQEEIARRHWTSLVTPMAKFDPDIVLEFYANAWPTEEGVRDMRSWVRGQWIPFDADALSQFLGDLLVLEEGQECEFSQRRNRPDGFDEEAIAQLL

SEQ ID NO: 148937 - protein, 290 aa, Glycine max
  Coding DNA Sequence Number=SeqID_57252
  Gene Ontology: Mol. function=nucleotidyltransferase activity; Cellular component=integral to membrane
  Homolog annotation: Hit_ID=A4WFE9; Match level="QueryCoverage=57%, HitCoverage=81%, E-value=3e-71, Identity=77%"; Hit description =Malonate decarboxylase subunit, putative
MPELVLAAIKPLGLSATAAALFLTGVILSARKLQINTMVITSTIAKLLIQPAIAWGIVLLFGLHGSVAITAILMIALSAGFFGGVFGNRFGVQSPDAEAVLLLSSPVYPVAAAVYLIDVRNVIMTTTLRPHDLIWLTARDALEGITETWVDAAWHTGLPVVVRRDVDNDGRIPVGVRGLRRDQRAAGWVKTENVRRVVSPEELCVTADLLRSPFVTQPPVQVALQLAQQSWSWTWGITGSTGFALATGIPVIHADSDLDLLIRAPQPISPDAFTAWQSQLSGALCRADTQ

SEQ ID NO: 148938 - protein, 86 aa, Glycine max
  Coding DNA Sequence Number=SeqID_57253
MAGMGKLDHLEERLRAIEGGEDYAFANLEELFLIPKHGHSQVQGAELWQVQGDYSLQEPSKDGTFLESISGRDLMVAFVRQYQYNF

SEQ ID NO: 148939 - protein, 150 aa, Glycine max
  Coding DNA Sequence Number=SeqID_57254
MLDLVLKGQAFFDGMPRGIPMDCKRSSYVIGSGVNSGIGFGGKFLIALELSAGRVVVGAGTWGASLWMGALGYTGLRGLDPCGHRSDDMGISLLPFCPSCSDYFSMGTCGGNVIELPSFQPYINSFLGEYQVREAGRHVAYQLLIVKHWQ

SEQ ID NO: 148940 - protein, 176 aa, Glycine max
  Coding DNA Sequence Number=SeqID_57255
  Subcellular localization annotation: CTP_CleavageSite=56; ConfidenceScore=5.36e-01
ARGKRSEALTTSAPETPAPSSSTTPLPPTQTPVIPPTPTQIPLPAPLSGLGLPSIMSMEYFDVQVAWPGAQPSPSRGGGAFATQEPVLGETAAVEGEDELTPPEPSYFDAGIHMAQEEDASTDQIHEPSSALVPNDATPSTPAPELEQPISQDSPVPQVLDLNEHAQEKPHDEQDI

SEQ ID NO: 148941 - protein, 73 aa, Glycine max
  Coding DNA Sequence Number=SeqID_57256
MKKQQWRKRRRGERRRHPLGNKPWKKELHHQESALDKKLGEETSMEEKKEREKARRGEHEIEEGKEAEKLNFE

SEQ ID NO: 148942 - protein, 68 aa, Glycine max
  Coding DNA Sequence Number=SeqID_57257
MAPNPWVEDERKRNSWGIRNRGKEWRIALSINYAWLILVGGGCKNKNVIHRAPKKGREWRIALSNHYA

SEQ ID NO: 148943 - protein, 120 aa, Glycine max
  Coding DNA Sequence Number=SeqID_57258
  Gene Ontology: Mol. function=helicase activity; Biological process =viral genome replication
  Homolog annotation: Hit_ID=Q8RV60; Match level="QueryCoverage=80%, HitCoverage=7%, E-value=8e-16, Identity=43%"; Hit description =Putative uncharacterized protein At2g05640
MENYKESMNCTLAIYHYSTLYSFLMEKTDIELTYFTVLLHPAKKESYTMVESERLSYIRNNQKKLRVDKYSSLQSSLDTGTAKGLTKGKRVILPSTFVGSPRYMDQLYFDGMTICSHVGF

SEQ ID NO: 148944 - protein, 132 aa, Glycine max
  Coding DNA Sequence Number=SeqID_57259
  Subcellular localization annotation: CTP_CleavageSite=27; ConfidenceScore=5.16e-01
MMRTSWSSSTSMTTKSAGKTICLTLIRMSSITSYGLVMDWSASYKVILVGKISNSPNHLHMESGIKLMLALKSMGAFPTVTSPIEQGIVILLGSLCFWWKDLLYHSTKVSLHNDILLVNVFVLPCQHIFQKL

SEQ ID NO: 148945 - protein, 350 aa, Glycine max
  Coding DNA Sequence Number=SeqID_57260
  Homolog annotation: Hit_ID=Q84VH5; Match level="QueryCoverage=100%, HitCoverage=57%, E-value=1e-150, Identity=73%"; Hit description =Envelope-like protein
MIPGPGPVPEKLVPKRQQRVKISENPSLAPSPREEDTEMDKKIRSLVNNILKNASVPDADKDVPTSSTPNAEVRSSSSEEESTEEEDQATEETPAPRAPELAPGDLIDLEEVESDEEPIAKKLAPGIAERLQSRKGKTPITRSGRIKTTAQKKSTPITPTTSRWSKVAIPSKKRKEISSSDSDDDVGTRCSRHQESQEIREKDFALERELGRDALDFKEIMDLIKAAGLLKTVTKLGDCYESLVREFIVNIPSDITNRNSDEYQKVFVRGKCIRFSPAVINKYLGRPTEGVVDIAVSEHQIAKEITAKQVQHWPKKGKLSAGKLSVKYAILHRIGTANWVPTNHTSTVAT

SEQ ID NO: 148946 - protein, 75 aa, Glycine max
  Coding DNA Sequence Number=SeqID_57261
MLVLSSSLSPALKKSSSICCLYSSTLILPFIVGGNVPLPKSTLKIIPILYWRSPMNLSFLNKGSPPIEGIPLKAK

SEQ ID NO: 148947 - protein, 56 aa, Glycine max
  Coding DNA Sequence Number=SeqID_57262
MQKSKRDVYLGAYLNGFVFNSALKGLDETPQSKSKVVAARWIVVKCNKQKGSTECG

SEQ ID NO: 148948 - protein, 148 aa, Glycine max
  Coding DNA Sequence Number=SeqID_57263
  Homolog annotation: Hit_ID=A5AZ88; Match level="QueryCoverage=40%, HitCoverage=5%, E-value=3e-07, Identity=43%"; Hit description =Putative uncharacterized protein
MEEGFSHGSVPIILGRPFMKIARTKIDVYVGTLSMEFGDIVVHFNILDAMKHPSEDHSVFRLEIIDQIVDDYMFDFDSVLHGRKHSFLSDLHTCHSLCIESESKFEFDPVSDFYAESEFEFESGFDFLGVVPLDVDFLESECTIHVAG

SEQ ID NO: 148949 - protein, 102 aa, Glycine max
  Coding DNA Sequence Number=SeqID_57264
MEDTPVSLASLARKRLGCDNRLIGCHERELKEITKRPTVMLHGARNPGHEERKWLRKKLSMKRSRKEATGEGSSTALEFDSQRFRSAEHQQRFEAIKGWSFQ

SEQ ID NO: 148950 - protein, 132 aa, Glycine max
  Coding DNA Sequence Number=SeqID_57265
MPPTRHPLDSDKSKRALGFPALITGLYQSFGGDAPEVADAPPPPHQADPTGSLGMERYLQHLVCQQAANHRGQGFIPFVCPTPYQFRAEVACPRDWPEAQAGEAPAEAPSDDGFARFLGRERSHMTMGSPDS

SEQ ID NO: 148951 - protein, 96 aa, Glycine max
  Coding DNA Sequence Number=SeqID_57266
  Gene Ontology: Mol. function=helicase activity; Biological process =viral genome replication
  Homolog annotation: Hit_ID=A2Q378; Match level="QueryCoverage=84%, HitCoverage=5%, E-value=2e-19, Identity=58%"; Hit description =Putative uncharacterized protein
MARDRLQDVQVDNIKLKLIANREKDGRTYNVPIVPKVAALIVGDFDANSKRDIIIETQHGQLQRIHELHSSYLALQYPLLFPYGEYEYRLDILHSS

SEQ ID NO: 148952 - protein, 319 aa, Glycine max
  Coding DNA Sequence Number=SeqID_57267
  Gene Ontology: Mol. function=hydrogen ion transporting ATP synthase activity, rotational mechanism; Cellular component=proton -transporting two-sector ATPase complex; Biological process=ATP synthesis coupled proton transport
  Homolog annotation: Hit_ID=Q6I8E6; Match level="QueryCoverage=72%, HitCoverage=70%, E-value=1e-124, Identity=100%"; Hit description =Pseudo-atpA
  Pfam annotation: Domain name=ATP-synt_ab; Domain location=208-317; Score=-55.0; E_value=0.00033; Accession=PF00006.16; Description=ATP synthase alphabeta family, nucleotide-binding domain
  Pfam annotation: Domain name=ATP-synt_ab_N; Domain location=84-152; Score=90.2; E_value=6.3e-24; Accession=PF02874.14; Description=ATP synthase alphabeta family, beta-barrel domain
  Pfam annotation: Domain name=Complex1_49kDa; Domain location=1-87; Score=-135.4; E_value=0.0018; Accession=PF00346.10; Description =Respiratory-chain NADH dehydrogenase,
  Pfam annotation: Domain name=HAS-barrel; Domain location=84-150; Score=46.4; E_value=9.7e-11; Accession=PF09378.1; Description=HAS barrel domain
  Pfam module annotation: Pfam domain module=ATP-synt_ab::ATP-synt_ab _N::Complex1_49kDa::HAS-barrel; Domain location=208-317::84-152::1 -87::84-150
MTTGSSVYSTSIHHFELYTEGFSVPAPSTYTAVEAPKGEFGVFLVSNGSNRPYRRKIRAPGSAHSQGLDSMSKHHMPADVVTIIVDEIGRVVSVGDGIARVYGLNEIQAGEMVEFASGVKGIALNLENENVGIVVFGSDTAIKEGDLVKRTGSIVDVPAGKAMLGRVVDALGVPIDGRGALSDHERRRVEVKAPGIIERKSVHEPMQTGLKAVDSLVPIGRGQRELIIGDRQTGKTAIAIDTILNQKQMNSRATSESETLYCVYVAIGQKRSTVALRYGLQFLLFFAVFYLISTNINMASVDTFESLVRRLAFYLGGIL

SEQ ID NO: 148953 - protein, 56 aa, Glycine max
  Coding DNA Sequence Number=SeqID_57268
MSVKNHPRALRRRPVRVTVFCENAPTICDQHRLKGALKPGDPQGLHSEESIRVSPS

SEQ ID NO: 148954 - protein, 56 aa, Glycine max
  Coding DNA Sequence Number=SeqID_57269
MEATKEKMTTMMEAMMSMRKMMEVNMATVVAASIATEVNPTHPPGLNQVNRPVSDM

SEQ ID NO: 148955 - protein, 131 aa, Glycine max
  Coding DNA Sequence Number=SeqID_57270
MIMRGQDIYSSQDEATTSPSSSESEEARGEESSEEIYLQEEGQSLMVKEECKEVSVSSKRLAKKESRFTIKTNIKETFPLRQPPYFLLCKNTLVSIATPLGLEFIPQVKELLDEGLVCKSLNPSALLVPKI

SEQ ID NO: 148956 - protein, 179 aa, Glycine max
  Coding DNA Sequence Number=SeqID_57271
  Homolog annotation: Hit_ID=A5B939; Match level="QueryCoverage=43%, HitCoverage=55%, E-value=6e-23, Identity=66%"; Hit description =Putative uncharacterized protein
MRDEPDEWVTSAQLRANLDPTKGVGRLRQAGRWSWKSKSAKDLPTLETAQPEVGSSGWKSTARRVVSGAPPAALENPEDRVPPTPGKGSRQNGSVTSGKGLALRAGHGGPSPEPVGCRWTARAASAARAGRRVPVGGRIGNGPFGASSPGVEQSTQNWYGQGESDCLIKTKHCDGPCGC

SEQ ID NO: 148957 - protein, 138 aa, Glycine max
  Coding DNA Sequence Number=SeqID_57272
MAPTRHPLDPEKSNRALGFLALIMGLCQSYGVHVTPSKAAGAPPPPQQADPAGPLGVEHYRQHLVHQQAANHHGQGQGSAPLVCPTLEQFRAEVAWPGDRPDAQVGEEPTGSLGETDESHMDEDMTDLLGFLEGSGAT

SEQ ID NO: 148958 - protein, 168 aa, Glycine max
  Coding DNA Sequence Number=SeqID_57273
MGETHEISHHNLADFEPYLGYATKGQVVGGISLQNTLEGPQFRPQPQPFYGKMVGYTPSSFADLVFADERIKLGLERGKSDYPGLINAKVGANEEDENEGETLAMIAIPTWSNFPSTQQCHYSANISPSHYPPPSHPQRPSLNQPQSLPIEHPVPKHQPKRNFVAKSL

SEQ ID NO: 148959 - protein, 16 aa, Glycine max
  Coding DNA Sequence Number=SeqID_57274
MKKIHGLQAPMELTSC

SEQ ID NO: 148960 - protein, 143 aa, Glycine max
  Coding DNA Sequence Number=SeqID_57275
MKREKHTSYSSHNSCKSLSEELRDYYEGRHRSHLRPHSHRREKERKPQEANINLSYFHGKDNVEANLDWEIRVEQQLKNKYTSKSYSSHSYPKKDQGQGILGVTPSKPKDDKGKTIEKQAPKRTHYFSMPHHKNHDYEGPRHL

SEQ ID NO: 148961 - protein, 122 aa, Glycine max
  Coding DNA Sequence Number=SeqID_57276
MWGIPFILEPNQTLTCIMSSHSTSLEPKSRLTINLDPGRKIPQSKSGRKQKEKKGKFPIKEWEKVKKEEEEGKKAPDQGSKENRRNVQRGLWTGQYLNNTELPPNERKKKEREPRPKIVFSL

SEQ ID NO: 148962 - protein, 149 aa, Glycine max
  Coding DNA Sequence Number=SeqID_57277
  Homolog annotation: Hit_ID=Q6WAY6; Match level="QueryCoverage=62%, HitCoverage=16%, E-value=9e-11, Identity=37%"; Hit description =Putative uncharacterized protein
EGKERVLFSCGDHPNVPLVGMRGCINYNPTIAIRQLGYPMRGAPTEERLSPFLGRDFGAQSFKIVQRVHKAWESPLRKDKELRGIRNGIIGGYHEWAKSSYTRTSGKSVPELREENAATARAPQNEKPRGLARKSMAEINSEELCGQQQ

SEQ ID NO: 148963 - protein, 115 aa, Glycine max
  Coding DNA Sequence Number=SeqID_57278
MPKWLSAQTISINPDPGSQVAGGGTGQANPLTCGDLRHLLDLCHPDPYPSGYPYKHSFAIRQTQSPVTVEIPKRLSVQTISVNPDPGSQVAGGGTVWLSAPFVNQGQTSPLTRRD

SEQ ID NO: 148964 - protein, 73 aa, Glycine max
  Coding DNA Sequence Number=SeqID_57279
MMITKDDDKGDDKKLKGQSKNEFKMFKMESRTIQDSRGKVEEHFKIQGSSFKNQDQDSRFKIQDSRFKIQEKT

SEQ ID NO: 148965 - protein, 70 aa, Glycine max
  Coding DNA Sequence Number=SeqID_57280
MSKRREKTLIGKDTTLLMAVEERKLAEDDKELPKEKLGRSDGQQTHTTNNTNISFTKEKVETKGRAKNSK

SEQ ID NO: 148966 - protein, 182 aa, Glycine max
  Coding DNA Sequence Number=SeqID_57281
  Gene Ontology: Mol. function=phosphoprotein phosphatase activity; Biological process=intracellular signaling cascade
  Homolog annotation: Hit_ID=A7R8Y3; Match level="QueryCoverage=62%, HitCoverage=32%, E-value=1e-17, Identity=40%"; Hit description =Chromosome undetermined scaffold_3090, whole genome shotgun sequence
EPYTTTVMATLPQICVVGSVAWFAVVPLICFHVVEWHQPDRVLQQFGLQKPIPGCPSQPQNLHGITLKGKQDENWFHLLAPIISQWNNRAEFRVDVYPRQEGLLGFNSDNMYMVSPQGRNTWTVDDLMPYVEKLAIISEEQERIIEPVSHGPTSEREFSAQEFHILQSSVETRGIGRRRELV

SEQ ID NO: 148967 - protein, 115 aa, Glycine max
  Coding DNA Sequence Number=SeqID_57282
MASRKRKAPSTPTQARFDRSRFISQEAWERYTDVIVPRKLLPERNVVVYYTEYDEFKEELERRHWDEELTDFGDDNIDVAIVKEFYANLYDPEDKSPKQVRVRGEFSLTLDPWRA

SEQ ID NO: 148968 - protein, 110 aa, Glycine max
  Coding DNA Sequence Number=SeqID_57283
MEGFHQQTLLPRGENTETFSSLTSYPELRRSEFLIGGYVGARASLLSTTPLFATMTQKLVACGDTLRLSAPRHSVTPSVIDEQRPIWSSAPFPEMSASSGGDFFRVSQVI

SEQ ID NO: 148969 - protein, 86 aa, Glycine max
  Coding DNA Sequence Number=SeqID_57284
MRLPFLWPMLDSFGSGFPWQSDAQKHQYPPFLSLGEEGRCWNNKLHQHQELEAFFIISYLPICVTVFSSPALSVSSFPMDSCCNPG

SEQ ID NO: 148970 - protein, 104 aa, Glycine max
  Coding DNA Sequence Number=SeqID_57285
MDGLVDLVAIDAFLAHHDHKESPVVAMLADLYDTFDRRCEKSRDTSKKVRKAWEVVQKKDKELSGSNNGPIGGYRRWLKAHVQGLDWLPSLRQPLRCFTFKGGS

SEQ ID NO: 148971 - protein, 47 aa, Glycine max
  Coding DNA Sequence Number=SeqID_57286
MSHHSSSANGEEEGIGHILDLTPIGRKRKDNLKRLTLTSYTSMGRTM

SEQ ID NO: 148972 - protein, 50 aa, Glycine max
  Coding DNA Sequence Number=SeqID_57287
LIAWDENESSDGSEKEINLLSKDYESDENISQEVYAKRKSLTSIFKDLGT

SEQ ID NO: 148973 - protein, 511 aa, Glycine max
  Coding DNA Sequence Number=SeqID_57288
  Gene Ontology: Mol. function=siderophore-iron transmembrane transporter activity; Cellular component=cell outer membrane; Biological process=siderophore transport
  Homolog annotation: Hit_ID=A1JJ84; Match level="QueryCoverage=97%, HitCoverage=69%, E-value=0.0, Identity=80%"; Hit description =Putative iron transporter precursor
  Pfam annotation: Domain name=TonB_dep_Rec; Domain location=244-498; Score=112.8; E_value=1e-30; Accession=PF00593.15; Description=TonB dependent receptor
AELLYSGLHGQGYRDNNDNTDIDDFMLKTRYAFSDRDELLANFHYYDAKAGMPGGLSAAQYSQNPFQSTRPWDQFEGRRKDMSFKYKHQEDDKQFEVLTYFTDSYRGSNIESEGTGKNAGQRRMVSYPRHYSTWAIEPSYSQVFRFWDMAHEITLGYRYLNETMDEKASRSAWYNPADIGSTPETPDYYQHTSGGTAANAFYIDDTINVGNWTVTPGLRYESIRTHVDDAFNNISREKSYSEPLPSLNVMYHLSDAWKLFANANTSFGSMQYFQLTKGGNGNQPAPGLTAEKAHTYEFGTRYDDTVVKAEATLFYIDFDNQLQYISNDVGWTNMGATKHKGIELALSYDLSELNRALDGASVYTSYTYTKASTDKGDFAGKDLPFYSRQVYTVGTRYATGSWVWNLDGYAQSKQHSPGTGPEYVTQESADGQFGDIAGYMVWNMRGEYNFGPQLSNLTLGAGVKNLFDQRYFTRSNDNNFGKYVGEPRTFFVQGSIALNNRGPAGASVSPT

SEQ ID NO: 148974 - protein, 39 aa, Glycine max
  Coding DNA Sequence Number=SeqID_57289
ENEAHVLMQSYPARALARRLQVDWARDPRKGPRVLMSLR

SEQ ID NO: 148975 - protein, 274 aa, Glycine max
  Coding DNA Sequence Number=SeqID_57290
  Homolog annotation: Hit_ID=A5AZG1; Match level="QueryCoverage=34%, HitCoverage=30%, E-value=2e-07, Identity=35%"; Hit description =Putative uncharacterized protein
  Pfam annotation: Domain name=zf-CCHC; Domain location=201-218; Score =22.6; E_value=0.00058; Accession=PF00098.14; Description=Zinc knuckle
MSLDSSSSINGEGSTPKDPLYKILDELRSLKLWKEKQERKEKGKKRVKEISQDEKEKIREEERRKILKKLRKEKHASYSSHNSCKILSKELRYYYEGRHRSHLRPHSHMKENERKSQEANINLPYFHGKDNVEAYLDREIRIEQKLKRKSTLKSYGSHSYPKKDQGLGILGAAPSKPKYDKGKTIEKQPPKASMQEKTSSIKCFKCLGRGHITSQCPTTKTMIMRGQDIYSSQDKATTSPSSSESEKAKGEESSEEIYPQEERLPLVVKEKCKE

SEQ ID NO: 148976 - protein, 134 aa, Glycine max
  Coding DNA Sequence Number=SeqID_57291
  Gene Ontology: Mol. function=transporter activity; Cellular component= membrane; Biological process=transport
  Homolog annotation: Hit_ID=A7MEZ6; Match level="QueryCoverage=100%, HitCoverage=26%, E-value=9e-46, Identity=71%"; Hit description =Putative uncharacterized protein
  Pfam annotation: Domain name=OEP; Domain location=1-111; Score=-13.3; E_value=0.06; Accession=PF02321.9; Description=Outer membrane efflux protein
GGRLVSSVKLARAQQGAAVLDYRQTVLTALGDVENALVSYRTDQQREAGLAKTIDALQNAFDLASDSYRQGIASFIDVLDAQRQLAQAQQQRAQAQVQSALDLVALYKALGGGWEPYQQVQLPDYTVFGDAPRG

SEQ ID NO: 148977 - protein, 112 aa, Glycine max
  Coding DNA Sequence Number=SeqID_57292
MAKYIMSMWLLQLPLLLFLAIKTAVELSQKILKGLEVVSTIFSPKMKLLIHIVATYPSAGGRRVTRGMRVPRKEYARSRHQRLFEENVGKTGKDAIYKLLSERLGSCIYARG

SEQ ID NO: 148978 - protein, 39 aa, Glycine max
  Coding DNA Sequence Number=SeqID_57293
MEFTKLPNDGTKPSQGPKKGNMSSSNNHRTKLGICSSNG

SEQ ID NO: 148979 - protein, 190 aa, Glycine max
  Coding DNA Sequence Number=SeqID_57294
MFIDGLRQQTKQLLDASAGGKIKLKTPEEATELIENMLASDHAILLDKTHQPTKKSLLQVVPFVVRLMKQANVFLLKKTHKKFIIWEINSDKGKLKEDFQASSRFNKDQCGPSNRPIQQGPNIIQRTTKLEETLTQFMQVGQLAKQIADKSSNNFVENIEKNPKEECKAVMTRSKRFVEAEAEESVVHKK

SEQ ID NO: 148980 - protein, 118 aa, Glycine max
  Coding DNA Sequence Number=SeqID_57295
MARVGDNGGVYHQLDGSQCLLLDAMTTQMQHLLNRNNEELYRRIAKSSLFILKPLSPREVCDDQIRMREKREQEKENSEAPHRNRKRKSDTPEGKSDTHKRESDTHERKFNYFEEASE

SEQ ID NO: 148981 - protein, 129 aa, Glycine max
  Coding DNA Sequence Number=SeqID_57296
MVKSWNLLRADQRLIFAKKLAQGFPGINRDTRIYLFCEVLQWLLFLSAVPPVQLLTGVVRNGKSTRPDISAGKCRGPAARNHHTPPRLMRRYRARPIRHSGCATVGKGDRCGPLRYYASWRKGDVLQGD

SEQ ID NO: 148982 - protein, 254 aa, Glycine max
  Coding DNA Sequence Number=SeqID_57297
FYANLYSLEGPSPKQVRIRGHLIRIDADSLNAFLETPVVLAEGHPGKILKKDLTTLAQVWSVLSYSNLAPTSHTSDLTVDRARLIFGLVTQLDMNVKALISGQITSMAQSNSSRLRFPILITALCRTRGVAFDSLIFACLSPVINLAYIRKNCWNPDDPTVIIRGARRPRARPAETPSTSTAPHPASTSATPLLARLTAAPSTLPPIDFQHFKAMLQSIHQGKIILLQSLQLVAPPNSIPTVEQFNEWVAWPGT

SEQ ID NO: 148983 - protein, 227 aa, Glycine max
  Coding DNA Sequence Number=SeqID_57298
  Gene Ontology: Mol. function=rRNA methyltransferase activity; Biological process=regulation of transcription, DNA-dependent
  Homolog annotation: Hit_ID=A6TEU2; Match level="QueryCoverage=100%, HitCoverage=52%, E-value=1e-111, Identity=87%"; Hit description=16S rRNA m5C967 methyltransferase
  Pfam annotation: Domain name=NusB; Domain location=5-129; Score =152.1; E_value=1.5e-42; Accession=PF01029.9; Description=NusB family
MKKNSNLRSLAAQAIEQVVEKGQSLSNVLPPLQQKVSEKDKALLQELCFGVLRTLSQLEWLIGKLMARPMTGKQRTVHFLIMVGLYQLLYTRIPPHAALAETVEGAVAIKRPQLKGLINGVLRQFQRQQEELLAEFAQHENRYLHPKWLLKRLQQAWPQQWQDIVSANNLRPPMWLRVNRNHHSRDEWLALLEDAGLQGFTHPDYPDAVRLATPAPVHALPGFDKGW

SEQ ID NO: 148984 - protein, 247 aa, Glycine max
  Coding DNA Sequence Number=SeqID_57299
  Gene Ontology: Cellular component=integral to membrane
  Homolog annotation: Hit_ID=A4W8D0; Match level="QueryCoverage=36%, HitCoverage=27%, E-value=4e-39, Identity=93%"; Hit description =Putative membrane protein precursor
MAVSSANWMAMGAIIWLLMGEDVNYFFVLGVLLVSSIAGVIVHIPAGIGVLEAVFIALLAGEHVSQGTIIAALLAYRMLYYFLPLALATDVGEVNAPHPTPLPKGEREPIEPLSPLGRGEQVDEIQIERQRAQNRVFAQVRAVAHVDLFANIFQLLGVIRRQPHEDHHPNVGHRPHQRFALQPQVYQRRQHDPDQPHEQHAAEAAQIAFGGVTVEAHRTKHPAGYHEGAGDGRVGVNDENAGKRQPR

SEQ ID NO: 148985 - protein, 70 aa, Glycine max
  Coding DNA Sequence Number=SeqID_57300
DYPPHISASPHQLDLAPYASGSYNAQWNAPELLHDKHMSHLSHILGKMGVEEPWLGVVFGIGCAVGGPCG

SEQ ID NO: 148986 - protein, 182 aa, Glycine max
  Coding DNA Sequence Number=SeqID_57301
NVRKKAQAIQKQNIAPHVLSRGGYEYLEQKLLAEKTKKKLEEAAQSGSVDGVIDPPSQVRRHVKWKMARTKKTGEMTTGAAKEIVEKIVSDTGILRPHGRRDVLTTTIGRPKHPGRVCAAGVGVTIKQYFGSAPRTSRSSSSLPPDELQQLTQQIRDQLEESITEKVTRQLMASFSQMQSQI

SEQ ID NO: 148987 - protein, 46 aa, Glycine max
  Coding DNA Sequence Number=SeqID_57302
MALMHEEAAEEEEDAAEDVQNQTCMMILMPPHDYRYWGICLAADEF

SEQ ID NO: 148988 - protein, 266 aa, Glycine max
  Coding DNA Sequence Number=SeqID_57303
  Gene Ontology: Mol. function=transferase activity; Cellular component= cytoplasm; Biological process=queuosine biosynthetic process
  Homolog annotation: Hit_ID=A7MEL5; Match level="QueryCoverage=95%, HitCoverage=71%, E-value=1e-126, Identity=87%"; Hit description=S -adenosylmethionine:tRNA ribosyltransferase-isomerase
  Pfam annotation: Domain name=Queuosine_synth; Domain location=13-226; Score=462.5; E_value=5.4e-136; Accession=PF02547.6; Description =Queuosine biosynthesis protein
MAHYRQNHTGAATDFAFELPESLIAHYPQAQRSGCRLLSLDGPSGALNHGVFTDVLDKLNPGDLLVFNNTRVIPARVYGRKASGGKIEMLVERMLDDKRVLAHVRASKAPKPGAELLLGDDESVKATMVARHDALFEIEFADDRAVLDILNSVGHMPLPPYIDRPDEEADRELYQTVYSARPGAVAAPTAGLHFDEPLLAALKAKGVEMAFVTLHVGAGTFQPVRVENINDHIMHSEYAEVPQDVVDAVLACKARGNKVVAVGTTS

SEQ ID NO: 148989 - protein, 272 aa, Glycine max
  Coding DNA Sequence Number=SeqID_57304
  Subcellular localization annotation: CTP_CleavageSite=31; ConfidenceScore=5.05e-01
MADGFNEEAIAQLLCTPRQDFARTTTGRRVRIMRTSMTTLTQTWMTLLLSNVLPSDHNFDLPLPKCQLVYAILTRMSVHVAQVIADTIYLFAGMPPTRHPLDLDKSNKALGFPALITGPCQSFGVLVTPSKVIQPPITRAFIEKYCTPRQAQGDAPQAADAPPPPHQADPAGSLGMERYLQHLVRQQAANHRGQVQIYECLYRFSLSQQGQGFAPFACPTPEQFGAEVTWPGDWPEAQAGEALAGSPDDAEEPVLMRDDDLLGFLGGSEPRD

SEQ ID NO: 148990 - protein, 363 aa, Glycine max
  Coding DNA Sequence Number=SeqID_57305
  Subcellular localization annotation: CTP_CleavageSite=44; ConfidenceScore=5.43e-01
RHPGGGRGAAAGGLSSAPRRAVAVFAAAGVEPVVGSHARRAVVRARALAPATVGGGSGRRRLPERAPVRPAVPRRNRADAGQGDRATAGGGGQGAHRRERRATGGDCSLGGVQRSGAHETGVYPRIWPVAAGDPPARPRGITFLPRLAAGHTRGATDVSGFRERIELGDAPYAAHSGGGGGVAGPARGAAGVQYAPGSENGAAERRGGLAGTAGRAGLCLARHERRRMVGVLRPRAGLAADSPVRNGGGSDHPFAPIAERPADRRRAGGHRLGHQPVKRRGAALPDLQLGRSAGERGAAQSAYGWADRLAHLLPDHPFDAARKARAGDRLRPGRAGDSGGGQGLRRPGDGGGNRSGARAAGAL

SEQ ID NO: 148991 - protein, 186 aa, Glycine max
  Coding DNA Sequence Number=SeqID_57306
VDPWVHVLTFRELHVLTFRGLHALAFRGLHVLAFRGLHVLAFREWRALTFRGSSALKCFTKTCAPGYGASSFLLSVLGPPLDIEEQPTVQAQPEREAITQLLCIPGQDFTRAAAKRQVRIMRTNMTTLTQIWMTLLLSNIPPGDRNADLPLGSAHKTPGGAQQGPGVSSSGYRPLSVLQGARPPQQ

SEQ ID NO: 148992 - protein, 73 aa, Glycine max
  Coding DNA Sequence Number=SeqID_57307
MGYRSRPQSSSDPPLTGLSLRSIVCKAHMQRMELQMHAYMQHLANQQAANHRGQVQLNDSFYQSHCRMAWGQA

SEQ ID NO: 148993 - protein, 69 aa, Glycine max
  Coding DNA Sequence Number=SeqID_57308
MSRNFMDYATIPSLTSGMLQNFDGLPTMLPFGNHPEHVGSFTDCFLMMGVKYLEAVPSEVLHNGRQTRN

SEQ ID NO: 148994 - protein, 85 aa, Glycine max
  Coding DNA Sequence Number=SeqID_57309
MWTTTGEELATQLAQASKVASSRSNSLLEEGSRRPKWARLLFVPPFLLNAPPSIFLLSKELRKLTDYAKTPLFDFYHITEFHGLR

SEQ ID NO: 148995 - protein, 186 aa, Glycine max
  Coding DNA Sequence Number=SeqID_57310
  Homolog annotation: Hit_ID=A5B6K0; Match level="QueryCoverage=79%, HitCoverage=26%, E-value=2e-18, Identity=31%"; Hit description =Putative uncharacterized protein
  Pfam annotation: Domain name=DUF659; Domain location=119-186; Score= -43.5; E_value=0.00079; Accession=PF04937.6; Description=Protein of unknown function (DUF 659)
PENVKLEMIAAYEKNIAETAAYMEAMQEEDEEEEDGILEIARLKSGKKRPTTSNEASLTASNKRITTKKGPIDFLFSKAPEESIKLGKTMRQSSVNETYNKAARDRAAIGTYGPHLKPPSYHELRVPLLKKELEYTKGLYEGSVDASEYMKTGQKIFELLDSFVEEIGEKNVIQVVTDNGSNYVLA

SEQ ID NO: 148996 - protein, 186 aa, Glycine max
  Coding DNA Sequence Number=SeqID_57311
  Homolog annotation: Hit_ID=UPI00006A2D9E; Match level="QueryCoverage =59%, HitCoverage=65%, E-value=2e-09, Identity=15%"; Hit description =UPI00006A2D9E related cluster
VLAIRGLHILAFRGLHILAIRGLHALTFRGLHVLAFRGSSTFIFRELHVLAFRELHALTFRGLHVLAFRELHVLTIKGLHALTFRGLHVLAFRGSCTFTFRGLHVLAFKGLHALTFRGWTPSPSKVLGPPPDIGGRPTMRAQPKEGYHAATVHTGARFHPCHCKETSVDHAHQHDHSYTDINDVAT

SEQ ID NO: 148997 - protein, 205 aa, Glycine max
  Coding DNA Sequence Number=SeqID_57312
MAPRKLPAKRSRKDKAAEGTSVAPEYDSHRFRSAEHQQRFEAIKGWSFHRERCVQLWDDEEVIAQLLCIPGQDFARTTAGRWVRIMRTNMNTLTQTWMMLQLSNILPSDHDSDLPLPKCQLVYATVAACPFAGEQGRGSRVRFPKEERCAESPPTFICGKRRKNRRKPVKVKIQSSGVVFTFEEGRQKRGFCSYVPSIEEEIRPT

SEQ ID NO: 148998 - protein, 151 aa, Glycine max
  Coding DNA Sequence Number=SeqID_57313
STLEDPTLSKLPHVWHLLSMSGFTRNSPQISASPHQLDLAPYASEPYNAQWNAPGLLRDKHTLRSSRILGEMEVDEPWLGLWLPLNYQVDMGASQHRTLELGWYSSLEVRNDIVGLVGNLAVQGWQSQHGFLPHPHPLYLPQFSHSSKQDD

SEQ ID NO: 148999 - protein, 78 aa, Glycine max
  Coding DNA Sequence Number=SeqID_57314
VDSRGSHPTFYYKKLIGYMPANFADLVFVGERIESRLRKGKFEYASNVAPNNNRRAPVVGARKKEKETPTRSPPPRRG

SEQ ID NO: 149000 - protein, 87 aa, Glycine max
  Coding DNA Sequence Number=SeqID_57315
MLQVDSRGSQSDLRTNPSQEGENDEDMFKSKGKDPLEGLGGPMTRARARKAKEALQQVLSILFEYKPKFQGEKSKVVSCIMAQMEEN

SEQ ID NO: 149001 - protein, 102 aa, Glycine max
  Coding DNA Sequence Number=SeqID_57316
MKVSSLGIPYIVKHLEYTTKEPMTIEESIHVTFDETNISSPRKEFVDDIADTLEDTKNKEREMMKTRMIKMTQHKKMIIFLKNGKLQEIILLTTSSVISQKG

SEQ ID NO: 149002 - protein, 168 aa, Glycine max
  Coding DNA Sequence Number=SeqID_57317
MFWLASLNLGYWLEVVFGQVSGKGRRVVFKLKDLSQQLLSCTLWDDYCLQFLKFLDDYEGDGPITVLLTHGRIKEAQGSYPPSVSNFFKVSKLIINQPVMEIQEFNEWLAELGIEARSGFKSHGEGSTQLSGSIQLSSKEPFFGKTEAKTIDDINTISEVIILYRGIL

SEQ ID NO: 149003 - protein, 60 aa, Glycine max
  Coding DNA Sequence Number=SeqID_57318
MEAPLELRNGERERERRRHFKEKMSLEEAHHHRRPWIRAWRKKEMNEGRGREEHEILCSK

SEQ ID NO: 149004 - protein, 99 aa, Glycine max
  Coding DNA Sequence Number=SeqID_57319
MAASDHTILRDRVHIPTKRSCRVCIVVELTILAAVSPMENQLMKSIIWGTSQDIISMQVDSLDSSMANSIINSRDSGEITLEILSTPGWTIHKATATRA

SEQ ID NO: 149005 - protein, 288 aa, Glycine max
  Coding DNA Sequence Number=SeqID_57320
  Homolog annotation: Hit_ID=Q9AVH2; Match level="QueryCoverage=62%, HitCoverage=75%, E-value=2e-64, Identity=61%"; Hit description =Putative senescence-associated protein
RQNEREPTNGSLFWPNIVEEERDTGLIGEGRIKATRAESQWIVAARPLCHLQYPVAYLSRLQRILPAARWELRFKASRRANPPHEGHQRHVPLGGRGPLLLVGKRTAGARVASSPDSDLEAFSHNPTHGSFAPLAFQPSAMTNSHVPYWWVNNPTLGEFCFTMIGRADIEGSKSNVAMNAWLPQASYPCGNFSDTSSFKFRRTKGSIGHAFTVRIRTGNQNQTSFYPFVPHEISVLVELILGHLRYLLTDVPPQPNSPPDNVFRPDRPAEADLGSKKRGSAPLPIHGI

SEQ ID NO: 149006 - protein, 72 aa, Glycine max
  Coding DNA Sequence Number=SeqID_57321
MPPRFFFVSLRKKCVTQINTEQVTVIRCWNWGHDIAVKGSLWAMKNELVFPQHHQTIAGLQKYQCDDPGKGY

SEQ ID NO: 149007 - protein, 90 aa, Glycine max
  Coding DNA Sequence Number=SeqID_57322
MVGAFSQNNVTLTGLPMISPSERDLTYQCGLSCHGKECHNINILVEGTIRIAKHSLSECSVARPTQQSSTTQSYSSPPTKWHKPQEGFFK

SEQ ID NO: 149008 - protein, 105 aa, Glycine max
  Coding DNA Sequence Number=SeqID_57323
MRSFNGDFPPCRCSGRQRRRGERRRHPLGNKPWKKELHHQDEPWIRSLEGCFNGGKERGRERERGEHKIEGIKEGKKWNFEVASLRSFLEKTSLRSFFEKTSLRS

SEQ ID NO: 149009 - protein, 154 aa, Glycine max
  Coding DNA Sequence Number=SeqID_57324
  Homolog annotation: Hit_ID=UPI00016621D1; Match level="QueryCoverage =80%, HitCoverage=40%, E-value=1e-08, Identity=32%"; Hit description =UPI00016621D1 related cluster
MSKSCGFGMTDPLDESISCFLIRVDPWVLVLIAFRGLHILAFRGLHVLTLRGLHVLTFVGLHALTFRGPNVLTFRGLHALAIRRLHVLTFVGLHALTFRGLHVLANRGLHALTLRGLHVLANRGLHALTSRGLHILALRGLHALTFRGLRVLIF

SEQ ID NO: 149010 - protein, 52 aa, Glycine max
  Coding DNA Sequence Number=SeqID_57325
MFMIITYPWNKLCSIGTKVWELWTSDPTVIDGGAGVDDEGLLSALALFLDAI

SEQ ID NO: 149011 - protein, 132 aa, Glycine max
  Coding DNA Sequence Number=SeqID_57326
MDEKKEKQLEEAAKYGSTNTVIDPPSPIRRHMKWKMARIRKTDQMTSEIAKEIADKIASHGSFVSHERQDVLTAAIGQPEHPGRVHATRIGVTIKQYFGPAPRTSPTSLSMAPGDLERLTQKIRDQLEESIT

SEQ ID NO: 149012 - protein, 104 aa, Glycine max
  Coding DNA Sequence Number=SeqID_57327
MTRLNNHDTSRFASPTRLSCLATAGSLRGRDLACLTGLIPDDEVVYAEDEHKSPRVNGLVVCVEDDVNLRVSTSLLASIDKGCRRDVDGAEKLLVYLRTSPDLR

SEQ ID NO: 149013 - protein, 160 aa, Glycine max
  Coding DNA Sequence Number=SeqID_57328
MGEVEEVQEQMKADMEAMKEQMATMMEAMMRMKKIIEANAVAVVATSVVAKVNSTLPSGLFQMNHPTSDMVDKDLGSMGGPHYVQIQNKHAFSPYGLPPNYMPPNVAYTPNENVNSSTHILIESQQPQSDREHVSQPMGETHENAPPQFSRLRALPRICH

SEQ ID NO: 149014 - protein, 83 aa, Glycine max
  Coding DNA Sequence Number=SeqID_57329
  Subcellular localization annotation: CTP_CleavageSite=34; ConfidenceScore=5.07e-01
MHTQSFTNPQFLKIGLTHKKSPVESPTVATCPSRASEGEAHGCASKGGKVDKSGAFAPTYPPLERKSDLRSSSLSVNRVILFT

SEQ ID NO: 149015 - protein, 106 aa, Glycine max
  Coding DNA Sequence Number=SeqID_57330
MFDTLKTDGEFGHFNLGNGGKMKVEGIGSMTSQGYKYAGSKWGCKVYKGIHLALQGQKNKDNLCYLDGQALKRSHDSKVKKKVKFSNVEEVLGDTSFGGGVCSLSN

SEQ ID NO: 149016 - protein, 92 aa, Glycine max
  Coding DNA Sequence Number=SeqID_57331
GHVLARKTLVQGDASSIGACRPRIFFINGFICFLEDEWQRNEERKRERKRHFKEKMSLEEAHHHRRPWIRAWRKKEMNEGRGREEHEILCSK

SEQ ID NO: 149017 - protein, 121 aa, Glycine max
  Coding DNA Sequence Number=SeqID_57332
MKLLPPSSSDFRILWPTVWVQCWTNFTDLEIFPPVQLPLTGWCVDAKAPPDISAGPSVAAFVLRAAQLLGRAIGAGLFAITPAGERGMCCKAIKLGNARVFPVTTLNSMDTSKLKVLSSAS

SEQ ID NO: 149018 - protein, 77 aa, Glycine max
  Coding DNA Sequence Number=SeqID_57333
MYLLEGDVSFLNDHLEETLGSSKIEENHSKCINLPQGKDGHSHPGSRFMVSWDFGSRLVERMDMIYVKALVWPAVQG

SEQ ID NO: 149019 - protein, 66 aa, Glycine max
  Coding DNA Sequence Number=SeqID_57334
MVAITPANVPQPPFFRGYNSNATCAYHGGVSGHSIEHCMTLKHKVMTKDMNRYLRALQWSNERHHA

SEQ ID NO: 149020 - protein, 62 aa, Glycine max
  Coding DNA Sequence Number=SeqID_57335
MASMMDAILGMKQLMESNAATAAAVISAAEADPTLPTVAHHPFPNLVGRERSTSGHISNPHL

SEQ ID NO: 149021 - protein, 117 aa, Glycine max
  Coding DNA Sequence Number=SeqID_57336
  Homolog annotation: Hit_ID=A5APU0; Match level="QueryCoverage=39%, HitCoverage=4%, E-value=8e-08, Identity=52%"; Hit description =Putative uncharacterized protein
MSQNLTDYAIIPSLASRMLWNFTDCALTRPFNSRHVAQLHGLPNDGCQVPRSGQARVAPQQTDDPRTKLGNFLWGGDFEANKIPWVKWDTICLPKNKWGLGIKDLIKFNEALLGTWG

SEQ ID NO: 149022 - protein, 53 aa, Glycine max
  Coding DNA Sequence Number=SeqID_57337
MDKFDFFVPHPLVITSLLPLECCENKTTVDTSEPYTGAMKGTMHKPQANLGAD

SEQ ID NO: 149023 - protein, 81 aa, Glycine max
  Coding DNA Sequence Number=SeqID_57338
GVSSLSSFSITLPFIFQEAKESIDEEDPRPTSSNGACIMWYQSTRASSVEGRSPEYEEPRDLRSNPFQGGGNDAILSRKGI

SEQ ID NO: 149024 - protein, 72 aa, Glycine max
  Coding DNA Sequence Number=SeqID_57339
MGDSAKVVIKQDMKGIEHKYGFNNNKREKPEKKRKITLANCRNLPFGGRATRDSRDACSTKGIRAESPPTFI

SEQ ID NO: 149025 - protein, 216 aa, Glycine max
  Coding DNA Sequence Number=SeqID_57340
MAPRKLASRRSRKDKAAEGTSSAPEYDSHRFRSAEHQQRFEAIKGWSFLRERRVQLRDDEYTDFQKEIVCRRWASLVTLMAKFDPDIVLEFYANAWPTEEGMRDMRSWVRGQWIPFDADAISQFLGYPLVLEEGQECEYGQRRNRSDGFDEEAIAHLLCIPGQDFARTAAGRRVRIMRTNMTTLTQIWMTLLLSTSIPATIIPTSPYRSVSWCTPS

SEQ ID NO: 149026 - protein, 208 aa, Glycine max
  Coding DNA Sequence Number=SeqID_57341
VGSIDVAVVKEFYANLYNPKDQSPKQARVRGHLIKIDADSLNDFLETPVVLKEGETLPTYSRLCRLRSNPQEIEARLCIPHKGFVLNAEGQPWKLLRKDLTILAQTWSVLSYSNLAPTSHTSDLNMDRARLVYGLVTHMDMNIGALILGQISSIAQSKCSRLGFPALITALCRARGVTSNSLTYESLSLAINLAYIKKNCWNLGASYS

SEQ ID NO: 149027 - protein, 152 aa, Glycine max
  Coding DNA Sequence Number=SeqID_57342
  Gene Ontology: Mol. function=aspartic-type endopeptidase activity; Biological process=DNA integration
  Homolog annotation: Hit_ID=A5BKY7; Match level="QueryCoverage=98%, HitCoverage=32%, E-value=1e-31, Identity=49%"; Hit description =Putative uncharacterized protein
  Pfam annotation: Domain name=zf-CCHC; Domain location=116-133; Score =28.7; E_value=2.1e-05; Accession=PF00098.14; Description=Zinc knuckle
MDIDYAIRKDEPPAITETSEPNVVDLYEKWERSNRLSVMFIKTNISASIRGSVDQHDKVRDLLKAIDEQFTISEKSLASTLIIRGEIDNGKRVRRKKSVGTDKGKIPTQPTIKKESKCFFCKKKGHMKKDCPKFKSWFEKKGYGKPKEASGK

SEQ ID NO: 149028 - protein, 253 aa, Glycine max
  Coding DNA Sequence Number=SeqID_57343
  Homolog annotation: Hit_ID=Q6Z8F0; Match level="QueryCoverage=25%, HitCoverage=58%, E-value=5e-18, Identity=73%"; Hit description =Putative uncharacterized protein P0459B01.18
YALTRTLHRRSGSVGGATHRGIPPISFLAPYGPTPGARRCRGTPRARAAIHNRDDDVSTSISTARAWATIAIRVGQCPESIGGPALTPWDGIYRPDWGCIPKQPDSPTAHRGATGSGHDGALTLSSAPFQRTWPRSATEDASPDSNSDAEGDRFSWWAVPGSLAVTKGILRVAPPDLRSRWERACTQRVVDGSRTDRLARDWSRAWLIHHFITAKSAMNPDFNQPRGGRALGLMASGATCVQRLDGSRDSAIH

SEQ ID NO: 149029 - protein, 126 aa, Glycine max
  Coding DNA Sequence Number=SeqID_57344
  Pfam annotation: Domain name=zf-CCHC; Domain location=53-70; Score =31.2; E_value=3.8e-06; Accession=PF00098.14; Description=Zinc knuckle
MAAQEEEDDEESEDEEDFSFFVKKFHKFVKNRRIERRQNFNHGKRFQEGSPTLRCYKCNQLGHIKANCPSNEQWPEKNDKKSHEERRTKKAYIAWDDNDSSEGSEKEEINLLTKANESEEDITQRD

SEQ ID NO: 149030 - protein, 316 aa, Glycine max
  Coding DNA Sequence Number=SeqID_57345
DFQLVPTVKEFEEILGCPLGGRKPYLFSGFYPSTTRVAKYQGSVWRKGQRPWQIKANGLSFIDILALLIFGVVLFPNMEGLVDLAVIDAFLAFHHGKESPVVAILAMYDTFDRGCEKSSARIVCCALALYVWLVSHLFLQEGRPVYPLQGHRSCVEKGKANWDQLLASMEGRLLIGSLTRRKEESGFYLHAKGCPMRGDRELRGSSNGIIGGYHKWLRVRTQGLDWLPNLKTVRDNEVKASGESDEVQALKAKLERARVVKEKFKSIAIKGSNSELKLRRGERNHHGETEGNMWAIIDECKEKLNLAATHEQRLED

SEQ ID NO: 149031 - protein, 51 aa, Glycine max
  Coding DNA Sequence Number=SeqID_57346
  Homolog annotation: Hit_ID=A5BMX7; Match level="QueryCoverage=80%, HitCoverage=5%, E-value=9e-07, Identity=51%"; Hit description =Putative uncharacterized protein
MDSLKQSWHIDSGCSKHMAGDASKFIHISPKNSEHVIYGDNNKDFFSPLCS

SEQ ID NO: 149032 - protein, 122 aa, Glycine max
  Coding DNA Sequence Number=SeqID_57347
  Gene Ontology: Mol. function=nucleoside transmembrane transporter activity; Cellular component=integral to membrane; Biological process=nucleoside transport
  Homolog annotation: Hit_ID=P76417; Match level="QueryCoverage=100%, HitCoverage=28%, E-value=7e-54, Identity=84%"; Hit description =Putative nucleoside transporter yegT
  Pfam annotation: Domain name=Nuc_H_symport; Domain location=1-122; Score=-114.6; E_value=2.1e-06; Accession=PF03825.7; Description =Nucleoside H+ symporter
MMFVEWFIWGAWFVPLWLWLSKSGFTAGEIGWSYACTAIAAILSPILVGSLTDRFFAAQKVLAVLMFAGAILMYFAAQQTQFSAFFPLLLVYSLTYMPTIALTNSIAFANVDDVEADFPRIR

SEQ ID NO: 149033 - protein, 59 aa, Glycine max
  Coding DNA Sequence Number=SeqID_57348
EPVQVIEVSSSKEDLEEDQEELSFAPVMDAPDLPEDDEDPLLDVDSPEDIMSASKADST

SEQ ID NO: 149034 - protein, 62 aa, Glycine max
  Coding DNA Sequence Number=SeqID_57349
SRLFRFFRRFPQINVGGDSARIPFVEHASRESRVALPPKGRLRQGITKKKVLTMMKLMLKLQ

SEQ ID NO: 149035 - protein, 117 aa, Glycine max
  Coding DNA Sequence Number=SeqID_57350
  Gene Ontology: Biological process=transposition, DNA-mediated
  Homolog annotation: Hit_ID=Q1J7G7; Match level="QueryCoverage=32%, HitCoverage=67%, E-value=7e-11, Identity=72%"; Hit description =Transposase
DLPSQWLLFLSAVPPVQLLTGWCVTAKAPPDISAGKCSGRVPFAIQAAQLLGRAIGAGLFAITPAGERGMCCKPIKLGNARVFPEFDPQIKRGGDSGGIIPFKQHASRESRVALPPK

SEQ ID NO: 149036 - protein, 89 aa, Glycine max
  Coding DNA Sequence Number=SeqID_57351
MSAAESPTIATCPFAGERRRGSQVRFSFKEERCAESPPMFICGKCRKNRSKPVKMKILSSGVVFTLEEGRQKRGFCSYVPSSGEEIRPT

SEQ ID NO: 149037 - protein, 110 aa, Glycine max
  Coding DNA Sequence Number=SeqID_57352
  Pfam annotation: Domain name=G-patch; Domain location=2-41; Score =13.1; E_value=0.0049; Accession=PF01585.14; Description=G-patch domain
MARVMLGNGDEPGMGLGKDNGGITSLIKTQGNRGKYGLGYKPTQADMKRSTAGRKNSGQSSRWRQESQGFAICEDDVPSTLDLVRPCPPDFQLGNWRVEERPGIYATSIM

SEQ ID NO: 149038 - protein, 110 aa, Glycine max
  Coding DNA Sequence Number=SeqID_57353
MKLASTALLLKIANWKHCSKTCVQIKLFHSPRDFQLVLIIEEFEKIDGCPLEGTKPFFTSGHSPSIPRLSEVLGIPVTKLREKEMNRNGVRSFLKKLMEDKARECASKGE

SEQ ID NO: 149039 - protein, 89 aa, Glycine max
  Coding DNA Sequence Number=SeqID_57354
  Subcellular localization annotation: CTP_CleavageSite=25; ConfidenceScore=5.14e-01
VKLSFDSSFSRFLFSSNFFFRISPVCKTKKGSKIGATLWQELFTELRDKLQCGSSYLIQNLRIVDNQSEYRVCPAPYLVYFLKTTCGIL

SEQ ID NO: 149040 - protein, 56 aa, Glycine max
  Coding DNA Sequence Number=SeqID_57355
FSNYTKSVVAVLSGRCELSPQALDLLHQWSPLLLEHQWQQNGEGGKVIGDATSRRR

SEQ ID NO: 149041 - protein, 140 aa, Glycine max
  Coding DNA Sequence Number=SeqID_57356
IDWAHLVRYRMHKALQANAPLPYPHLITLFLRHFQIPLDDEPFVQVKRSFAIGAGAVTSFGYRKDRNGQWLKKDALPPQDERTPSPPPQREDSALMNEKTSSNGRAIRRERDHPRTATAACPSVTAHPAPTAPIPPSLSL

SEQ ID NO: 149042 - protein, 106 aa, Glycine max
  Coding DNA Sequence Number=SeqID_57357
MGFPLPAVIYPAKNLSAFVIRSPLRRFCVLFFGGKDEDSFHRPRKAGVAAHDVQRYVKESDRAAQCTRQDKMSNEELKLQDPRCRIQCPGHPARKYWRCCTMHKAR

SEQ ID NO: 149043 - protein, 121 aa, Glycine max
  Coding DNA Sequence Number=SeqID_57358
  Subcellular localization annotation: CTP_CleavageSite=75; ConfidenceScore=5.51e-01
MSRGGRQKWGFCSYVSSIAMRKSDLRSSCKSGKRGRRLPPSSPGRAGRQPPPPFSYKKAEGGCSKDPSAPWLCISAVLGEKNCFREENPSRGASVTLPRCFRKQIREGFRPFFIRSSFFNR

SEQ ID NO: 149044 - protein, 176 aa, Glycine max
  Coding DNA Sequence Number=SeqID_57359
MASITEAMLKLQKTIEDNATAAASNTAREAEPVLQPAINLGRDKNATGFNRRYSPQAYPYGLPPDFTPRTAPDDLSQAPSFESQDGLQEDDEGDAHLGPLLPLKEPAPHELPQPNVVRHVPSPSAPVKELVCFAKDKGKIDLLEERLRAVEGLGSYPFSDLADLCLVPDIIIPPKF

SEQ ID NO: 149045 - protein, 96 aa, Glycine max
  Coding DNA Sequence Number=SeqID_57360
EAKRLIERLVAGSLEVSLRIAGARGRVLSGRCGCSVEPRHGIESSKWAIFGKQNWRCGMNRKLGYGAQLRANLDPTKGVGRLRQQDGHGSQPWKEG

SEQ ID NO: 149046 - protein, 369 aa, Glycine max
  Coding DNA Sequence Number=SeqID_57361
  Homolog annotation: Hit_ID=Q2HW90; Match level="QueryCoverage=47%, HitCoverage=35%, E-value=2e-18, Identity=33%"; Hit description =Putative uncharacterized protein
LMGQVQRQAFRKAYGKIWDLAMVEVSTKTSASLAQYYDQPLRCFTFGDFQLSPMVEEFEEILGCPLGGRKPYLFSGFYPSLARISKIVKILAQELDHRKQVENGVVGIPRKYLEEKARILAGKGEWAPFIDILALLIFGGVLFPNVDGLVDLPAIDAFLAYHNHKESLVVAMLADLYDTFDRRYNLATPMRGAPLEEEIAPVISRGFNKANVETLQKVRKAWEVVRKKDKELRGSNNGPIGGYRKWLRAHVQGLDWLPCLRTAKREEVEAPKEDEEVQALRTELEKAQTVKERFKSAALKIRKENAKLRDINTATTKSLEQETQRARREEHGRNKFRGALWGSNSELKLRREESDQSRVDSLILKDELK

SEQ ID NO: 149047 - protein, 76 aa, Glycine max
  Coding DNA Sequence Number=SeqID_57362
MHRSPTATLRRNRAERRRKLLQDRTVASILKEETHFFYLLSPDSQSSRESATQLPEVIIMAEEHDQRITLEDYSSS

SEQ ID NO: 149048 - protein, 154 aa, Glycine max
  Coding DNA Sequence Number=SeqID_57363
  Homolog annotation: Hit_ID=Q9SJS1; Match level="QueryCoverage=36%, HitCoverage=7%, E-value=3e-08, Identity=51%"; Hit description =Putative Athila retroelement ORF1 protein
MYTELQELSMQKNLFQCLLVFMRLRTASGDVVPINLEIEATCRRNNAARRRREQDTEGSSHTSPPLSPHHTEMDGEQARRVTLEDFSNTATPQFFTSIARPEVQAANISYPHSLIQLIQGNLFHGLPSEDPYAHLASYIEICNTVKIAGVPEDA

SEQ ID NO: 149049 - protein, 29 aa, Glycine max
  Coding DNA Sequence Number=SeqID_57364
MPEETPLLLVRPCIVRNGFMIPTWLAHGA

SEQ ID NO: 149050 - protein, 118 aa, Glycine max
  Coding DNA Sequence Number=SeqID_57365
MSSKVILMMPKNQELSKFSSKDSRIKFQDSRIIKIKIKIQDSKIQESREDLIKISIKKFFKTLSSTRSFHKIITKEFYSLRVHLLGDCYTKNKRGYISCGSVQVEGTSTWVFKENKGG

SEQ ID NO: 149051 - protein, 100 aa, Glycine max
  Coding DNA Sequence Number=SeqID_57366
  Subcellular localization annotation: CTP_CleavageSite=73; ConfidenceScore=5.15e-01
MEVTILQKLGQKKDRVTSLLRLLPNTFRTVDVLVTSNFTLTKVSRTIKKHALRRPYRTCARARVMGEVEEGVRADGGRHGGRHGGHGRGNGHNDGGHDEA

SEQ ID NO: 149052 - protein, 93 aa, Glycine max
  Coding DNA Sequence Number=SeqID_57367
MVIFHHGDAAEGKGEEERGGASPPRIALDKKLEVDALMEEKKERRGEHEIEGIKEGEKWNFEVYLIRLSFIKVTTSVTHASIYRLGSFLEKLS

SEQ ID NO: 149053 - protein, 55 aa, Glycine max
  Coding DNA Sequence Number=SeqID_57368
MQNMEHGHLNIVARVQIIFDDAVTGLKNFDLILQTNAVHRTVVKWLNMMPPNLVY

SEQ ID NO: 149054 - protein, 952 aa, Glycine max
  Coding DNA Sequence Number=SeqID_57369
  Gene Ontology: Mol. function=nucleotidyltransferase activity
  Homolog annotation: Hit_ID=A7QTV9; Match level="QueryCoverage=87%, HitCoverage=89%, E-value=1e-128, Identity=43%"; Hit description =Chromosome undetermined scaffold_171, whole genome shotgun sequence
  Pfam annotation: Domain name=NTP_transf_2; Domain location=68-144; Score=14.7; E_value=0.0047; Accession=PF01909.14; Description =Nucleotidyltransferase domain
  Pfam annotation: Domain name=PAP_assoc; Domain location=224-317; Score=0.1; E_value=0.058; Accession=PF03828.10; Description=PAP25A associated domain
  Pfam module annotation: Pfam domain module=NTP_transf_2::PAP_assoc; Domain location=68-144::224-317
MGSGSNCIPIGIVSSKTPYVPKVLDQKRWSRAEARAAELIAQIQPNYASEAHRNAVVFNLQCLIMNSVPCQVFTFGSVPLKTYLPDGDIDLAVFAENQHSEDRLIQDVRNILENQGTNEDSEFHVKEVQYIQGEVKIIKCLIENFVVDISFNQIDGLGTLCFLEEVDNLIRKEHLFKESIILIKAWSYYESRILGSQHGLLSTYGLEILIIYLFNIYSHTLAGPLEVLFQFLNFFSKFDWNKYCISLRGPVPIRSLPKMKAEPPRYARKNCPELLLSEKFLDSCESNYGVKLSYREIRDKPFVCKHLNIVDPLRANNNLGRSISRGNFCRIKGAFSLGAKRIERLLSCTEDNIIAEFDLFFTNSWDRNGNGYWVDTETYNLLIRNKSVETSHEYAVEQPHGVSQNPDNHSEESKQMSGTSDVIVANTMNNKVLANRGQSPTYSSNEAHDMHHFPEFYFSSEFSHLYGEAPSHHHHNTGFSSEIQQSYGQISDDWRSEHAFDPENTSSGYYYDYEYDFGVNYENVFPTDEAMLMHQHQEEFGFPNLNEYQQAAVNVNSSDVPFPPPPPHVLASGYMHENSFGVLYGNWIDQSTIGTDLRENTSTESTTSRVQALQLGSSQRDVIDNKNFPPVEGGSSGPSFQVPTMFPFYNLPTETTFAATNYDILDGDFETHYMNLQYGRLCKNPKSLPMHLREQFPWYGKPKGVFNIEEHAHPPVRVMLPQRASRLRGNTNQSVGFWLPRFSDGTGTFFPKPSSSYHELWFWRRNRLQQDRYIEYQRYERKDNNGEREHNLFSNSEARLADLGQYKLENPGSNESSQKDERKDKDGEREQNLFLNSERMFPSLGRYKFENPGSNESSNQGESSHSGTSKVPNIGTGRDSKRFKKRDIRSLNGDADYLLGQKYFPFLVCASLTRVKLEKVNHLYKESVIIVRLLICPPYMCVIQRWHEEGFM

SEQ ID NO: 149055 - protein, 539 aa, Glycine max
  Coding DNA Sequence Number=SeqID_57370
  Gene Ontology: Mol. function=transferase activity; Cellular component= cytoplasm; Biological process=phosphorylation
  Homolog annotation: Hit_ID=A9ZN02; Match level="QueryCoverage=99%, HitCoverage=99%, E-value=1e-169, Identity=59%"; Hit description=5 -phosphomevelonate kinase
  Pfam annotation: Domain name=GHMP_kinases_C; Domain location=423-506; Score=28.1; E_value=3.2e-05; Accession=PF08544.4; Description=GHMP kinases C terminal
  Pfam annotation: Domain name=GHMP_kinases_N; Domain location=203-284; Score=33.7; E_value=6.6e-07; Accession=PF00288.17; Description=GHMP kinases N terminal domain
  Pfam module annotation: Pfam domain module=GHMP_kinases_C::GHMP _kinases_N; Domain location=423-506::203-284
MAEVVTSAPGKVLMTGGYLILERPNPGLVLSTNARFYAIIKPIHHEIKPDSWAWAWTDIRLTSPQLCRQALYKLALKNLAIQTVSPRHLHLLLFKLFFSLLASIIELLLCSFWFWYFSDTRNPFVEYAIQYSVAAAYATFDQNKKELLHKLLLHGLDITILGGNDFYSYRNEIERRGLPLTPESLATLLPFSSITFNTDDADGGSCKPEVAKTGLGSSAAMTTAVVAALLHYLDVVKLSSSKDHWERKDVADLDMVHKIAQTAHCIAQGKVGSGFDVSSAVYGSQRYVRFSPEVISSTKVGDIAVPLPDSITEIIKGNWDHDTAEFSLPPLMTLLLGEPGTGGSSTPSMVGAVKKWQKSDPQKSLDTWRRLSEANSALEMQLNLLSKLAKEQWNAYKSVIDSCSMLRSDKWIEQASEPNKEAIIKALLGAKEAMLGIRYRMSQMGEAAGVPIEPESQTQLLDATVNLEGVLLAGVPGAGGFDAVFAVTLGDSSSNVTKIWSSLNVLALLVKEDPCGVCLEKADPRTNEITSAVSSIHIQ

SEQ ID NO: 149056 - protein, 367 aa, Glycine max
  Coding DNA Sequence Number=SeqID_57371
  Gene Ontology: Mol. function=mRNA (guanine-N7-)-methyltransferase activity; Cellular component=nucleus; Biological process=mRNA processing
  Homolog annotation: Hit_ID=A7QZT1; Match level="QueryCoverage=99%, HitCoverage=97%, E-value=1e-138, Identity=68%"; Hit description =Chromosome chr13 scaffold_286, whole genome shotgun sequence
  Pfam annotation: Domain name=Methyltransf_12; Domain location=29-134; Score=10.2; E_value=0.048; Accession=PF08242.3; Description =Methyltransferase domain
  Pfam annotation: Domain name=Pox_MCEL; Domain location=1-281; Score= -56.3; E_value=1.3e-10; Accession=PF03291.7; Description=mRNA capping enzyme
  Pfam module annotation: Pfam domain module=Methyltransf_12::Pox_MCEL; Domain location=29-134::1-281
MSQPTQQRLYDFAKMALINIFVHPYATVCDLYCGDADADKWAHAQIGHYIGIDAPSSGIDQMRETWETHRKSYTAEFFELDPCTENIETHLEEKTNMTDVVCCLQHLQLCFETEEKARKLLHNVSSLLKPGGYFLGITPDSSTIWAKYQRNVEAYHNKSSSMKPNIVPNCIRTENYMITFEVEEEKFPLFGKKYQLKFANDVSAETYCLVHFPSFIRLAREAGLEYVEIQNLTEFYDDNRAQLAGLLTHYVPNLLDPRGRLLPRSYDALGLYTTFIFQKPDPEIAPPIPTPLLPDVSYNLDENTILGTVEEEKTEHMDESVIEVTIWRDDEVINGHVVEPAIGLGKISEQKGILGPGPADLRFPEAL

SEQ ID NO: 149057 - protein, 519 aa, Glycine max
  Coding DNA Sequence Number=SeqID_57372
  Gene Ontology: Mol. function=hydrogen ion transporting ATP synthase activity, rotational mechanism; Cellular component=proton -transporting two-sector ATPase complex; Biological process=ATP synthesis coupled proton transport
  Homolog annotation: Hit_ID=A7QEQ1; Match level="QueryCoverage=100%, HitCoverage=100%, E-value=0.0, Identity=69%"; Hit description =Chromosome chr16 scaffold_86, whole genome shotgun sequence
MSSTVLEVTRAAHEEVERLERLIVKELQNDPASNKERLYQSHRVRNMIDTITSTTEKLIGVYEDNDNARKDEIAALGGQTATGINVFSAFYDRLKEIREYHRKHPVARVVDANDDYETLLNEEPQIEFSGEESLGRYLDLHELYYQYVNSKFGEPIEYSAYLDVFSDTDKIPRKMKMTRQYREYLANLLEYLLYFFQRTEPLQDLDRILSKVTTEFEESWVVGKVQRWENDNQENGHVLAEHAPIDLDYYSTIEELMEVGPERLKEALAALGLKTGGTVQQRAERLFLTKHTPLEKLDRKHFAKGACGVEKNGVAAVPQEDGNSKEIALMEAKMTKLCHLLEETIARTKDNVVKKQALTYEEMEAEREEEETQEDSESEDEEQQIYNPLKLPMGWDGKPIPYWLYKLHGLGQEFKCEICGNYSYWGRRAFERHFKEWRHQHGMRCLGIPNTKNFNEITSIERVLTSVLRALEAKELWKKIQQRQGVNKWRPDLEEEYEDKEGNIYNKKTYTDLQRQGLI

SEQ ID NO: 149058 - protein, 497 aa, Glycine max
  Coding DNA Sequence Number=SeqID_57373
  Gene Ontology: Mol. function=histone-lysine N-methyltransferase activity; Cellular component=nucleus; Biological process=DNA mediated transformation
  Homolog annotation: Hit_ID=A7QEQ4; Match level="QueryCoverage=100%, HitCoverage=46%, E-value=0.0, Identity=70%"; Hit description =Chromosome chr16 scaffold_86, whole genome shotgun sequence
  Pfam annotation: Domain name=PHD; Domain location=48-97; Score=35.3; E_value=2.2e-07; Accession=PF00628.20; Description=PHD-finger
  Pfam annotation: Domain name=SET; Domain location=331-479; Score =139.8; E_value=7.7e-39; Accession=PF00856.19; Description=SET domain
  Pfam module annotation: Pfam domain module=PHD::SET; Domain location =48-97::331-479
MLQLAEFHATAQVPAKPKKPSLKERKQKLLTFLQEKYEPVHAKWTTERCAVCRWVEDWDYNKIIICNRCQIAVHQECYGARNVRDFTSWVCKACETPDIKRECCLCPVKGGALKPTDVDTLWVHVTCAWFRPEVSFASDEKMEPALGILSIPSNSFVKGIGSNPRNSLFACESMAVFVYPPQTPFGGSFLHWQIHGSCTQCCKCSTYFHAMCASRAGYRMELHCLEKNGKQTTKMVSYCAYHRAPNPDTVLIMQTPLGVISTKSLLQTKKKSGSRLISSNRRKQDDTPVDNTEHEPFSAARCRIFQRTNHTKKVVHEPQAFSSFRERLYHLQRTENDRVCFGRSGIHGWGLFARRNIQEGDMDQWDFGLLEHLELGSSAEVLEYRGEQVRRSIADLREARYRLEGKDCYLFKISEEVVVDATDKGNIARLINHSCMPNCYARIMSVGDDESRIVLIAKTNVVAGDELTYDYLFDPDEPEENKVPCLCKAPNCRKYMN

SEQ ID NO: 149059 - protein, 533 aa, Glycine max
  Coding DNA Sequence Number=SeqID_57374
  Gene Ontology: Mol. function=histone-lysine N-methyltransferase activity; Cellular component=nucleus; Biological process=chromatin modification
  Homolog annotation: Hit_ID=UPI000034F123; Match level="QueryCoverage =84%, HitCoverage=48%, E-value=3e-83, Identity=46%"; Hit description =PHD finger protein-related / SET domain-containing protein (TX4)
  Pfam annotation: Domain name=PWWP; Domain location=325-409; Score =8.2; E_value=0.0022; Accession=PF00855.8; Description=PWWP domain
MVNQNAMTNKLTQETRKKNLRFSDILAPNSLTFFDPLRVSLHEIRPRALASSFALFFSEFQFGIRVYGVSRAFGLVTRTMIIKRNLKSQMPSLKRVKLGDSVGENDECSYARKKRKTNNGYYPLNLLGDVAAGVIPVSFHGLLGAAGVVEKGFSAAWCNGVESNVKNEVVVEVKKKNEVQRPPLVRTSRGRVQVLPSRFNDSVIDNWRKESKSSSGGLRDCDYDEEFECKKEKFSFKAPKVCNNNQKKGKSEEKTGSKARKYSALCNSFERSKCLSSPGDGSLALRHSGAAAVEEDDEKGRFLEVEKVGLMGLKEKRNGLFGPEDFYAGDIVWAKAGRKEPFWPAIVIDPMTQAPELVLRSCIADAACVMFLGYAGNEDQRDYAWVNHGMIFPFMDYVDRFQGQSELSYYTPSDFQMAIEEAFLAERGFTEKLIADINTAASSNGYDDSILKAFQKVSGSNQYAGYHFLNQNLEGTDYYCPTCKAKFDFELSDSEKPQPKVKWSKNNGQLVLPNRVTVLCNGVEGTYFPSLHS

SEQ ID NO: 149060 - protein, 315 aa, Glycine max
  Coding DNA Sequence Number=SeqID_57375
  Gene Ontology: Mol. function=protein binding; Cellular component =cytoskeleton; Biological process=cell division
  Homolog annotation: Hit_ID=Q84LL6; Match level="QueryCoverage=100%, HitCoverage=100%, E-value=4e-91, Identity=56%"; Hit description=Salt tolerance protein 5
  Pfam annotation: Domain name=CS; Domain location=140-215; Score =117.1; E_value=5.2e-32; Accession=PF04969.7; Description=CS domain
  Subcellular localization annotation: CTP_CleavageSite=60; ConfidenceScore=5.39e-01
MAIISDFNEEEPKPAHSSPPQPQSSSSSSSFSATFDRSNPIAFLERVFEFVSEQSDFLATQSAEKEIVSLVHAAGKKKRELLKAERENADKKKREDLKVTEERQKVEKRLNEEKELKAEDTNKNESASRVPNKGNGLDLEKYSWTQSLQEVNVNVPVPNGTKSRFVTVEIKKNHLKVGLKGQPPIIEGEFHKSVKPDDCYWSIEDQNSISILLTKHDQMEWWKCLVKGDPEIDTQKVEPENSKLGDLDPETRQTVEKMMLWLFTQLASSSSSLPKFDQRQKSMGLPTSEELQKQEMLKKFMSEHPEMDFSRAKIS

SEQ ID NO: 149061 - protein, 19 aa, Glycine max
  Coding DNA Sequence Number=SeqID_57376
EAADDNGMQLLAAVATGEN

SEQ ID NO: 149062 - protein, 552 aa, Glycine max
  Coding DNA Sequence Number=SeqID_57377
  Gene Ontology: Mol. function=protein binding; Cellular component =Golgi apparatus; Biological process=vesicle docking during exocytosis
  Homolog annotation: Hit_ID=A7NSJ5; Match level="QueryCoverage=99%, HitCoverage=91%, E-value=0.0, Identity=81%"; Hit description =Chromosome chr18 scaffold_1, whole genome shotgun sequence
  Pfam annotation: Domain name=Sec1; Domain location=21-552; Score =315.7; E_value=8.4e-92; Accession=PF00995.14; Description=Sec1 family
MVVSSSARDYINRILQDISGMKILILDSQTVGIVSVVYSQSELLQKEVFLVELVDSISKSNESMSHLKAVYFLRPTSENIQLLRRQLASPRFGEYHLFFSNILKDTQIHLLADSDEQEVVQQVQEFYADFVAIDPYHFTLHVPSHYIYMLPAVVDPSTVQRFSDRVVDGLSALFLALKRRPVIRYQRTSDIAKRIAQEAAKLMYQEESGLFDFRRMEVSPLLLVIDRRDDPVTPLLNQWTYQAMVHELIGIQDNKVDLKSVGKFPKDQEEIVLSSEQDSFFKANMYENFGDIGMNIKRMVDEFQQVSKSNQNIQTIEDMAKFVDNYPEYRKMHGNVTKHVTLVTEMSKIVEERKLMSVSQTEQELACNGGQGAAFEEHDRDLGIMECLSPTSSSMRCLVEYLSGLAVTNLLNNESISDVDRLRLVMLYALRYEKDSPVQLMQLFNKLASRSAKYKPGLVQFLLKQAGVDKRTGDLFGNRDLMNIARNMARGLKGVENVYTQHQPLLFQLMESIVKGRLRDVDYPFVGNHFQQGRCNLVSIMISDATTLLPDC

SEQ ID NO: 149063 - protein, 364 aa, Glycine max
  Coding DNA Sequence Number=SeqID_57378
  Gene Ontology: Mol. function=molecular_function; Cellular component =membrane; Biological process=auxin mediated signaling pathway
  Homolog annotation: Hit_ID=A7PD50; Match level="QueryCoverage=96%, HitCoverage=95%, E-value=3e-63, Identity=37%"; Hit description =Chromosome chr17 scaffold_12, whole genome shotgun sequence
  Pfam annotation: Domain name=DUF6; Domain location=201-330; Score =3.7; E_value=0.042; Accession=PF00892.11; Description=Integral membrane protein DUF6
  Pfam annotation: Domain name=DUF6; Domain location=23-158; Score =32.5; E_value=1.6e-06; Accession=PF00892.11; Description=Integral membrane protein DUF6
  Pfam annotation: Domain name=UAA; Domain location=50-336; Score= -161.9; E_value=0.026; Accession=PF08449.2; Description=UAA transporter family
  Pfam module annotation: Pfam domain module=DUF6::DUF6::UAA; Domain location=201-330::23-158::50-336
MEVNKTKMSEVLPFIIMVIMEGWTIGLTIFAKTAITNGMSPLVFIVYTNALATIILFPCSFLTHQEDRKERPSFTFSLFMRFLFLGFIGITMTQAFLFLGLSYSSPILVCAMGHLIPTFNFLLSVIFRKTEMNLRSPGMQVQLIGILVSIMGAVVAEFFKGPLVRPSSHDHLKHANKQYLVFSSTPEFWVLGGALLAASFFSLSIFNLFQKETVERYPEPMKVLSYSNLLGTILSAIVSWIVEREINVWKIKRNKDLILIVLTALVGGVIRPNIHVWFTRIKGPLYVPLFKPFGIAFATTFALCFFSNSLHYGSVIGTTTLGMGYYTVMYGQIKGNEEETSCDDCSSDSLDKKIPLLQEKMEEV

SEQ ID NO: 149064 - protein, 219 aa, Glycine max
  Coding DNA Sequence Number=SeqID_57379
  Gene Ontology: Mol. function=electron carrier activity; Biological process=electron transport
  Homolog annotation: Hit_ID=A8MQY2; Match level="QueryCoverage=92%, HitCoverage=89%, E-value=1e-79, Identity=73%"; Hit description =Uncharacterized protein At1g21350.2
  Pfam annotation: Domain name=AhpC-TSA; Domain location=64-167; Score=- 4.5; E_value=0.0029; Accession=PF00578.12; Description=AhpCTSA family
  Subcellular localization annotation: CTP_CleavageSite=53; ConfidenceScore=5.47e-01
MALRLRLKVSSIGSPFLQLGSSASAACSVSKLGFHPPRLQLNKNSHPIRLFVRAARIESKGVTLGFRTPQFQLPEPLTGTTWTLDDFEAYPALLKGLAVIAISSNSVATHPQDGPEFMAEDAKLFGYPFPYLYDESQDVAQHFGAVCTPEFYLFKKDGRRPFELVYHGQFDDSRPSNNVPVTGRDLSLAIDRVLSGQPVPSEQKPSVGCSIKWHPGKKF

SEQ ID NO: 149065 - protein, 158 aa, Glycine max
  Coding DNA Sequence Number=SeqID_57380
MVNSSHFLFIQEHVIEFWQEVMDALGPNIKIAVVEGGIRVEDVRVEEVKVKDVKESKPMATVFCHFGSWVTSMHVVVCGVEVVSGGCSGGVSCGGVVGWLGGGGAWWSCRFGGEVTRVCWREEGISSHSLQSGGTTKRNCPSQKDADSFGLEKIKKEG

SEQ ID NO: 149066 - protein, 290 aa, Glycine max
  Coding DNA Sequence Number=SeqID_57381
  Gene Ontology: Mol. function=transferase activity, transferring glycosyl groups; Cellular component=integral to membrane; Biological process=protein amino acid glycosylation
  Homolog annotation: Hit_ID=A7QNC0; Match level="QueryCoverage=100%, HitCoverage=76%, E-value=1e-108, Identity=68%"; Hit description =Chromosome chr2 scaffold_132, whole genome shotgun sequence
  Pfam annotation: Domain name=Galactosyl_T; Domain location=129-275; Score=-20.0; E_value=2.1e-05; Accession=PF01762.12; Description =Galactosyltransferase
MQSRGSSHRVSSMGNNRSRIPALLISMFAAFASIYVAGRLWLDAENRVYLIKELDRITGQGQSAISVDDTLKIIACREQHKKLDALETELAGARQEGFVSNPLIETNGTYSTRRPLVVIGILTKFGRQKNRDAIRKAWMGSGASLKKIEEGKGIIVRFVIGRSENRGDSQDKDIDHENRLTNDFLILDNHVETNDAFPKKVKLFFAHAADKWDAEFYAKVNDDVYVNIDALGATLATHLDKPRVYMGCMKSGEVFSELEYFMILILVSVKYDRNHKWYEPEWWKFGDKKS

SEQ ID NO: 149067 - protein, 175 aa, Glycine max
  Coding DNA Sequence Number=SeqID_57382
  Pfam annotation: Domain name=MAP7; Domain location=5-167; Score= -84.2; E_value=0.097; Accession=PF05672.2; Description=MAP7 (E-MAP -115) family
MSHHSSSVNGEGTSHKDPLSRILDELSSLKLWKEKQERKEKGKKRVEEISQDERKKIREEERRKIMKEMKREKHASYSSHNSCKSLSEELSDYYEGRHRSHLKPHSHRREKERKPQEANINLSYFHGKDNVEANLDWEIRVEQQLKKKSTSKSYGSHSYPKKDQGQGILGVTPSK

SEQ ID NO: 149068 - protein, 60 aa, Glycine max
  Coding DNA Sequence Number=SeqID_57383
MLLKYAIKIPRLPCYGVEPSSCFYEKFIEPTSSLTKMSWTMLKSKLIQPHVCIKIRILQL

SEQ ID NO: 149069 - protein, 147 aa, Glycine max
  Coding DNA Sequence Number=SeqID_57384
MGQLQRQAFRKAYVKIWDLAMVEVSTEAIASLTQYYDQPLRCFIFGDFQLSPMVEEFEEILGCPLGGRRPYLFSRFYPSLARISKIVQISAQELDHRKQGSMLFSPIMTTRKARVVAMLADLYDTFGRRCEKSNTRTVAVLQLFMYG

SEQ ID NO: 149070 - protein, 199 aa, Glycine max
  Coding DNA Sequence Number=SeqID_57385
  Gene Ontology: Mol. function=oxidoreductase activity, acting on NADH or NADPH, quinone or similar compound as acceptor; Cellular component=integral to membrane; Biological process=ATP synthesis coupled electron transport
  Homolog annotation: Hit_ID=Q6EM64; Match level="QueryCoverage=68%, HitCoverage=34%, E-value=6e-71, Identity=96%"; Hit description=NADH dehydrogenase subunit B
  Pfam annotation: Domain name=Oxidored_q1; Domain location=23-197; Score=-38.1; E_value=2.7e-05; Accession=PF00361.11; Description=NADH- Ubiquinoneplastoquinone (complex I)
MAITEFLLFILTATLGGMFLCGANDLITIFVALECFSLCSYLLSGYTKKDVRSNEATTKYLLMGGASSSILVHGFSWLYGSSGGEIELQEIVNGLINTQMYNSPGILIALLFITVGIGFKLSPAPSHQWTPDVYEGVRVRNNESLYDKQIHFASSLLRVVPTKDRTNDEQVIEIEKNRSFRTTDEGFLEKLRISNPFEN

SEQ ID NO: 149071 - protein, 157 aa, Glycine max
  Coding DNA Sequence Number=SeqID_57386
MTRRDKIWSFCTLVSSRGGGPDDTQRYLTVICTLVSSRGGGPDDTGRYLAVIRTLVSSRGGGPDDTRRYLTVIRTLLSSRGSGPDDTQRQNLAANLMTRKDKIWSFCTLVSSRGDGPDDTRRYLTVIRTLLSSRGGGPDDTQRQIGHSAPFVPLGST

SEQ ID NO: 149072 - protein, 367 aa, Glycine max
  Coding DNA Sequence Number=SeqID_57387
  Gene Ontology: Mol. function=motor activity; Cellular component=cell projection
  Homolog annotation: Hit_ID=UPI00016621D1; Match level="QueryCoverage =75%, HitCoverage=41%, E-value=6e-17, Identity=30%"; Hit description =UPI00016621D1 related cluster
DPLAYRGLHALAFRGLHALAFRGLQALAFRGLHVLAIRGLHALTFRGLHALSIGGLHILYFRGLHALTFRGLHAFSFRGLHVLAFKGISVLSFKGLHALAFRGLHRTTHPRLQRLHALPLKGRNVLSFRGLHALAFEGLHVLAFRGLQTLPFRGLHVLAFRGLHALPFRGLHVLAFRGLHALAFRGLHVLAFSGLHVLAFSGLHVLTFKGLHVLTFRGLHVLTFKGRNVLAFRGLHICALREFKEEAIMQLLCIPGQDFTRASTKRRVRIMRTNMTTLTHIWMTLLLSNILPSDHNADQLVCAAWHRDRAHKTPSGPRGVQEGPGVSSSGYGPLSVLPGARPPSKGSHPQDTQWTRRSPTGPWGFQL

SEQ ID NO: 149073 - protein, 228 aa, Glycine max
  Coding DNA Sequence Number=SeqID_57388
ENFEAPEEDEEVRALKLELGKARLAKEKFKSAATHIRKECTDLQEENAATARALEQETKRARKEEYGREKFQGALWGSNNELKLRREEIDWSRVHGMILKEELAACARSKRSLAQHLEATEQSMLAIIGQYKEDLSQSVTHEQKLAEDFAQVYVEKEARGRVIDALHQEVTMWMDRFALTLNGSQDLPRLLAKAKAMAEVCTAPEEIHGLINYCQHMIDLMAHIIRNR

SEQ ID NO: 149074 - protein, 74 aa, Glycine max
  Coding DNA Sequence Number=SeqID_57389
MTKARQKRGMESNPCGVYPDLSSFTGSGVYPDLSSFTGSGVYPDLSSFTGSGVYPDLSSFTGSGVIQIFVACIK

SEQ ID NO: 149075 - protein, 303 aa, Glycine max
  Coding DNA Sequence Number=SeqID_57390
  Homolog annotation: Hit_ID=Q84VH5; Match level="QueryCoverage=76%, HitCoverage=37%, E-value=1e-95, Identity=72%"; Hit description =Envelope-like protein
MTVKTSDTCSSRRRSQLVCKRMPGADKPVRARQRMRKEKIPHQAPFAIQAAQLLGRAIGAGLFAITPAGERGMCCKAIKLGNARVFPVTTLEFMVNMPSDITNRKSDEYQKVFVRGKCVRFSPAVINKYLGRPTDGVIDIAVSEHQIAKEITAKQVQHWPKKGKLSAGKLSVKYAILHRIGAANWVPTNHTSTVATESLAVKLPMAFPTVLCGIMLSQHPNRLNHMDSVMKREFPLSLHYKLFEGTHVPDIVSTSGKAAASGAVSKDALIAELKDTCKVLEATIKATTEKKMELDALIKRLSE

SEQ ID NO: 149076 - protein, 151 aa, Glycine max
  Coding DNA Sequence Number=SeqID_57391
MTLLLSNILPSDRNANLPLQKYQLVCDVPTWGSHPQRHPVDLKKSNRVLGFPALVTGLYQSYRVPVPPLARSCHPDIGIAPARHPVDPKKSNRVLRRPALITGLCHFYGVPVDPSKFIRPLLIGLSSRSTAPPGRRRARHHSSIGMAGSGQ

SEQ ID NO: 149077 - protein, 402 aa, Glycine max
  Coding DNA Sequence Number=SeqID_57392
  Homolog annotation: Hit_ID=Q2HW90; Match level="QueryCoverage=76%, HitCoverage=66%, E-value=4e-32, Identity=31%"; Hit description =Putative uncharacterized protein
MQAFRKTYGKILELTIAEVSIEAIASLTQYYDQPLRCFTFGDFQLVPTIEEFEEILGCPLGGRKPYLSSGCLPSLSRIATVVKDSARGLDRIKQTRNGIAGLPQKYLEDKARGLAAIDAFLAYHHSKESPVVAVLADLFDTFDRRCEKSSARIICCLPALCVWLVSHLFQQDTRHPCPLLSHRSCAEKRRMDWDQLLAGIGGRTISWFPRWKKGKEGVLFSCGRYPNIPLVGTRGCINYNPTLAIRQLGYPMRGAPTEESMSPFLVRDLGAQNSKTIQRIHKAWETPLRKGQELRGIRNGIIGGYHEWLKVHIRGLDWLAKLKVVSEENFEAPEEDEEVQALKSELGKAKLAKEKFKLAATHVRKECAGLREENAITARALDERPRGLARKSMAGTISRSSM

SEQ ID NO: 149078 - protein, 159 aa, Glycine max
  Coding DNA Sequence Number=SeqID_57393
MAGLRDSKVRESEITPRATRKAVIRAGKSSREELEYDNTLQVWASVVRSFLRSFQGTPSAFKTNSRLGIHSLEEGIQRGCIELDQLPLHSDLLGGFVFWVIKICIKLLDQGYIYVPIHMPGVNILGIPLLGSLRDESGGVIRLLGPGYTGLPLPGGHLH

SEQ ID NO: 149079 - protein, 152 aa, Glycine max
  Coding DNA Sequence Number=SeqID_57394
  Homolog annotation: Hit_ID=A0PAV3; Match level="QueryCoverage=25%, HitCoverage=17%, E-value=5e-07, Identity=76%"; Hit description =Restriction endonuclease
MVKVGTSYVPINVSFSPKVGPGLPGINRDTRIYLFCEVIFRHSCPSCSATDGVGFPSHDVVKRRPVNCNTTHYRANWSSTAVAAALELVDPPGCRNSIGLASNSAMNNAGPSGRFNFDGNALNNTYGVSSSLSIPSTSRGGPVPAFVPFSEG

SEQ ID NO: 149080 - protein, 73 aa, Glycine max
  Coding DNA Sequence Number=SeqID_57395
MVSGLLIWWLVVHRCTSRISPIIGIRADGSELVIPQVARIASSTACPAGGAGWPEWLAGRASTAGGHGYTRGS

SEQ ID NO: 149081 - protein, 118 aa, Glycine max
  Coding DNA Sequence Number=SeqID_57396
MDWFFHISHPFMTPGHTSDPLPHGHAPQSRVIPQAPQTDISHVLKPGASSTSVEEPKHAVEIYDDIVERLERHLSQGAVTPDSSTHEVIEERLRLAKSVTQDHLVYVRSRRRRRTNQA

SEQ ID NO: 149082 - protein, 259 aa, Glycine max
  Coding DNA Sequence Number=SeqID_57397
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=20%, HitCoverage=50%, E-value=1e-23, Identity=100%"; Hit description=LacZ protein
MVKVGTSYVPINVSFRQKLAQGFPVLQWLLFLSAVPPVQLLTGWCVTAKAPPDISAGKCSGHAARRVPFAIQAAQLLGRAIGAGLFAITPAGERGMCCKAIKLGNARVFPEFDKGEHYPISPAHRLSLPYEIPDESNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 149083 - protein, 214 aa, Glycine max
  Coding DNA Sequence Number=SeqID_57398
VDPWVLVPIFIRGLHVLAIRGLHVLAFRGLHALTFRGLHVLAFRGLHVLTFKGPHVLAFRGLHVFNFRGLHVLAVKGTARPRHHRTTLPHLQKAARPELQRVAHPCLYEGYAEAITHLLCILGQDFTHAAAKRRVWIMRTNMTTFTWIWMTLLFSNILPGDHNANLPLQMYRASGPLLIELSSRSTAPPGRHMAKHHSSLGMANSGQQTHRHHL

SEQ ID NO: 149084 - protein, 206 aa, Glycine max
  Coding DNA Sequence Number=SeqID_57399
MAFIIGESFGGSHTREGLLATLPQVHLISAGWLSFQEEGPNVKTNPLASHGKASVNAIQEGGPSRARRLGEVATSRHFIYQSLQAACMVSRGGGERDECLFHLGESHDMETCLMVEELLQRLMDCGQLEVSIGGREEPQICMQLEEKKVPLTPKALVICFTRKGTGSTPIYPRTAPKPTPFAYQSNKVVPWKYTPPAFSERVCNRS

SEQ ID NO: 149085 - protein, 82 aa, Glycine max
  Coding DNA Sequence Number=SeqID_57400
MISWFLKGENDAILPRKGPVTRTMSKRLQEDWTRAAEEGPRVLMNLRISELFSEHKISCSSLPLPSFISFFLQALIHNLLWW

SEQ ID NO: 149086 - protein, 276 aa, Glycine max
  Coding DNA Sequence Number=SeqID_57401
  Gene Ontology: Biological process=transposition, DNA-mediated
  Homolog annotation: Hit_ID=Q6UUU1; Match level="QueryCoverage=21%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPVTTLANWSSTAVAAALELVDPPGCRNSMQEYHYDVLKTYHIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 149087 - protein, 99 aa, Glycine max
  Coding DNA Sequence Number=SeqID_57402
  Gene Ontology: Mol. function=nucleic acid binding; Biological process= DNA integration
  Homolog annotation: Hit_ID=A5C737; Match level="QueryCoverage=56%, HitCoverage=12%, E-value=3e-12, Identity=64%"; Hit description =Putative uncharacterized protein
  Pfam annotation: Domain name=zf-CCHC; Domain location=68-82; Score =14.9; E_value=0.0086; Accession=PF00098.14; Description=Zinc knuckle
MVKCLVKLQTKFREDPTVNEGWAAFLPRQLHGITTSTSQNKKRKKTKGAAEGTSQQKKQNKDEEFTYYFCKKSGHMKKECPKYAAWRVKKGLPVEPTTK

SEQ ID NO: 149088 - protein, 361 aa, Glycine max
  Coding DNA Sequence Number=SeqID_57403
  Homolog annotation: Hit_ID=Q84VH5; Match level="QueryCoverage=100%, HitCoverage=55%, E-value=1e-139, Identity=71%"; Hit description =Envelope-like protein
  Subcellular localization annotation: CTP_CleavageSite=21; ConfidenceScore=5.15e-01
MATSPKETSAPGSPSVPSSPSSTKAPSNQEQPEFHIQPIQMIPGQAPVPEKLVPKRQQRVKISENPSPATSPREVDPEMDKKIRSIVSSILKNASVPDADEDVPTSSTPDVSVPDAEKDRNQQRKRIKPQRRPLAPRAPEPAPGDLIDLEEVESDEEPIANKLAPGIAERLQSRKGKTPIKRSGRIKTMAQKKSTPITPTTSRRSKVAIPSKKRKEISSSDSDDDVEPDVPDIKRTKTSGKKVPGNVPDAPLDNISFHSIGNVERWKFVYQRRLALERELGRDALDCKEIMDLIKAAGLLKTVTKLGDCYESLVREFIVNIPSDITNRKSDEYQKVFVRGKCVRFSPAVINKYLGRPTDGV

SEQ ID NO: 149089 - protein, 161 aa, Glycine max
  Coding DNA Sequence Number=SeqID_57404
MTPTRHPLDPDKSNRALGFPALITGLCQSFGVPVAPTKVIRPPITRAFIEKYCTQRQAQGDAPQAAGAPPPPHQAGQAGAFDMEQYLRHLVRQQAANHRAHGFAPFSCPTPDQFRAEVAWPGDWPEAQAGEAPPESPGDGEEAHEDEEMADLLDFLGGSGD

SEQ ID NO: 149090 - protein, 157 aa, Glycine max
  Coding DNA Sequence Number=SeqID_57405
QQKVYTDNHSGISARQRDSKVSMTDLVSAEDDGAEDDVSLCVLSGFSSYRQQKVYTDNHSGISARQRDSKVSMTDLVSAEDDAFRLTDSKKFIRITTRVFPRQRDSKVSMTDLVSAEDDAFHLTDKQKVYTDNHSGISARQRDSKVSMTDLVSTEDD

SEQ ID NO: 149091 - protein, 182 aa, Glycine max
  Coding DNA Sequence Number=SeqID_57406
  Homolog annotation: Hit_ID=Q2HW90; Match level="QueryCoverage=92%, HitCoverage=34%, E-value=7e-19, Identity=36%"; Hit description =Putative uncharacterized protein
MGPLQRQAFRKVYGKILDLTAAKVFTEAVVSLAQYYDQPLRCFTFGDFQMVPTIEEFEEILGCPLGGRKPYLFSGFLPSLSKIAVVVGDSAKELDRMKQTRNGVVGLPQKYLEGKARDMASQEKWGPFADILALLIFGVVLFLNVDGLVDLAAIDAFLAYHHSKESPVVAILADLFNTFDRS

SEQ ID NO: 149092 - protein, 265 aa, Glycine max
  Coding DNA Sequence Number=SeqID_57407
KGEWALFIDIFALLIFGGVLFPNVDGLVDLAAIDAFLAYDDHKESPVVAMLADLYDTFDRPKMHACLLESHRSCTEKGRANWDQLLANREGASVNWGCINYNLVLAIRQLGYPMRGAPLEEELAPVISRGFSETNVETLRKVRKAWEVVQKKDKELRGSNNRPIGGYREWLKAYVQGLEMLPSLRTAKREEVEAPEEDEEVQALRTELEQAQTIKERFKLAALKTRKENTELRDVNVATTKALERETKRACREEHGRNKFRGALW

SEQ ID NO: 149093 - protein, 188 aa, Glycine max
  Coding DNA Sequence Number=SeqID_57408
MEAMKEQMATMMEAMMSMKKIMEANVVAIAATSAVAKVNPMPPSGLNQMYHPTSYMVGKDLGSIGGPHYAQIQNKHAFPPYGLPPNYTPPNTAYTPSENVNNSTPILIESRQPQTDHAHVSQTVGETHEIPYHNLADFEPCLSYATKGQVVGGKAQGHEGGKDYAFIDVEELFLVPKHGHSQVQCVGL

SEQ ID NO: 149094 - protein, 246 aa, Glycine max
  Coding DNA Sequence Number=SeqID_57409
  Homolog annotation: Hit_ID=Q652R5; Match level="QueryCoverage=36%, HitCoverage=36%, E-value=9e-17, Identity=53%"; Hit description =Putative uncharacterized protein P0603C10.50
  Subcellular localization annotation: CTP_CleavageSite=66; ConfidenceScore=5.01e-01
MAHLELSIPWRGSTEQPHRPTYLKFENRHSSPSFGSRQVCSHSNPSQKIRVGRRCNPQGDPTNQLPCALRVYSPVDSHTCQTPWSVFQDGPNGEPTGRRQERAGAEARQGRALPSTIAMMTSPRAYQQPGLGPPSQSASVNVPSRSADRLSPFHIRPGHIAGPHPLPSRQFQALFDSLFKVLFIFPSRYLFAIGLSPVFSLGRNLPPDWGCIPKQPDSPTAPRGATGSGHDGALTLSGAPFQGTWA

SEQ ID NO: 149095 - protein, 15 aa, Glycine max
  Coding DNA Sequence Number=SeqID_57410
AGQSLSPAIFSANSL

SEQ ID NO: 149096 - protein, 109 aa, Glycine max
  Coding DNA Sequence Number=SeqID_57411
MKSWMQNSKHNVYLGAYLNGAHWQMVVILPKENLVVWFCSLHNKPDNYLKGIINSALKGLNDTPQPKSKAGARSIVVKYFNDVRPLEAERLKALRIQWAQYYLKVRNKT

SEQ ID NO: 149097 - protein, 157 aa, Glycine max
  Coding DNA Sequence Number=SeqID_57412
YPMRGAPSEEIILPFIARGFNEANVKILQRIHRAWNTMERKDKELSGSLSGKEAKVPEESEEVKALKAELEKMRVVKEKLKMVVTRVRKDKNKFRGALWGNNNKLKLRRAKRDELRMESMVLEDKLKACQRAKRSLMEQLSRTKENMLTIIDQYKEK

SEQ ID NO: 149098 - protein, 95 aa, Glycine max
  Coding DNA Sequence Number=SeqID_57413
MSSGCLLVDPNGHNSFSALCPVLLGYDNFVLFECCITWMLGKLGRIDGDPVLRGTRIWATWEYVRSVGGGQQGMVGLCTLCGCGKLVVHHRPTAT

SEQ ID NO: 149099 - protein, 65 aa, Glycine max
  Coding DNA Sequence Number=SeqID_57414
  Homolog annotation: Hit_ID=Q53KJ4; Match level="QueryCoverage=75%, HitCoverage=7%, E-value=5e-07, Identity=57%"; Hit description =Transposable element protein, putative
MAEEHDQRITLEDYSRNLFQGLPNEDPYAHLATFIEICNTVKIAGVPDKAIRLSLFSFLLAGEAK

SEQ ID NO: 149100 - protein, 362 aa, Glycine max
  Coding DNA Sequence Number=SeqID_57415
  Gene Ontology: Mol. function=motor activity; Cellular component=cell projection
  Homolog annotation: Hit_ID=UPI00016621D1; Match level="QueryCoverage =61%, HitCoverage=40%, E-value=8e-17, Identity=31%"; Hit description =UPI00016621D1 related cluster
  Subcellular localization annotation: CTP_CleavageSite=87; ConfidenceScore=5.28e-01
RDTRPRLERTTRPHLQRAARPRLQRTTRPHLQRTTCPWLQRTTCPCLQRTTRPRLQRTTRPRLQRTTRPPHQRTTRPRLQRTTHPCLQRAARPHLQRTTRPRLQRTPCPHLHRATRTRRQRTARPRLQRAAHPRYRGQHILAIRGLHALSFRGIHVVAFRGLHVLVFRGLLALAFRGLHVLTIRALYALTFRGLHVLTVRGLYALTFRGLHVLAIRGLHALTFRGLYILAIRGLGLHALTFRGLHVLTFRGLHALTFRGLHVLAIRWLHALAFRVLHVLTFNGLHVLTFRGLHALTLRGLHVLTFKGQYTLAFKGRHILNFKGLHALMFRGLHALTFRGLHALPFRGLHVLAIRGLHALTFR

SEQ ID NO: 149101 - protein, 105 aa, Glycine max
  Coding DNA Sequence Number=SeqID_57416
MKKELLRNLVVRTACTQFLESFPVLIQVFSTKLPDAEMSFLMTVVLDARKNFSENTLLRSSQLKMDLGTRLNSRQYFKITSHNIKMITSILGREFLIELAKGLAK

SEQ ID NO: 149102 - protein, 117 aa, Glycine max
  Coding DNA Sequence Number=SeqID_57417
  Gene Ontology: Mol. function=protein binding
  Homolog annotation: Hit_ID=Q1SWI7; Match level="QueryCoverage=61%, HitCoverage=11%, E-value=9e-22, Identity=67%"; Hit description =Leucine-rich repeat
MANLSFLSMLDLSYNHLKGNIPTGTQLQTFDASSFIGNNLCGPPLPINCSSNGKTHSYEGSDGHGVNWFFVNHGGMPIFISLIMCGSNFNLFAQGRVAERKEGKDRRCGEMELRMTK

SEQ ID NO: 149103 - protein, 116 aa, Glycine max
  Coding DNA Sequence Number=SeqID_57418
TLTFRGLHVLAFKGIHALTFRGLDVLALSGLHVLAFEGLHALVFKGLYVLPLRGLHVLSFGGLHTLAFRGLQAPLFRRLHALAFRGRHVLAFGGLRSPSSFDGYVSSLSVGSISTP

SEQ ID NO: 149104 - protein, 79 aa, Glycine max
  Coding DNA Sequence Number=SeqID_57419
MAAEWRRKRERRCLFKENMSLEEAHDHRRPWIRAPRKKEMNEGRGREEHEILCYKRALKSEPTNPRSIPRFSTKCAQVS

SEQ ID NO: 149105 - protein, 112 aa, Glycine max
  Coding DNA Sequence Number=SeqID_57420
MAKIQGHKRRKIFSTIYKEEWTQPWPMGSKIYPKVHENPKAFFINSSPILLEPLAHGSGNWSFPREDCITMDKSLKVGEDEWTEKGRRSTKFCASKEPTNPRSSPRFSTKCA

SEQ ID NO: 149106 - protein, 298 aa, Glycine max
  Coding DNA Sequence Number=SeqID_57421
MAPKKLSTKRSRRDAAAEGSSATPEFDSHRFRSAEHQHASRPSKDGRSTKRRVQLREDEYIDFQEEIAHRHWTSLVTPMAKFDPKIVLEFYANAWPIEEGVRDMRSWVRGQWIPFDANALSQFLGGPLVLEEGQQCEFNQRRNRVWIMRTSMTTLTQTWMILLLSNVLPSDNNSDLPLPKCQLVYAILTRMSVHVAQVIADAIYLFAGMPPTRHPLDPDKSNRALGFPGLITGLCQSFGVPVTPSKVIRPPITRAFIEKYCTPRQAQGDAHQAADALPPPHQTDPVGSLGMERYLQHL

SEQ ID NO: 149107 - protein, 280 aa, Glycine max
  Coding DNA Sequence Number=SeqID_57422
  Gene Ontology: Biological process=transposition, DNA-mediated
  Homolog annotation: Hit_ID=Q6UUU1; Match level="QueryCoverage=21%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPVTTLANWSSTAVAAALELVDPPGCRNSINLSVKGVGISTAVFGVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 149108 - protein, 67 aa, Glycine max
  Coding DNA Sequence Number=SeqID_57423
MEVQIAIRPTWAFQSLPLEGCCFWRKQPCSPGEKGFSLLGTSYSLEIAEENYFREENPSRGASVTFP

SEQ ID NO: 149109 - protein, 196 aa, Glycine max
  Coding DNA Sequence Number=SeqID_57424
MPSPSRGLHVLALRGLHALTLGTSYRHREGTTRPRLQRTTCPRLERATRPHLGGLHVLTIRGLHALTSRGLHVLAFRGLHILTFRGLHALAIFRGLACPHLQRTACPSPFRGLHALAFRGLHVLAFRGLHILTFRGLHALASRGLHALTFRGLHVLTLQRATRPRPSEDCIGLLLAVKGLHSSFLLTVPGPPPDIG

SEQ ID NO: 149110 - protein, 15 aa, Glycine max
  Coding DNA Sequence Number=SeqID_57425
FLHDAYDEVELWLDL

SEQ ID NO: 149111 - protein, 167 aa, Glycine max
  Coding DNA Sequence Number=SeqID_57426
MSHFQEFFKGRRQATITRGGHQWSWVVEEKISLSELVSLSKTSLLVLSVTSSAERVTSSDSQTFDVTEDQPHPYWSIHTVKPTSSTQPNEPEFTAKPSSPNKELSPYSEDEDKVLHNQPQEDHEEEAESVSPITIVPLYYMLPHMHNFEESNFEDSEYGHTFDHKEV

SEQ ID NO: 149112 - protein, 129 aa, Glycine max
  Coding DNA Sequence Number=SeqID_57427
MAEVSIEAIASLAQYYDQPLRCFTFGDFQLSPMVEEFEEILGCLLGGRKPYLFSGFYPSSARISKIVQILTQELDHRKQVENGVVGVPRKCLEAKARILAAAIDAFLAFHDRKESLVVAILADLYDTFD

SEQ ID NO: 149113 - protein, 377 aa, Glycine max
  Coding DNA Sequence Number=SeqID_57428
  Homolog annotation: Hit_ID=Q84VH5; Match level="QueryCoverage=100%, HitCoverage=59%, E-value=1e-141, Identity=67%"; Hit description =Envelope-like protein
EQPEFNIQPIQIIPGQASAPEKLAPRRQQGVKISENPSLATSPREVDPDMDKKIRSIVSSILKDASVPDAEKDVPTSSTPSVSVPDVEKDVPTSSTPNAEVLPSPSEEESTDEEDQSTEETPAPRAPEPAPGDLIDLEEVESDVEPIANKLAPGIAERLQSRKGKTPLKRGKKISSSDSDDDVELDVSTSKRAKKSGKKVPENVLMHHWTTFSFHSIGNAERWKFVYQRRLALERELGRAALDCKEIMDLIKAAGLLKTVTKLGDCYESLVREFIVNIPSDITNRKSDEYQKVFVRGKCVRFSPAVINKYLGRPTDGVVDIAVSEHQIAKEITAKRVQHWPKKGKLSAGKLSVKYAILHRIGAANWVPTNYTSTVAT

SEQ ID NO: 149114 - protein, 27 aa, Glycine max
  Coding DNA Sequence Number=SeqID_57429
MAFNITFLHLEPLNIKLIDTVDLEGGP

SEQ ID NO: 149115 - protein, 185 aa, Glycine max
  Coding DNA Sequence Number=SeqID_57430
  Pfam annotation: Domain name=Transposase_23; Domain location=56-126; Score=1.4; E_value=0.00083; Accession=PF03017.5; Description =TNP1ENSPM transposase
  Subcellular localization annotation: CTP_CleavageSite=39; ConfidenceScore=5.38e-01
MTRQLMASFNQMQSQIQTQMQSQGLALPPRPLVGPFGLRVSTKGSCVDPLGNDLKTGDSDRCGLYIEVDLARLVSLGRVYEGSTIVHNTPLLPGQVKVSVEEVTDADAPVPIPTDEVSLVGQTLHTFLAWPTHLVKSLSQQVKWDATVFGVFNPDFPLYIKHEDLSEIAHGGQCLSISVLQLWIL

SEQ ID NO: 149116 - protein, 175 aa, Glycine max
  Coding DNA Sequence Number=SeqID_57431
MLRTGDSDSCGLYIEADLARLVAMERVYEGSIVVHNTPLLPGQVKVSVEEVTDADAPVPVPTDEVTVSLAKPPSKPDPEVRWDVTVFGVFNPNFPLYIKHEDLSEIAHGGQCLSISVLQLWILHLTETCMRVRNSDIYGFLEPQSIQRSGQSQFESESSTTADTGRWWSSCPRNT

SEQ ID NO: 149117 - protein, 253 aa, Glycine max
  Coding DNA Sequence Number=SeqID_57432
MSASDHVILRDRTHHPMKKILIELSSHDALFAQNKLLSKKLEILTETLSKLPTKLSVGQPMHSSILQANVFPLKKTLKKFIIWEINSDKGILKEDFQAFSRVPIINKDSRGHTLIADKSSNTFVANTEQNPKEECKVVMTRSKRFVEAKDEDSVVHKKKTVDKKGTDGTKNKVKGESNQEKEEQIMVKNKELKDQEKEIEVEKEIENEKNEKEEKNNKNAKKSRSEKAVDEGVEVPYPMVPSKKEKDRHLARF

SEQ ID NO: 149118 - protein, 52 aa, Glycine max
  Coding DNA Sequence Number=SeqID_57433
MASGISMMEAMMSVKKIMEANAVAIAATSVVAKVNLMSPSGINQMNHPTSDM

SEQ ID NO: 149119 - protein, 257 aa, Glycine max
  Coding DNA Sequence Number=SeqID_57434
  Gene Ontology: Biological process=transposition, DNA-mediated
  Homolog annotation: Hit_ID=Q6UUU1; Match level="QueryCoverage=23%, HitCoverage=40%, E-value=3e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPVTTLFEITVDNFDIDKIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTGK

SEQ ID NO: 149120 - protein, 188 aa, Glycine max
  Coding DNA Sequence Number=SeqID_57435
  Homolog annotation: Hit_ID=Q9LCV5; Match level="QueryCoverage=84%, HitCoverage=17%, E-value=5e-10, Identity=33%"; Hit description=Atp operon
MVLHALQQRLRQADLQRQPLQIDQVLRRRFGVARALGELQLAIFTQLHVVQRFQCRGRGAHHHRDILFPGAEHRQIAGVVAPAFLLFIRAVVLFVDDDHAQLTERREQRRTGADDDGGFAAARAQPNRQPFAVVQPGVQHVYRRVEALAKAGDGLRRQADFRHQHQRLSAFGQHVFQHAEVDFGLAGA

SEQ ID NO: 149121 - protein, 95 aa, Glycine max
  Coding DNA Sequence Number=SeqID_57436
MLVHMIRTRLFAAARLVALQYQGVAQELIKGNYWPLNRERKSRLSIVASYPSAGGRRVTHGMRVPRKEYARSRHQRLFEENVGKTGKDAIYELFK

SEQ ID NO: 149122 - protein, 88 aa, Glycine max
  Coding DNA Sequence Number=SeqID_57437
QKKVYTDNHSGISARQRDSNVSMTDLVSTEDDTIKKNVYTDNHSGISACQRDSMSAAEDDVSLCVLSGFSSYRQQKNVLYGITTQYFR

SEQ ID NO: 149123 - protein, 208 aa, Glycine max
  Coding DNA Sequence Number=SeqID_57438
  Homolog annotation: Hit_ID=Q6WAY4; Match level="QueryCoverage=88%, HitCoverage=33%, E-value=2e-20, Identity=35%"; Hit description =Putative uncharacterized protein
MGKNQNGKRFYQVKVKGLDVTSLKELGRLMRPLKRQAFCKVYGKILDLTAVEVFTEAVVSLAQYYDQPLRCFTFGDFQMVPTVEEFKEILGCPLGGRKPYLFFGFLPSLSKIAVVVGDSEKELDRMKQTRNGILPRKYLEGKARDMASQEKWVPFADMLALLIFGVVLFPNVDGLVDLAAIDAFLAYHHSKESPVVAILADLFDTFDR

SEQ ID NO: 149124 - protein, 253 aa, Glycine max
  Coding DNA Sequence Number=SeqID_57439
  Subcellular localization annotation: CTP_CleavageSite=46; ConfidenceScore=5.31e-01
MAKIQGPKEGKPILIFTKKNGPNLGPWAQKSTLRFMRTLGPSSATLAQSSWSPLLVDLVTDPFLGRIASVPIYFFAKFFTVAICQGLKMNNDSFGSSLIPESGNVEGDELSFESAFSTDGQILSPHPSRLHWTTLKALMCTRSWLLSANIDGSLKSTILEQINTLVNEITTDDEGFYKHVRDRIGQGREKPIPSGAGMGVNLSPYQVLGVGETGELGQGKQKPALTCPVAMPNKFLGYYLIYFLLRSYDLFRV

SEQ ID NO: 149125 - protein, 95 aa, Glycine max
  Coding DNA Sequence Number=SeqID_57440
MVIPQGEACLAQGRRVPRLPGRDNSQALSTSRMAPTRHPLDPEKSNRALGFPALIRGLCQSYRVPVTPSKVIRPPITRAFIEKYCTPRQAQGDAH

SEQ ID NO: 149126 - protein, 170 aa, Glycine max
  Coding DNA Sequence Number=SeqID_57441
MRSPSIMLPRPRSVLRSNGSTNATLASMGCQEDYYDAHRGSELQNVNLVCEDLRPALIVGQDENGRTVKALVFRHQAICRKQRYSPARDCRQLHIRTLRSFGCRNGSAKFEANHMNFEEVLRDSFGKNNANGHALMHSGRSYRRLCDWLTYESGCCVHVRKCHKCNTSQE

SEQ ID NO: 149127 - protein, 191 aa, Glycine max
  Coding DNA Sequence Number=SeqID_57442
PAWRGRRVPARSVRSARAGRRRRCAARPCGCSGSIPGRAHRVPQAEYRRGQAVGARAPIVFQEAAGHQGLGQATDRCRGQAGAFGQFAVAEQVGAGLERAQDFQPALERPVLADAIKARAPVGGRSGGLSCGHSIPLYGNRGVPAPQCSAYRVVMPEESCPAGQDRSNSNGARRWRTTNSSHCNDMKGWRR

SEQ ID NO: 149128 - protein, 83 aa, Glycine max
  Coding DNA Sequence Number=SeqID_57443
MMCWWAPLLKITHAPNIFMICVHRDSLGSDQGMDPKRIKVILEWPTPSFVEERIPEFHETVDLRSNPFQGGGNDAILPPKGIR

SEQ ID NO: 149129 - protein, 222 aa, Glycine max
  Coding DNA Sequence Number=SeqID_57444
  Gene Ontology: Mol. function=RNA-directed DNA polymerase activity; Biological process=RNA-dependent DNA replication
  Homolog annotation: Hit_ID=Q2HRM6; Match level="QueryCoverage=52%, HitCoverage=36%, E-value=3e-09, Identity=30%"; Hit description=RNA -directed DNA polymerase
MARAGDNGGVYHQLDESQRLFLDVWTTQMQRLLNRNKEEPYRRIAKSSSFTLKPLSPRKVCDDQIRMREKREQEKENSEAPQRNMKKKSDTPEEKSDTQERESDNSNQLTIYVSPSVQPLLQEFKDVFPKEIPHGLPPSRSIEHQVKVEYVKRLYDQVKVQIAKKNESYTKQANKKRKEVGMMRIMKLAKYRLKAQVEKDESLSGEGQSPRVEKDEGPSGEG

SEQ ID NO: 149130 - protein, 127 aa, Glycine max
  Coding DNA Sequence Number=SeqID_57445
MTKGNPSNLQPFDPEIDKTFHRLVRHHFIPFDHPEHSITGESVHSVIGDFEHPDFEHYNFEHSDSEHSDFEHSENMAQPPPRERTLREMDAPDFTNESLCIQYPDEDVPYVLKTGLIHLLPKFHGLA

SEQ ID NO: 149131 - protein, 59 aa, Glycine max
  Coding DNA Sequence Number=SeqID_57446
  Gene Ontology: Mol. function=ATPase activity; Cellular component =chromosome; Biological process=chromosome organization and biogenesis
  Homolog annotation: Hit_ID=A5ALP1; Match level="QueryCoverage=84%, HitCoverage=4%, E-value=4e-16, Identity=86%"; Hit description =Putative uncharacterized protein
MEREKKLSILYQKQGRATQFSSKASRDKWLQKEIDDLERVLSSNKGQASIHGMKMSAFL

SEQ ID NO: 149132 - protein, 31 aa, Glycine max
  Coding DNA Sequence Number=SeqID_57447
MASPVALAFLKGRHKYALSTGQRSLTRTPFR

SEQ ID NO: 149133 - protein, 112 aa, Glycine max
  Coding DNA Sequence Number=SeqID_57448
  Subcellular localization annotation: CTP_CleavageSite=30; ConfidenceScore=5.21e-01
MYPLLFSVTTTQVDVPSTCTTKDVPSNVLRQSSQAGRIKRILRLCRFEFFDKGEGGHKRIQAVSPLFFWKREKGMKKMNITLLFSRFRKPENFRKLLAKEEEEEIQEDVQRD

SEQ ID NO: 149134 - protein, 18 aa, Glycine max
  Coding DNA Sequence Number=SeqID_57449
MAIMKLQANQLQIIEGYK

SEQ ID NO: 149135 - protein, 141 aa, Glycine max
  Coding DNA Sequence Number=SeqID_57450
MTTLTQTWMTLLLSNVLPSDHNSDLPLPKCQLVYAILTWMNVHVAQGPGVSGAITGLCQSYEVPVTPSKVIRPPITQAFIEKYCTPRQPHQQFGAEVTLPGDCPDAQAREERAGSPGEADESHMDEDMTDLLGYLGGSGAI

SEQ ID NO: 149136 - protein, 66 aa, Glycine max
  Coding DNA Sequence Number=SeqID_57451
MQITITPEDQEKTTFTCVATYPSAGGRRVTRGIRVPRKEYARSRHQRLFEENVGKTGKDAIYELLS

SEQ ID NO: 149137 - protein, 192 aa, Glycine max
  Coding DNA Sequence Number=SeqID_57452
  Gene Ontology: Mol. function=motor activity; Cellular component=cell projection
  Homolog annotation: Hit_ID=UPI00016621D1; Match level="QueryCoverage =97%, HitCoverage=40%, E-value=1e-16, Identity=32%"; Hit description =UPI00016621D1 related cluster
RLHALAFRRLHVLPFRGQHVLTFRGLHALAFRGLHVLTFKGLHVLTFRGLHILPFRGLHALTFRGLHALTFRGLHFLAIRGLHALAFRGLHALAFRGLHALAIRGLQVLAIRGLQVLAFRGLHVLAFRGLHVLAFRGLHVLTFRGLLVLAFRGLHALAFRGLHVLAFRGLHALAFRGLHALALPLEDYMSSP

SEQ ID NO: 149138 - protein, 150 aa, Glycine max
  Coding DNA Sequence Number=SeqID_57453
  Gene Ontology: Mol. function=transporter activity; Cellular component= cell outer membrane; Biological process=transport
  Homolog annotation: Hit_ID=A5FMY7; Match level="QueryCoverage=78%, HitCoverage=11%, E-value=1e-28, Identity=53%"; Hit description=TonB -dependent receptor, plug precursor
MKKVTTGILILVLSSSLAVINAQQKKKNDTVKTQDIEGVVVTALGIKREKKSLGYASQEIKASALSDGTTNTGNIAAQLSGKVAGLNVTTNNNFGGSSNLLIRGMKTLGGGNPLIVIDGSPVNNSNTQEKNIDYGNALSDINQDDIESIN

SEQ ID NO: 149139 - protein, 88 aa, Glycine max
  Coding DNA Sequence Number=SeqID_57454
MDLKVKAATSLNSNAKKKANLFAEKKERIRLPTYNDDLGGKKYHISEFLSQPSGIAAVLNTKALQSFESLDANTYRSAASLILFWWPE

SEQ ID NO: 149140 - protein, 124 aa, Glycine max
  Coding DNA Sequence Number=SeqID_57455
IFGQDVLDIVSDIVDPATSMLLATPVFSGRMSWTLYPTSWILQLHAFSNSSIFRQDVLDIVSDIVNPAASILHLTLYLAFTQDSEVACAAQFLSSNQAYLGKTKRRCLGSDGSLLVELLRRLDL

SEQ ID NO: 149141 - protein, 156 aa, Glycine max
  Coding DNA Sequence Number=SeqID_57456
  Pfam annotation: Domain name=zf-CCHC; Domain location=84-101; Score =26.7; E_value=8.7e-05; Accession=PF00098.14; Description=Zinc knuckle
YILCGTSRGYIYLGCYTENKRGYISCGSVQVEDTSTWLFKENKGGYIHCGSLACKGFYKVERNLKNRWLLGNWMKRSQKGSPTLKCYKCNRPGHIKAHCPTNESWPEKNEKKSHEERRSKKAYIAWDDNDSSDGSEKEINLLSKDYESDENISQED

SEQ ID NO: 149142 - protein, 131 aa, Glycine max
  Coding DNA Sequence Number=SeqID_57457
MAPTRHPLDPDKSNRALGFPALITGLCQSFGVPVAPSKVIRPSITRAFIEKYCTQRQAQGDAPQAVDAPPPHQAGPAGSFDTEQAEVTWPGDWPEAQAGEAPTEAPDEADEAHEDEEMTDLLDFLGGSGAT

SEQ ID NO: 149143 - protein, 191 aa, Glycine max
  Coding DNA Sequence Number=SeqID_57458
MSSPSESSCRGLHVLAFRGYTFSPSEDYTSSPSEDYTSSAKEDYTFSPEHYTSSPSEGYTPSPSEVCTLSPSEDYMSSPSEDYTSSPSEDYTPSHSEDHTFSPSEDYTSSPKEDYTSSPSGGYTTSPSEGYTPLPSEGCTPSPSEDYMSSPSEDSSSFPKRTTRPRLQKATRPSPSEDYTSSSSEDCTSSP

SEQ ID NO: 149144 - protein, 200 aa, Glycine max
  Coding DNA Sequence Number=SeqID_57459
KQHIPLPFPPREISNKKLEEIEKEILETFRKVESCALISESLKEVKKISKGMNVSALIGKYVTQIPEKCKDPGTLSMEFGDITVHWNILDAIKHPSGDLSIFRAEIIDHVVDEYMTDLHSNMHACHSSCIESEFALDYMSEFDAESEYEFESSDVLPLKIDFIESDRTNHISGSTHTSNFLYEVQAEEPSLSTAIQPATP

SEQ ID NO: 149145 - protein, 164 aa, Glycine max
  Coding DNA Sequence Number=SeqID_57460
MQQGQTYILVATFPEPNYGVKMENHEGLTVASFSTETARQVWKILLRLKGSSQCGVSTENNGGLWWPPVVVGDGEEAWDIGNGFGRRKEKENGVFPRLHEIQRLKHSNSSALGKRSVVEIGPMNLQAKFRKDPTVNEGRRLLLPRQLWTTSLRSFIKRLPREAS

SEQ ID NO: 149146 - protein, 55 aa, Glycine max
  Coding DNA Sequence Number=SeqID_57461
MENWRTALRNNFAGAPDSKWRMENWRTALRNNFAGLQTRRCRTHEQRYAINSWVY

SEQ ID NO: 149147 - protein, 187 aa, Glycine max
  Coding DNA Sequence Number=SeqID_57462
  Gene Ontology: Mol. function=RNA-directed DNA polymerase activity; Biological process=regulation of transcription, DNA-dependent
  Homolog annotation: Hit_ID=A5C5U6; Match level="QueryCoverage=99%, HitCoverage=9%, E-value=2e-33, Identity=38%"; Hit description =Putative uncharacterized protein
MELEFWDTNPFKATTKAFSSGFHYKPTIILKSRTFYELIFVDSNSVSIKYFKDPKDQTLNTHSTIQILKVLQPRHFGSDLNKGKRFSVLFDPVGYTYWDYVDAWTKVFWHQNTRFKHSWLIYFKTNTIYNFPNWFLQWWDFFGPIPEIFPETVQQGFTQFERQYNSQESQIPADLKYFSSFALSWIF

SEQ ID NO: 149148 - protein, 84 aa, Glycine max
  Coding DNA Sequence Number=SeqID_57463
  Homolog annotation: Hit_ID=Q5MG92; Match level="QueryCoverage=47%, HitCoverage=2%, E-value=2e-07, Identity=60%"; Hit description =Putative retrotransposon polyprotein
MVMLSNRDITSASSSSSSSESESECDVQSLEGDLLTVRRLMGSVFPMESSHLLLGRSWQYDRDVVHNGVTNKFSFVHKGQKGYP

SEQ ID NO: 149149 - protein, 49 aa, Glycine max
  Coding DNA Sequence Number=SeqID_57464
MKGADNRKASLRATSSWMVTKSGVVDKSEALAPTYPPMRNSDLRSSGKL

SEQ ID NO: 149150 - protein, 107 aa, Glycine max
  Coding DNA Sequence Number=SeqID_57465
LENAPTKPTTIQDLQTEINNLKREVKELHQQQEIHQIILSQLEGSSDSENTEKDEENETENLEDEMFMGLINKIKIQKFYINIRIIINDFVLDTWPYLIQGLIQTAF

SEQ ID NO: 149151 - protein, 174 aa, Glycine max
  Coding DNA Sequence Number=SeqID_57466
GIHASSTSAPFPALAYLSAQSSQTLDAKLQSLFEGHILIIQSLQELAQQRPIMSVEQFIEKAPQQHEPELENDNSSEATIFGDVDCKKRKLETRSNEAAHHGPMPASANAPFPGVDPSLPQHAVDSSIHVLEIHEGQTIPVLPFDTSPPATPIWHITDEKNVQIQDNQDQSQEF

SEQ ID NO: 149152 - protein, 326 aa, Glycine max
  Coding DNA Sequence Number=SeqID_57467
  Gene Ontology: Mol. function=transferase activity, transferring nitrogenous groups; Cellular component=cytosol; Biological process =amino acid biosynthetic process
  Homolog annotation: Hit_ID=A6TBC4; Match level="QueryCoverage=100%, HitCoverage=92%, E-value=1e-170, Identity=92%"; Hit description =Histidinol-phosphate aminotransferase
  Pfam annotation: Domain name=Aminotran_1_2; Domain location=1-321; Score=299.4; E_value=6.7e-87; Accession=PF00155.12; Description =Aminotransferase class I and II
  Pfam annotation: Domain name=Aminotran_5; Domain location=2-317; Score=-181.8; E_value=0.011; Accession=PF00266.10; Description =Aminotransferase class-V
  Pfam annotation: Domain name=Cys_Met_Meta_PP; Domain location=20-236; Score=-276.8; E_value=0.0028; Accession=PF01053.11; Description =CysMet metabolism PLP-dependent enzyme
  Pfam module annotation: Pfam domain module=Aminotran_1_2::Aminotran _5::Cys_Met_Meta_PP; Domain location=1-321::2-317::20-236
DVWLNANEFPTAVEFQLTEQTLNRYPEPQPKAVIENYAQYAGVTPEQVLVSRGADEGIELLIRAFCEPGEDAVLYCPPTYGMYSVSAETIGVECRTVPTLADWHLDLPGIEANLTGVKVVFVCSPNNPTGQIINPQDFRALLEMTRGKAIVVADEAYIEFCPQASLAGWLNEYPHLVILRTLSKAFALAGLRCGFTLANAEVINVLLKVIAPYPLSTPVADIAAQALSPAGIAAMRARVAQILDERAYLVDALREIACVEQVFDSETNYLLARITASSAVFKSLWDQGIILRDQNKQPSLSGCLRITIGTRAESQRVIDALTAENV

SEQ ID NO: 149153 - protein, 92 aa, Glycine max
  Coding DNA Sequence Number=SeqID_57468
  Homolog annotation: Hit_ID=A5BD56; Match level="QueryCoverage=48%, HitCoverage=3%, E-value=6e-07, Identity=51%"; Hit description =Putative uncharacterized protein
MKNNLLSIGLLLQKGFSMNLHDGTMEIFDRMQKKILKAKISENMTFQVPFLGGNRFFVSLVDEFSRKMWTYLLKVKSEVFENLKKFTTMTEK

SEQ ID NO: 149154 - protein, 71 aa, Glycine max
  Coding DNA Sequence Number=SeqID_57469
MEVGETKKQRKQNMKEDEWRGAKKEDGETKKHRKRTCSEINENGTKTKIEIKQNMNMKRNGEEQKWKMERM

SEQ ID NO: 149155 - protein, 144 aa, Glycine max
  Coding DNA Sequence Number=SeqID_57470
  Homolog annotation: Hit_ID=A4DID9; Match level="QueryCoverage=42%, HitCoverage=86%, E-value=3e-18, Identity=53%"; Hit description =Putative uncharacterized protein
HVWGLTPAQCRKVKEVGDLMTGEPTTEAPVNGGRNYNGPKGSEIPCRGKEGLLLGGPEPSVRYHSGRARILTLCQDLRAEGQSQAEGSLTARPTRRAGTKVGLSDPTVPSGRAVAQRIKGWAVRPLKRYVSWVQNVVRQFGPYP

SEQ ID NO: 149156 - protein, 128 aa, Glycine max
  Coding DNA Sequence Number=SeqID_57471
  Homolog annotation: Hit_ID=A0PAV3; Match level="QueryCoverage=29%, HitCoverage=17%, E-value=5e-07, Identity=76%"; Hit description =Restriction endonuclease
MVKVGTSYVPINVSFSPKVGPGLPGINRDTRIYLFCEVIFRHRYFSAQSASAVPPVQLLTGWCVTAKAPPDISAGKCSGRVPFAIQAAQLLGRAIGAGLFAITPAGERGMCCKAIKLGNARVFPVTTL

SEQ ID NO: 149157 - protein, 80 aa, Glycine max
  Coding DNA Sequence Number=SeqID_57472
  Subcellular localization annotation: CTP_CleavageSite=53; ConfidenceScore=5.46e-01
MKDLTKIPEYPPISNPSKQQGLASNSRSTWTSGLSTPTGLVTNDLSRVAFLVRFKVDNDYDAALGGGGGGGELGGVSICL

SEQ ID NO: 149158 - protein, 118 aa, Glycine max
  Coding DNA Sequence Number=SeqID_57473
MSSDTGDHRPHDLGFLEVLLETQLPVDQTLKTICFGSLDSEENYEDFLNDINYQALNESPIGHNQFPKVTSEVVAIAEDINDMSFMSAQSAEVTSHTIDLGRDGLLEEDENGAEQRIV

SEQ ID NO: 149159 - protein, 86 aa, Glycine max
  Coding DNA Sequence Number=SeqID_57474
MSPPPLGPHNHSQTHLKLSGRLDEDMTKSKVKDPLEGLGGPMTRARARKAKEALQQVLSILFEYKPKFQGEKSKVVSCIMAQMEED

SEQ ID NO: 149160 - protein, 186 aa, Glycine max
  Coding DNA Sequence Number=SeqID_57475
  Homolog annotation: Hit_ID=Q6UUU1; Match level="QueryCoverage=54%, HitCoverage=95%, E-value=2e-28, Identity=53%"; Hit description =Putative uncharacterized protein
GKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTGKRFPLAAPSCALLFLPFRLPVSFRCYGRVCLIPRLTLIPGRQFAPSWTVCTNPPFSPTAAPYPVTIVLSPTRKDMQKHHWHIH

SEQ ID NO: 149161 - protein, 228 aa, Glycine max
  Coding DNA Sequence Number=SeqID_57476
  Homolog annotation: Hit_ID=A5AFX7; Match level="QueryCoverage=28%, HitCoverage=28%, E-value=2e-10, Identity=57%"; Hit description =Putative uncharacterized protein
  Subcellular localization annotation: CTP_CleavageSite=51; ConfidenceScore=5.50e-01
MSRVDRRTGSHRSTSDRDTSPAPIRFPPDNFKHSLTLFSKSFSSFPRGTCSLSVSRQYLALDGIYRPIGAAFPNNPTRRQRLVVRQGPGTTGLSPSLAPPSRGLGPGPPLRTLLQTTIRTPRATDFHGGLFPVRSPLLRESLLVSFLRLLICLNSAGRRALGLMASGATCVQRLDGSRDSAIHTKYRISLRSSSMQEPRYPLPRVIVCKCCVVTTPAGHRLRAPGSRT

SEQ ID NO: 149162 - protein, 93 aa, Glycine max
  Coding DNA Sequence Number=SeqID_57477
MAFTSNCQQFVLDVGCVVLSVIHEAMGQLKTDSVVRGGNHVKCPIGVRVHGTQATYRTDEDTIAKRPYMAMQMSRNYDGMVASSADCVPRGRR

SEQ ID NO: 149163 - protein, 97 aa, Glycine max
  Coding DNA Sequence Number=SeqID_57478
MHSMRIPESFISMKCCQSIGDRNCHSLDYGVEPSSCFYEKVHQVRLKHGSNHLAKIGAKDGSSYIAASLLPNTFRIVDVLVTSSFTLTKMSWTMLKI

SEQ ID NO: 149164 - protein, 96 aa, Glycine max
  Coding DNA Sequence Number=SeqID_57479
MATTKALERETKRACREEHGWNKFRGALWGSNNELKLLREERDQSRNCHSLDYRVELSLCFFEKKVHQVKLKYGSNHLAKIGAKDESSYITASKHI

SEQ ID NO: 149165 - protein, 177 aa, Glycine max
  Coding DNA Sequence Number=SeqID_57480
  Homolog annotation: Hit_ID=A5C995; Match level="QueryCoverage=58%, HitCoverage=6%, E-value=1e-08, Identity=34%"; Hit description =Putative uncharacterized protein
MTRGNPSDLQTFDPEIDRTFHRLVRHHFIPFDHPEHSITGESVHSVIGDFEHPDLEHYNFEHSDYEHSDFAHAENMAQPPPRERTLREMAAPDFTYESLCIQYPDEDVPYVLKTGLIHLLPKFHGLAGEDPHKHLKEFHIVYSTTKPPDVQEDHIFLKAFPHSLEEWQTTGCITLLQ

SEQ ID NO: 149166 - protein, 119 aa, Glycine max
  Coding DNA Sequence Number=SeqID_57481
  Homolog annotation: Hit_ID=Q1J7G7; Match level="QueryCoverage=30%, HitCoverage=64%, E-value=8e-07, Identity=60%"; Hit description =Transposase
LPGINRDTRIYLFCEVISVTAVPPVQLLTGWCVTAKAPPDISAGKCSGRVPFAIRAAQLLGRAIGAGLFAITPAGERGMCCKAIKLGNARVFPVTTLYIEQLTEMPQNVLYDAIGIYQR

SEQ ID NO: 149167 - protein, 338 aa, Glycine max
  Coding DNA Sequence Number=SeqID_57482
  Gene Ontology: Mol. function=motor activity; Cellular component=cell projection
  Homolog annotation: Hit_ID=UPI00006A2D9E; Match level="QueryCoverage =69%, HitCoverage=95%, E-value=4e-18, Identity=17%"; Hit description =UPI00006A2D9E related cluster
GLHVLTFRGLHAVTFHGQHFLTFRGLHVLTFRGLHVLAFTGLHVLAFGGLHTLAIRGLHVLTFRGLHDLTLLHALAFRGLHTLNFRGLHAFAFKGQHVLTFRGLHVLAFRGLHALAFRGLHVLAIGGLHALTFRVLHVLSLRGLHILAFRGLHLLPFRGIHVRTFRGLHVLAFRGLQGLHVLTFRGLHALTFKGLHVLGFRGLHVLAFTGLHVHAFRGLHALTFRGLHRAARRHLQSAARRHLQRTTRLRLQRPARPCLQRAARPAHQRVACPHLPRITRPRLQRTTRPRLKRTTRPRLQRTTCRPFKGVQVLSFRGLHVLAFRAYTPSPSEDYTSSP

SEQ ID NO: 149168 - protein, 71 aa, Glycine max
  Coding DNA Sequence Number=SeqID_57483
MGLRKKWRIGEQRYAITSRGSRLDGRGCMNSARGARGSEKSGEWRIGEQCYAITSPGFGLEGGGHMNSARQ

SEQ ID NO: 149169 - protein, 265 aa, Glycine max
  Coding DNA Sequence Number=SeqID_57484
  Gene Ontology: Biological process=transposition, DNA-mediated
  Homolog annotation: Hit_ID=Q6UUU1; Match level="QueryCoverage=22%, HitCoverage=40%, E-value=3e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGRMNENAIDGAPNQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 149170 - protein, 346 aa, Glycine max
  Coding DNA Sequence Number=SeqID_57485
  Homolog annotation: Hit_ID=Q6WAY6; Match level="QueryCoverage=50%, HitCoverage=38%, E-value=1e-15, Identity=29%"; Hit description =Putative uncharacterized protein
MANQEEWVPFMDVLALLIFGVVLFPNVDGLVDLATIDAFLAYHHSKESPVVAVLADLFDTFDRSWFPRWKEGKEGVLFSCGGDPNIPLIGTRGCINYNPALAIRQLGDPMRGAPMEESMSPFLVRDFGAQNFKAIQRIHKAWETPLRKDQELRGIRNGIIGGYHEWLKVHIRGLDWLAKLKVVSEDSFEAPEEDEEVQALKNELGKAKLAKEKFKLAATHIRKECAELREENATTARALEQETKRACTEEYGRNKFRGALWGSNSELKLRREERDQSRAHSMVLKEELVACSRSKRRLSQRLCETETNMLAIVAKYQEELSLATAHEQRVEDEYAQVYAEKEARGR

SEQ ID NO: 149171 - protein, 131 aa, Glycine max
  Coding DNA Sequence Number=SeqID_57486
  Homolog annotation: Hit_ID=Q2HTA0; Match level="QueryCoverage=73%, HitCoverage=14%, E-value=2e-13, Identity=41%"; Hit description=IMP dehydrogenase/GMP reductase, related
  Pfam annotation: Domain name=DUF1723; Domain location=30-79; Score =55.6; E_value=1.8e-13; Accession=PF08330.1; Description=Protein of unknown function (DUF1723)
MAKFRRLALEIEGLVAVSGLSPVIACSLDTGDRRLMFAFVERWHKETSSFHLLVGEVTITLDDVALLLHLPIVGAFHSFEQLHVGDAVEMLVELLEVSATKARAKTIQCHGSYVRLSWLQDVYQMKINACH

SEQ ID NO: 149172 - protein, 47 aa, Glycine max
  Coding DNA Sequence Number=SeqID_57487
  Subcellular localization annotation: CTP_CleavageSite=34; ConfidenceScore=5.28e-01
MATPPASPPPPPPPTDTSTSPSTLKRTCKEKRLRSLATRPPGAERLV

SEQ ID NO: 149173 - protein, 202 aa, Glycine max
  Coding DNA Sequence Number=SeqID_57488
MTWDEVVDKFLKKYFPESKTAEDGLRPQSKQLLDASAGGKIKMKTLEEAMDLIENMAASDIAILRDRAHIPTKKSLLELTSQDSLLDVQSVVELMTLDVVSLVKNQLFNYMGNQPKNTFNEGGFTGFQNGQQYQQQRQWQNHPGNQFNRDQGGPSNRPQQQVPSLYEHTTKLEETLAQFMQVSMSNQKSSESAIKNREVQVG

SEQ ID NO: 149174 - protein, 252 aa, Glycine max
  Coding DNA Sequence Number=SeqID_57489
MEEILHLVEGQLEDPGLPRGPHVQDLRFCWFELDINDNSSLTDLQDRRGSLRGGILLQVIKPTRTTKEEEEKKAYDEHLFESINHPLHHPYTGSLIQSLLLQTGLRALLRLVGWEVPLMIILCVLSGLESGYTLHMMDPAGGQPAANPAAEQPSNVPSGASTSGWRSFEEGVLLESSNESSEASVNQQPVIPELEPPLLDDNTRRAELAVRLRANWWGIAYNERILDSFVRSQLAIERHIEAALVADGYSPQ

SEQ ID NO: 149175 - protein, 107 aa, Glycine max
  Coding DNA Sequence Number=SeqID_57490
MPHKENHDHEGQTFIVVKRDYFCPSSSGSEDEVSGEESSEEVYPHEECDLLMVRRLLGEISPLRTNLCCTFPPQLCYRELQMDQALKLRQDKEYEFEEYRQQNGTTF

SEQ ID NO: 149176 - protein, 89 aa, Glycine max
  Coding DNA Sequence Number=SeqID_57491
MPISPYGCISWSVSSRHRDRDHKEPSGLGGVRQGPGVSSSGYGPLDHAHKTPNGPREVQQGPGVPSSGYGPLLVLHGARSPQQGHAIMT

SEQ ID NO: 149177 - protein, 138 aa, Glycine max
  Coding DNA Sequence Number=SeqID_57492
  Gene Ontology: Biological process=transposition, DNA-mediated
  Homolog annotation: Hit_ID=Q1J7G7; Match level="QueryCoverage=23%, HitCoverage=45%, E-value=8e-10, Identity=87%"; Hit description =Transposase
MVKVGTSYVPINVSFSPKVGPRASRYQQGHLDLFILRSDLPSQVLQWIVFLSAVPPVQLQTGWCVTAKAPPDISVGKCSGHAARRVPFALQAAQLLGRAIGAGLFAITPAGERGMCCKAIKLGNPRVFPVTTLQNAAQ

SEQ ID NO: 149178 - protein, 161 aa, Glycine max
  Coding DNA Sequence Number=SeqID_57493
MPPCSGSIIQISPLYIKHEDLSEIAHGGQCLSISVLQLWILHLTETCMRVGNSDIYGFLEPQSIQRSGQSQFKSESYIKSWMQNSQRDVYLGAYKWVPLQRTLADGGHPAQGTPSCLPKSKASARWIVVKYFNDPRPLEPERLKAFWIQWAQFYLRVRDRA

SEQ ID NO: 149179 - protein, 94 aa, Glycine max
  Coding DNA Sequence Number=SeqID_57494
MQSRVMLPPLDRDFLFSEGEVVVGGDAIDESPKAFYGDVLCYMSFVQDLYQQSLMRLGAHEEFQKRDSSRGFVELLNDFELTLLNNAEELACLL

SEQ ID NO: 149180 - protein, 79 aa, Glycine max
  Coding DNA Sequence Number=SeqID_57495
QQPQSREHKIAKLPKLLAASHMILPSFHESSLTLFALLTDAILPRKGPVTRAMSKRLQEDWARAAEEGPRVLMNLRIDF

SEQ ID NO: 149181 - protein, 80 aa, Glycine max
  Coding DNA Sequence Number=SeqID_57496
MVTKGWSFNGGFNGEEEERKSNSLAFLCARRGQFSKVGNIYIKTLRMKPRAWFRGCHRGRGFIGFLGSEVERIERREKEE

SEQ ID NO: 149182 - protein, 202 aa, Glycine max
  Coding DNA Sequence Number=SeqID_57497
  Homolog annotation: Hit_ID=Q84VH5; Match level="QueryCoverage=82%, HitCoverage=28%, E-value=5e-75, Identity=76%"; Hit description =Envelope-like protein
MMFSEHQIAKEITAKRVQHWPKKGKLSAGKLSVKYAILHRIGAANWVPTNHTSTVATESFAIKLPIAFPTVLCGIMLSQHPNILNYTDSVMKRESPLSLHYKLFEGTHVPDIVLTSGKAAASGAVSKDTLIAELKDTCKVLEATIKANTEKKMELERLIKRLSDSGIDDGEAAEEEEEAAEAEEDAAEDTDSDDDDDSEATP

SEQ ID NO: 149183 - protein, 63 aa, Glycine max
  Coding DNA Sequence Number=SeqID_57498
MGDGVMQSYPPRALDRRLQEDWAKNAREGPRVLMSLRVDFGPMGDMNPHGTKVVLGIKWMNGM

SEQ ID NO: 149184 - protein, 287 aa, Glycine max
  Coding DNA Sequence Number=SeqID_57499
  Gene Ontology: Biological process=transposition, DNA-mediated
  Homolog annotation: Hit_ID=Q6UUU1; Match level="QueryCoverage=20%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPVTTLNSINNQLKQLIPKHAKTGWQFDKDQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 149185 - protein, 68 aa, Glycine max
  Coding DNA Sequence Number=SeqID_57500
MGGVVTLLDILGGENRVFLMMRNTCTWGHVTRFRTPLRLRLITMGGVACARQGDLDTYCLVFLSESVV

SEQ ID NO: 149186 - protein, 128 aa, Glycine max
  Coding DNA Sequence Number=SeqID_57501
  Gene Ontology: Biological process=transposition, DNA-mediated
  Homolog annotation: Hit_ID=Q1J7G7; Match level="QueryCoverage=32%, HitCoverage=71%, E-value=5e-12, Identity=72%"; Hit description =Transposase
DLPSQVLQWLLFLSAVPPVQLLTGWCVTAKAPPDISAGKCSGRVPFAIQAAQLLGRAIGAGLFAITPAGERGMCCKAIKLGNARVFPVTTLNSMMKKIMKRANEYTSNSLAIVANIHNLLQRFYMALH

SEQ ID NO: 149187 - protein, 132 aa, Glycine max
  Coding DNA Sequence Number=SeqID_57502
  Gene Ontology: Mol. function=pantetheine-phosphate adenylyltransferase activity; Cellular component=cytoplasm; Biological process=coenzyme A biosynthetic process
  Homolog annotation: Hit_ID=A4W515; Match level="QueryCoverage=100%, HitCoverage=83%, E-value=7e-62, Identity=90%"; Hit description =Phosphopantetheine adenylyltransferase
  Pfam annotation: Domain name=CTP_transf_2; Domain location=1-108; Score=52.2; E_value=1.8e-12; Accession=PF01467.17; Description =Cytidylyltransferase
MFDKVILAIAASPSKKPMFNLNERVQLATDAISHLPNVEVVGFSDLMANFARAQQANILIRGLRAVADFEYEMQLAHMNRHLMPELESVFLMPSKEWSFISSTLVKEVARHHGDVTHFLPDNVHQALMAKLK

SEQ ID NO: 149188 - protein, 170 aa, Glycine max
  Coding DNA Sequence Number=SeqID_57503
MASRKLSTKRSRRDAAAEGTSVAPEFDSHRFKSAEHQQCFEAIKGWSFHRDKWVQLRDDEYTDFQEEIAHALSQFLGDSQVLEEGQECEFSQRRNRADGFDEEAIAQLLCPMMPLRMPLISLSFLNGLSYALWTVCIILKLCAPKSLTRKGERLSSIDAPLIGYLNCLIA

SEQ ID NO: 149189 - protein, 93 aa, Glycine max
  Coding DNA Sequence Number=SeqID_57504
MVHNIPLLHDQVKVGVEEVEDAKAPIPIPTNEVILVGQALNTFLACPTHLVKRVSDQDATVFGVFNQDFPLHIKHEDLSEVAYGGQCLSIFVI

SEQ ID NO: 149190 - protein, 84 aa, Glycine max
  Coding DNA Sequence Number=SeqID_57505
  Homolog annotation: Hit_ID=A4EB57; Match level="QueryCoverage=83%, HitCoverage=56%, E-value=1e-16, Identity=53%"; Hit description =Putative uncharacterized protein
MPRILLKERGAFGNADTGGAWLSSARAFGTLFLAAGDKPEEGEDDVKSSCPLCPGRHTCYNGRDKGSRSREGELTPKTRPQFGL

SEQ ID NO: 149191 - protein, 108 aa, Glycine max
  Coding DNA Sequence Number=SeqID_57506
MQPRKLSAKRSRKDVAAEGTSAAPEFDSHRFRSTEHQQRFEAIKGWSFHRERRVQLRDDEYTNFQEEIVRRRWASLVTPMAKFDPDIVLEFYANAWPMEEGVWNMRSW

SEQ ID NO: 149192 - protein, 144 aa, Glycine max
  Coding DNA Sequence Number=SeqID_57507
MDDIATEQHSAQRPQCRYPPAEVSVGIAPTRHPVDPEKSNRALRFPALVMGLCQSYRVPVPPSKVMPSHPVDPEKSNRVLGFPALITGLCQFYGVPVAPSKVIKPRTNQALIKKYYAPKKAQGETPQQPGHGRQRTTDALPPSP

SEQ ID NO: 149193 - protein, 121 aa, Glycine max
  Coding DNA Sequence Number=SeqID_57508
GHALRHPYRTRARARVMGEVEEIQEKMKADMEAIKEKMATMMEAMMSVKKIMEANAVAIAATSVVAKVNPTSPSGLKQMNHPTSNMVGKDLGRQAVGGIPLQNTLEGPQYHPQPQPSRSPA

SEQ ID NO: 149194 - protein, 74 aa, Glycine max
  Coding DNA Sequence Number=SeqID_57509
  Homolog annotation: Hit_ID=Q6UUU1; Match level="QueryCoverage=70%, HitCoverage=35%, E-value=4e-14, Identity=76%"; Hit description =Putative uncharacterized protein
MAYERGGDFLEDARKILNREVRGPRQSRFSIGSAPLTSITKSDAQISGGETRQDLKIPGVPPGGSLVRSPGPAF

SEQ ID NO: 149195 - protein, 147 aa, Glycine max
  Coding DNA Sequence Number=SeqID_57510
MAPRKLVTKRSRKDKAAEGTSSTPEYDSHRFRCVEHQQHFEAIKGWSFLRERRVQLRDDEYTDFQEEIGRRRWASLVTPMAKFDPDIVLEFYANAWPTEEGIRDMRSWVRGQWIPFDADAIGQLLGYPLVLEEGQECEYGQRRNRSD

SEQ ID NO: 149196 - protein, 424 aa, Glycine max
  Coding DNA Sequence Number=SeqID_57511
  Homolog annotation: Hit_ID=Q6WAY6; Match level="QueryCoverage=90%, HitCoverage=64%, E-value=3e-25, Identity=27%"; Hit description =Putative uncharacterized protein
MANQGDWVPFMDVLALLIFGVVLFPNVDGLVDLAAIDAFLAYHHSKESLVVAVLSDLFGTFDRRCEKSSARIICCLPALCVWLVSHLFQQDTRHPCPLLSHRSCTEKRRIDWDQLLAGIGGRTISWFPRWKEGKEGVLFSCGGYPNIPLVGTRGCINYNPALAIRQLGYPMRGAPMEESMSPFLVRDFGAQNPKSIQRNHKAWETPLRKDQELRGIRNGIIDWLAKLKVVSEESFEAPEEDEEVQALKSELGKVKLAKEKFKLAATHIRKECAELREENAITARALEQETKRARKEEYGRNKFCGALWGSNSELKLRREERDQSRAHSMVLKEELVACSRSKRSLSQRLCETETNMLAIIAKYQEELGLATAHEHRITDEYAQVYAEKEARGWVIDSLHQEATMRMDRFAFTLKGSQELPRLLA

SEQ ID NO: 149197 - protein, 106 aa, Glycine max
  Coding DNA Sequence Number=SeqID_57512
MNQNEGIVTGVFKIFCLCSVLLGCDSLYGFECRFVWMLWKLGRIDGDPVLRETRIWATWEYVSSDGGGQQGWWVYARFVDVENLLCTIARPPPSTTCDGYPIILQA

SEQ ID NO: 149198 - protein, 127 aa, Glycine max
  Coding DNA Sequence Number=SeqID_57513
MTRGNPSDLQPFDPEIDRTFHRLVRHQFIPFDHSEHSITGESVHSVIGDFEHPDLEHYNFEHSDSEHSDFAHSENMAQPPPRERTLREMVAPDFTYESLCIQYPDEDVPYVLKTGLIHLLPKFHGLA

SEQ ID NO: 149199 - protein, 134 aa, Glycine max
  Coding DNA Sequence Number=SeqID_57514
  Subcellular localization annotation: CTP_CleavageSite=41; ConfidenceScore=5.30e-01
EVSRLWKAKSSAGSSLGNRSDSKVLGSTGLSCCAITRDSVHLSAVNSYMPSSFPDLVFVDERIEVGLRKGKFDCLALTNKKPRANEEKEKEEGTHVVAAIPTWPNFPPVQQCHYSADISPSHYPPPNHPQRPSL

SEQ ID NO: 149200 - protein, 31 aa, Glycine max
  Coding DNA Sequence Number=SeqID_57515
RIAWNRQAEKKKKSPSDVTRNPQTCECESQA

SEQ ID NO: 149201 - protein, 308 aa, Glycine max
  Coding DNA Sequence Number=SeqID_57516
MQRQCADAAGLQGLKHRLTIAFGIAEHHAGRRLMITNGRHQQRRALIARGLIEALFDGGLRFVIAHFDAQRLALNAFADACDTRRIGGGKQQRLTLRRRVADHIVDIVGEAHVQHAVGLIQHQHLQFVQQQRFLAQMLLNAPRRPHHDVRRVHQRIELRPHRLATAQRQDFDVLRETRQATQLFAHLIGQFAGGAEHQRLRGDLSDDDIIQQTNAERRRFAAAGFRLGAHVPPLQNGGQRGGLHRRHFGVPQFVEVGQLFGWQRQGRKRNCAHGDNSYMTNGMAARPQVGAESAANDNRDGRRYGQRA

SEQ ID NO: 149202 - protein, 47 aa, Glycine max
  Coding DNA Sequence Number=SeqID_57517
GKDYGESGFWLKDKRDAPHYFHDTKCKNDDLETLCKTGRACTYADTQ

SEQ ID NO: 149203 - protein, 84 aa, Glycine max
  Coding DNA Sequence Number=SeqID_57518
MKNKKVVMAGVSLSEACALSENHPLSEALNLLSESGESGGESVKHLRAQCVINSLSESFVFSRAKRAQLTQRKITNLRLARKWR

SEQ ID NO: 149204 - protein, 140 aa, Glycine max
  Coding DNA Sequence Number=SeqID_57519
  Homolog annotation: Hit_ID=Q6WAY6; Match level="QueryCoverage=32%, HitCoverage=8%, E-value=1e-10, Identity=62%"; Hit description =Putative uncharacterized protein
EGKEGVLFSCGDYPNVPLIGTRGCINYNPALAIRQLGYPMKGAPTEESLSPFLVRDLGAQSLKENFETSEEAEEVQALKLELGKARLAKEKFKSAATHIRKECTELQEENVATARALEQETKRARKEEYGPREIPRSIVG

SEQ ID NO: 149205 - protein, 95 aa, Glycine max
  Coding DNA Sequence Number=SeqID_57520
  Homolog annotation: Hit_ID=A0PAV3; Match level="QueryCoverage=40%, HitCoverage=17%, E-value=5e-07, Identity=76%"; Hit description =Restriction endonuclease
MVKVGTSYVSINVSFSPKVGPGLPGINRDTRIYLFCEVIFRHSCPSCSATDGVAAQLLGRAIGAGLFAITPAGERGMCCKAIKLGNARVFPVTTL

SEQ ID NO: 149206 - protein, 264 aa, Glycine max
  Coding DNA Sequence Number=SeqID_57521
  Gene Ontology: Biological process=transposition, DNA-mediated
  Homolog annotation: Hit_ID=Q6UUU1; Match level="QueryCoverage=28%, HitCoverage=51%, E-value=1e-22, Identity=72%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGIRSAALFLYTTLSSSFTSTNLLLIVITALHSSLIKLIDTVDLEGGPVGKPVVPAALMNRPTRGERRFAYWALAECILAYYVGTDEGVSEVLHVAGEKRLHRCVSKICDTGYIPLPRSLTRYARSFDCGERKWLTNGGGDFLEDATKILNRE

SEQ ID NO: 149207 - protein, 166 aa, Glycine max
  Coding DNA Sequence Number=SeqID_57522
MGRMKKTGEMTTEATKEIVEATQGSFVPHGCQDVLAAAIGRPEHPGRARAAGAGIRDQLEESIIEKVTRQVMASFSQLQSQMQSQGLAVPLEPLVGPGPSGPRVSTKGSCVDPSGNDPEMGDSDRCGLYIEGSTLVHNTPLLPGQVKVSVEEVIDADAPVPVPTDE

SEQ ID NO: 149208 - protein, 114 aa, Glycine max
  Coding DNA Sequence Number=SeqID_57523
MKLAKYRLKAQVEKDEGPSGEGQSPRVEKDEGPEAETLSRLLITYQGNPCGVYLDLSSFTGSGVYPDLSSFTGSGVYPDLSSFTGSGVYPDLSSFTGSGVIQTFVACIKRSAPT

SEQ ID NO: 149209 - protein, 40 aa, Glycine max
  Coding DNA Sequence Number=SeqID_57524
MTCEIYRIPLVKNIVSLKTSMQQGYAYIPIVRFPNSQLWY

SEQ ID NO: 149210 - protein, 38 aa, Glycine max
  Coding DNA Sequence Number=SeqID_57525
MVEIRRWPRFCNPDSFGPHSLKMLTSMCYIVINVKGWE

SEQ ID NO: 149211 - protein, 210 aa, Glycine max
  Coding DNA Sequence Number=SeqID_57526
VERPGSTSGPPMVEREMITMMVDTLPVFYYEKLVGYMPSSFVDLGFAGKRIEVGLKRGKFDYVSSTGANAGRIGATGAKKKEGDTHAVTSAPAWVKLPQASHGTHQYAQHHASFSAHAGNFSNAAPAQPRAPAPIQRGAPLSSGSNHDSPGRQCPLWFQFQHDENLSPEANSRIHPTPNDVRRPLAVPHRQPNGCDNSREDLPIPFPKVV

SEQ ID NO: 149212 - protein, 70 aa, Glycine max
  Coding DNA Sequence Number=SeqID_57527
KSQLAAFLASSKSKESLAQNLKEVLQLLQQEAKEEPPKKEAESPETNDDQEDDPFYQNEDDCFGISLDDD

SEQ ID NO: 149213 - protein, 161 aa, Glycine max
  Coding DNA Sequence Number=SeqID_57528
MLESFQQEDQMSILELYIEKDVVDGSMFHSANSLTTCENNLSNNEAQPPRNVSNLHGDEDDDDDLVSNSYVEESLDEDDSIDGISDTDDEVTDMIQPVYKEFKIHFGMMLCIIIISTEVILMRRTFVVWRCHRVLMLAKNYMLAWILIVKMRSRMQSNNML

SEQ ID NO: 149214 - protein, 115 aa, Glycine max
  Coding DNA Sequence Number=SeqID_57529
  Subcellular localization annotation: CTP_CleavageSite=86; ConfidenceScore=5.11e-01
MTRQLQRMGILGGNQERTKTATKAGAKTLQRFPQCAPASSVISLNDIGVQSEGSSSPSMLVQYQKFPPRKSPFHNERGNITMVPPELARLAYLLLERFFILVRYRPMAHGVMLTF

SEQ ID NO: 149215 - protein, 254 aa, Glycine max
  Coding DNA Sequence Number=SeqID_57530
  Homolog annotation: Hit_ID=UPI00016621D1; Match level="QueryCoverage =98%, HitCoverage=39%, E-value=2e-15, Identity=33%"; Hit description =UPI00016621D1 related cluster
FRGLHALAIRGVHVLTFRRPHALAIREPHVLPFVGLHALTFRRTTRSHLRGLHALAFRRTTRPPPSEGYTPSPSEGLQVLTFRGLHALAIRGLQVLTFRGLHALAIRGLHVLTFRGPQALAIRGPHVLTFVGQHALTFRGPHVLTFRGLHALAIRGPHVLTFRGLHALAIRGLHVLTFRGLHALAIRGLHVLTFSGLHALAIRGLHVLTFVGLHALTFRGPHVLTFRGLHALAIRGPHVLTFVGLHALTFRGLH

SEQ ID NO: 149216 - protein, 80 aa, Glycine max
  Coding DNA Sequence Number=SeqID_57531
MVRRVFLLALTCFGIPNVENARNWVANVVLKFNDDPMENEFEIVVFLRQVWWAAGKRKGFGKRREKNENDGKRRHRQSEN

SEQ ID NO: 149217 - protein, 85 aa, Glycine max
  Coding DNA Sequence Number=SeqID_57532
RIPAAGAPPPPHQAGPAGSFDTEQYLRHLVRQQAANHRAHVAWPGNWPEAQAGEAPPEAPDDGEEAHEDEEMTDLLDFLGGSGAT

SEQ ID NO: 149218 - protein, 197 aa, Glycine max
  Coding DNA Sequence Number=SeqID_57533
MSLHSSSSVNGEGSTSKDTLYKILDELRSLKLWKEKQERKEKGKKRVEEISHDEREEERRKIMKEMKREEHVSYSSHNSCKSLSEELRDYYEGRHRSHLRPHSHRRENERKPQEANINLPYFHGKDNVEAYLDWEIRVEQKLKRNSTLKSYGSHSYPNKDHGLGILWAASSKPKNDKGKTIEKKPPKASRQEKTSSI

SEQ ID NO: 149219 - protein, 172 aa, Glycine max
  Coding DNA Sequence Number=SeqID_57534
MDNEEGMQEQMKADLSALKDQMASISEVMLKLQKTIEDKATATASSTVREAEPVLQPALNPGLDRNTAVFGRRYSPQAYPYGLPPDFTPRATPEDLSQAPTFEGQLPPYEDYPGQDDGEGDTHLGPLLHLKDPSPHELPQPNIVCQIPASPTPVKESVPFAGDKGKIEALEE

SEQ ID NO: 149220 - protein, 327 aa, Glycine max
  Coding DNA Sequence Number=SeqID_57535
  Homolog annotation: Hit_ID=Q2HW90; Match level="QueryCoverage=65%, HitCoverage=57%, E-value=8e-24, Identity=32%"; Hit description =Putative uncharacterized protein
MGQLQRQAFRKAYGKIWDLARVEVSMEPIASLSQYYDQPLRCFTFEDFQLVPTMKEFEEILGCPLGGRKPYLFSGFYPSTTRVAKYQGSVWRKGKRPWQIKANGLSFIDILALLIFGVVLFPNMEGLVDLAAIDAFLAFHHGKESPVVAILAMYDTFDRGCPSICYKVTARASKKERILSSCEGCPNVPLMGTRGCINYNPVLAIRQLGYPMRGVPSDESIMPFIARGFSDHNARDRELRGSSNGIIGGYHKWLRVRTQGLDWLPNLKTVRDNEVKASEESDQVQALKAKLERARVVKEKFKSIAIKGSNSELKLRRGERNHHGSKA

SEQ ID NO: 149221 - protein, 270 aa, Glycine max
  Coding DNA Sequence Number=SeqID_57536
  Gene Ontology: Mol. function=motor activity; Cellular component=cell projection
  Homolog annotation: Hit_ID=UPI00016621D1; Match level="QueryCoverage =92%, HitCoverage=40%, E-value=1e-19, Identity=33%"; Hit description =UPI00016621D1 related cluster
AIRGLHVLAFRRLHTLAFRGLHILPFRTLRVLGFRGLHVLAFRGQHALGFRGLHVLPFKGLHVLTFRGLYVLGFRRLHVLTFRGLRVLTFQGLHILAFRGLHILGFRGQHILTFKGLHVLAFRGLHTLAFRGVHALAIRGLHALNFRGLHVLTFRGLHVLTIRRLHALTFRGLHVLAIGGLHALTLRGLHVLTIRGLHALAIRGLHVLAIRALHVLAFRRLHALAFRGLHVLAFRGLHILGFRGLHVLAFKGLPVLLFRGLRVLGFRGLH

SEQ ID NO: 149222 - protein, 138 aa, Glycine max
  Coding DNA Sequence Number=SeqID_57537
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=71%, HitCoverage=75%, E-value=3e-25, Identity=66%"; Hit description=LacZ protein
  Subcellular localization annotation: CTP_CleavageSite=32; ConfidenceScore=5.04e-01
MTMITPSSKLTLTKGNKSCPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 149223 - protein, 124 aa, Glycine max
  Coding DNA Sequence Number=SeqID_57538
MRKTLLFTTVSIFLLISISVKAQKGASSEDRIKKVLYFNPEVEPDIDEIKEPTNHAFFSAVSDNLSGYKKNKMLRTEIQIPFDSVDAQTIADYCINNDADFAVVPKVKYFKVGIGKYVFSNQVV

SEQ ID NO: 149224 - protein, 139 aa, Glycine max
  Coding DNA Sequence Number=SeqID_57539
DQPRVDSLILKDELKVCLRSKRSLSQCLCETKTNMLAIVSKYQEELNLATAHEHIVTDEYAQVYAEKEARGRVIDLLHQEATMWMDRFALTLNGSQELPRLLAKAKAMADTYSAPEEIHGILSYCQHMIDLMAHIIRNR

SEQ ID NO: 149225 - protein, 82 aa, Glycine max
  Coding DNA Sequence Number=SeqID_57540
  Subcellular localization annotation: CTP_CleavageSite=19; ConfidenceScore=5.26e-01
MTTIPIRPNFPPAQQCHYSANNNPSPYPPPSYPQRPSLNQQQNPPTTQPMLAPPLAKTKTPTKEGILQQKTYRIHPNFSVLC

SEQ ID NO: 149226 - protein, 83 aa, Glycine max
  Coding DNA Sequence Number=SeqID_57541
  Gene Ontology: Mol. function=catalytic activity; Cellular component =cellular_component; Biological process=metabolic process
  Homolog annotation: Hit_ID=Q9MB42; Match level="QueryCoverage=80%, HitCoverage=8%, E-value=2e-14, Identity=52%"; Hit description=Beta -amyrin synthase
MWRLKIANGGKDPYIFSTNNFLGWEIWEFDPEACIEEEKAEVEAARENFYDNLFNFRACGDRLWWFQWKKFQLASSHSPYPFN

SEQ ID NO: 149227 - protein, 127 aa, Glycine max
  Coding DNA Sequence Number=SeqID_57542
  Gene Ontology: Mol. function=small GTPase regulator activity
  Homolog annotation: Hit_ID=A7PUV1; Match level="QueryCoverage=56%, HitCoverage=7%, E-value=1e-22, Identity=69%"; Hit description =Chromosome chr4 scaffold_32, whole genome shotgun sequence
MVVSNESLSYSFGLSNGFAKKPMLSMTVVESRDFLIPLSESIAFHRLPFFETIAVITKAKGANLFCWNHRRGFLCLARQKHICIFRHDDEDDVGNASMMETILYLVGANGEMPTSHVLPVPMAKHAP

SEQ ID NO: 149228 - protein, 219 aa, Glycine max
  Coding DNA Sequence Number=SeqID_57543
  Homolog annotation: Hit_ID=A7PDN1; Match level="QueryCoverage=89%, HitCoverage=10%, E-value=2e-60, Identity=64%"; Hit description =Chromosome chr11 scaffold_13, whole genome shotgun sequence
MRLAGARQTKGDEVNDDDIPSTSGRQFTEGVDGDLLPSDVPKHIGQSPLPAYEPAFDWENERTLIFGQRIPETPLSQYGIREIGMKISVKVQSLQFQAGLAGECYVVDIGGIMWERREKLSEDFYFHVLPTETQNAKITCEPRAVFYLDAPSASVCLLIQLEKHATEEGGVTASVYSRKDPIRKRLVETEKDKVELEDDADWNKKTQVGMEEEIGLGFF

SEQ ID NO: 149229 - protein, 238 aa, Glycine max
  Coding DNA Sequence Number=SeqID_57544
  Homolog annotation: Hit_ID=A5B4F7; Match level="QueryCoverage=77%, HitCoverage=64%, E-value=4e-84, Identity=79%"; Hit description =Putative uncharacterized protein
MAAYAFVVLYRLRSEINLPIMRELVPHYLQDAGRERLDYLEDGKSVFRLRLRLCSSLYPINERIRDFFLEYDRHTLRTSPPWGSELLEAINSLKNVDSTALLQFLHPILNMLLHLIGNGGETLQESVDDAERNHFLVNYVDCAFDDFGGRQPPVYPGLSTVWGSLARSKYGMLGAVLKWLGSLPLTTNFLRERLGSLPLVPGCISLVLELVACVLERTTCGGADLKGRLKRCRVQPPG

SEQ ID NO: 149230 - protein, 242 aa, Glycine max
  Coding DNA Sequence Number=SeqID_57545
  Gene Ontology: Mol. function=protein binding
  Homolog annotation: Hit_ID=A2WXK8; Match level="QueryCoverage=78%, HitCoverage=72%, E-value=2e-27, Identity=38%"; Hit description =Putative uncharacterized protein
  Pfam annotation: Domain name=DUF506; Domain location=1-165; Score =135.1; E_value=2e-37; Accession=PF04720.3; Description=Protein of unknown function (DUF506)
DVLRSEGDTGCEAKVLKCVLNHMRGRKGAEKTKTSLSKWLVMRMKMDGLDASVCHTSWATSLGCPAGEYEYIEVIIEDDQNCGKPTRLIVDIDFRSQFEVARPTQNYKELTDSVPVILVGTENKLCKIISLLCSAAKQCLREKGLHVPPWRTASYMQAKWLSVSRKEPSHDVIGYDDHEHADADIIGNWVPPSLKPKKRDLDGGGSVRSNSNVTKSWRMSEWVDSKDILKLKSIRILPKILA

SEQ ID NO: 149231 - protein, 1324 aa, Glycine max
  Coding DNA Sequence Number=SeqID_57546
  Gene Ontology: Mol. function=protein binding; Cellular component =nucleus; Biological process=chromatin modification
  Homolog annotation: Hit_ID=A7QB95; Match level="QueryCoverage=98%, HitCoverage=98%, E-value=0.0, Identity=57%"; Hit description =Chromosome chr4 scaffold_73, whole genome shotgun sequence
  Pfam annotation: Domain name=LRR_1; Domain location=1021-1043; Score =2.0; E_value=1.3e+02; Accession=PF00560.24; Description=Leucine Rich Repeat
  Pfam annotation: Domain name=LRR_1; Domain location=1077-1093; Score =5.4; E_value=31; Accession=PF00560.24; Description=Leucine Rich Repeat
  Pfam annotation: Domain name=LRR_1; Domain location=1103-1126; Score =2.0; E_value=1.3e+02; Accession=PF00560.24; Description=Leucine Rich Repeat
  Pfam annotation: Domain name=LRR_1; Domain location=1160-1182; Score =1.8; E_value=1.4e+02; Accession=PF00560.24; Description=Leucine Rich Repeat
  Pfam annotation: Domain name=LRR_1; Domain location=1265-1287; Score =11.2; E_value=2.6; Accession=PF00560.24; Description=Leucine Rich Repeat
  Pfam annotation: Domain name=LRR_1; Domain location=819-840; Score =4.2; E_value=51; Accession=PF00560.24; Description=Leucine Rich Repeat
  Pfam annotation: Domain name=LRR_1; Domain location=877-899; Score =5.8; E_value=26; Accession=PF00560.24; Description=Leucine Rich Repeat
  Pfam annotation: Domain name=LRR_1; Domain location=936-962; Score =12.4; E_value=1.6; Accession=PF00560.24; Description=Leucine Rich Repeat
  Pfam annotation: Domain name=LRR_1; Domain location=964-987; Score =1.2; E_value=1.8e+02; Accession=PF00560.24; Description=Leucine Rich Repeat
  Pfam annotation: Domain name=TPR_1; Domain location=162-195; Score =15.4; E_value=0.076; Accession=PF00515.19; Description =Tetratricopeptide repeat
  Pfam annotation: Domain name=TPR_1; Domain location=205-238; Score =11.4; E_value=0.23; Accession=PF00515.19; Description=Tetratricopepti de repeat
  Pfam annotation: Domain name=TPR_1; Domain location=245-278; Score =28.6; E_value=2.2e-05; Accession=PF00515.19; Description =Tetratricopeptide repeat
  Pfam annotation: Domain name=TPR_1; Domain location=382-415; Score =18.4; E_value=0.026; Accession=PF00515.19; Description =Tetratricopeptide repeat
  Pfam annotation: Domain name=TPR_1; Domain location=422-455; Score =9.4; E_value=0.39; Accession=PF00515.19; Description=Tetratricopeptid e repeat
  Pfam annotation: Domain name=TPR_1; Domain location=65-98; Score=3.6; E_value=2; Accession=PF00515.19; Description=Tetratricopeptide repeat
  Pfam annotation: Domain name=TPR_2; Domain location=162-195; Score =16.8; E_value=0.083; Accession=PF07719.8; Description=Tetratricopepti de repeat
  Pfam annotation: Domain name=TPR_2; Domain location=205-238; Score =21.0; E_value=0.0045; Accession=PF07719.8; Description =Tetratricopeptide repeat
  Pfam annotation: Domain name=TPR_2; Domain location=245-278; Score =28.4; E_value=2.6e-05; Accession=PF07719.8; Description =Tetratricopeptide repeat
  Pfam annotation: Domain name=TPR_2; Domain location=25-58; Score=5.8; E_value=5.8; Accession=PF07719.8; Description=Tetratricopeptide repeat
  Pfam annotation: Domain name=TPR_2; Domain location=382-415; Score =16.6; E_value=0.091; Accession=PF07719.8; Description=Tetratricopepti de repeat
  Pfam annotation: Domain name=TPR_2; Domain location=422-455; Score =10.4; E_value=1.5; Accession=PF07719.8; Description=Tetratricopeptide repeat
  Pfam annotation: Domain name=TPR_2; Domain location=65-98; Score=7.5; E_value=3.5; Accession=PF07719.8; Description=Tetratricopeptide repeat
  Pfam module annotation: Pfam domain module=LRR_1::LRR_1::LRR_1::LRR _1::LRR_1::LRR_1::LRR_1::LRR_1::LRR_1::TPR_1::TPR_1::TPR_1::TPR _1::TPR_1::TPR_1::TPR_2::TPR_2::TPR_2::TPR_2::TPR_2::TPR_2::TPR_2; Domain location=...
  Pfam module annotation: Domain location=1021-1043::1077-1093::1103 -1126::1160-1182::1265-1287::819-840::877-899::936-962::964-987::162 -195::205-238::245-278::382-415::422-455::65-98::162-195::205 -238::245-278::25-58::382-415::422-455::65-98
MDADLKSAKAAYRNAKAEGNHREEARWANVIGDILKNRGEYVQALKWLRIDYEISLKHLPEKHLLPTCQSLGEMYLRLEHFSDALIYQKKHLDLARDAGDVVEQQRASTQLGRTYHELFSRSEHDHNSIRNAKKYFKSAMDLAVKLQENPPNSKSSFLKEYIDAHNNIGMLEMDLDNLHEARKILTRGLEICNDEEVAEFDDGRSRLHHNLGNVYMELRDWDKARKHIRTDIVICNRIGHVQGEAKGYINLGEVNYRTQKYEDASAYYEKALGLAKSLEDEDALVRQIEQNIETVREAVKVMADIKKEEQSLKKLKRDIATARGTPNERKFLLQQNAVLERLVEKARMISAWEKRLFQAMHCEFAKEKKKIASELCDRQRLADSYLDVAESYHKLRKFNKAIKWYKKSWEMYKNIGNLEGQAMVKINIGNVYDSTESWRKALDAFQESYSIAVEADLPDVQLAALENMHYSNMIRFDDEDETRRLNLLIDKLKKLEEKEAEAKSMPEDFCSETDTEADECLSNSGSDDFCFPKTISRSKTLTTGEELKEDAPLMSLYQSLKGSSKKKAGHKESLANSTKQDEHSPSSLKNQTSDHQTVVGRKRVRVILSDDDDDEVECSSRKDHNCPVEDLPTYDAIKSKASPCKFQVISENGSKTAINVEESSSSFKCWSPHRATKSGRHSRSFSNDIVAEPDFPGGSKCDTDVSGKQNDITQPMLHHSQNDLQQYVTCRIGNDLIRVEASLCTTGDQLNIDSLKAVVACLYYLQFPTEKRSEGLLPIIEHIKCAGRDLESLETVEHLKEVLGNDMVEASVDGWIHKGLIKMYVDHCKELSEVPNIKVLKKLYNLEVSDDEIVVSDCDLQDLSITPLINALHSQKSFAMLDLSHNLLGNGTIEKLQKVFTASGQSYGGLTLDLHCNRFGPTSLFQICECSLLFDRLEVLNISGNRLTDACGSYLSTILKNCTALCSLNIENCCVTSRTIQKVADALDSTSVLAHLCIGYNSPVSGNAIVNLVSKLSTLKRFSELNMSGLKLGKPVVDTLCKLAGTLNLSGLILGGTGVGTEGAIKLAESLLQGTEELVKLDLSYCGLTFNFVLNTSVNFFCSILELNLEGNPIMPEGSNTLFSLLVNPQCCLKVLVLKKCQLGLAGILHIIEALAENSCLEELNVANNSIPKEVSALQYDLSVKSCSQNQEQKLDTMKVDDNQEVLGSLNSADHLLEVADSEDVPVETAASGFDDSCASSCQRNSSPECHFTQQFSIAIGKAKNLQLLDLSNNGFSAQAAEAFYGSWATLRPLSSQNHITEQIIHFSTRENKCCRVKPCCKKV

SEQ ID NO: 149232 - protein, 700 aa, Glycine max
  Coding DNA Sequence Number=SeqID_57547
  Gene Ontology: Cellular component=cytoplasm; Biological process =protein transport
  Homolog annotation: Hit_ID=A7QBB6; Match level="QueryCoverage=98%, HitCoverage=96%, E-value=1e-140, Identity=56%"; Hit description =Chromosome chr4 scaffold_73, whole genome shotgun sequence
MASSHGNAHSDAAKMEQIITEFFAKSLHIILESRALYVSSRNSYGDQAVSSPCSSSSSSSSVRPRDKWFNLALRECPAALENIDLWRQNNLECIVIDVILVQRPLDWDPVTVSFSPKRVLPRSSSLKERCPFGWNTDQEELGVVGRSEKIVERWLVQYESRKTRDSNSGSRRSSNVSLHNLYKKSTLLLRSLYATVRLLPAYKLFRELNSSGQIRDFTLGHRVSSFVEPFTRKQEAEMMKFGFTPVDTSSGRLCLSVMYCPSASDVSSEPSTPMSPQVITDYVGSPLADPLRRFPSLPVAGLPSSRQRSWSFDHYRASPPSYLPSPTHSESLSSGYNACLRRFPPASLPPHPSEMSLIQKKNTNFDDYYPSASPSTSNSGPLPCKPLLRSESAPVSIPTAEVDNSPGYSNRHNLPPSPPLRISRGIGKIDKNPMQTGATAEKLFSLGKDESRKYSGVKISANSSPQISISRSSSRSYQDDFDDTDFTCPFDVDDDDMTDPGSRLNRYRNKSTSIPLGFPVSGLGKSSQKENTKERSVGHQHNMVPDLLRGGEKSLKIGAFCTGLEAMLLRIILMSSMEVESESLDHGHIAETLEAGGFFPIRKSQDAAVGALVHMLKKAPPLHQDFSTSQHLSQGAYPETWKNNTQGTNQILEASSRPVSIMSSGIIATRKTTADALEEFHGYKEMKNLLLRRGSSKHQK

SEQ ID NO: 149233 - protein, 209 aa, Glycine max
  Coding DNA Sequence Number=SeqID_57548
  Gene Ontology: Mol. function=catalytic activity; Cellular component =spliceosome; Biological process=mRNA processing
  Homolog annotation: Hit_ID=A5AZZ9; Match level="QueryCoverage=97%, HitCoverage=73%, E-value=3e-96, Identity=84%"; Hit description =Putative uncharacterized protein
  Pfam annotation: Domain name=WD40; Domain location=118-166; Score =5.5; E_value=6.6; Accession=PF00400.23; Description=WD domain, G -beta repeat
  Pfam annotation: Domain name=WD40; Domain location=170-208; Score =44.4; E_value=4e-10; Accession=PF00400.23; Description=WD domain, G -beta repeat
  Pfam annotation: Domain name=WD40; Domain location=38-74; Score=12.0; E_value=1; Accession=PF00400.23; Description=WD domain, G-beta repeat
  Pfam annotation: Domain name=WD40; Domain location=78-114; Score =15.4; E_value=0.21; Accession=PF00400.23; Description=WD domain, G -beta repeat
  Pfam module annotation: Pfam domain module=WD40::WD40::WD40::WD40; Domain location=118-166::170-208::38-74::78-114
MASYVLVNGVKFNEYSSVVVSAGYDQSLRAWDCRSHSTEPIQIIDTFADSVMSVCLTKTEIIGGSVDGTVRTFDIRIGRETSDNLGQPVNCVSMSNDGNCILAGCLDSTLRLLDRSTGELLQEYKGHTNKLCLKIQDQSYKLDCCLTNTDAHVTGVSEDGFIYFWDLVDASVVSRFKAHTSVVTSVSYHPKENCMVTSSVDGTIRVWKT

SEQ ID NO: 149234 - protein, 592 aa, Glycine max
  Coding DNA Sequence Number=SeqID_57549
  Gene Ontology: Mol. function=DNA binding; Cellular component=nucleus; Biological process=regulation of transcription, DNA-dependent
  Homolog annotation: Hit_ID=A7PKY2; Match level="QueryCoverage=84%, HitCoverage=99%, E-value=5e-52, Identity=38%"; Hit description =Chromosome chr7 scaffold_20, whole genome shotgun sequence
MTTGRSLDRKVVKASGKCNPKTGFIGVRNSPKRTNKLDQKARGCGQELTDKENQYFPFKEHMRKCPELPNKCTFLTEKREAIELHPGQMLTSAKIKLQLFPINEGTRIGLEKDGHNPYLELTLRGRKKICSILKHLGKKWGSSSIAKGELMLFPYNIMENLSGCRRWTINDSDTTASAVYTAVGSPALFRLKYGWFYMLEPGSFGIPSTPTPDKPDVAGSGNANLEETLCGERDKVRISKEYKATEVGNAASETVSQKVENATVDPMDNEPRISSSLQQPSSPWIDSLSNISIGGLLSEASLFGGLDPKSFAGIQPCDITSDSLDAFIAAAQINNRPVPRLPADDLRTSILDAEETCHAFPLRKLSSPTDVQAACGKDYSAVRSQDVSSNLLKFSNADKGFYELNVVFVVSNEPKASQKCLSNKITSSVALGQKVNDQDGASQNPPSGKTQTDLLLSSRPYDDDRSLGLTGINWNDSMGPFDLGMPAQKLNGGDSLSIGGFRYLQFRVATWDALTPNTLLLGTASLERLKRNKEQHAPKPITTHSSNKHVYDVLEEKEEIGDNISSKDKVDLEDVAAINDDKSHEKKKNIAR

SEQ ID NO: 149235 - protein, 54 aa, Glycine max
  Coding DNA Sequence Number=SeqID_57550
MKTRKREGDTTQEQEERGGDKEIERKMIGGQIRIHWHLLDWEEKESVRKEKEKG

SEQ ID NO: 149236 - protein, 359 aa, Glycine max
  Coding DNA Sequence Number=SeqID_57551
  Gene Ontology: Mol. function=nucleic acid binding; Cellular component= nucleus; Biological process=mRNA processing
  Homolog annotation: Hit_ID=Q9FT01; Match level="QueryCoverage=79%, HitCoverage=74%, E-value=1e-131, Identity=81%"; Hit description =Putative splicing factor
  Pfam annotation: Domain name=RRM_1; Domain location=233-288; Score =1.9; E_value=0.099; Accession=PF00076.13; Description=RNA recognition motif. (a.k.a. RRM, RB
  Pfam annotation: Domain name=RRM_1; Domain location=49-120; Score =100.7; E_value=4.5e-27; Accession=PF00076.13; Description=RNA recognition motif. (a.k.a. RRM, RB
  Pfam module annotation: Pfam domain module=RRM_1::RRM_1; Domain location=233-288::49-120
MAIALSGQLLLGQPVMVKPSEAEKNLVQSNASGGAAGVTGPYGAVDRKLYVGNLHFNMTESQLREIFEPFGPVEIVQLPLDLETGHCKGFGFVQFTHLEHAKAAQSLNGKLEIAGRTIKVSCVTDHVASQDTTAKSADLDDDEGGLTLNAHSRALLMQRLAGADPASLGLPVVNGSVPAQQTISLPIGAPVLPTQVMPNPAVEPVGNPSDCLLLKNMFDPSTETEPDFDIDIKEDVEEECSKYGRVKHIFVDKKSSGFVYLRFDTVEAASGAQRAMHMRWFARRCPIISISPYPLSLCINMLQFRPLGYVRLSISSNQSCMKPSLKGKFEEVHTWLEAPEDTICIIFCGLSFHTLSSSL

SEQ ID NO: 149237 - protein, 467 aa, Glycine max
  Coding DNA Sequence Number=SeqID_57552
  Gene Ontology: Mol. function=protein binding; Cellular component =protein complex; Biological process=ubiquitin-dependent protein catabolic process
  Homolog annotation: Hit_ID=A2XP48; Match level="QueryCoverage=97%, HitCoverage=95%, E-value=1e-158, Identity=64%"; Hit description =Putative uncharacterized protein
  Pfam annotation: Domain name=PCI; Domain location=279-415; Score =10.1; E_value=0.0093; Accession=PF01399.18; Description=PCI domain
MRLAGDVAGTRKAATDILQLCFDARAWKTLNDQIVVLSKRRGQLKQAVTAMVQQAMQYIDETPDIETRIELIKTLNSVSAGKIYVEIERARLIKKLAKIKEEQGLIAEAADLMQEIAVETFGAMAKTEKIAFILEQDYVRAQILSRKISPRVFDADLSKEKKKPKEGDNVVEEAPADIPSLLELKQIYYELMIRALSALRALVKGGALVKGVKWEMFVLRCGKMHSPAIYEIPSVKEDPAKWIPILRKICWYLVLAPYDPMQSSFLNSTLADKNLSEIPNFKLLLKQLVTMEVIQWTTLWDTYKSDFENEKASGKSLGEKAAEDLRQRIIEHSFCASVYRFVIDSGCGCLLLSLYKCYRGSFYAGVLLEFTYHFKWFILFIVELHDAEKHLSDMVVSKALVAKIDRPLGIVCFQTAKDSNDILNSWAANLEKLLDLVEKSCHQIHKETMVHKAALKGVGDTEGKSGL

SEQ ID NO: 149238 - protein, 205 aa, Glycine max
  Coding DNA Sequence Number=SeqID_57553
  Gene Ontology: Mol. function=nucleic acid binding; Cellular component= ribonucleoprotein complex; Biological process=mRNA metabolic process
  Homolog annotation: Hit_ID=Q8LC48; Match level="QueryCoverage=86%, HitCoverage=76%, E-value=5e-22, Identity=91%"; Hit description=Small nuclear ribonucleoprotein, putative
  Pfam annotation: Domain name=LSM; Domain location=7-149; Score=36.2; E_value=1.2e-07; Accession=PF01423.13; Description=LSM domain
SLGIPVKLLHEASGHVVTVELKSGELYRGSMIECEDNWNCQLESITYTAKDLKFGNATLNWVLRPGIRDKDYAQMEVGAWMFGMNNNRYKDLGLRPFVYARSIGPWEATSCTMSVPWSLLRTLLGFRDGKTSQLEHVFIRGSKVRFMVIPDMLKNAPMFKRLDARIKGKGASLGVGRGRAVAMRAKAQAAGRGAAPGRGVPPVRR

SEQ ID NO: 149239 - protein, 3139 aa, Glycine max
  Coding DNA Sequence Number=SeqID_57554
  Gene Ontology: Cellular component=integral to membrane
  Homolog annotation: Hit_ID=A7PKZ2; Match level="QueryCoverage=74%, HitCoverage=100%, E-value=0.0, Identity=65%"; Hit description =Chromosome chr7 scaffold_20, whole genome shotgun sequence
MDFSLGSEDPPILKLHKWDLSEAQIGLSDFREAFLSPTREILLLHSYEREALLLPLSKGELHSGGAEGGYDYDDNHNPGSANVSSEASTRPSESVLVNDSPCTSGSDVDIDTDLVGIKCSKSNSLPYISDVNSLAWARCEDGYDQHKDALFREVLFVSGRCGVTVHAFLKLTKTKGMVQPMLEGNFRQGRWVEWGPVAALSSDFSHGVSGDQNVNLTGDGGVESLRGSATKRYLESFFTKVETTVSDGILLTKFPENNEFPCLTEVVSFSIFDGSLSLDHLLKEKTVQSKENWQEPVDSARDASDRSSLSFCGADTKLDCFSSVFGVVINGFYECRRVFSGASNCLVGFFLTLMHHVSVNISDEDQRGRSRDLLLVAKLDNWGIRWVSMVKLDERINTVQSVEWMDFQFSDNLLVCLNSSGLIVLYSAMSGEYVTHLNVLQACGLNPHFNLQGLEKLYSHDNIYAKQECSINDNMSDQQSDSFRGSFKRLVVASHSSLLAVVDECGVIYVISLGEYIPDKIYSSEKLLPYCQQFVQGMLVGWEVGGSDIDRQAVYSNLSGHFRSNDLNIKHGNVALSDKAVAVKLEVHDDNFLDSVYDVYHFDGKDVIGEAIGCTFQGCFYIVRDGGLSVYIPSISILSNFLPVEYIGYRQSSKDMEISVLLKDNLEIKEPIKRFSPWKVEILDRVLLYEGTEMADQLFLKNGWDIKVSRIRQLQIALDYLKFYEIERGNINVIKPGPVINLVDDVGSLEMLVDVDLAEEGILRLLFAAVYLIFNKGGNDSETPAASRLLALAACFATKMLHKYGLLQHKKDTCIAEGFNKMGLLSLPPIEPVKLQTEVDFAQKLCEIAHFLEIIRNLQCRHRSIFQRASQGLADRGEESSLISTDMLQEESQLSILPSDLESLDVLNQHELSFPRPGSNNNENLALVPVDSESHLVSDEFGYISHLTPLGGILGKKVLPVENPREMMARWKVDNLDLKTVVRDALLSGRLPLAVLHLHQMNDFVADKEPHDTFTEVRDIGRAVAYELFLKGETELAVATLQRLGENVESYLKQLLFGTVRRSLRIQIAEEMKRYGYLGPYEWKILDDMSLIESLYPSSSFWKSYNHRLKEISIAPDSVLPVENKLRLLHNHSFDSHVIECGEIDGIVFDAWIDISESSSALEVDEDDAHVGYWAAAAVWFDAWDQRTVDRMILNQSVHSDNSILWESQLEYHVCRNHWKEVFRLLNLMPAYVLSAGSLQLNLDLVEPASSLGCNMNMKSSNYGNFLCSFEELDSVCMEVPNVQMYRFSPDICSGWMRMLVEEKLAKRFIFFKEYWEGTLEMIALLARSGFISGRDKVCLEDDLTKTSSVRDGAVQALHKIFVHHCAQNNLPNLLDLYLDHHSLVLDNDSLYALQETAVDCEWARWLLLSRVKGCEYEASLANARSIMSRNLVPRSDLSVLELDEIIRTVDDIAEGGGEMAALATLMHAAVPIQSCLNSGGVNRHSNSSAQCTLENLRPTLQKFPTLWRTLIGACLGQDTMALLVPKAKTDYLNWRDDIFFSTSHDTSLLQMLPCWFPKPIRRLIQLYVQGPLGCQSFSGFPTGETLLHRDIDLFINADVHAEINAISWEATVQRHIEEELYGPLLEENGFGLEHLLHRGRALAAFNQILGHRVQNLKSEEESSTSAHGQTNIQSDVQTLLSAVEQSEETLLSSVLPVAIMHFEDSMLVASCAFLLELCGLSANKMRIDIAVLKRISLFYKSSENNENLWQLSPKGSVFHAISHEGDVTESLARALADEYLHKDSPATATETVSKQASRALILVLHHLEKASLPQLVDGKTYGSWLLSGNGDGNELRSQRKAASQHWTLVTNFCRLHQLPLSTKYLAALARDNDWIEFLSEAQIGGYSFDTVVQVASKEFSDPRLRLHMLTVLRGMQSKKKASTALFLDTLEKGSETTFPDENMCVPVELFQILAECEKQKCPGEALLRKAKELSWSILAMVASCFLDVSPLSCLTVWLEITAARETSSIKVNDIASQIADNVGAAVNATNALPVGDRVLTFHYNRQSPKRRRLITLVSLDSSASAISDICSSSISEEIFDSKGKTMENDRKIEHFGCINVPSDSHEGPASLSKMVAVLCEQQLFLPLLRAFEMFLPSCPLLPFIRALQAFSQMRLSEASAHLGSFSARIKEEPFYLQANVGREAQIGASWISSTASTAADAVLSTCASPYEKRCLLQLLAATDFGDGGHTAAHYRRVYWKINLAEPLLRKDNELHLGDEISDDASLLSALENNRHWEQARNWAKQLEPNGAPWKSAMHHVTESQAESMVAEWKEFLWDVPEERVALWSHCHTLFIRYSFPSLQAGLFFLKHAEAVEKDLPARELHELLLLSLQWLSGMISLSNLVCPLQLLREIETKVWLLAVESETQVKSEGDFNFTFSTRESGIKNDPSIIDRTASIIAKMDNHINTMRSRIVEKYESRENNQIPHKNQVMDAGLSTTFGGNTKTKRRAKGYMAPRRPPLESADKSADTDDGSSTNSLKNEFQLQEENVKVEMSFSRWEERVGAAELERAVLSLLEFGQIAAAKQLQYKFSPGQIPSEFRLVDAALKLAAISTPPSNVSVPMLDEEVRSVMHSYGIMNDKHYVDPLQVLESLVTIFIEGNGRGLCKRIIAVIKAANTLGLSFSEAFNKQPTELLQLLSLKAQDSFEEANFLVRTHPMPAASIAQILAESFLKGVLAAHRGGYMDSQKEEGPAPLLWRFSDFLKWAELCPSEPEIGHALMRLVITGQEIPHACEVELLILSHHFYKSSSCLDGVDVLVALATTRVDAYVLEGDFPCLARLITGVGNFYALNFIFGILIENGQLDLLLQKYSAAADTNTGTAEAVRGFRMAVLTSLKHFNPNDLDAFAMVYNHFDMKHETAALLESRAEQSCEQWFRCYNKDQNEDLLDSMRYFIEAAEVHSSIDAGNKTRKDCAQASLLSLQIRMPDFQWLYRSETNARRALVEQSRFQEALIVAEAYNLNQPSEWALVLWNQMLKPEVMEEFVAEFVAVLPLQPSMLFDLARFYRAEVAARGDQSHFSVWLTGGGLPAEWAKYLGRSFRCLLKRTRDLKLRTQLATVATGFGDVIDACTEEMDKVPDNAAPLVLRKGHGGAYLPLM

SEQ ID NO: 149240 - protein, 967 aa, Glycine max
  Coding DNA Sequence Number=SeqID_57555
  Gene Ontology: Mol. function=nucleotide binding; Cellular component =nucleus; Biological process=metabolic process
  Homolog annotation: Hit_ID=A7PKZ8; Match level="QueryCoverage=96%, HitCoverage=95%, E-value=0.0, Identity=69%"; Hit description =Chromosome chr7 scaffold_20, whole genome shotgun sequence
  Pfam annotation: Domain name=DEAD; Domain location=247-409; Score= -44.6; E_value=0.09; Accession=PF00270.20; Description=DEADDEAH box helicase
  Pfam annotation: Domain name=DUF1726; Domain location=97-191; Score =197.4; E_value=3.5e-56; Accession=PF08351.2; Description=Domain of unknown function (DUF1726)
  Pfam annotation: Domain name=DUF699; Domain location=270-467; Score =390.3; E_value=2.9e-114; Accession=PF05127.5; Description=Putative ATPase (DUF699)
  Pfam module annotation: Pfam domain module=DEAD::DUF1726::DUF699; Domain location=247-409::97-191::270-467
MASEQGIGPCSSSLATSLETSLYCVQIVNLHYMLSKAQIKSRPTVLWCYKDKLELSSHKKKRSKQIKKLVQRGLYDPEKGDSFDLFLAGGGFTYCLYKESEKVLGNTFGMCVLQDFEALTPNLLARTIETVEGGGLIVLLLRSLSSLTSLCTMVMDVHDRFRTESHNEAAGRFNERFLLSLASCKACVVMDDELNILPISSHIRSITPVPVKEDSDELSEAEQDLKNLKEQLNEDFPVGPLIKKCCTLDQGKAVVTFLDVILDKTLRSTVALLAARGRGKSAALGLSVAGAIAVGYSNIFVTAPSPENLKTLFDFICKGFDALNYKEHIDYDVVKSANPEFKKGTVRINIYKHHRQTIQYILPHEHEKLSQVELLVVDEAAAIPLPVVKSLLGPYLVFLSSTVNGYEGTGRSLSLKLVQQLEEQSHVSTKSTKDTGRLFKKIELSESIRYASGDPIESWLNSLLCLDASNTIPNISRLPPPSECDLYYVNRDTLFSYHRDSELFLQRMMALYVASHYKNSPNDLQLMADAPAHHLFVLLGPVDESKNQLPDILCVIQVSLEGQISRKSAIQSLTDGHQPFGDQIPWKFCEQFRDTVFPSLSGARIVRIATHPSAMRLGYGSQAVELLIRYYEGQLIPISEIDVEDKVQAPRVRVTEAAKQNAVTGEHTCMILKPLNNDEIEADGSNQLGFFSPFYQDFRQRFAKLLASTFRVMEYKLALSIIDPKINFKNQDPTEATSDKCLQSVKDYLSPHDMKRLEAYVDNLADFHLLGERGVLMTKILDLVPTLTHLYFQEKLPVTLSYAQASVLLCIGLQNQNISYIEGQTNLERQTILSLFIKVMKKFYKYLDGLASKEIESTLPRLKEIVMEPHSVSLDEDLNNAAKQVEDDMKSKAEATFTPELLQQFAIEGESGFETVLQNNGGKIPIGGLISVKSSKVKHEKEKGSHKSDKKRSKDNHNHKSSKRKRS

SEQ ID NO: 149241 - protein, 50 aa, Glycine max
  Coding DNA Sequence Number=SeqID_57556
MGVKQNHVTPLLQWLPGARDGTLHMWNFVLEGMEKEKKEDKGRKERKGIL

SEQ ID NO: 149242 - protein, 202 aa, Glycine max
  Coding DNA Sequence Number=SeqID_57557
  Gene Ontology: Mol. function=nucleic acid binding; Cellular component= nucleus; Biological process=mRNA modification
  Homolog annotation: Hit_ID=A7PL31; Match level="QueryCoverage=96%, HitCoverage=72%, E-value=1e-58, Identity=35%"; Hit description =Chromosome chr7 scaffold_20, whole genome shotgun sequence
  Pfam annotation: Domain name=PPR; Domain location=120-154; Score =28.0; E_value=3.4e-05; Accession=PF01535.11; Description=PPR repeat
  Pfam annotation: Domain name=PPR; Domain location=19-53; Score=23.5; E_value=0.00077; Accession=PF01535.11; Description=PPR repeat
  Pfam module annotation: Pfam domain module=PPR::PPR; Domain location =120-154::19-53
  Subcellular localization annotation: CTP_CleavageSite=95; ConfidenceScore=5.10e-01
MVTHYCGVTPCINRFSTLFTWNSNFRHLVNQGHAQNALILFRQMKQSGITPNNSTFPFVLKACAKLSHLRNSQIIHAHVLKSCFQSNIFVQTATVDMYVKCGRLEDAHNVFVEMPVRDIASWNAMLLGFAQSGFLDRLSCLLRHMRLSGIRPDAVTVLLLIDSILRVKSLTSLGAVYSFGIRIGVHMDVSVANTLIAAYSKC

SEQ ID NO: 149243 - protein, 91 aa, Glycine max
  Coding DNA Sequence Number=SeqID_57558
  Gene Ontology: Mol. function=oxidoreductase activity; Cellular component=integral to membrane; Biological process=electron transport
  Homolog annotation: Hit_ID=A7PL33; Match level="QueryCoverage=85%, HitCoverage=15%, E-value=5e-25, Identity=69%"; Hit description =Chromosome chr7 scaffold_20, whole genome shotgun sequence
MTSTIIAMYGSDTGMKRKVEESDLGKLEYLEMVVKESMRLHPGAHLLIPHQSAEDCMVGDFFIPKKSRLIVNAWAVMRDPSAWSEADKFWP

SEQ ID NO: 149244 - protein, 88 aa, Glycine max
  Coding DNA Sequence Number=SeqID_57559
  Homolog annotation: Hit_ID=A5AZ35; Match level="QueryCoverage=81%, HitCoverage=100%, E-value=5e-14, Identity=51%"; Hit description =Putative uncharacterized protein
MDEVMKEKKGQKGPIRMSDIAMLVAEEYERRVKSLRKSGGGTGAGEFDMVSCVSVIVSRLKEKKQLLQWVLEPKTQVAMAASNSFFSA

SEQ ID NO: 149245 - protein, 750 aa, Glycine max
  Coding DNA Sequence Number=SeqID_57560
  Homolog annotation: Hit_ID=A7R5F9; Match level="QueryCoverage=64%, HitCoverage=97%, E-value=1e-157, Identity=62%"; Hit description =Chromosome undetermined scaffold_957, whole genome shotgun sequence
  Pfam annotation: Domain name=DUF630; Domain location=1-60; Score =111.6; E_value=2.4e-30; Accession=PF04783.3; Description=Protein of unknown function (DUF630)
  Pfam annotation: Domain name=DUF632; Domain location=287-664; Score =416.1; E_value=5e-122; Accession=PF04782.3; Description=Protein of unknown function (DUF632)
  Pfam module annotation: Pfam domain module=DUF630::DUF632; Domain location=1-60::287-664
MGATNSRAEKNEALSLCKERKRFVKVAIDSRYALAAAHVSYIQSLRNVGIALRRYAESEVEVESSLSISDKTPSQTSYPSPSSPSHVAEVEVLESPLHNESPLSPPVATTLSYMRSGGSAAVTVRINAFGNNYLDDESTVVPMPPPPPESGASWDFFDPGEDSESFRFAVHCSESRDFRDEEKGDQWLHVGSDGHCMVQPLLDDKFGGNLSNAGMGNECGNSYAHCNDHSTVSRGVEGGNGIVDGELRELELPSAAGGLSRAVADKDAGGRSSAKREKNMPGKNVCTEREDPSEFITHRAKDFLSSIKDIEHRFVRASESGREVLRLLEANKIKVGYSEAKGKSSTTALLSAVQPVCCGRKASPVFQEPAQKIISWKRTASSRSSSSRNALATKTKEDIDDSGSDFVEEFCMIAGSHSSTLDRLYAWERKLYDEVKASESIRKDYDRKCHQLRHQFAKDQGTHVIDKTRSVVKDLHSRLTVAIYSVDSISKRIERMRDEELLPQLLELTEGQLSVKALTTNYLGNYWLCRLIRMWKAMLECHHAQYITISLAYHSRSTPGTLQGYARRDIMTQLLEEVEFFGLSFANWINSLTSYVEAVNAWLQNCILQPRERTKSRRPFSPRRVLAPPIFVLCRDWSAGIKVLPSEELSQTIRNFLSDLHLRTEQHNDQLLKKQNSVNASTTETESKPNEENEDESTNLSCIHARLTKVLDRLTKFSEASLKMYEDIRQKSESARNAYHNCRTIRAEKF

SEQ ID NO: 149246 - protein, 394 aa, Glycine max
  Coding DNA Sequence Number=SeqID_57561
  Gene Ontology: Mol. function=catalytic activity; Biological process =trehalose biosynthetic process
  Homolog annotation: Hit_ID=A9PCZ6; Match level="QueryCoverage=87%, HitCoverage=94%, E-value=1e-134, Identity=70%"; Hit description =Putative uncharacterized protein
  Pfam annotation: Domain name=Trehalose_PPase; Domain location=149 -383; Score=337.8; E_value=1.9e-98; Accession=PF02358.7; Description =Trehalose-phosphatase
MKVGGEIERKTQGSMVCGGDLKDIGVGVWDQAWVPAGFITMKMTQNAIVSKTKSGIKGDIAVAQKPLAAPPPPGYIPIPRRRVLKNLEINGGQRINAWVDSMRASSPTNSKSTSSLAEEHSSWILRHPSALDMFEQIMDASRGKQIVMFLDYDGTLSPIVDDPDHAFMSDSMRRTVRKLARCFPTAIVTGRCKDKVYSFVRLAELYYAGSHGMDIQGPTRDCKYSKDKGEPVLFQPASEFLPMIDEVHHQLVEKMKSIPGAKVENNKFCCSVHFRCVDEKKWSELAQEVRSVLKEYPKLRLNQGRKVLEIRPSIKWDKGKALEFLLESLGFANCNDVFPVYIGDDKTDEDAFKKLRDRGQGSGILVSKFPKDTSASYSLQEPNEASDGFPSTFG

SEQ ID NO: 149247 - protein, 238 aa, Glycine max
  Coding DNA Sequence Number=SeqID_57562
  Gene Ontology: Mol. function=binding; Cellular component=postsynaptic membrane; Biological process=protein amino acid phosphorylation
  Homolog annotation: Hit_ID=A7PR02; Match level="QueryCoverage=58%, HitCoverage=93%, E-value=1e-53, Identity=75%"; Hit description =Chromosome chr6 scaffold_25, whole genome shotgun sequence
  Pfam annotation: Domain name=Ank; Domain location=118-150; Score=1.5; E_value=20; Accession=PF00023.21; Description=Ankyrin repeat
  Pfam annotation: Domain name=Ank; Domain location=52-84; Score=45.8; E_value=1.5e-10; Accession=PF00023.21; Description=Ankyrin repeat
  Pfam annotation: Domain name=Ank; Domain location=85-117; Score=38.4; E_value=2.6e-08; Accession=PF00023.21; Description=Ankyrin repeat
  Pfam module annotation: Pfam domain module=Ank::Ank::Ank; Domain location=118-150::52-84::85-117
MGATEANTTLQARPETTSENIEALLDAARYDDMDDVKSLEASGVPLDSKDEQGRTALHMAAANGHIDIVEYLISRGVDLNSPNEEKNTPLHWACLNGHVEAVKKLIMAGANVSVLNSHERTPMDEAVSGGKPEVMDAINEAVALVELRGAMFEQDHECFGILLPPKFPLWNSSSENGIEGVGMKEGALEDVRSLPTFRFSQSNSLVMVDDNKKQLVKGRIDSGNGSHMIELLSNQMIL

SEQ ID NO: 149248 - protein, 152 aa, Glycine max
  Coding DNA Sequence Number=SeqID_57563
MCDSDDNNNVDDFNNNNRNISGGNVDVIGSGGNDNVVVIVVLMVAIIFLIFEFSMTLTLQHFLRSYFTLRDSISLNIPVANGDDIGGGGGDNDIDGSDKRDISGGGGASNVGGVGGSIDENEGGGSSVGSGGYGDANCGCGGDDGDSIVGSG

SEQ ID NO: 149249 - protein, 548 aa, Glycine max
  Coding DNA Sequence Number=SeqID_57564
  Gene Ontology: Mol. function=binding; Cellular component =intracellular; Biological process=protein folding
  Homolog annotation: Hit_ID=A7R3Y7; Match level="QueryCoverage=88%, HitCoverage=71%, E-value=1e-165, Identity=61%"; Hit description =Chromosome undetermined scaffold_588, whole genome shotgun sequence
  Pfam annotation: Domain name=TPR_1; Domain location=193-226; Score =23.9; E_value=0.00059; Accession=PF00515.19; Description =Tetratricopeptide repeat
  Pfam annotation: Domain name=TPR_1; Domain location=227-260; Score =11.6; E_value=0.22; Accession=PF00515.19; Description=Tetratricopepti de repeat
  Pfam annotation: Domain name=TPR_1; Domain location=261-295; Score =13.4; E_value=0.13; Accession=PF00515.19; Description=Tetratricopepti de repeat
  Pfam annotation: Domain name=TPR_1; Domain location=337-370; Score =0.9; E_value=4.2; Accession=PF00515.19; Description=Tetratricopeptide repeat
  Pfam annotation: Domain name=TPR_1; Domain location=381-414; Score =15.1; E_value=0.082; Accession=PF00515.19; Description =Tetratricopeptide repeat
  Pfam annotation: Domain name=TPR_1; Domain location=427-460; Score =14.6; E_value=0.095; Accession=PF00515.19; Description =Tetratricopeptide repeat
  Pfam annotation: Domain name=TPR_1; Domain location=461-494; Score =35.7; E_value=1.7e-07; Accession=PF00515.19; Description =Tetratricopeptide repeat
  Pfam annotation: Domain name=TPR_1; Domain location=495-528; Score =13.0; E_value=0.15; Accession=PF00515.19; Description=Tetratricopepti de repeat
  Pfam annotation: Domain name=TPR_2; Domain location=193-226; Score =29.0; E_value=1.7e-05; Accession=PF07719.8; Description =Tetratricopeptide repeat
  Pfam annotation: Domain name=TPR_2; Domain location=227-260; Score =17.7; E_value=0.045; Accession=PF07719.8; Description=Tetratricopepti de repeat
  Pfam annotation: Domain name=TPR_2; Domain location=261-295; Score =17.2; E_value=0.062; Accession=PF07719.8; Description=Tetratricopepti de repeat
  Pfam annotation: Domain name=TPR_2; Domain location=337-370; Score =4.0; E_value=9.5; Accession=PF07719.8; Description=Tetratricopeptide repeat
  Pfam annotation: Domain name=TPR_2; Domain location=381-414; Score =26.6; E_value=9.2e-05; Accession=PF07719.8; Description =Tetratricopeptide repeat
  Pfam annotation: Domain name=TPR_2; Domain location=427-460; Score =12.3; E_value=0.87; Accession=PF07719.8; Description=Tetratricopeptid e repeat
  Pfam annotation: Domain name=TPR_2; Domain location=461-494; Score =22.9; E_value=0.0012; Accession=PF07719.8; Description =Tetratricopeptide repeat
  Pfam annotation: Domain name=TPR_2; Domain location=495-528; Score =18.8; E_value=0.02; Accession=PF07719.8; Description=Tetratricopeptid e repeat
  Pfam annotation: Domain name=TPR_4; Domain location=227-252; Score =1.9; E_value=23; Accession=PF07721.5; Description=Tetratricopeptide repeat
  Pfam annotation: Domain name=TPR_4; Domain location=381-406; Score =14.8; E_value=0.32; Accession=PF07721.5; Description=Tetratricopeptid e repeat
  Pfam module annotation: Pfam domain module=TPR_1::TPR_1::TPR_1::TPR _1::TPR_1::TPR_1::TPR_1::TPR_1::TPR_2::TPR_2::TPR_2::TPR_2::TPR _2::TPR_2::TPR_2::TPR_2::TPR_4::TPR_4; Domain location=193-226::227 -260::261-295::337-370:...
  Pfam module annotation: Domain location=:381-414::427-460::461 -494::495-528::193-226::227-260::261-295::337-370::381-414::427 -460::461-494::495-528::227-252::381-406
  Subcellular localization annotation: CTP_CleavageSite=30; ConfidenceScore=5.09e-01
MGNNFPQGKCGCGGLIFWRPPPNNNNNNSNANKFENLSNASDTKKGQGGCEDITFSGTASSNKPTNSSTRSGTKPNHVVNQNYQRNHPKVSPTEGYVSNGRRVPKEAIGISGELESMITDRQKGSSNLVRASSSNVMMFNNLGNLRQGGNTNTYSQNPVANGRYTNQTVENVSKGNKEQPGSLCRVVSTRMNPEQLKIMGNEDYKNGRFQEALALYDAAIAIDPNKASYRSNKSAALTALGRLLEAVFECREAIQIEPRYQRAHYRLGNLNMRLGEMDKALYHYKQAGPEIDPDENAKVKKIQVHLNKCTEARRLGDWNKLIKETNNAISSGADSAPQIFALQAEAFLKLRRHQHAEEAMSKGSNFDVDHCTKFFGPICHANTLVTQSRVHLAAGRFEDALVAIQRASRLDPNNNEMKKVMRKARAAAAARSNGNELFMASKFSEASVAYGEGLEHDPYNSVLLCNRAACRSKLGQFEKAVEDCNASLSLRPSYSKARLRRADCNAKLKRWEASIQDYEILLKETPEDEELTRALLEAKEHLIQQRGE

SEQ ID NO: 149250 - protein, 250 aa, Glycine max
  Coding DNA Sequence Number=SeqID_57565
  Homolog annotation: Hit_ID=Q9ZVD2; Match level="QueryCoverage=80%, HitCoverage=76%, E-value=6e-16, Identity=27%"; Hit description =Expressed protein
  Pfam annotation: Domain name=Hin1; Domain location=94-225; Score =55.6; E_value=1.7e-13; Accession=PF07320.4; Description=Harpin -induced protein 1 (Hin1)
MEGHADHNSAVLPPPPGRHAPAAGTYIVQFPKDQVYRVPPRENALIVEQYRNPATAKKRRGGCCCCCNRRVLITFALVVTTIVAVVGITLATLYFIFSPAGPKFTVSHVAVNRNNKNSQGAAAQYEVSLRARNPNEKLAIQYQEGDVSLLLFDESKVAEGKFPTLEQGGGEASEVKLELTGSSGAFPRGMHGGDAAVDLKLEIKLAIRIRTAGLETWGMSSNVACQFKDHGMGLGYVSYCCSMANTALKP

SEQ ID NO: 149251 - protein, 296 aa, Glycine max
  Coding DNA Sequence Number=SeqID_57566
  Gene Ontology: Mol. function=cysteine-type peptidase activity; Cellular component=nucleus; Biological process=ubiquitin-dependent protein catabolic process
  Homolog annotation: Hit_ID=O24454; Match level="QueryCoverage=97%, HitCoverage=80%, E-value=1e-143, Identity=87%"; Hit description =Ubiquitin carboxyl-terminal hydrolase 3
  Pfam annotation: Domain name=UCH; Domain location=2-287; Score=186.8; E_value=5.4e-53; Accession=PF00443.20; Description=Ubiquitin carboxyl- terminal hydrolase
MALCYFRVLLQISSQKKKTGVIAPKRFVQRLKKQNELFRSYMHQDAHEFLNFLLNELVDILEKEAQAAKTDQETSPPSEKAVNGPKNGQANGVHKEPLVTWGILTNETRCLQCETVTARDETFLDLSLDIEQNSSITSCLKNFSSTETLNAEDKFFCDKCCSLQEAQKRMKIKKPPHILVIHLKRFKYMEQLGRYKKLSYRVVFPLELKLSNTVEDADIEYSLFAVVVHVGSGPNHGHYVSLVKSHNHWLFFDDENVEMIDESAVQTFFGSSQEYSSNTDHGYILFYESIGSGNRS

SEQ ID NO: 149252 - protein, 259 aa, Glycine max
  Coding DNA Sequence Number=SeqID_57567
  Gene Ontology: Mol. function=heat shock protein binding; Cellular component=chloroplast thylakoid membrane; Biological process =response to heat
  Homolog annotation: Hit_ID=Q7Y204; Match level="QueryCoverage=68%, HitCoverage=45%, E-value=1e-58, Identity=57%"; Hit description =Putative DnaJ protein
  Pfam annotation: Domain name=DnaJ; Domain location=95-167; Score =116.4; E_value=8.6e-32; Accession=PF00226.22; Description=DnaJ domain
  Pfam annotation: Domain name=DnaJ_CXXCXGXG; Domain location=213-259; Score=-14.6; E_value=0.00026; Accession=PF00684.10; Description=DnaJ central domain (4 repeats)
  Pfam module annotation: Pfam domain module=DnaJ::DnaJ_CXXCXGXG; Domain location=95-167::213-259
  Subcellular localization annotation: CTP_CleavageSite=55; ConfidenceScore=5.04e-01
MGNSSSAVTKIQYHGQGCIIQPQNGSRKETGECFQSYLSLSIARFRGRGRKRKVSFMAATSSSFFSQDSTLLNVGAPQTFNHRKGSRLIVRANADYYSVLGVSRNASKSEIKSAISKLFTFDISAYRKLARNYHPDVNKEPGAEQKFKEISNAYEVLSDDEKRSIYDRFGEAGLKGSAMGMGDFSNPFDLFESLFEGMNRGAGSRGSWNGAIDGAKPGTTPSRCSTCGGQGRVVSSMRTPLAIFQRSMTCSACNGTGEI

SEQ ID NO: 149253 - protein, 882 aa, Glycine max
  Coding DNA Sequence Number=SeqID_57568
  Gene Ontology: Mol. function=binding; Cellular component=nucleus; Biological process=mRNA modification
  Homolog annotation: Hit_ID=Q6Z236; Match level="QueryCoverage=60%, HitCoverage=95%, E-value=1e-163, Identity=53%"; Hit description =Pentatricopeptide (PPR) repeat-containing protein-like
  Pfam annotation: Domain name=PPR; Domain location=374-408; Score =25.7; E_value=0.00017; Accession=PF01535.11; Description=PPR repeat
  Pfam annotation: Domain name=PPR; Domain location=436-470; Score =21.6; E_value=0.0029; Accession=PF01535.11; Description=PPR repeat
  Pfam annotation: Domain name=PPR; Domain location=499-533; Score =29.3; E_value=1.4e-05; Accession=PF01535.11; Description=PPR repeat
  Pfam annotation: Domain name=PPR; Domain location=561-595; Score =49.1; E_value=1.5e-11; Accession=PF01535.11; Description=PPR repeat
  Pfam annotation: Domain name=PPR; Domain location=662-696; Score =41.1; E_value=4e-09; Accession=PF01535.11; Description=PPR repeat
  Pfam annotation: Domain name=PPR; Domain location=697-731; Score =28.8; E_value=2e-05; Accession=PF01535.11; Description=PPR repeat
  Pfam annotation: Domain name=PPR; Domain location=733-767; Score=3.1; E_value=3.4; Accession=PF01535.11; Description=PPR repeat
  Pfam annotation: Domain name=PPR; Domain location=799-833; Score=7.3; E_value=1.1; Accession=PF01535.11; Description=PPR repeat
  Pfam module annotation: Pfam domain module=PPR::PPR::PPR::PPR::PPR::PP R::PPR::PPR; Domain location=374-408::436-470::499-533::561-595::662 -696::697-731::733-767::799-833
MRYCATFDTHRASLPYVARFHAKRVLKFQDALLTSYHRNEIKFAELTLDIYRMIQCLEWEPSETFYQKHTVKPKENGDIIDHSGASGIIDMNLTADMTDPTIPPNPRKATLYRPSVTHVIAVSFQAYWKVLATICEELPPDCVVLVYLSASGKAGLNNVSQVENSGGSSKYSRHKVLSQTSLGQNSGPSETQSNGKRELSYYDNYLWFGPKGNSGLNNLYPGDLIPFTRKPLFLIIDSDNSHAFKAAFCQMIGLTPNEADTDVYNEAENIIANAFTEWEIILCSSTTMDLVWAQVISDPFLRRLILSVTCTHSMLTSLVPTFWRQRHSFFVLATLFSSTRDVYHANLDIVALSRAGKVDAARKLFDEMATKDVVTWNSMLSAYWQNGLLQRSKALFHSMPLRNVVSWNSIIAACVQNDNLQDAFRYLAAAPEKNAASYNAIISGLARCGRMKDAQRLFEAMPCPNVVSYTAMVDGYARVEGGIGRARALFEAMPRRNSVSWVVMINGLVENGLCEEAWEVFVRMPQKNDVARTAMITGFCKEGRMEDARDLFQEIRCRDLVSWNIIMTGYAQNGRGEEALNLFSQMIRTGMQPDDLTFVSVFIACASLASLEEGSKAHALLIKHGFDSDLSVCNALITVHSKCGGIVDSELVFGQISHPDLVSWNTIIAAFAQHGLYDKARSYFDQMVTVSVQPDGITFLSLLSACCRAGKVNESMNLFSLMVDNYGIPPRSEHYACLVDVMSRAGQLQRACKIINEMPFKADSSIWGAVLAACSVHLNVELGELAARRILNLDPFNSGAYVMLSNIYAAAGKWKDVHRIRVLMKEQGVKKQTAYSWLQIGNKTHYFVGGDPSHPNINDIHVALRRITLHMKVKGNYEEIFF

SEQ ID NO: 149254 - protein, 698 aa, Glycine max
  Coding DNA Sequence Number=SeqID_57569
  Gene Ontology: Mol. function=transferase activity, transferring glycosyl groups; Cellular component=integral to membrane; Biological process=metabolic process
  Homolog annotation: Hit_ID=Q9FKQ8; Match level="QueryCoverage=88%, HitCoverage=99%, E-value=1e-116, Identity=57%"; Hit description =Arabidopsis thaliana genomic DNA, chromosome 5, P1 clone:MNA5
MSPEQFLEFAWGLANSKKPFLWIIRPDLVFGGSEILSSEFVNETSNRGLIARDFSRKVSDRHWEDPSREMWVFYLISLPLTVGMVLFTLRYYAAPHVPRYVLLTVGYTWLSSLSIIILVPADIWTDLEFEFDALLHLVNYYTVCYNGVGSSKTGWSPDLQRAVEFANLHKHSDAQVSNCRRAVVPLIQGFEDAGDFTVSERLKTSLHVNLIFYLIVGSIGLFGFILLIMMHKRWSGSLLGLAMACSNTFGLVTGAFLLGFGLSEIPKSIWRNADWTTRQKVLSHKIAKMAVRLDDAHQELSNAIVVAQDTSNQMSRRDPLRCYMDVIDDMLTQMFREDPSFKPQGGRLGESDIDYDTDEKSMATLRRHLRGATEEYYRKQVQKGLAVILGVMSVTILLAEATLLPSVDLSLFSILIKSVGTQEVLVQRMGNIDNAVPFFGDKFNRIYPLIMVIYTLLVASNFFDRVFDSLGSWKRYVFETETEDMDGFDPSGLIILQKERYWLEQGGNVGEQVVPLVRNFNGIDVESSDNIMFKQFTHFIADMVQVKNGVEMKGNSALVNKETDGNLPKTLKEETRRYSSSREAISSKYAAVRQQSELTSAKVSLLDHGNAHSSNAAGTSGLASTWQTMTTGFRSFGANLGGKGFLPIRQTQEAKMSRVSSSESLDDIFQRLKRPALDQNIDNDKDNLKRGNISGPSR

SEQ ID NO: 149255 - protein, 122 aa, Glycine max
  Coding DNA Sequence Number=SeqID_57570
  Subcellular localization annotation: CTP_CleavageSite=34; ConfidenceScore=5.44e-01
MAVGCISFTAMLGDGTIMHCSSQYGSGTTSSRPSCATSTSRLRSYVGSYVNDYGLGEEGMNSVVTFGGALDKGMNSMVNFGGVLDEDMNLVVDFGGTLDDGMNGMVHWSGENHHSKQQEQDK

SEQ ID NO: 149256 - protein, 83 aa, Glycine max
  Coding DNA Sequence Number=SeqID_57571
MVFSIAMRIQPFSKEDNKTGLGLSLRDEVGVFVAAETAWITPVLQPREGEALAQLCAKITTTTTVIVLKTKIDSQDHNDNDNN

SEQ ID NO: 149257 - protein, 534 aa, Glycine max
  Coding DNA Sequence Number=SeqID_57572
  Homolog annotation: Hit_ID=A7R0H8; Match level="QueryCoverage=41%, HitCoverage=85%, E-value=3e-55, Identity=56%"; Hit description =Chromosome undetermined scaffold_309, whole genome shotgun sequence
  Pfam annotation: Domain name=DUF617; Domain location=75-235; Score =208.5; E_value=1.5e-59; Accession=PF04759.4; Description=Protein of unknown function, DUF617
MASGVTTVDCEKQVRSWRLLRSLMQLLIPTCNCATIIEDDQDLTTTTNETLRNTRSKYYNYYTPSSSSLMSSTTNITGTIFGYRRGKVSFCIQANANSNNPILLLELAVPTAILAKEMRGATLRIALESGRGDGDDDGKADTLLSTPLWTMYCNGRKVRYAVKRRPSNTDFEALRLMGSVVVGTGVMKCKELVSWKKLEEDDQLMYLRASFKRVRGSDNSVWSTRPELEYNIPPSCVGHGQSIAEQGGATLQTHHALPSTRHEPRFLHAPHAQAPSHAPLLWRRLTRYRLGRCGGPDGPPSGDQQRRRGPEVPDRRPPHHPPRQLHPPGPALRVPLRRRQKLPQPLQLPTQRRPHIMGTLVLGPMVREAHRAAPVHFQDPGILPRNPDRQRRQGVGSGICKRPEPNNVYGNNGLVEEIVKLAREDWGVVEVEVRVRVSEFKERLGGFKFGEVVELVCCLKRLEQCQEMMDGARELGLWDFVGEVKDKAGIQVYRQEGKLRKESRKLRFSESDRFSAPVLNSRDFLHFPSGRFLL

SEQ ID NO: 149258 - protein, 286 aa, Glycine max
  Coding DNA Sequence Number=SeqID_57573
  Gene Ontology: Mol. function=structural molecule activity; Cellular component=cytoskeleton; Biological process=multicellular organismal development
  Homolog annotation: Hit_ID=A7P460; Match level="QueryCoverage=100%, HitCoverage=63%, E-value=1e-133, Identity=81%"; Hit description =Chromosome chr1 scaffold_5, whole genome shotgun sequence
  Pfam annotation: Domain name=Actin; Domain location=2-283; Score =24.4; E_value=7.4e-16; Accession=PF00022.10; Description=Actin
MGFAGNVEPCFIAPTVVAVNESFLNQSRGSSKGSWVAQHNAGVMADLDFFIGDEALSKSRSSSTYNLSYPIRHGQVENWDAMERFWQQCIFNYLRCDPEDHYFLLTESPLTAPESREYTGEIMFETFNVPGLYIAVNSVLALAAGYTTSKMTGVVVDVGDGATHVVPVADGYVIGSSIKSIPIAGKDITLFVQQLMRERGENVPPEDSFEVARKVKEMYCYTCSDIVKVVFISILSTLTALFEEFVEFNKHDKEPGKYIKHWRGIKPKTGAPYSCDIGYERFLGPE

SEQ ID NO: 149259 - protein, 654 aa, Glycine max
  Coding DNA Sequence Number=SeqID_57574
  Gene Ontology: Mol. function=protein tyrosine/serine/threonine phosphatase activity; Cellular component=intracellular; Biological process=protein amino acid dephosphorylation
  Homolog annotation: Hit_ID=A7P490; Match level="QueryCoverage=99%, HitCoverage=77%, E-value=0.0, Identity=54%"; Hit description =Chromosome chr1 scaffold_5, whole genome shotgun sequence
  Pfam annotation: Domain name=DSPc; Domain location=99-238; Score =133.2; E_value=7.3e-37; Accession=PF00782.11; Description=Dual specificity phosphatase, catalytic domain
  Pfam annotation: Domain name=Gelsolin; Domain location=265-339; Score= 11.0; E_value=0.035; Accession=PF00626.13; Description=Gelsolin repeat
  Pfam module annotation: Pfam domain module=DSPc::Gelsolin; Domain location=99-238::265-339
MLGEESNNNNDRAGGHRRTTHSRSVSWTDRSPVTRKPPRPLQPLAIHKRSVLEWPSAGCDDLGDWSLPPTPRGSTKTPDSGSGQVFQFKKDYYAFYDKECSRIAEHVYLGSDTVAKSVELLRRHGITHVLNCVGFVCPEYFKTDFVYKTLWLRDSPSEDITSILYDVFDYFEDVRNQGGRVFVHCCQGVSRSTSLVIAYLMWREGQSFEDAFHYVKIARGVTNPNMGFACQLLQCQKRVHAMPASPSSVLRMYRMAPHSPYDPLHLVPKLIDHPSSRALDSRGAFVVHVPNAIYVWIGKECGSVMCCNARSAAAQVVRYERATEKIVSVFEDEEPKEFWIALSTKEVVVVENGEVKNVVERIEIDVGIRPRRVEEYDLDFGIFHKALAGGVVPPFSLSNAGSENCLPARENGWGRLTRKLASGIMKGLFTSSKCCESSVNIIEEGNQHKNVDPPLPPSSNNVGGSWSSFECFVDNGLERGKDSVQQVRDQFVVPSVGSSMPPPSPHSRAASDSFACFLSNSSKFSSKSPPLSPASSDYASSFTFSPSSTDLSIVSSRQSSPSGLESAEPNHVKDASSSESRSLVQKEGEAFLANHTLVGAKSSLPRKGSSLSIAERRGSNPPPRMMLPLASESSRVSKVRVRSRSFSLPALDDT

SEQ ID NO: 149260 - protein, 804 aa, Glycine max
  Coding DNA Sequence Number=SeqID_57575
  Gene Ontology: Mol. function=metal ion binding; Cellular component =plasma membrane; Biological process=cytokinin metabolic process
  Homolog annotation: Hit_ID=A7P478; Match level="QueryCoverage=50%, HitCoverage=93%, E-value=1e-159, Identity=71%"; Hit description =Chromosome chr1 scaffold_5, whole genome shotgun sequence
  Pfam annotation: Domain name=Cellulase; Domain location=391-663; Score=-11.9; E_value=7.7e-06; Accession=PF00150.9; Description =Cellulase (glycosyl hydrolase family 5)
  Pfam annotation: Domain name=Copine; Domain location=156-304; Score =308.7; E_value=1.1e-89; Accession=PF07002.7; Description=Copine
  Pfam module annotation: Pfam domain module=Cellulase::Copine; Domain location=391-663::156-304
MAMVGVSPGDYWSDGRKLRLQGMTSGDMETDRDSESIMGGKSSKGSERRHVSSYGSAGSSSSWDDYEYPQSPNAYPQQNPYHTPLHHRAPAPFHDYSQPKRKLDRRYSRIADDYHSLDEVTTALSHAGLESSNLIVGIDFTKSNEWTGKRSFNRKSLHHIGSGQNPYEQAISIIGKTLSVFDEDNLIPCFGFGDASTHDQDVFSFHSDERFCNGFEEVLSRYRDIVPRLRLAGPTSFAPIIEMAMTIVEQSGGQYHVLLIIADGQVTRSVDTQHGQLSPQEEKTIGAIVKASGYPLSIVLVGVGDGPWDMMREFDDNIPARAFDNFQFVNFTEIMSKGIDSSRKETEFALSALMEIPSQYKATIDLGILGSARRGHSPDRVPLPPPHYERASSSSTTSFRSNSFQHSTPTYDNVNAESSSRSSYDNKVCPICLTNGKDMAFGCGHQAVVKSLGDNDVMVILDNHITQPGWCCSNSDGNGFFGDKFFNPDQWILGLTKMATLFNGVTNVVGMNLRNELRGPKQNVNDWYKYMVKGAEAIHAANPDVLVILSGLNYDKDLSFIQKRPVSLTFKGKLVYEAHWYAFTDGQAWVNGNPNQVCGQVAGNMMRTSGFLVNQGWPLFISEFGGDLRGTNVNHNRYLNCFLALAAELDLDWALWTLVGSYYFRQGVIGMEEFYGILSWDWIQVRNTTFLNRISALQLPFRAGSEGMPATLGIMCSDPNSRWEMISDSKLHLSSKLSDDSNVCLDVDDNNNIVTNACKCLSKDRTCDPSSQWFKPIDSGSRSMLTTSTSSMLYKFIGPFMEAV

SEQ ID NO: 149261 - protein, 852 aa, Glycine max
  Coding DNA Sequence Number=SeqID_57576
  Gene Ontology: Mol. function=nucleic acid binding; Cellular component= nucleus; Biological process=red or far red light signaling pathway
  Homolog annotation: Hit_ID=Q9M0V3; Match level="QueryCoverage=99%, HitCoverage=83%, E-value=0.0, Identity=77%"; Hit description=DNA damage-binding protein 1a
  Pfam annotation: Domain name=CPSF_A; Domain location=574-791; Score =260.0; E_value=5e-75; Accession=PF03178.6; Description=CPSF A subunit region
MDNKDARHVKTYEVALKDKDFVEGPWSQNNLDNGADLLIPVPPPLCGVLIIGEETIVYCSANAFKAIPIRPSITKAYGRVDPDGSRYLLGDHTGLVSLLVIIHEKEKVTGLKIEPLGETSIASTISYLDNAFVYVGSSYGDSQLIKLNLQPDAKGSYVEVLERYVNLGPIVDFCVVDLERQGQGQVVTCSGAYKDGSLRVVRNGIGINEQASVELQGIKGMWSLRSSTDDPFDTFLVVSFISETRILAMNLEDELEETEIEGFCSQVQTLFCHDAVHNQLVQLLFHLPLANKPALQVTSSSVRLVSSTTRDLRNEWHAPSGYSVNVATANATQVLLATGGGHLVYLEIGDGILQEVKHAQLEYEISCLDINPIGENPNHSNLAAVGMWTDISVRIFSLPDLSLITKEQLGGEIIPRSVLLCAFEGISYLLCALGDGHLLNFMLNTSTGELTDRKKVSLGTQPITLRTFSSKNTTHVFAASDRPTVIYSSNKKLLYSNVNLKEVSHMCPFNSAAFPDSLAIAKEGELTIGTIDDIQKLHIRSIPLGEHARRICHQEQSRTFAICSLKYNPASGEDSEMHFVRLLDDQTFEFISTYSLDTYEYAINQKIQLYKWVLRDDGTHELQSECGHHGHILALYVQTRGDFIVVGDLMKSISLLIYKHEEGAIEERARDYNANWMSAVEIVDDDIYLGAENSFNLFTVRKNSEGATDEERGRLEVVGEYHLGEFVNRFRHGSLVMRLPDSDVGQIPTVIFGTINGVIGVIASLPHEQYVFLEKLQSNLRKVIKGVGGLSHEQWRSFNNEKKTVEARNFLDGDLIESFLDLNRSKMDEISKAVDVSVEELCKRVEELTRLH

SEQ ID NO: 149262 - protein, 81 aa, Glycine max
  Coding DNA Sequence Number=SeqID_57577
  Homolog annotation: Hit_ID=P94077; Match level="QueryCoverage=45%, HitCoverage=19%, E-value=5e-10, Identity=89%"; Hit description=Zinc -finger protein Lsd1
MEGFQSLSIDPMGQTMLEHYLLHQHKDVLAVFCSDYIILFHYLQSMPQSQSQTVVVENPMSVDSSGKLVSNVVVGVTTDKK

SEQ ID NO: 149263 - protein, 1053 aa, Glycine max
  Coding DNA Sequence Number=SeqID_57578
  Gene Ontology: Mol. function=DNA binding; Cellular component=nucleus; Biological process=embryonic development ending in seed dormancy
  Homolog annotation: Hit_ID=Q9SUN9; Match level="QueryCoverage=92%, HitCoverage=94%, E-value=1e-179, Identity=52%"; Hit description =Putative uncharacterized protein F9F13.50
  Pfam annotation: Domain name=FYRC; Domain location=861-956; Score =84.3; E_value=3.8e-22; Accession=PF05965.5; Description=FY rich C -terminus
  Pfam annotation: Domain name=FYRN; Domain location=809-857; Score =56.4; E_value=1e-13; Accession=PF05964.5; Description=FY-rich N -terminus
  Pfam annotation: Domain name=JmjC; Domain location=312-428; Score =237.9; E_value=2.2e-68; Accession=PF02373.13; Description=JmjC domain
  Pfam annotation: Domain name=JmjN; Domain location=72-116; Score =84.3; E_value=3.9e-22; Accession=PF02375.8; Description=jmjN domain
  Pfam annotation: Domain name=zf-C5HC2; Domain location=513-565; Score= 32.1; E_value=2e-06; Accession=PF02928.7; Description=C5HC2 zinc finger
  Pfam module annotation: Pfam domain module=FYRC::FYRN::JmjC::JmjN::zf- C5HC2; Domain location=861-956::809-857::312-428::72-116::513-565
MWMVFICYMTSFVFWGLERLEISHPGGGLDNPLRHKPEMENTLESPGSSRHRKISARWDPVDACRPIVDEAPVFYPTIEEFEDTLGYIAKIRPQAELYGICRIVPPACWVPPCPLKEKDLWENAKFPTRIQQIDLLQNREPMRKKIRGRKRKHRKQSKMGMGRRTAKSGSEANVASEPEEKFGFQSGSDFTLKDFQQYASVFKDCYFGLNDANEHEKVSDNSHQQRWKPSVEEIEGEYWRIIEQPTDEVEVYYGADLETGSLGSGFPKISSLTKNESDRYTLSGWNLNNFPRLSGSALCFEGSDISGVVVPWLYVGMCFSSFCWHVEDHHLYSLNYLHWGDPKVWYGIPGSHAPGLEDAMRKHLPDLFEEQPNLLNELVTQLSPSVLKSEGVPVHRTVQHSGEFVVTFPRAYHCGFNCGFNCAEAVNVAPVDWLLHGQNAAELYSSQCRKTSLSHDKLLFGCAQEAVHALADLTLHGKEDLKYIKWRSACGKDGVLTKAVKIRITMEKERLDCIPTHLKMLKMDSCKCSPDCYSCLKHSNLFCSCEMNNRFILFRYTMDELSTLVEALEGESHAIEVWANRNTVMVSADAEDACIYKQDVESAICQTQSYKEGKNSTYCAGTNDKSNSTIPSSSYSQISAELVHSEFHHETLSAPSDTKDCHKDSLNEKDLAMDNKIMVGTGGSVDLNIDVMSGEPENYFLHAADYHHNKGVPYVEKVCFAETRKEQDNMEPGADCIASLEKEFSSCSRDVQNSCTLDGYKLFGVDLQMHSDSGEQLNSVSKMGVVETSNTSISLTNQSSLMNNFGISVEPVNLGSVMCGKLWCSKHAIYPKGFKSRVKLFSILDPPRICNYVSEVYGAGFLGPIFKVTMEERPNEAFTNTSADKCWETVLDRLNHEIKRRRSRGEIELPPLELLQSINGHKMFGFLSPSIIQAVEAADPKHQCVEYWNHKEVVSESSGSAIDDCKFSHGSSNSLGDVKTKLFGAGLIKQEQDSIIGNCDSFEEMKLVLQGFLKKASPNELSAMHKLFSSDALFTQWRTAFVSLIEEIQKACA

SEQ ID NO: 149264 - protein, 137 aa, Glycine max
  Coding DNA Sequence Number=SeqID_57579
MGPRAVGEARGEEACRGREKRRSFLRKRHTILLGAPSISLYWGGADIVLKSLSTFIRVTKSGDDTLMEDKSGVDSTKGFNLDKSEISSTRNSERSSHEYTIFGIHINKKSIDAMQQLHKRINEYNIVIFIDNSRLYS

SEQ ID NO: 149265 - protein, 103 aa, Glycine max
  Coding DNA Sequence Number=SeqID_57580
MSSSRWNLLLRKRWRWCSSSLMLMAATSSFRSTEELMELLLAANQLNLNTRNFLLMDTITDMIKNTSVEFVVSNFFTITGGSTPAAGERGTGPPSKCPGIGRG

SEQ ID NO: 149266 - protein, 162 aa, Glycine max
  Coding DNA Sequence Number=SeqID_57581
  Gene Ontology: Mol. function=protein serine/threonine kinase activity; Cellular component=cytoplasm; Biological process=protein amino acid phosphorylation
  Homolog annotation: Hit_ID=Q8RXH5; Match level="QueryCoverage=97%, HitCoverage=44%, E-value=1e-59, Identity=70%"; Hit description =Osmotic stress-activated protein kinase
  Pfam annotation: Domain name=Pkinase; Domain location=1-112; Score= -104.5; E_value=0.024; Accession=PF00069.16; Description=Protein kinase domain
SYLLHSRPHSVIGTPAYIAPEVLSGKDYDGKLADVWSCGVILYTMLVGALPFEDIKDTENFQKTIKRVMAVQYKFPERVCISQDSKNLISRIFVANPAMRITMKEIKSHPWFLKNLPKELRDGAQDVYYNEENTKYPLQSIEEIMNIVNEAKTTTATSSPYL

SEQ ID NO: 149267 - protein, 1356 aa, Glycine max
  Coding DNA Sequence Number=SeqID_57582
  Gene Ontology: Mol. function=UDP-glucose:glycoprotein glucosyltransfer ase activity; Cellular component=endoplasmic reticulum; Biological process=protein amino acid glycosylation
  Homolog annotation: Hit_ID=A7PYK5; Match level="QueryCoverage=39%, HitCoverage=97%, E-value=0.0, Identity=56%"; Hit description =Chromosome chr12 scaffold_38, whole genome shotgun sequence
  Pfam annotation: Domain name=UDP-g_GGTase; Domain location=894-1095; Score=337.3; E_value=2.6e-98; Accession=PF06427.2; Description=UDP -glucose:Glycoprotein Glucosyltrans
MGCLWRSRCRVLIVFMLLNIGSAFADTPQRPKNVQTSLRAKWSGTPLLLEAGELLSNEKKDLFWDFIEIWLNTEKDAVSSRTAKDCLKKILECGRPLLREPLKSLFELSLMLRSASPRLVLYQQLAEESLTSFPLGDENYSDNETEEKLQTEKKIERRKVDPLHGVILKSHGGKCCWVDTGEHLFLDFYELLAWLQDSAEQVGDSFQRPEIFDFDHVYYELSVGSPVAILYGAIGTNCFKEFHVALVKAAKEGKVKYVVRPVLPAGCELNINHCGSVGAGESVNLGGYGVELALKNMEYKAMDDSTVRKPELASEVMAFRDYLLSSTVSDTLDVWELKDLGHQTVQRIVRASDPLQSMQEINQNFPSVVSSLSRMKLEDSVRDEIMANQRMVPPGKSLMALNGALVNVEDIPQGTLKKLLSTSPPSESSIPRVDFRSSHVHYLNNLEEDAKYKQWRNNLDESIDMIISLYENDFPVRFGIVLYSSKFVTQLENHATKEHSDEDISTMIICLFSYINENYGAEMAYQFLRNEALIDALSDETQRIQEQVYYGQMMSDTDVLAKFLSEAGIQRYNPKIISDSKPRFIPLSMFTLGEESVLNDIVYLHSPGTIDDTKAVTHLLAVDITSRNGMKLLQQGIHYLTNVLDFLDQLCSLYEKNYILSPAMEAESTEAFVDMVCELSKANGLPSKGYRFALPEFPAGEVRKHFTKNSLYRVLGLESGVNAVFTNGRRMDSLSDEGWEWDLKWRRELFDSELDMAVRFLEDLQGISIHPERRDKWIWKEDVSELWKVKVPSKVALFVWRLIRDRLPTKTNLRKRNQNHATLVGIIIVDQYLSPVSSEPPIGIRLFLKRKGLMTVRSWRMPYSSARPAHLFLHFSATTDLLSSWEVLKNVGKFISDIVMALSSSMAKRDRNSESARFEILNDQHSAIILNNENSSIHIDAVLDPLSPTSQRLSGILRVLWKYIQPSMRIVLNPVSSLADLPLKSYYRYVVPTMDDFSNTDSAINGPKAFFANMPLSKTLTMNLDVPESWLVEPVIAFHDLDNILLENLGNTRTLQAVFELEALVLTDHDPPRGLQLILGTKTTPHLVDTLVMDNLGYWQMKVSPGVWYLQLAPGRSSELYILKEDSEGNYDKKSSKLITINDFRGKVFHMEVVKKKGKEHEKLLLLDDNAQDNKKGSGLNSNFLKWASGFIGSNKSSKKAEKSPQPGGFYLSSGMQSSLCASCQFARYERFMKIMILSVLKNTHRPVKFWFIKNYLSPPFKVIFVDADQVVRADMGVLYDMDIRGKPLAYTPFCDNNKEMDGYSALYVVDLKKFRETAAGDNLRVIYETLSKDPNSLANLDQENFRRYLSFTQTK

SEQ ID NO: 149268 - protein, 376 aa, Glycine max
  Coding DNA Sequence Number=SeqID_57583
  Gene Ontology: Mol. function=protein dimerization activity; Cellular component=nucleus; Biological process=regulation of transcription, DNA-dependent
  Homolog annotation: Hit_ID=A9PHN3; Match level="QueryCoverage=98%, HitCoverage=98%, E-value=1e-129, Identity=66%"; Hit description =Putative uncharacterized protein
  Pfam annotation: Domain name=bZIP_1; Domain location=233-291; Score =23.8; E_value=0.00063; Accession=PF00170.12; Description=bZIP transcription factor
  Pfam annotation: Domain name=bZIP_2; Domain location=229-282; Score =6.6; E_value=0.092; Accession=PF07716.6; Description=Basic region leucine zipper
  Pfam module annotation: Pfam domain module=bZIP_1::bZIP_2; Domain location=233-291::229-282
  Subcellular localization annotation: CTP_CleavageSite=35; ConfidenceScore=5.31e-01
MANSKGSSSFRNFMYPGKHPLLPPKSPFPSVSQAYADYVPNPAVGLKAGNRPRDGNTHHQRTSSESLVIEEQPSWLDDLLNEPETPVRRGGHRRSSSDSFAYIDTVNASNLNYASQDEYKYKNMMSIPPWSPQDFDCSKDARHVPVYAEMNSTKQKNRSWDSFSNAMTNPVGVPSGKDSAAFQSSGLQCTPHEADALPPAASEKHDSVELGLQDAKSFPEKKDISHAKSSASETDTKRAKQQFAQRSRVRKLQYIAELERNVQALQAEGSEVSAELEFLNQQNLILSMENKALKQRLENIAQEQLIKYLEQEVLEREIGRLRALYQQQQQPPQTQPQQQPSGSHRRSNSRELESQFANLSLKHKDTNSGQDPALRI

SEQ ID NO: 149269 - protein, 185 aa, Glycine max
  Coding DNA Sequence Number=SeqID_57584
  Gene Ontology: Mol. function=acetolactate synthase activity; Cellular component=chloroplast; Biological process=branched chain family amino acid biosynthetic process
  Homolog annotation: Hit_ID=A7QAY2; Match level="QueryCoverage=100%, HitCoverage=99%, E-value=1e-68, Identity=60%"; Hit description =Chromosome chr5 scaffold_72, whole genome shotgun sequence
  Pfam annotation: Domain name=ACT; Domain location=7-73; Score=44.3; E_ value=4.4e-10; Accession=PF01842.16; Description=ACT domain
TSGIRSHTLSMLVNDAPGVLNIVTGVFARRGYNIQSLAVGHAEVEGLSRLTTVVPGTDESISKLVQQLYKLVELHEVRDITHLPFAERELMLIKIAVNAAARRDVLDIASIFRAKAVDVSGHTITLEPVLDQQFSADPASYHQFKASAVLNMLSDNWLVARTGRIALVRESGVDSKYLRGYSYPL

SEQ ID NO: 149270 - protein, 789 aa, Glycine max
  Coding DNA Sequence Number=SeqID_57585
  Gene Ontology: Mol. function=calcium ion binding; Cellular component =mitochondrion; Biological process=multicellular organismal development
  Homolog annotation: Hit_ID=A7QAX6; Match level="QueryCoverage=89%, HitCoverage=86%, E-value=0.0, Identity=66%"; Hit description =Chromosome chr5 scaffold_72, whole genome shotgun sequence
  Pfam annotation: Domain name=LETM1; Domain location=215-512; Score =473.3; E_value=3e-139; Accession=PF07766.4; Description=LETM1-like protein
  Subcellular localization annotation: CTP_CleavageSite=22; ConfidenceScore=5.18e-01
MASRAILRRRRSLIHQYLNNCFASSSPSPSNRSLEFAIATTSPLFPCKHGTTPYRDGLFHRFGLGQLVPRFGSAVPLDGFSGLNAPIGVRWLSQSAAAAAKRHEPDENDETVAKKRKEASPEECDQAVEGLTTAKAKAMAKRAQEESQKDVQSVLRRVWTAFLGIGPALRAVASMSRNCGVVAAIAICCCRLKYETVKCLFVGDLAFREDWAKKLVHWKGEFVSTLQHYWLGSKLLWADVRISSRLLLKLAGGRSLSRRERQQLTRTTADIFRLVPFAVFIIVPFMELLLPVFLKLFPNMLPSTFQDKMKEQEALKRRLKARIEYARFLQDTVKEMAKEVQNSRSGELKKTAEDLDEFLNTIRRGATVSNEEILGFAKLFNDELTLDNISRPRLVNMCKYMGISPFGTDAYLRYMLRKHLRRIKEDDKLIQAEGVDSLSEDELQEDCRERGMLGMLSVEEMRQQDIETSVFLNIKCYFGVSILKFVNLPVQLRDWLDLSLNHSVPSSLLILSRSFTVSGRLKPEEAVQATLSSLPDEVVDTIQVTSLPSEDSVSERRRKLEFLEMQEELIKEEEEREEVVQRMESSSSQDDKALKEMNVSTAKEAHQLARDRAFENKEQLCELSRALAVLASASSVSTEREDFLRLVNKEIELYNSMVEEEGPNGKKDAFKAYKAAREEHEHTNELDEGDKVSSALIGRVDAMLQNLEKEIDDVDAKIGDRWRLLDRDYDGKVTPEEVASAAMYLKDTLGKEGIQELVSSLSKDRDIVKLGSWREDGNAHEDDETRERL

SEQ ID NO: 149271 - protein, 2147 aa, Glycine max
  Coding DNA Sequence Number=SeqID_57586
  Gene Ontology: Mol. function=calcium-dependent cysteine-type endopeptidase activity; Cellular component=intracellular; Biological process=proteolysis
  Homolog annotation: Hit_ID=A7P092; Match level="QueryCoverage=92%, HitCoverage=92%, E-value=0.0, Identity=75%"; Hit description =Chromosome chr6 scaffold_3, whole genome shotgun sequence
  Pfam annotation: Domain name=Calpain_III; Domain location=1963-2100; Score=-34.2; E_value=0.00022; Accession=PF01067.13; Description =Calpain large subunit, domain III
  Pfam annotation: Domain name=DUF554; Domain location=652-861; Score= -144.5; E_value=0.093; Accession=PF04474.3; Description=Protein of unknown function (DUF554)
  Pfam annotation: Domain name=Peptidase_C2; Domain location=1660-1961; Score=271.9; E_value=1.4e-78; Accession=PF00648.12; Description =Calpain family cysteine protease
  Pfam annotation: Domain name=Voltage_CLC; Domain location=687-1052; Score=-183.0; E_value=0.075; Accession=PF00654.11; Description =Voltage gated chloride channel
  Pfam module annotation: Pfam domain module=Calpain_III::DUF554::Peptid ase_C2::Voltage_CLC; Domain location=1963-2100::652-861::1660 -1961::687-1052
MAKYLARSSTSFALWFPESFCMGSCYFSNSGTYHLGLLVDCNIGSRPDWFGCNNGWHCPSIGILFNYALVENSVAKLKLYWIQCKPGAVAILLLLAVALLCAYELCAVYVTTGSRASDRYSPSGFFFGVSAIALAINMLFICRMVFNGNGLDVDEYVRRAYKFAYSDCIEVGPVACLPEPPDPNELYPRQSRRASHLVLLYLGSLCVLLVYSILYGLTAKEENWLGAITSVAVIILDWNLGACLYGFQLLDSRVAALFIAGTSRVFLICFGVHYWYLGHCISYAVMASVLLGAAVSRHWSATNPLAARRDALQSTVVRLREGFRRKEHNSSSSFSEGCGSSMKRSSSVEAGNLGNVIEAGRAMAAGDGSNWNNVLSQTTSLPDGINSDKSIDSGRSSLALHSSSCRSVVHEPEVGTSSDDRNLDHNNSLVVCSSSGLDSQGNDSSASNSANQQTLDLNLALAFQESLNDPRIATMLKSRTRQGDRELSSLLQDKGLDPNFAMMLKEKSLELDPTILALLQRSSMDADRDHNENTDNTSVDNAMPNQISLSEELRLHGLEKWLQLCRLVLHHITGTPERAWVLFSFIFILETIIVAIFRPKTIKIINATHQQFEFGLAVLLLSPVICSIMAFLRSLTAEEMSMTSKPRKYGFIAWLLSTCVGLLLSFLSKSSVLLGISLTVPLLVACLSVAIPIWICNGYQFWVPRVNCTGSAGNDRIPRTKEGIVLLISMSVFVGSVLALGAIVSAKPLDDLRYKGWNGDPKILGSPYTSSVFLGWAMASAIGLVVTSVLPIISWFATYRFSLSSAIFIGLFAVILVAFCGVSYLEVIKTRDDQVPTNGDFLAALLPLVCIPAVLSLCCGLLKWKDDDWKLSRGVYIFVIIGLLLLLGAISALIVVVKPWTIGVAFLLVLLLMVLAIGAIHHWASNNFYLSRTQMVFVCFLAFLLALAAFLVGWFEGKPFVGASVGYFSFLFLLAGRALTVLLSNPIVVYSPRVLPVYVYDAHADCGKNVSVAFLMLYGIALATEGWGVVASLKIYPPFAGAAVSAITLVVSFGFAVSRPCLTLKMMEDAVHFLGKETVIQAIARSATKTRNALSGTYSAPQRSASSAALLIGDPTIMRDRAGNFVLPRADVMKLRDRLRNEELVAGSFFSRLRYHRTFRHEPTSDVDHRRVMCAHARILALEEAIDTEWVYMWDKFGGYLLLLLGLTSKAERAQDEVRLRLFLDSIGFSDLSAKKIKKWMPEDRRQFEIIQESYIREKEMEEEVFMQRREEEGRGKERRKALLEKEERKWKEIEASLLSSIPNASSREAAAMAAAVRAVGGDSVLDDSFARERVSSIARRIRASQLSRRALQTGVAGAICVLDDEPTASGRHCGPIDSSLCQSQKVSFSIALMIQPESGPVCLLGTEFQKKICWEILVAGSEQGIEAGQVGLRLITKGDRQTTVAKEWSISATSIADGRWHIVTMSIDADLGEATCYLDGGFDGYQNGLPLCVGSSIWEQGTEVWVGVRPPTDIDAFGRSDSEGVESKMHIMDAFLWGRCLTDDEVSSLYTSMASADFGALDFPEDNWQWADSPSRVDGWDSDPADVDLYDRDDVDWDGQYSSGRKRRSERDGMVVDIDSFSRKYRKPRIETQEEINQRMLSVELAIKEALYARGETRFTDQEFPPNDHSLFVDPANPPAKLQVVSEWLRPGEIGRQNHLDCRPCLFSGAPNPSDVCQGRLGDCWFLSAVAVLAEVSRISEVIITPDYNEEGIYTVRFCVQGEWIPVVVDDWIPCELPGKPAFATSKKAYELWVSILEKAYAKLHGSYEALEGGLVQDALVDLTGGAGEEIDMRSGEAQIDLASGRLWSQLLRFKQEGFLLGAGSPSGSDVHISSSGIVQGHAYSILQVRDVDGHKLVQIRNPWANEVEWNGPWSDSSPEWTDRIKHKLKHVPQSKDGIFWMSWQDFQIHFRSIYICRIYPSEMRHSVHGQWRGYSAGGCQDYDTWNQNPQFRLTATGQDASFPIHVFITLTQGVGFSRTTAGFRNYQSSHDSQMFYIGMRILKTRGRRAAFNIYLHESVGGTDYVNSREISCEMVLEPEPKGYTIVPTTIHPGIAYMYLVLLISFSAWVLGGSCTCTAGALLRTIGIEILFLGEMMASVREMDEV

SEQ ID NO: 149272 - protein, 731 aa, Glycine max
  Coding DNA Sequence Number=SeqID_57587
  Gene Ontology: Mol. function=protein binding; Cellular component =cytoplasm; Biological process=humoral immune response
  Homolog annotation: Hit_ID=A5C6V5; Match level="QueryCoverage=89%, HitCoverage=90%, E-value=1e-163, Identity=48%"; Hit description =Putative uncharacterized protein
  Pfam annotation: Domain name=YTH; Domain location=521-612; Score =169.8; E_value=7.4e-48; Accession=PF04146.6; Description=YT521-B -like family
MFSCSFTPVCTEATDLLQKLSLETQPKPLEIPEPTKKATGNQYGSVDSGNAANGQIPSYDRSVTPVLQDFIDPTMCYLPNGYPSTAYYYGGYDGTGNEWDDYSRYVNSEGVEMTSASIFTFLLSKILGVYGDNGSLLYHHGYGYAPYGPYSPAGSPVPTMGNDGQLYGPQHYQYPPYFQPLTPTSAPFTPTPAVLPQGEVSTSVAADQKPLPVEAANGNSNGVSNGGNAKGNNAAAPIKQANQNSSFSSKASNERVAMPGRGPTSGYQDPRFGYDGVRSPIPWLDAPLFSDGQPRPVSSTTITSSISGGNNTASRSQTFRPNSQFMGLHHPRPMPAMGATHSFINRMYPNKLYGQYGNTVRSGMGYGTHGYDSRANGRAWLAVDSKYKTRGRSGGYFGYGNENVDGLNELNRGPRAKGGKNQKGFAPTILAVKGQNLPASLGTDEEKDKTSTVPDRDQYNKADFPEEYTDAKFFVIKSYSEDDIHKSIKYNVWASTQNGNKKLDAAYHEAQQKPGGCPVFLFFSVNTSGQFVGLAEMIGPVDFNKSVEYWQQDKWNGCFPLKWHVVKDVPNNLLRHITLDNNENKPVTNSRDTQEVWEGKPADEKIEINGEVNTQKSEVSSEVLKESLAEKDSDDHKVPENGCATKTGDAPKGAKPVVPESKIVANGSEDRDWLPSEDKDLYIEIGWAELLHRMLAPIPSHWVLFTVSSFTLLLSTGVEARWEILKNIVGF

SEQ ID NO: 149273 - protein, 874 aa, Glycine max
  Coding DNA Sequence Number=SeqID_57588
  Gene Ontology: Mol. function=protein dimerization activity; Cellular component=nucleus; Biological process=regulation of transcription, DNA-dependent
  Homolog annotation: Hit_ID=Q5D1M3; Match level="QueryCoverage=97%, HitCoverage=99%, E-value=0.0, Identity=82%"; Hit description=Class III HD-Zip protein 4
  Pfam annotation: Domain name=Homeobox; Domain location=36-94; Score =63.5; E_value=6.9e-16; Accession=PF00046.20; Description=Homeobox domain
  Pfam annotation: Domain name=MEKHLA; Domain location=725-874; Score =297.5; E_value=2.6e-86; Accession=PF08670.2; Description=MEKHLA domain
  Pfam annotation: Domain name=START; Domain location=184-404; Score =207.7; E_value=2.8e-59; Accession=PF01852.10; Description=START domain
  Pfam annotation: Domain name=bZIP_1; Domain location=75-134; Score =11.4; E_value=0.019; Accession=PF00170.12; Description=bZIP transcription factor
  Pfam module annotation: Pfam domain module=Homeobox::MEKHLA::START::bZ IP_1; Domain location=36-94::725-874::184-404::75-134
MKECGGSLGGEGKEEEDYSKQRDSASNKQQLMDCGKYVRYTPEQVEALERVYIECPKPSSSRRQQIIRECPLLANIETKQIKVWFQNRRCREKQRKEASRLQTVNRKLSAMNKLLMEENDRLQKQVSQLVYDNGFMKQQIHTASATTTTDNSCESVVVSGQRQHQNPKIQHPQWDANNPAGLLAIAQETLAAFLSKATGTAVNWVQMIGMKPGPDSIGIVAVSRNCSGVAARACGLVSLEPTKVAEILKDRPSWYRDCRCLNVLSVIPTGNGGTIELMYMQTYAPTTLAAARDFWTLRYTTSLEDGSLVICERSLTSSTGGPTGPAASNFVRAEMLPSGYLIRSCEGGGSIVHIVDHVDLDVRKIKLFKSFCLECPEVLRPLYESPKFLAQKLTTAALRNVRQIAQESSGEVQYGGGRQPAVLRTFSQRLCKGFNDAVNGFVDDGWSLMGNDGVEDVTIGINSSPNKFFSSHYNTSMLPAFGGGVLCAKASMLLQNVPPALLVRFLREHRSEWANYGVDAYSSACLKASPYAVPCARPSGFPSSHVIIPLAHTIEHEEFLEVVRIEGNAFPPDDVALACDMYLMQLCSGIDENAIGACAQLVFAPIDESFADDALLLPSGFRIIPLDPKTDGPASTRTLDLASTLETGSGNARSAGESDLNNYNLRSVLTIAFQFTFENHLRDNVAVMARQYVRNVVRSVQRVAMAIAPSRISTQLGPKSLPGPPEALTLARWICKSYSLHTCTELFSVESTSGDAILKQLWHHPDAILCCSVKTNASPVFTFANQAGLDMLETTLVALQDIMLDKVLDEAGRKFLCIEFSKIMQQGFAYLPAGICVSSMNRPVSYEQAIAWKVLDDDDSNHCLAFVFMNWSFV

SEQ ID NO: 149274 - protein, 904 aa, Glycine max
  Coding DNA Sequence Number=SeqID_57589
  Gene Ontology: Mol. function=P-P-bond-hydrolysis-driven protein transmembrane transporter activity; Cellular component=chloroplast outer membrane; Biological process=intracellular protein transport
  Homolog annotation: Hit_ID=Q9LKR1; Match level="QueryCoverage=92%, HitCoverage=61%, E-value=1e-171, Identity=69%"; Hit description =Chloroplast protein import component Toc159
  Pfam annotation: Domain name=AIG1; Domain location=319-510; Score =55.3; E_value=3.3e-15; Accession=PF04548.7; Description=AIG1 family
  Pfam annotation: Domain name=MMR_HSR1; Domain location=319-417; Score= 16.6; E_value=3.3e-05; Accession=PF01926.14; Description=GTPase of unknown function
  Pfam annotation: Domain name=Miro; Domain location=320-447; Score= -1.3; E_value=0.013; Accession=PF08477.4; Description=Miro-like protein
  Pfam module annotation: Pfam domain module=AIG1::MMR_HSR1::Miro; Domain location=319-510::319-417::320-447
ENGFEPIEKGEEESVDGGDESAVGPVHDGQSGTEGVGVGENGVEGDGLKSDIDVPPEEGGGGSEFVEKNEVKMEGDVGQHGDREIDDSVLDGEIGSHVEEIGGNGEREINGSVSDEKGDGLVFGSTEAANKFLEDLELHQSRDAERIVTDSDEEEESDDEGEGKELFDTATLAALLKAASGADQDGGSITITSQDGSRLFSVERPAGLGSPLQSGKPAVRQTRPSLFTPSMSRPSAISDSNLSQEEKNKLEKLHEIRVKYLRLVHRLGFTTEESIAAQVLYRMTLVAGRQSGQMFSVESAKETASRLEAEGRDDFDFSVNILVLGKAGVGKSATINSIFGETKTSINACGPATTSVKEIVGVVDGVKLRIFDTPGLKSSALEQNFNMKVLSAVKKLTKKSPPDIVLYVDRLDLQTRDMNDLPMLRSITSVLGSSIWRNVIVTLTHAASAPPDGPSGAPLSYEVFVAQRSHTVQQTIGQAVGDLRLMNPSLMNPVSLVENHPSCRKNRDGQKTHTYPKLPADQSGPDNGDSDVEMADLSDSDLDEDEDEYDQLPPFKPMKKSQVAKLTKEQQKAYFDEYDYRVKLLQKKQWREELRRMREMKKKGNTKENDYGYMEEDDQENGSPAAVPVPLPDMAMPPSFDSDNPAYRYRFLEPTSQLLTRPVLDNHGWDHDCGYDGVNIEQSLAIINKFPAAVTVHVTKDKKDFTIQLDSSVAAKLGENGSAMAGFDIQSVGKQLSYSVRGETKLKNFKRNKTSAGVSVTYLGENVCTGLKVEDQIAVGKRLVLVGSTGVVKSKTDSAYGANVEVRLREADFPIGQDQSSLSLSLVKWRGDLALGANLQSQISVGRGYKVAVRAGLNNKLSGQITVRTSSSDQLQIALVAILPIAKAIYKNFWPGASENYSIY

SEQ ID NO: 149275 - protein, 262 aa, Glycine max
  Coding DNA Sequence Number=SeqID_57590
  Gene Ontology: Mol. function=hydrolase activity
  Homolog annotation: Hit_ID=A7QRA3; Match level="QueryCoverage=65%, HitCoverage=54%, E-value=7e-53, Identity=58%"; Hit description =Chromosome chr13 scaffold_149, whole genome shotgun sequence
MEKSEGMDVSILCALGKDILLDLLENPILVSASNSLKANSERKFSVSDESSPERSKWVYIFQREYATVDPALVDFVGTDEATTCVGLVIRNQKNGMTSVAHMDSPKIVEMGLSQMLSSLVDNSLETEFDHANGSTVSESPADLDGYSFPLCLKIVHTLWSREEKFHIRTICVLGHNTRRDSDGNTYPFFNGFVLLYCFLVNNYMHFQPLNGIFDFSHPFRRRLQQESSSQLSLIELLDVQMKLSEEYEYPCLMKMPTGTESY

SEQ ID NO: 149276 - protein, 220 aa, Glycine max
  Coding DNA Sequence Number=SeqID_57591
  Gene Ontology: Mol. function=4-alpha-hydroxytetrahydrobiopterin dehydratase activity
  Homolog annotation: Hit_ID=Q6QJ72; Match level="QueryCoverage=27%, HitCoverage=32%, E-value=1e-23, Identity=80%"; Hit description =PCD/DCoH-like protein 2
  Pfam annotation: Domain name=Pterin_4a; Domain location=115-210; Score=57.6; E_value=4.3e-14; Accession=PF01329.10; Description =Pterin 4 alpha carbinolamine dehydratase
MSEDAAHTLMPQRFTKEHGKTHILPRRTEIVIYFAKRNCRMGSRCSVRQSRGEEEVVETAEQQLGWLLFCTPVVLILIVRWLSSMENSYWFFSASLPGERQGRTHQGLSEGSSPWGVAQPSGSEKKKKKQAAPFKQDGVMKLRRSWAVKTFTKGLEFFRIVAVLAENEGHHPDLHLVGWNNVTIEIWTHAVGGLTENDFILAAKIDKLDVLDLLRRKPSD

SEQ ID NO: 149277 - protein, 123 aa, Glycine max
  Coding DNA Sequence Number=SeqID_57592
  Gene Ontology: Cellular component=integral to membrane
  Homolog annotation: Hit_ID=A7P797; Match level="QueryCoverage=98%, HitCoverage=26%, E-value=1e-20, Identity=46%"; Hit description =Chromosome chr9 scaffold_7, whole genome shotgun sequence
MAVHGSKRWAVKWVAEKVLVAFLLVSVYVASSQQNTDQKTISSASNETKGVDTKAHHAEGFYKHTWPEMKFGWKIIVGSIIGFLGSAFGTVGGVGGGGIFVPMLTLIIGFDARSATAISKCKN

SEQ ID NO: 149278 - protein, 469 aa, Glycine max
  Coding DNA Sequence Number=SeqID_57593
  Gene Ontology: Mol. function=ATP-dependent peptidase activity; Cellular component=integral to membrane; Biological process=ATP -dependent proteolysis
  Homolog annotation: Hit_ID=A7P797; Match level="QueryCoverage=87%, HitCoverage=85%, E-value=1e-128, Identity=56%"; Hit description =Chromosome chr9 scaffold_7, whole genome shotgun sequence
  Pfam annotation: Domain name=DUF81; Domain location=73-437; Score= -1.3; E_value=1.1e-05; Accession=PF01925.10; Description=Domain of unknown function DUF81
  Pfam annotation: Domain name=Voltage_CLC; Domain location=16-411; Score=-167.0; E_value=0.011; Accession=PF00654.11; Description =Voltage gated chloride channel
  Pfam module annotation: Pfam domain module=DUF81::Voltage_CLC; Domain location=73-437::16-411
MAVHVPRRWDVKWVVGKALIAFLLLVSVSATSSHQNTDNKTTSPSNGTIGVDHHAKAFYKHHWPSMKFGWRIIVGAVVGFLGSAFGTVGGVGGGGIFVPMLTLIVGFDQKSATAISKCMITGGATATVFYNLRQRHPTLDLPVIDYDLALLFQPMLMLGISIGVAFNVIFPEWMLTVLLIIFFVGISVKSFFKGVDTWKKETIMKKEAKKNSRIDDIGSPEDDAHYIQTGDPTKDDTNQSRKKVSIIENIRWKELGLLFAGWIMILALEIGKKHTTTCSRLYWLSNLLQVPIAVGMSSYEAVRLYKGKRIIASKGDKQTHWCVLQLVLFCACGTLAGMIAGLLGLGGGFILGPLFLGLGIPPQVASATSTLVMAFSASMAVVEYYLLKRFPVPYALYFVAIATAAALVGQHLVRKAIAILGRASVIIFILTLTLSVSAVLLGGVGIAHMIQKIENKEYMGFGDLCTYRK

SEQ ID NO: 149279 - protein, 65 aa, Glycine max
  Coding DNA Sequence Number=SeqID_57594
MTPRESVRTRKSICWGLLFKISVVEAWVVDEPSFAMASTHKFPSRKCSQGVKLAWPLPHTIFNPC

SEQ ID NO: 149280 - protein, 1064 aa, Glycine max
  Coding DNA Sequence Number=SeqID_57595
  Gene Ontology: Mol. function=nucleotide binding; Cellular component =intracellular; Biological process=signal transduction
  Homolog annotation: Hit_ID=A7Q678; Match level="QueryCoverage=48%, HitCoverage=96%, E-value=0.0, Identity=72%"; Hit description =Chromosome undetermined scaffold_55, whole genome shotgun sequence
  Pfam annotation: Domain name=GTP_EFTU; Domain location=356-579; Score= 255.4; E_value=1.2e-73; Accession=PF00009.18; Description=Elongation factor Tu GTP binding domain
  Pfam annotation: Domain name=GTP_EFTU_D2; Domain location=602-669; Score=57.7; E_value=4.1e-14; Accession=PF03144.16; Description =Elongation factor Tu domain 2
  Pfam annotation: Domain name=GTP_EFTU_D3; Domain location=675-783; Score=48.7; E_value=2e-11; Accession=PF03143.8; Description =Elongation factor Tu C-terminal domain
  Pfam annotation: Domain name=Glyco_hydro_16; Domain location=816-982; Score=277.9; E_value=2.1e-80; Accession=PF00722.12; Description =Glycosyl hydrolases family 16
  Pfam annotation: Domain name=MMR_HSR1; Domain location=359-508; Score= 7.4; E_value=0.00023; Accession=PF01926.14; Description=GTPase of unknown function
  Pfam annotation: Domain name=XET_C; Domain location=1006-1058; Score =84.0; E_value=4.8e-22; Accession=PF06955.3; Description=Xyloglucan endo-transglycosylase (XET
  Pfam annotation: Domain name=zf-RanBP; Domain location=44-73; Score =24.8; E_value=0.00032; Accession=PF00641.9; Description=Zn-finger in Ran binding protein and others
  Pfam module annotation: Pfam domain module=GTP_EFTU::GTP_EFTU_D2::GTP_ EFTU_D3::Glyco_hydro_16::MMR_HSR1::XET_C::zf-RanBP; Domain location =356-579::602-669::675-783::816-982::359-508::1006-1058::44-73
MPRKVNYGLDYDDDYYDDDYDDYAYDDVDAEDYGGPDTKQETIKPGLWQCSICTYDNDESMTFCDICGVVRRPLVNTGTSNSNKTVEDVTKSPGASKLARSLFQSLQQQIAKETVLFPKPDDGFLTDGSNFYKLDNVRGEFHEIHKDFSTQSHPHLNIDPFKFNVPSPDDVVYTGLRSSKTGLKDKATNSNSQLSSSTREKNELSVQSNAESSDNLSSLMQKSRQDSSTESKLSKKVAIDLQTSGKTSNSLPESLSKDKDNNINKINSSKNGTIDIQSSKEKSGSLSTRSKVKESDNISSSSIKDGKPESISSSFSNMVVDVRFGNSDNTNAKGTHSRVSYKPEKWMLPEQAEDTLTQLNLAIVGHVDSGKSTLSGRLLHLLGRISQKEMHKYEKEAKLQGKGSFAYAWALDESSEERERGITMTVAVAYFDTMRYHVVVLDSPGHKDFVPNMISGATQADAAILVIDASLGSFEAGMDGSKGQTREHAQLIRSFGVDRVIVAVNKMDAVAYSQDRFDFIRQQLGVFLHFCGFKDSSLSWIPMSAMENQNLVASPSDARLKNWYGGPYLLDAIDSLQPPTREFSKPLLMPICDVIKSTTLGQVSASGKLEAGALRSGSKVLVMPSAVVGTVRSLERDSNACTVARAGDNVAVTLQGVDGNHVMAGDVLCHPDFPVAVAKHLELKVLVLDGASPILVGTQLEFHIHHAKEPGRVSRILSVLDPKTGKVTKKSPRCLSAKQSAVIEVILNETVCVVEFSSCKALGRVSLRSMGRTIAVGVVTRIIEEQAWIKLCSQTTGSYITLDEVYGLTLTAEGDFFEDIDITWGEHGGVNILGSNSLVLSLDQSSGSGFRSNAEYLYGRIDMQIKLVSGPNHDEIDFEFLGNLSGEPYIVHTNIYTQGIGNREQQFYLWFDPTKYFHTYTIVWNPQRIIFMVDNVPIRVFNNYEARGVPFASSQAMRLYSSLWCADQWATRGGLVKTNWSYAPFKAYYRNFDAKACVWSKGSSSCPSSPPSMTHNTWQAQDLDADGRRSLRWVQKYYMIYNYCKDYKRFPQGRPRECRLSRFS

SEQ ID NO: 149281 - protein, 155 aa, Glycine max
  Coding DNA Sequence Number=SeqID_57596
MQAMLVLVERILHNIIRFTGNQKSLFLSPLLPAAILQHHSSGSGLSNVILKVKEKFFAFLLFALSYQNKTTTWVLQVKEKFFAFLLFALSYQNKTTTWVLQVKETFFAFLLFVLSYQNNSVEDDATKYLLCFLALCTELLQMAGICRIKTTPSGG

SEQ ID NO: 149282 - protein, 239 aa, Glycine max
  Coding DNA Sequence Number=SeqID_57597
  Gene Ontology: Mol. function=hydrolase activity, acting on glycosyl bonds; Cellular component=cytoplasm; Biological process=response to DNA damage stimulus
  Homolog annotation: Hit_ID=A7PNE7; Match level="QueryCoverage=46%, HitCoverage=33%, E-value=3e-46, Identity=80%"; Hit description =Uracil-DNA glycosylase
  Pfam annotation: Domain name=UDG; Domain location=68-206; Score =126.6; E_value=7.3e-35; Accession=PF03167.10; Description=Uracil DNA glycosylase superfamily
MEHGGKDVVKLKSPKLDSKRASYITCLETDNPNGLFPTRFEAVEAHSPHIRRRQCLRALRRSTNSASRGSPKPKDPYHWPGQAMGLSFSVPEGVKVPSSLVNIFKELHQDLGCSIPTHGNLQKWALQGVLLLNAVLTVRKHHANSHAKKGWEQFTDGIIKDNLTEDGRVVFLLWGNNAREKSRNHRVFRDQMWSEEFLARLKKLEEAWKAAKNVGDKFPANTVYNKSKEPMKWIPAGEY

SEQ ID NO: 149283 - protein, 124 aa, Glycine max
  Coding DNA Sequence Number=SeqID_57598
  Homolog annotation: Hit_ID=A7QDF3; Match level="QueryCoverage=45%, HitCoverage=54%, E-value=4e-12, Identity=58%"; Hit description =Chromosome chr10 scaffold_81, whole genome shotgun sequence
MVLKSKAVFLVLLVLVVCQLSCGLGEDWSTRRLSRHNNNNKVIPPSCGELVLKSQCSENSKCRWCTSEDLDDMCFSKSEALRLPHQSMIYFKLKPWLGYIVEGREEMATFYPFALSVAKCHSNS

SEQ ID NO: 149284 - protein, 72 aa, Glycine max
  Coding DNA Sequence Number=SeqID_57599
MVSVTEQFPQGKERNFEGWEICVWKRWWHAMKQFCGGKFEGFKEILQSSAVLGFLIRHGPEAEEWSEFVKWE

SEQ ID NO: 149285 - protein, 148 aa, Glycine max
  Coding DNA Sequence Number=SeqID_57600
  Gene Ontology: Mol. function=ER retention sequence binding; Cellular component=endoplasmic reticulum membrane; Biological process=vesicle- mediated transport
  Homolog annotation: Hit_ID=A7QDG3; Match level="QueryCoverage=44%, HitCoverage=30%, E-value=3e-12, Identity=60%"; Hit description=ER lumen protein retaining receptor
  Pfam annotation: Domain name=ER_lumen_recept; Domain location=1-91; Score=-113.6; E_value=0.00011; Accession=PF00810.9; Description=ER lumen protein retaining receptor
MMHTCLMAPIHDLLGKTKSHQMIFWAFSIYLEAVAILPQLVLLQRSGNVDNLTVQYIVLSELLRYLLVAMTYPDVYWAELDFSAYVFPTLSPVLMFAQLLEDLPVPQVLFRQLCMQISSTIISSERGLDDVSFESEGTRLTPLPGKQF

SEQ ID NO: 149286 - protein, 585 aa, Glycine max
  Coding DNA Sequence Number=SeqID_57601
  Gene Ontology: Mol. function=catalytic activity; Biological process =cellular metabolic process
  Homolog annotation: Hit_ID=Q8S4X1; Match level="QueryCoverage=93%, HitCoverage=92%, E-value=0.0, Identity=76%"; Hit description=UOS1
  Pfam annotation: Domain name=ADH_zinc_N; Domain location=142-263; Score=-13.5; E_value=0.01; Accession=PF00107.17; Description=Zinc -binding dehydrogenase
  Pfam annotation: Domain name=CIA30; Domain location=277-422; Score =179.8; E_value=7.1e-51; Accession=PF08547.3; Description=Complex I intermediate-associated pro
  Pfam annotation: Domain name=Epimerase; Domain location=146-539; Score=-62.1; E_value=0.015; Accession=PF01370.12; Description=NAD dependent epimerasedehydratase family
  Pfam annotation: Domain name=NmrA; Domain location=146-546; Score= -99.9; E_value=0.017; Accession=PF05368.4; Description=NmrA-like family
  Pfam annotation: Domain name=TrkA_N; Domain location=146-298; Score= -7.3; E_value=0.031; Accession=PF02254.9; Description=TrkA-N domain
  Pfam annotation: Domain name=adh_short; Domain location=144-276; Score=-53.4; E_value=0.041; Accession=PF00106.16; Description=short chain dehydrogenase
  Pfam module annotation: Pfam domain module=ADH_zinc_N::CIA30::Epimeras e::NmrA::TrkA_N::adh_short; Domain location=142-263::277-422::146 -539::146-546::146-298::144-276
  Subcellular localization annotation: CTP_CleavageSite=34; ConfidenceScore=5.33e-01
MNIIVAFVVHMNPALFQMEAFYTTLSSPASTSVLNFQGSELPRRNLCKKSSHTIFASPTLPKPFLQICGRPQTLIYTSTRLSSGAHRATISAEAGRQNWDFGRFVKTLFFFNGFPSPAKFFDFLAEKISDPSPSEVINTMGTSDIVLVAGATGGVGRRVVDILRKKGIPVRVLVRNEEKARKMLGSDVDLVIGDITKDSTLIPEYFKGVKKVINAASVIVGPKEGDTPDRSKYSQGIKFFEPEIKGDSPEKVEYIGMRNLIKAVKDNLGLRRGKLLFGFEGINYRQLPWGALDDVVMGGVSESTFQIDPSGGENGGPTGVFKGVVSTANNGGFTSIRTKNFSEPENLSAYDGLEFRLKGDGRRYKIIVRTSSDWDTLGYTAGFDTEKGKWQSLMFSKFESDGKLNETFVEGPFELPVSSIRAYIKDPITPRFVHVSSAGVTRPERPGIDLSKQPPAVRLNKELDYILTFKLKGEDLLRESGIPYAIVRPCALTEEPAGANLIFDQGDNITGKISREEIALMCVAALDSPYACDKTFEVKSVIPFSEPFTVDPTNPPPEKDYDVYFKNLKEGITGKEALQQNPVSV

SEQ ID NO: 149287 - protein, 143 aa, Glycine max
  Coding DNA Sequence Number=SeqID_57602
MNVHSGKYRSERSDLPFFSKAHFEPFVDSSLVPSALDLRKEDLIRENLHLRKGDLAKGQLVMEVRNRLRTRCHRRSCRCLSLPFVPVLVAALRAGARRRHGVVASSELEKIAGEVAAGVEVVVGGHQAAASFKSGKGFAKVNE

SEQ ID NO: 149288 - protein, 270 aa, Glycine max
  Coding DNA Sequence Number=SeqID_57603
AIGTTSSLEPKLDNWQTQCAFHNERNIGETLRCNSRIGSGGDAILTCGWGQAGLCGGMMGYDGGRLLAKGALGYWVMLAKRHGSRDLDQRSIDIVLERIAQAFGSFILTISIVDVGSQHQTFYGELKFHVLAPIPKWVGCVLAFDYFQANNEMLVSPPMPLSQQKDVMKALPKPLPASMVASYLSNKKEDEKDEDEKEENEQSVEHLSPQDLLKRHIKRAKKGRIVEEWNRTMIDDWQADLLAHEILMFLQVEDPHFCDSFPLPNTTTFL

SEQ ID NO: 149289 - protein, 341 aa, Glycine max
  Coding DNA Sequence Number=SeqID_57604
  Homolog annotation: Hit_ID=A7QKL3; Match level="QueryCoverage=16%, HitCoverage=9%, E-value=1e-13, Identity=67%"; Hit description =Chromosome chr2 scaffold_113, whole genome shotgun sequence
MASVDPEIAKTREEQKRMEQQLASLTSVTSHTSWLLTPPPKSLLKYMPSAPDSDNDIGFRKPQRIIDRDDDYRRRRLNQIISPARRPRTLREKEETLKAIAMKKKEEEEAAKGAPPQQQQKRRNRWDQSQDDGGIDPGSKHATEQSEGLEHEIKQVRESLISAYEKNIATRLKVEVCRLEANNYNITKDACATSMQNVRAIKAMLRSLEMVSDPKKGGTQACETTTMVLVGSRYRTQEDRLGKQWISMSVERKRWSGNFRDLTKFNQALLGKWKWNLFYYQGELWARVLDSKYGGCNLRVVLAMEEQQDRWVWLSDSTGVYTISSAYQLLDRESRDENIDE

SEQ ID NO: 149290 - protein, 171 aa, Glycine max
  Coding DNA Sequence Number=SeqID_57605
  Gene Ontology: Mol. function=zinc ion binding; Cellular component =extracellular region
  Homolog annotation: Hit_ID=Q9M4H4; Match level="QueryCoverage=100%, HitCoverage=55%, E-value=1e-35, Identity=58%"; Hit description =Ripening-related protein grip22 precursor
  Pfam annotation: Domain name=DPBB_1; Domain location=93-169; Score =12.6; E_value=0.00028; Accession=PF03330.9; Description=Rare lipoprotein A (RlpA)-like double-psi be
MIRIKARNGRSTVAKEVDECDSVHGCACKINVVDASETVWKDLGLNTDDGLHSPPYNPSGTHATLTLNNFARGGDGGGPAECDGNFHPLPQRVVALSTGWYNHGARCGKMIRIKARNGRSTLAKVVDECDSVHGCDKSHACKTNVVDASKTVWKDLGLNTNDGEVPVTWTM

SEQ ID NO: 149291 - protein, 128 aa, Glycine max
  Coding DNA Sequence Number=SeqID_57606
  Gene Ontology: Cellular component=extracellular region
  Homolog annotation: Hit_ID=Q9M4H4; Match level="QueryCoverage=71%, HitCoverage=41%, E-value=1e-32, Identity=68%"; Hit description =Ripening-related protein grip22 precursor
  Pfam annotation: Domain name=DPBB_1; Domain location=57-122; Score= -11.9; E_value=0.1; Accession=PF03330.9; Description=Rare lipoprotein A (RlpA)-like double-psi be
MRKARYVSILSIKWCSLTSIQPSGTPAILTVNDFGPGRDGGDPSECDGNYHPLPQRVVALSTGWYNGGSRCGKMVRITARNGRTAVAKVVDECDSTQGCDQDHANQSPCKTNIALTLMMVKYQSPTMA

SEQ ID NO: 149292 - protein, 367 aa, Glycine max
  Coding DNA Sequence Number=SeqID_57607
  Gene Ontology: Mol. function=transferase activity, transferring glycosyl groups; Biological process=metabolic process
  Homolog annotation: Hit_ID=Q8LP23; Match level="QueryCoverage=85%, HitCoverage=97%, E-value=1e-41, Identity=48%"; Hit description =Rhamnosyl transferase
MENLILEDAGTQCSERIGTTFIIWAKNIKINFGKIMNHTFQFNYPEVDNRSPIKLHVVMFPFLAFGHFNAFVQLSNKLFYHGVSITFLSAASNIPRIKSTLNLNPAITVIPLHLPNGITSTAELPPHLAGKLILAIDLTQSHVKSLLLELKPHYVFLDFAQNWLPKLASELEIKSVRFVSFSAISDSCINVPSRLAGVEGRNITFDDLKKPPPGYPKKSNISLKAFEAMDLMFLFKRFGEKNLTGYQLMLKHSSVGCHLGHGGFNSVVEALTSDCELVLLPFKADQFFNAKLIAKDLEAGIEGNRSEDGNFKKEDILKAVKTIMVEDDKEPGKHIKENHMKWKEFLSNKGIQNKFITDLVAQLKSIA

SEQ ID NO: 149293 - protein, 328 aa, Glycine max
  Coding DNA Sequence Number=SeqID_57608
  Gene Ontology: Mol. function=transporter activity; Cellular component= mitochondrial inner membrane; Biological process=mitochondrial transport
  Homolog annotation: Hit_ID=A7QEA2; Match level="QueryCoverage=89%, HitCoverage=98%, E-value=1e-132, Identity=77%"; Hit description =Chromosome chr1 scaffold_84, whole genome shotgun sequence
  Pfam annotation: Domain name=Mito_carr; Domain location=132-228; Score=108.4; E_value=2.2e-29; Accession=PF00153.18; Description =Mitochondrial carrier protein
  Pfam annotation: Domain name=Mito_carr; Domain location=233-327; Score=107.4; E_value=4.2e-29; Accession=PF00153.18; Description =Mitochondrial carrier protein
  Pfam annotation: Domain name=Mito_carr; Domain location=35-128; Score= 67.5; E_value=4.5e-17; Accession=PF00153.18; Description =Mitochondrial carrier protein
  Pfam module annotation: Pfam domain module=Mito_carr::Mito_carr::Mito_ carr; Domain location=132-228::233-327::35-128
MAEVILNLIVESMMPDGSFLNVPMKSGYQHGGVDITHTKAFLTSLSAMVAETTTFPIDLIKTRLQLHGESLSSSHPTSAFRVGLGIIREQGALGLYSGLSPAIIRHMFYSPIRIVGYENLRNVVSVDNASFSIVGKAVVGGISGVLAQVIASPADLVKVRMQADGQRVSQGLQPRYSGPFDALNKIVRAEGFQGLWKGVFPNIQRAFLVNMGELACYDHAKQFVIRSRIADDNVFAHTFASIMSGLAATSLSCPADVVKTRMMNQAAKKEGKVLYNSSYDCLVKTIKVEGIRALWKGFFPTWARLGPWQFVFWVSYEKFRKFAGLSSF

SEQ ID NO: 149294 - protein, 287 aa, Glycine max
  Coding DNA Sequence Number=SeqID_57609
  Gene Ontology: Mol. function=5'-nucleotidase activity; Cellular component=endoplasmic reticulum; Biological process=nucleotide metabolic process
  Homolog annotation: Hit_ID=A7QNS7; Match level="QueryCoverage=66%, HitCoverage=56%, E-value=3e-64, Identity=65%"; Hit description =Chromosome undetermined scaffold_134, whole genome shotgun sequence
  Pfam annotation: Domain name=UMPH-1; Domain location=40-273; Score =19.3; E_value=6.6e-11; Accession=PF05822.3; Description=Pyrimidine 5'-nucleotidase (UMPH-1)
MEEVKGASDLLVGDPALLEKKIDAIRLGDSCYRVIADFDATLTMFWVNGTRGQTSHGLLQQGNPDYNAKRQQLYEYYHPLEFSPNIGLEEKTKLMEEWWGKAHGLLVEGGLTYDSIRQSVANANIAFREGVCELFEFLEVDFPSFYKFLNVDMFIVYQERDAPVLIFSAGLADIIEEVLRQKLHRSFKNVRIVSNRMAICEERPAKVGAIGFNGVFIWKNFALLPVCPSAIGFEIMGGVGVGGVANNILESLTLDIFIITPMIPLVTNGSRICMRSDSNVGWIDTYY

SEQ ID NO: 149295 - protein, 494 aa, Glycine max
  Coding DNA Sequence Number=SeqID_57610
  Gene Ontology: Mol. function=protein disulfide oxidoreductase activity; Biological process=cell redox homeostasis
  Homolog annotation: Hit_ID=A5BMG3; Match level="QueryCoverage=65%, HitCoverage=86%, E-value=1e-69, Identity=44%"; Hit description =Putative uncharacterized protein
  Pfam annotation: Domain name=Cu_bind_like; Domain location=315-387; Score=5.0; E_value=2e-05; Accession=PF02298.8; Description =Plastocyanin-like domain
  Pfam annotation: Domain name=Glutaredoxin; Domain location=228-293; Score=51.7; E_value=2.5e-12; Accession=PF00462.15; Description =Glutaredoxin
  Pfam module annotation: Pfam domain module=Cu_bind_like::Glutaredoxin; Domain location=315-387::228-293
MKGVKGKFLKKLKSIKPILKQDLILQIKASDGYVHFLPKIPSFNLHSPFVSRENKPEKVVQSCEKMQDEPEVIDVAELMKDLEEEDDYNDNKENIGPCSQKPQQHHKGVLQNGNRAKTDSKQRGVLEEKKSSPENADNNNNRNSNRKIPLLDTDVPSFRRPDLNSGSLFDPNLLAAFEQAVKEHSRITEEQRRSRVEEESSQKVEDDDPDPLMFFEEKCPPGGDGMVIFYTTTLRGILKTFEDCNKIRFLLQSFKVLYFERDISMHKEFRDELWSSLEGKLVPPRLFVKGRYIGGAEEVLSLHEQGKLRKIFEGVPMDYSNGPCDACGGIRFVLCFKCNGSHKKEYEHCTSLEPLRIFNTSPVILPLRERGVMFFICNIPNYCCLGQKIVISVHEGSIEKPPSPSPSPSQVPINISPQPSPNASAPQPHGSSGMSSPPSPTTNTSGGNGGNSPVPSSTQEGKSNAVALVGGKSFTVSLGQLLSVLGALFGFWIM

SEQ ID NO: 149296 - protein, 579 aa, Glycine max
  Coding DNA Sequence Number=SeqID_57611
  Gene Ontology: Mol. function=RNA-directed DNA polymerase activity; Cellular component=exocyst; Biological process=lateral root morphogenesis
  Homolog annotation: Hit_ID=A7QHV3; Match level="QueryCoverage=95%, HitCoverage=85%, E-value=0.0, Identity=79%"; Hit description =Chromosome undetermined scaffold_100, whole genome shotgun sequence
  Pfam annotation: Domain name=Exo70; Domain location=3-574; Score =461.1; E_value=1.4e-135; Accession=PF03081.6; Description=Exo70 exocyst complex subunit
MVFSPVTKEKGTERPRRTMEKAEAKILKGPHEDLENYLEAIDKLRSNIQFFGSKKGFKSSDGIVVHANNLLAKAISKLEDEFRQLLLSYSKPVEPERLFDCLPNSMRPSSPGHEGDPSGKNHHSESHNNNAEAVVYTPPALIPPRFLPLLHDLAQQMVEAGHQQPLLKIYRDARSHVLEESLQKLGVEKLNKDDVQKLQWEILEAKIGNWIHFMRIAVKLLFAGERKVCDQIFEGFDSLSEQCFAEVTTNSVSMLLSFGEAIAKSKRSPEKLFVLLDMYEIMQELHSEIETLFKGKACSAIREAATSLTKRLAQTAQETFGDFEEAVEKDATKTAVTDGTVHPLTSYVINYVKFLFDYQSTLKQLFQEFEGGEDSSQLASVTVRIMQALQTNLDGKSKQYKDLALTHLFLMNNIHYIVRSVRRSEAKDLLGDDWVQRHRRIVQQHANQYKRNAWAKILQCLSIQGLTSSGGGSGTAGGDGGTGSSSGASRAIVKDRFKSFNIMFEELHQKQSQWTVPDTELRESLRLAVAEVLLPAYRSFVKRFGPLVESGKNPQKYIKYSAEDLDRMLGEFFEVVFGG

SEQ ID NO: 149297 - protein, 860 aa, Glycine max
  Coding DNA Sequence Number=SeqID_57612
  Gene Ontology: Mol. function=protein binding; Biological process =protein metabolic process
  Homolog annotation: Hit_ID=A5C486; Match level="QueryCoverage=94%, HitCoverage=92%, E-value=0.0, Identity=52%"; Hit description =Putative uncharacterized protein
  Pfam annotation: Domain name=Clp_N; Domain location=112-169; Score =2.0; E_value=0.65; Accession=PF02861.11; Description=Clp amino terminal domain
  Pfam annotation: Domain name=Clp_N; Domain location=24-79; Score=7.4; E_value=0.17; Accession=PF02861.11; Description=Clp amino terminal domain
  Pfam module annotation: Pfam domain module=Clp_N::Clp_N; Domain location=112-169::24-79
MRGGICSIQLQALTPEATTVVKQAVNLATRRGHAQVTPLHVASAMLATSTGLLRKACLQCHSHPLQCKALELCFNVALNRLPASTSSPLLAPQYSTPSLSNALVAAFKRAQAHQRRGSIENQQQHILALKIEVEQLVISILDDPSVSRVMREAGFSSTLVKTRVEQAVSMEVCSQKASSDRSHAKENITKPHHVVLGGSNNVSPSSGPFGQVAGGSFMKPNLDHVNNDDVTSVLSELVRRKNTVIVGEGVANAEGVAREVMERFEVGNVPGDLRYVQFVSLPLMCFRNISKEEVEQKLMEIRNLVKSYVGRGVVLYLGDLKWLFEFWANFCEQKRNYYCSIEQMVMELKKLVCGSGESSRLWLMGIATFKAYMKCKICHPSLEAIWELHPFTIPVGSLSLSLNFHSDFQAQERSKVFFKDVAFEDRTGVRNHLTCCRDCLINFEKEAQSITNCISKKVCTASSLPTWLQNCKEERSDIMEDQESSRLEYLCKKWNSLCNSIHRRHPSIIEKPAVFFVSSSPSSPTSVSSNERKSNFHHSHLNWPIISESEKSPKECELYTETGDDDDDGYDSNFIMFMPDRDVPKPDLLSNPNSSPNSASSSEAVDGLESTQMFKEPNAENHKILCDALEKKIPQHKDVIVPEIASTVLHCRSGMRKRGLNHLMNREENQETWMFFLGVNSQAKESISRELAKVVFGSYSNFVSIGMSNFSSPEDDHDSTDEKSKRKRPREELKSSYVQRFGEAVNENPHRVFFLEDLDQVDYFSQKGVKQAIQSGSITLPSGESVPLKDAIVIFSCESFSSPKLRKSPCAENKGKEITVDDESSSLSLDLNLAIEDESGATLSEVGGKKNMNGKVILET

SEQ ID NO: 149298 - protein, 94 aa, Glycine max
  Coding DNA Sequence Number=SeqID_57613
  Homolog annotation: Hit_ID=A6FJQ2; Match level="QueryCoverage=40%, HitCoverage=84%, E-value=3e-11, Identity=92%"; Hit description=50S ribosomal protein L5
MTVKPLTHAAPGDGHSLSVSGCREQTSPSGRVSGCWRMRKEKIPHQAPFAIQAAQLLGRAIGAGLFAITPAGERGMCCKAIKLGNARVFPVTTL

SEQ ID NO: 149299 - protein, 623 aa, Glycine max
  Coding DNA Sequence Number=SeqID_57614
  Gene Ontology: Mol. function=oxidoreductase activity; Cellular component=anchored to membrane; Biological process=lignin catabolic process
  Homolog annotation: Hit_ID=A5AIX9; Match level="QueryCoverage=87%, HitCoverage=76%, E-value=0.0, Identity=66%"; Hit description =Putative uncharacterized protein
  Pfam annotation: Domain name=Cu-oxidase; Domain location=164-312; Score=174.3; E_value=3.1e-49; Accession=PF00394.13; Description =Multicopper oxidase
  Pfam annotation: Domain name=Cu-oxidase_2; Domain location=390-534; Score=122.0; E_value=1.7e-33; Accession=PF07731.5; Description =Multicopper oxidase
  Pfam annotation: Domain name=Cu-oxidase_3; Domain location=38-154; Score=153.5; E_value=5.7e-43; Accession=PF07732.6; Description =Multicopper oxidase
  Pfam module annotation: Pfam domain module=Cu-oxidase::Cu-oxidase _2::Cu-oxidase_3; Domain location=164-312::390-534::38-154
MAAGSAGARFKLVTCAIVLLPFLVTIATSADIFLDWHVSTDINLKPVSTDQPVITINGLFPGPLINATTNDVVHVNVFNDLDDPLLFTWNGIQQRLDSWEDGVSGTDCPIQPGRNWTYEFQTKDQIGTFSYFPSINFLKAGGGFGPIRVNNRPVISVPFPKPEAEFDLLIGDWYSSSYKDIRSRLNTSDVLPPDWMLINGKGPFMNNLSLSYETFNVTQGKLYLLRISNVGTAWSFNFRIQNHQMVLVETEGSYVNQIELESLDVHVGQSYSVLVTANQSAADYYIVASPKMSNATNNNTLVGVAILHYDNSTAPATGSLPSGPDPFDVQFSINQTKSIRWNLTTGAARPNPQGTFNVRNVTIAETFIFQASTAVIDGLSRYTVNNVSYLTPNTPLKLADYFSNGTGVYKLDAYSKNTSNANAVRGVFVASALYKGWTEIVLKNNLDIIDTWHLDGYSFFVVGIGEGEWNPESRSSYNLYDPVARSTVPVYPGGWSAVYVYPDNPGIWNLRSQNLESWYLGEELYVRVYDADPNPAKEKPPPQNLLLCGLFQPSPPSLKAHNPNAPSVSPAPNAPSVSPAPNAPSVSPAPNAPASKAYNPHRTSSWYIKNGSVILRSYLVGVS

SEQ ID NO: 149300 - protein, 722 aa, Glycine max
  Coding DNA Sequence Number=SeqID_57615
  Gene Ontology: Mol. function=hydrolase activity, hydrolyzing O -glycosyl compounds; Cellular component=plasma membrane; Biological process=carbohydrate metabolic process
  Homolog annotation: Hit_ID=A7PHX1; Match level="QueryCoverage=93%, HitCoverage=58%, E-value=0.0, Identity=68%"; Hit description =Chromosome chr13 scaffold_17, whole genome shotgun sequence
  Pfam annotation: Domain name=Alpha-amylase; Domain location=320-720; Score=-129.9; E_value=0.059; Accession=PF00128.15; Description=Alpha amylase, catalytic domain
  Pfam annotation: Domain name=Isoamylase_N; Domain location=133-218; Score=69.3; E_value=1.3e-17; Accession=PF02922.9; Description =Isoamylase N-terminal domain
  Pfam module annotation: Pfam domain module=Alpha-amylase::Isoamylase _N; Domain location=320-720::133-218
MLMSQMQNGLLYSRAYWVAESLIAWDVDVGNGFSCYLLASKNASLTIANCQIQGEDLKIKLQEDRVGLPANVVEKFPHIRGHKVFSLPPTLDVKPLLKFRLAVVICDSDGECMNCTGLQLPGVLDDLFSYSGPLGALFSEEAVSLYLWAPTAQAVHAYIYKDPSGDDPIEIVCLEEENGVWRTKGPKSWEGCYYVYEVCVYHPSTMRIEKCYTSDPYARGLSSDGRRSFLLNLDSVKLKPDGWDNLANKKPTIHSFSDISIYEMHIRDFSVNALKNILEYSYILKWILVILLFGSVERGENSQRIESASDLSVQPEFRGGYLAFTLQDSAGVLHLKKLSSAGITHVHLLPTFQFAGVDDQKEDWRFVDTSILESLPPDSDQQQALITAIQNFDGYNWGYNPVLWGVPKGSYASNPNGPYRTIEFRKMVMALNHIGLRVVLDVVYNHLQGSGPFDEHSVLDKIVPGYYLRRNSDGLIEHSTCINNTASEHFMVERLILDDLVHWAVNYKGVASSELQSLRAGSFCSFIVLRCISYHVLKDFLSLPPLNCTFYQNEKCLIKFHRLLILDPKMLFLFQIDGFRFDLMGHIMKSTMVKAKTALQCLTKEKDGLDGSSIYIYGEGWDFGEVAKNGRGVNASQFNLPGTQIGSFNDRIRDAILGGSPFGHPLQQGFVTGLLLQYWSEFPAKRGNEKLLQKVGLLVCQGKKEIINTGIWGKGLIESCII

SEQ ID NO: 149301 - protein, 20 aa, Glycine max
  Coding DNA Sequence Number=SeqID_57616
MKEGKSEEKKALVVGWVECK

SEQ ID NO: 149302 - protein, 570 aa, Glycine max
  Coding DNA Sequence Number=SeqID_57617
  Gene Ontology: Mol. function=catalytic activity; Cellular component =peroxisome; Biological process=metabolic process
  Homolog annotation: Hit_ID=A5BPU4; Match level="QueryCoverage=99%, HitCoverage=99%, E-value=0.0, Identity=66%"; Hit description =Putative uncharacterized protein
  Pfam annotation: Domain name=AMP-binding; Domain location=84-493; Score=390.4; E_value=2.7e-114; Accession=PF00501.19; Description=AMP- binding enzyme
MSGEEILSSNEEKYNRSQPPFGSRSGYNSRTGIYHSLIKLGIKHEIPTRPDLNTANFVLSQFPQAHLAEARIAFIDARTNLSVSYGELRRSIYSLASALFHGLEVRKGDVVFVLSPNSTLYSTICLAVLSVGAVLTTANPINTATEIAKQVHDSSAKLAISAPEELHKLVPTGVPTILTSHCSDGNMLSVEELIKGCCTSPELPQVPVAQSDTAAILYSSGTTGVSKGVVLTHANLISIMRLLLWSADVSGSQDDVFLAFIPMFHIYGLVFFGLGLLCVGVTTILMQKYDFQAMLDAIQKHKVNNLPAVPPVILALVKHARKATCDLSSLRRVGSGAAPLSKEVALEFRRMFPWIELRQGYGLTESSGGATFFASDKDAKAHPDSCGKLIPTFCAKVVDIEKGKPLPPHKEGELWFKSPTIMKGYLGNLEATSAAIDSEGWLRTGDLGYIDENGFVYIVERIKELIKHNGYQVAPAELESVLLSHPLIVDAAVIPVEDEETGQIPMAYVVRAAGSELSENQVIQFVAGQVAPYKKVRKVSFIDTIPKSAAGKILRKDLVSQSKYQLVSKL

SEQ ID NO: 149303 - protein, 591 aa, Glycine max
  Coding DNA Sequence Number=SeqID_57618
  Gene Ontology: Mol. function=catalytic activity; Cellular component =peroxisome; Biological process=metabolic process
  Homolog annotation: Hit_ID=A5BPU4; Match level="QueryCoverage=100%, HitCoverage=100%, E-value=0.0, Identity=63%"; Hit description =Putative uncharacterized protein
  Pfam annotation: Domain name=AMP-binding; Domain location=84-493; Score=382.5; E_value=6.8e-112; Accession=PF00501.19; Description=AMP- binding enzyme
MSRKEERSSRKDEYNKSLPPFDTRSGYDSRTGIYHSLVKLGTKHEIPTKPDLGTANFVLSQFPQAHLAEARIAFIDSGTNRSVSYGELRRSIYSLASALFNRLKVRKGDVVFVLSPNSTLYSTICLAVLSVGAVVTTANPINTESEIAKQVHDSGAKLAISTLEDLHKLVPTGIPTILTSRPFDGNMLSIEELIEDCYGSPQLPQVPVAQSDTAAILYSSGTTGRSKGVLLTHANIISIMRLLFWQVDVSGSQDDVFFAFIPMFHIYGMIFFGLGLLCIGITTVLMQKYDFQAMLVAIQKYKVNNLPAVPPVILALVKHSSKVKCDLSSLKRVGSGAAPLSKEVAQEFRRMFPSVELRQGYGLTESSGGAAFFASDKDAKAHPDSCGKLIPTFCAKVIDIETGKPLPPRKEGELWFKSPTIMKEYLGNMEETSATIDSEGWLRTGDLGYIDENGFVYIVERIKELIKHNGYQVAPAELESVLLSHPLIVDAAVIPVEDEETGQIPMAYVVIAAGSELSEDQVIQFVAGEKTIFPGNFFCQVSHENILMGKVAPYKKVRRVSFIDTIPKSAAGKILRKDLVSQSRHQLVSKL

SEQ ID NO: 149304 - protein, 52 aa, Glycine max
  Coding DNA Sequence Number=SeqID_57619
MGKGVEPVARERCKISKHRRQLRRRRSDGGGSKATVEISMDTSSSEGNKGYN

SEQ ID NO: 149305 - protein, 383 aa, Glycine max
  Coding DNA Sequence Number=SeqID_57620
  Gene Ontology: Mol. function=RNA binding; Cellular component=nucleus; Biological process=RNA splicing
  Homolog annotation: Hit_ID=A7PHV7; Match level="QueryCoverage=85%, HitCoverage=100%, E-value=1e-117, Identity=68%"; Hit description =Chromosome chr13 scaffold_17, whole genome shotgun sequence
  Pfam annotation: Domain name=KH_1; Domain location=123-188; Score =57.4; E_value=4.8e-14; Accession=PF00013.20; Description=KH domain
  Pfam annotation: Domain name=KH_1; Domain location=253-318; Score =62.8; E_value=1.1e-15; Accession=PF00013.20; Description=KH domain
  Pfam annotation: Domain name=KH_1; Domain location=37-102; Score =68.5; E_value=2.3e-17; Accession=PF00013.20; Description=KH domain
  Pfam module annotation: Pfam domain module=KH_1::KH_1::KH_1; Domain location=123-188::253-318::37-102
MESTESSYVSSPEGPRKHAASPPPKSPSLDSEEKPTYIRFLVSNSAAGSVIGKGGSTITDFQSQSGARIQLSRNHEFFPGTTDRIIMVSGAINEIQRAVELILSKLLSELHSEDDNDAEPKTKVRLVVPNGSCGGIIGKGGATIRSFIEDSQAGIKISPQDNNYYGQNDRLVTLTGSFDEQMRAIELIVSKLSEDPHYAQSMNSPFSYPGYQGVPYTYVLPSVAPPAYNAVNYRPNGAAGGKLQNSKEERSNSLTMGVADEHIGLVVGRGGRNIMEISQASGARIKISDRGDYVSGTTDRKVTITGSQRAIRTAESMILQKVAYATERGVMESEIGEKWCFDSGIVTLTVVIGGVECGENAYAVGADGCLDNRERLHGEDGFA

SEQ ID NO: 149306 - protein, 849 aa, Glycine max
  Coding DNA Sequence Number=SeqID_57621
  Gene Ontology: Mol. function=metal ion binding; Cellular component =plasma membrane; Biological process=embryo sac development
  Homolog annotation: Hit_ID=A5CA54; Match level="QueryCoverage=100%, HitCoverage=100%, E-value=0.0, Identity=64%"; Hit description =Putative uncharacterized protein
  Pfam annotation: Domain name=zf-C3HC4; Domain location=797-835; Score= 7.6; E_value=0.012; Accession=PF00097.16; Description=Zinc finger, C3HC4 type (RING finger)
MTDFQPLQQKPEPADAHAEFELGLEEFMRGHLDDCMSFASCSSSRAPDDEDDEGDQLVRRRRRSDLEGDDLAESSAARRRHSRILSRWAARQAQEMITTIERRNRESELMALAGLHTVSMLDSSFLRGSQSPTSGQEGAVERPSTQASAILQMWRELEDEHLLNRARERMRVRLRHQRNSDSHTNVSSTMSDSRGSENQGSLGDASESENDYGTWSHDQTGSRNAHGDHNGSSREQSLDLGEVERERVRQIVQGWMESGISDHSSNVSQINNSRRAEWLGETERERVRNIREWVQMISQQRGSRGSRRDAQVSEGAQADRARGLVADNDESQPEHVRRDMSRLRGRQALVDLLVRIERERQRELQGLLEHRAVSDFAHRNRIQSLLRGRFLRNERTVEDERPLSMAASELVQLRQRHTVSGLREGFRSRLENIVRGQAGTSPDTTSNSNASETRGDESQANSLVDGQQENYEQQQIRSLETDVRQLPNRTGTLESSTSESISWQEASNQGGNWQEQIAEEGGGNWRQSPFNQTRDGRAVGDWPQETPRNLAGEDPHPREAQRIWHDGNTRETVGNWSEGPSGATRNRRGVPIRRFNRFHPPDDDNVYSMELRELLSRRSVSNLLRSGFRESLDQLIQSYVERQGRAPIDWDLHQNLPASTPASPEQDPDQQGEERDEGQHETINRPSLVLPSPPVPPPQPLWHQDLHQTGWSRHSMHRSEIEWEIMNDLRSDMARLQQGMNHMQRMLEACMDMQLELQRSVRQEVSAALNRSGGENGSSAETSDDGSKWGHVKKGTCCVCCDNHIDSLLYRCGHMCTCSKCANELIRGGGKCPLCRAPILEVVRAYSIL

SEQ ID NO: 149307 - protein, 294 aa, Glycine max
  Coding DNA Sequence Number=SeqID_57622
  Gene Ontology: Mol. function=serine-type peptidase activity; Cellular component=mitochondrion; Biological process=proteolysis
  Homolog annotation: Hit_ID=A7NXM0; Match level="QueryCoverage=63%, HitCoverage=74%, E-value=2e-33, Identity=75%"; Hit description =Chromosome chr5 scaffold_2, whole genome shotgun sequence
MSQWKCFSLRVIESRFPLAHRRKKGVGSRNRDSWKEYSIGLVPRISSISYPHCGYFPSSGGFIAKRRKRNSLLRLNDCSDNIRQHASILFVRLVSGVMLVMSVSLASTEPSYKVIRKMLATLDDPFTRFLEPEKQSGTEGALTGVGLSIGYPTKAEMQPGGLVVISASPGGPAYRVGVLSGDVILAIDCTSTENMGLYDAAERLQWVFSPAFHLCFQLYTCWKIQSVFELSDGSGIVVTVARYETAAHTDIDKVGVIPDHPLPTPFPKDEDAFCNCLQDPASSCYVNRIKLFSK

SEQ ID NO: 149308 - protein, 250 aa, Glycine max
  Coding DNA Sequence Number=SeqID_57623
  Homolog annotation: Hit_ID=B0HC01; Match level="QueryCoverage=13%, HitCoverage=72%, E-value=8e-11, Identity=97%"; Hit description =Putative uncharacterized protein
SEQESARGSFQGETPGISIVLSGFATSDLSVDFCDARQGGGAYGKTPATRPFYGSWPFAGLLLTCSFLRYPLILWITVLPPLSELIPLAAAERPSAATGTTGFPTGKRAVSATQLIGVGLASNKLEGAEEYANADSDAIGEEEGLAEVANGVSHAGLVGAVIAGRRVHAAVLLGVSGGAALPALELLNGVAEALLRFAKAALGVGVGVVDERRRGWWCHENEMGMEMENTNRVTSHSHHRLVVSFSIRSL

SEQ ID NO: 149309 - protein, 362 aa, Glycine max
  Coding DNA Sequence Number=SeqID_57624
  Homolog annotation: Hit_ID=A7PBH2; Match level="QueryCoverage=83%, HitCoverage=58%, E-value=1e-134, Identity=78%"; Hit description =Chromosome chr16 scaffold_10, whole genome shotgun sequence
MGVNEVQVLHKICKAGTTRCPTLLVWNLLSSDLAWRLKEESLTSFLIMPNVHIPPPCPKCKVMYAFVMRPESLPKSYQDFIQKTGPVAEPVYKAVRDSCRGHSVDVASLHAYLSRVGKIDYAKLEEFPSIIPCSLIHPVTNSCLAHQGNATSLTFKKTFPLYFSLTFVPFVVLHLQKFTDAPFRTFWLAIKGAVRSTTFLSAFVGIFQGVICSHRKVFPRDHKLVYWIAGGIAALSVLLEKKARRGELALYVLPRAVDSLWYILVNRHLLPNIRNAEVFLFSLCMGGIMYYLEHEPETMAPFLRGLIRRFLASRISNPSPPSQTASYTYLQALDGITKPALQEKRDTESSSQKYNLESIPGL

SEQ ID NO: 149310 - protein, 237 aa, Glycine max
  Coding DNA Sequence Number=SeqID_57625
  Gene Ontology: Mol. function=sequence-specific DNA binding; Cellular component=intracellular; Biological process=regulation of transcription, DNA-dependent
  Homolog annotation: Hit_ID=A7PIB1; Match level="QueryCoverage=61%, HitCoverage=81%, E-value=7e-59, Identity=81%"; Hit description =Chromosome chr13 scaffold_17, whole genome shotgun sequence
  Pfam annotation: Domain name=CBFD_NFYB_HMF; Domain location=42-107; Score=134.4; E_value=3.2e-37; Accession=PF00808.14; Description =Histone-like transcription factor (CBFNF-Y) and archaeal histone
MKGDKNVKVCEMSDAPASPSHESGGEQSPRGSLSGAAREQDRYLPIANISRIMKKALPPNGKIAKDAKDTMQECVSEFISFITSEASEKCQKEKRKTINGDDLLWAMATLGFEDYIEPLKVYLARYREAEGDTKGSARSGDGSARPDQVGLAGQNAQVIAFLSISLECTNAQIVFIANTCKLNYGHSENIVLLDVYLITAWYYSVTTCLLNTADNVPNQWECGTLAFISPALDVMNS

SEQ ID NO: 149311 - protein, 341 aa, Glycine max
  Coding DNA Sequence Number=SeqID_57626
  Gene Ontology: Mol. function=protein binding
  Homolog annotation: Hit_ID=Q1RSH7; Match level="QueryCoverage=96%, HitCoverage=59%, E-value=1e-68, Identity=72%"; Hit description =General transcription factor IIH component, related
MEMEHPRTVAEILARRKQDEERRNRISKMTPIEDLQAQDNHPYAPLCIKLITRFMKCVLVGTCNNINIGKRKRHSLVGKGEVHVQQLRREKNMHCSVWQWYRRITSNRGKRKRGIVKSEHADRHRGGLNQGTGSRVNELTRSDPRDYFDSQQANAVKTLDDSQAGMEQMKCSLGSEEAYDSLRASISKIKTTGLRDPLFSPDVALKVLNGLTKNITSTKYHLGKSSQESVLDILPNSTKEKLLDHWVCSQELLRHFWSSYPVSTQNLVSKASPLLSGICGEGLMKSPTSPMTRRLKDSISQIYSKLEDIKVSAESDLRHHVSLVVHPMQQIGFDKHKPLPT

SEQ ID NO: 149312 - protein, 108 aa, Glycine max
  Coding DNA Sequence Number=SeqID_57627
  Gene Ontology: Mol. function=transferase activity; Biological process= response to stress
  Homolog annotation: Hit_ID=Q1RSH2; Match level="QueryCoverage=100%, HitCoverage=46%, E-value=1e-41, Identity=72%"; Hit description =Glutathione S-transferase, C-terminal; Thioredoxin-like fold
MKETLETLRVIEKENGLGEKKLMGGNTIGLADLALAWVAHTLVAMGDVIGVKFITADTFPHIHSWMVNFLEIPVINNNLPPHELAVEYFREKRQMFLAMVTQACHHHH

SEQ ID NO: 149313 - protein, 230 aa, Glycine max
  Coding DNA Sequence Number=SeqID_57628
  Gene Ontology: Mol. function=nucleic acid binding; Cellular component= intracellular; Biological process=regulation of transcription, DNA -dependent
  Homolog annotation: Hit_ID=Q8L6Y4; Match level="QueryCoverage=76%, HitCoverage=27%, E-value=5e-22, Identity=38%"; Hit description =Polycomb group protein EMBRYONIC FLOWER 2
  Subcellular localization annotation: CTP_CleavageSite=35; ConfidenceScore=5.54e-01
MATFGFQAMAHCLLLRRISQLSRFRSMPDIPGTSSARMAASETNSRRTGQRNNRVVWENLSEEEKLAAIESLTVYCRPIELYNIIKSRTKKKPLYLRRCMDYHIKAKRKKRLVLTASLSWKDDDNRALFPLCVCLGRLDPNTEARSAQRYHVGKISSFKGLSGVDGKGNTQLEVNFMLPEFDKLAGEVSTAKYWFLVFASAGNPISLSRANSSPWPVEVSSNECEICFNY

SEQ ID NO: 149314 - protein, 37 aa, Glycine max
  Coding DNA Sequence Number=SeqID_57629
MLQCEGLGGLREKERVLGEERRNEIVRQRRLRSQSEN

SEQ ID NO: 149315 - protein, 153 aa, Glycine max
  Coding DNA Sequence Number=SeqID_57630
MSEIEEVQEQMKADMKGHERAKMTIMMQVMMSMRKMMEVNMTIVVAASTATEVDPTHLSSLNQVNPPVSDMVGQGGEALGCTGDPHFVQVQNKHSFPPYGLLPTIHHSMLHTLSMRMSITPLPYSLGANNPNLVRHRSLNPWGRHMKYPETTL

SEQ ID NO: 149316 - protein, 115 aa, Glycine max
  Coding DNA Sequence Number=SeqID_57631
  Subcellular localization annotation: CTP_CleavageSite=2; ConfidenceScore=5.42e-01
ALASVAVTLRVTTTPAALNAPLQGASHSPFRLRNCWEGRSGFPSHDVVKRRPVNCNTTHYRANWSSTAVAAALELVDPPGCRNSIPSWDWGLGFPPCDKEDARVREMMCELESRM

SEQ ID NO: 149317 - protein, 260 aa, Glycine max
  Coding DNA Sequence Number=SeqID_57632
  Gene Ontology: Biological process=transposition, DNA-mediated
  Homolog annotation: Hit_ID=Q6UUU1; Match level="QueryCoverage=23%, HitCoverage=40%, E-value=3e-18, Identity=78%"; Hit description =Putative uncharacterized protein
MVKVGTSYVPINVSFRQKLAQGFPVLQWLLFLSAVPPVQLLTGWCVTAKAPPDISAGKCSGHAARRVPFAIQAAQLLGRAIGAGLFAITPAGERGMCCKAIKLGIRSERDICNPMFIAALVIAAKIRKRPKCFLINKGIKNCGIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 149318 - protein, 56 aa, Glycine max
  Coding DNA Sequence Number=SeqID_57633
MHIHGQDSKGKGEGSNEDPPVEVKANNDLPREWKALRDHPIDNIIGDISKGLYKKN

SEQ ID NO: 149319 - protein, 54 aa, Glycine max
  Coding DNA Sequence Number=SeqID_57634
MLVATPRIFPPLESAPVSLALARPRRARCDSWRLHWGLFLSGGESIIMLGLRLA

SEQ ID NO: 149320 - protein, 103 aa, Glycine max
  Coding DNA Sequence Number=SeqID_57635
MRIQGNAPAFVDELRGSRGGGSASIVRCRPSPGYCGVSPCACLGGAVLLDESLVNRGPDDLVGGDRYFVELTKASNQSWKSQDPIGLLRVHWVSCGVILANNR

SEQ ID NO: 149321 - protein, 82 aa, Glycine max
  Coding DNA Sequence Number=SeqID_57636
  Gene Ontology: Biological process=transposition, DNA-mediated
  Homolog annotation: Hit_ID=Q1J7G7; Match level="QueryCoverage=42%, HitCoverage=50%, E-value=4e-10, Identity=82%"; Hit description =Transposase
MVKVGTSYVPINVSFSPKVGPGLPGINRDTRIYLFCEWLLFLSAVPPVQLLTGWCVTAKAPPDISAGKCSGHAARNHHTRRA

SEQ ID NO: 149322 - protein, 126 aa, Glycine max
  Coding DNA Sequence Number=SeqID_57637
  Homolog annotation: Hit_ID=A7QME1; Match level="QueryCoverage=47%, HitCoverage=22%, E-value=7e-11, Identity=51%"; Hit description =Chromosome undetermined scaffold_125, whole genome shotgun sequence
MEEAKDSRKVEQLGEWWEMFGDGTPKLRRFAIHVLSLTCCSSGCKRNWSSFEMNDEDEQPRGEGDGGNVELVGDVGRSSNDLVVDVFDLDNLILVEPNDDAQSKEDLDGDESDDIHGDNPIRGLDI

SEQ ID NO: 149323 - protein, 199 aa, Glycine max
  Coding DNA Sequence Number=SeqID_57638
  Gene Ontology: Mol. function=tRNA nucleotidyltransferase activity; Cellular component=exosome (RNase complex); Biological process=tRNA processing
  Homolog annotation: Hit_ID=A7FCS9; Match level="QueryCoverage=100%, HitCoverage=83%, E-value=1e-103, Identity=95%"; Hit description =Ribonuclease PH
  Pfam annotation: Domain name=RNase_PH; Domain location=10-143; Score =196.5; E_value=6.7e-56; Accession=PF01138.12; Description=3' exoribonuclease family, domain 1
MRPAGRAPQQVRPLTLTRHYTKHAEGSVLVEFGDTKVLCTATVEEGVPRFLKGQGQGWITAEYGMLPRSTHSRNAREAAKGKQGGRTLEIQRLIARSLRAAVDLKKLGEFTITLDCDVLQADGGTRTASISGACVALADALNTLVANGKLKADPMKGMVAAVSVGIVNGEALCDLEYVEDSAAETDMNVVMMEDGRMIE

SEQ ID NO: 149324 - protein, 249 aa, Glycine max
  Coding DNA Sequence Number=SeqID_57639
  Gene Ontology: Mol. function=RNA-directed DNA polymerase activity; Biological process=regulation of transcription, DNA-dependent
  Homolog annotation: Hit_ID=A5BVS5; Match level="QueryCoverage=89%, HitCoverage=17%, E-value=4e-18, Identity=30%"; Hit description =Putative uncharacterized protein
MLSDNFSIDKETLRKDFYSPENEPQRKWFFQHYKGTNRKQIQDKFYEFISRQQIQDKFYEFVERVKINVLFFDWFHAYTIRKDIDYPWKQDIIGEPITNVITNWQLKDGELIQADLPPATQYQLPNIKDSSNKPVMVVPFKTKDINEEVTSRDIRSLMEQTNYTNKYLQVLGETLKTKISKQKTIEEASTKNSNIVPEAIINPISSKHWKTPSKLYQRPTAPDLLLEERGENNFKSFSTNNIYEWNIDA

SEQ ID NO: 149325 - protein, 131 aa, Glycine max
  Coding DNA Sequence Number=SeqID_57640
MEPNGKDQKVHYLVTTTEGGFMDYQQQCITKRGKLLMSLHCYQASQRPSMTTDRPPLPMSHTDSGIWPNISMCVKTCRCHVCIEQSKNYPTDAILPRKGPVTRTMSNKLQEDWARAVEKGPRVLMNLRVDF

SEQ ID NO: 149326 - protein, 152 aa, Glycine max
  Coding DNA Sequence Number=SeqID_57641
MGEAEEVQEKMKADMEAMKEKMATMMEAMMSVKKIMEANAVAIAATSVVAKVNLMSPSGLKQMNHPTSNMAHTSRPMEETHEIPHHDLANFEPCLGYAAEGQAVGGIPLQNTLEGPQYHPQLHLLHSTADKNPHDYGRNGKVGSSKGKAQGH

SEQ ID NO: 149327 - protein, 100 aa, Glycine max
  Coding DNA Sequence Number=SeqID_57642
MTPVNRKAGTGERTREPPGGNAWGAEPMEKRLCRGPLTSLVKYLPGNAHYSRKSPPRWAHPPFSAAGNTQTAPIALAQVGRFSLNAAMARQRSRRPKRGG

SEQ ID NO: 149328 - protein, 147 aa, Glycine max
  Coding DNA Sequence Number=SeqID_57643
  Homolog annotation: Hit_ID=A0ST23; Match level="QueryCoverage=18%, HitCoverage=55%, E-value=2e-08, Identity=100%"; Hit description =Putative reverse transcriptase
VPPVQLLTGWCVTAKAPPDISAGKCSGHAARRVPFAIQAAQLLGRAIGAGLFAITPAGERGMCCKAIKLGNARVFPVTTLIKLIDTVDLEGGPVGKPVVPAALMNRPTRGERRFAYWALAECILAYYVGTDEGVSEVLHVAGEKRLH

SEQ ID NO: 149329 - protein, 119 aa, Glycine max
  Coding DNA Sequence Number=SeqID_57644
  Subcellular localization annotation: CTP_CleavageSite=32; ConfidenceScore=5.75e-01
MGSPPASPPPPPPPPPPLDASASPSAVNRTRKASRLRSLSTRPPGAERPMVHVDPATGKADGPYRKKLRTYLGIVVCDKVDVTYENWKEVLTAQKDLIWEDIQDEKEVTSDRGGEMEAV

SEQ ID NO: 149330 - protein, 191 aa, Glycine max
  Coding DNA Sequence Number=SeqID_57645
IENGELGNRARQSIRGAPDSMRYAINSRGSRLDGGGHINSARQSIHRSLNKIENGELANSAKQLDGGGRMNSARQSIHGSLNKIENGELGNRARQSIRGAPDSIVEDASTAPGNQCMGLRIRLEIGDLANSARQSIRGSPDSMAPDSMVEDASTALGNQCMGLRIRLENGDLANNARQSIRGAPDSMVEDT

SEQ ID NO: 149331 - protein, 130 aa, Glycine max
  Coding DNA Sequence Number=SeqID_57646
  Gene Ontology: Mol. function=structural constituent of ribosome; Cellular component=chloroplast; Biological process=translation
  Homolog annotation: Hit_ID=A7Q5A7; Match level="QueryCoverage=33%, HitCoverage=59%, E-value=1e-11, Identity=79%"; Hit description =Chromosome undetermined scaffold_52, whole genome shotgun sequence
MPFFVHGSIFWCPRRRGTTPIHPELGGYSGEQISSGDDGVGPVAQRIRARGYEPRCRGFESLLAHNRPKKGRIFPSGAPDCGTKEYPEPTPSQLTADRSTTELLRNNGKFELIEFNSRSQPMTNMSSKFP

SEQ ID NO: 149332 - protein, 111 aa, Glycine max
  Coding DNA Sequence Number=SeqID_57647
MIIIKTSKSFASTVTTPRRFIYDALQKRGVIPRGGHGEDSFLMHPGKLHNLETCLAVEDLLQQMIDRGRLEVDDEGSEEQHICMQSADEGSFGRPKPLVVYFTRDAAPQTP

SEQ ID NO: 149333 - protein, 102 aa, Glycine max
  Coding DNA Sequence Number=SeqID_57648
  Subcellular localization annotation: CTP_CleavageSite=31; ConfidenceScore=5.04e-01
MMTKVMMKSSKVNQRTSSKCSRWNQEQFKTREEKLKNTSRFKRKVEFKNQDSRDQDSRDQDSRLKIQESREGLIKISMKRFPQKLSSTWFFSKHVYQRFFTI

SEQ ID NO: 149334 - protein, 37 aa, Glycine max
  Coding DNA Sequence Number=SeqID_57649
KIVSQAGKIGVPGLMMLSGHIGLPTKDHPLGDFPDDH

SEQ ID NO: 149335 - protein, 71 aa, Glycine max
  Coding DNA Sequence Number=SeqID_57650
  Subcellular localization annotation: CTP_CleavageSite=48; ConfidenceScore=5.36e-01
MVNAVSRTFPLDLMMKSVHFQVKKRLSFELQKVAVGLSSVVGLSAYPSLSATSTRLAQRRIWQSINTKAAR

SEQ ID NO: 149336 - protein, 34 aa, Glycine max
  Coding DNA Sequence Number=SeqID_57651
MGFLARRKNSGAFDQDVLASPVWALARIGTFMRW

SEQ ID NO: 149337 - protein, 152 aa, Glycine max
  Coding DNA Sequence Number=SeqID_57652
  Homolog annotation: Hit_ID=A4DID9; Match level="QueryCoverage=41%, HitCoverage=88%, E-value=7e-19, Identity=53%"; Hit description =Putative uncharacterized protein
PSVRYHSGRARILTLCQDLRAEGQSQAEGSLTARPTRRAGTKVGLSDPTVPSGRAVAQRIKGWAVRPLKRYVSWVQNVVRQFGPYPDREGRTSGVPVIVPTVNAGASGSTAETAMGSLPQRGWSERSFENSREVMYAAEHPNRPVDLNLVPT

SEQ ID NO: 149338 - protein, 137 aa, Glycine max
  Coding DNA Sequence Number=SeqID_57653
  Homolog annotation: Hit_ID=Q6UUU1; Match level="QueryCoverage=43%, HitCoverage=40%, E-value=1e-18, Identity=78%"; Hit description =Putative uncharacterized protein
FARNGPSSQLLLPENLKLMPIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 149339 - protein, 135 aa, Glycine max
  Coding DNA Sequence Number=SeqID_57654
MAKFDPDIVLEFYANAWPTEEGVRDMRSWVRGQWIPFDANAIGQLLGYPLVLEEGQECEYGQRRNRSDGFDEEPVRCGAGFCPDCCRETGMAPTRHPLDPDKSNRALGFPALITRLCQSFGVPVAPSKVIRPPIT

SEQ ID NO: 149340 - protein, 82 aa, Glycine max
  Coding DNA Sequence Number=SeqID_57655
  Subcellular localization annotation: CTP_CleavageSite=40; ConfidenceScore=5.24e-01
MPFCGRAKARLTGALSKGGKMRGVTTNVDKSGAFAPTYPPSKRKSDLRSSFLCVNQVIPFYLKGDHFKVLDLKNDPFYLVRN

SEQ ID NO: 149341 - protein, 64 aa, Glycine max
  Coding DNA Sequence Number=SeqID_57656
MWYHFSVKNLVGRLGVHDRTCLTMGRPVRVTLFCEIAPTMCDWHRLKGALKPDDPQGLHSEESV

SEQ ID NO: 149342 - protein, 111 aa, Glycine max
  Coding DNA Sequence Number=SeqID_57657
MGSSQTPSLKKRFYQVKVKSLGITSLKELGQLMGQLQRQAFRKAYGKIWDLAMVEVSTEAIASLAQRPYLFSGFYPSLARISKIVQISMQELDHRKQVENVVVGIPRKCLE

SEQ ID NO: 149343 - protein, 76 aa, Glycine max
  Coding DNA Sequence Number=SeqID_57658
  Subcellular localization annotation: CTP_CleavageSite=66; ConfidenceScore=5.55e-01
MGDQPHIKSRHTTDNSCTALLASQVEPRKASITAKSTSPSTFGNSMVPNTNNANMSMNESLPWCPMHAIKKAMQTF

SEQ ID NO: 149344 - protein, 217 aa, Glycine max
  Coding DNA Sequence Number=SeqID_57659
MPTVEEFEEILGCPLGGRKPYLFSGFYPSTTRVAKVVKISAQELDQVKQNRNGVVGVPRKCLEERAKALANQGEWASFIEILVLLIFGVILFPNMEGLVDLAAIDAFLAFHHGKESPVVAILAIDPNTRVLQGVRKAWDAVRRKDNELRGSSNGIIDDYHKWPRVRTQGLDCLPNLKTVRDDEVKASEESDEVQALKEKLERAWVVKEKFKSTTIKV

SEQ ID NO: 149345 - protein, 133 aa, Glycine max
  Coding DNA Sequence Number=SeqID_57660
IIDTVDHAEIPYGYPHPFVIQRRRARRQAETKFGHSAPLYHPEAAGPMIRGDTLRLSAPFCHPEAGGSMTSRDQIWSFCTLVSSRGGGPDDTRRYLTVIRTLVSSRGGGPDDTRKYPRGLSVHILLLSVRQNA

SEQ ID NO: 149346 - protein, 268 aa, Glycine max
  Coding DNA Sequence Number=SeqID_57661
  Homolog annotation: Hit_ID=Q6UUU1; Match level="QueryCoverage=22%, HitCoverage=40%, E-value=3e-18, Identity=78%"; Hit description =Putative uncharacterized protein
  Subcellular localization annotation: CTP_CleavageSite=42; ConfidenceScore=5.17e-01
GTSYVPINVSFSPKVGPGLPAVPPVQLLTGWCVTAKAPPDISAGKCSGRVPFAIQAAQLLGRAIGAGLFAITPAGERGMCCKAIKLGNARVFPGELELHRGGGRSRTSGSPGLQEFDSQGLNDSSLCDQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 149347 - protein, 194 aa, Glycine max
  Coding DNA Sequence Number=SeqID_57662
SFFHGLFPSGWCLPSPLLLCLSLHLHGGKSPLKDLIEAQRSSLHRSSTSKLLSVKEFYANLYDPEVKSPKQVENLCAYSRFSLLRPDPQELAAKLCTPGRGFELNADGLPLMILRKNMTTLAQTWSILSYCNLVPTSHTSDITLEMAKLIYGIIMKMDMNVGYLISHQISITAQHDSSKLGFPALLTTLCKARG

SEQ ID NO: 149348 - protein, 146 aa, Glycine max
  Coding DNA Sequence Number=SeqID_57663
MTRRDKIWSFCTLVSSKGGGPDDTQRYLTVICTLVSSRGGGPDDARRYPTAAGPMIRGDTLRLSAPLCHPEAVGPMMHGDTLWLSAPFCHPEAAGPMTSRDKIWSFCTLVSSRGGGPDDTRRYLTVIRTLVSSRGGGPDDTRNTYE

SEQ ID NO: 149349 - protein, 49 aa, Glycine max
  Coding DNA Sequence Number=SeqID_57664
MGRSPIELNFRGGAEWRRKRERRRHFKEKMSLEEAHYYRRPWIRAWRKK

SEQ ID NO: 149350 - protein, 263 aa, Glycine max
  Coding DNA Sequence Number=SeqID_57665
  Gene Ontology: Mol. function=peroxidase activity
  Homolog annotation: Hit_ID=A6TC63; Match level="QueryCoverage=100%, HitCoverage=87%, E-value=1e-142, Identity=94%"; Hit description =Putative uncharacterized protein yfeX
  Pfam annotation: Domain name=Dyp_perox; Domain location=5-263; Score =392.3; E_value=7.3e-115; Accession=PF04261.3; Description=Dyp-type peroxidase family
MSQVQSGILPEHCRAAIWIEANVKGDVNALREASKIFVDNVATFQAKFPDAKLGAVVAFGNTVWRQLSGGEGAEELKDFPVYGKGLAPSTQYDVLIHILSARHEVNFSVAQAAVAAFGDAIEVKEEIHGFRWVEERDLSGFVDGTENPAGEETRREVAVIKDGVDAGGSYVFVQRWEHNLKQLNRMSVPDQEMMIGRTKDANEEIDGDERPITSHLSRVDLKEDGKGLKIVRQSLPYGTASGTNGLYFCAYCARLYNIEQQLL

SEQ ID NO: 149351 - protein, 58 aa, Glycine max
  Coding DNA Sequence Number=SeqID_57666
MGSFVAHGRQDVLAAAIGRLEHLGHVRIAGASVTIKQYFGPAPRTSRTSSSMAPEDLE

SEQ ID NO: 149352 - protein, 72 aa, Glycine max
  Coding DNA Sequence Number=SeqID_57667
  Homolog annotation: Hit_ID=A5ATT1; Match level="QueryCoverage=100%, HitCoverage=80%, E-value=8e-18, Identity=51%"; Hit description =Putative uncharacterized protein
MGSAKYEVEKFTGQNDFGLWRLKMRAILMMADGDKKALLQKAHNAIILSLGDKVLRQVSKETTAAGIWLKLE

SEQ ID NO: 149353 - protein, 225 aa, Glycine max
  Coding DNA Sequence Number=SeqID_57668
  Subcellular localization annotation: CTP_CleavageSite=25; ConfidenceScore=5.17e-01
MSNAGRTHAGTLLAQGLPPVRMFFPGEAAMSLVVFDSHAPTAPAVTKAERCARSTLAAAQRLLHTGRASLRVLIQKPPDDRADLGSVGFQRQMAGVVEAHVGARDIPLPGLGAGGQEKGIVLAPHGQQRRLVLAEVRLELRILLDVGGVVQQQVELDVGIAGPGNQVAFERNRVGGHKGLVRNAFEVLPPDRGRRGELAQGVAVGVRWVLPVFLDGRPARPQPLF

SEQ ID NO: 149354 - protein, 264 aa, Glycine max
  Coding DNA Sequence Number=SeqID_57669
  Homolog annotation: Hit_ID=Q6UUU1; Match level="QueryCoverage=22%, HitCoverage=40%, E-value=3e-18, Identity=78%"; Hit description =Putative uncharacterized protein
MVKVGTSYVPINVSFRQKLAQGFPWLLFLSAVPPVQLLTGWCVTAKAPPDISAGKCSGRVPFAIQAAQLLGRAIGAGLFAITPAGERGMCCKAIKLGNARVFPVTTLANWSSTAVAAALELVDPPGCRNSIEVQWHAPVIPATQEAEIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 149355 - protein, 136 aa, Glycine max
  Coding DNA Sequence Number=SeqID_57670
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=38%, HitCoverage=50%, E-value=4e-24, Identity=100%"; Hit description=LacZ protein
  Subcellular localization annotation: CTP_CleavageSite=30; ConfidenceScore=5.06e-01
MLPRLVLNSSPQSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 149356 - protein, 93 aa, Glycine max
  Coding DNA Sequence Number=SeqID_57671
MWIFACKGFYKVEKKSQEPQVAWGLDVGTGCCRTSIKLLCLSSSSLLSRPTLRREGDAGLTGASSKKGKCAESPPTFIQEKCRKNWKGVVYKL

SEQ ID NO: 149357 - protein, 57 aa, Glycine max
  Coding DNA Sequence Number=SeqID_57672
MRGVATNVICGKRQKNRRKPVMKNIPDSGVVFMFEEGRQKWGSCCYVPSIEEEIRST

SEQ ID NO: 149358 - protein, 31 aa, Glycine max
  Coding DNA Sequence Number=SeqID_57673
MDTSKPYTRAMRGTMHEPQVNQGADQKFSPN

SEQ ID NO: 149359 - protein, 317 aa, Glycine max
  Coding DNA Sequence Number=SeqID_57674
MAPKKLSTKRSRRDATGEGSSAASEFDSHRFQSAKHQQRFEVIKGWSFHRERRVQLREDEHTDFQEEIARRHCTPLVTPMAKFDPEIVLEFYVNAWPTEERVWDMRSWVKGQWIPFDADALSQFLGDPLILEEGQQCEFSQRRSQGDGFDEEAIAQLLCIPGQDFARTTAGRRLRIMRTSMTTLTQIWMTLLLSNVLPSDHNSDLPLPKCRMAPTRHPLDPEKSNRALGFPALITSLCQFYGVHVTPSKVIRPPITRAFIEKYFTPRQAQSDEHQAAGAQPPPRQAGSAGPLSMDLSQHGQGFAPFVCPTPEQFGAE

SEQ ID NO: 149360 - protein, 63 aa, Glycine max
  Coding DNA Sequence Number=SeqID_57675
MSSTKIEENHSKCINLTQGKDYGKLGFWLKACSKAGHEICQGLASGSGIKGMSHIISMIHMQQ

SEQ ID NO: 149361 - protein, 50 aa, Glycine max
  Coding DNA Sequence Number=SeqID_57676
VLALDEVQVKDNLTYKAHPQKITDRRMNSLRGKDIALVKVQWGPDEGDST

SEQ ID NO: 149362 - protein, 116 aa, Glycine max
  Coding DNA Sequence Number=SeqID_57677
DSHITVEPVQRSNNVVVDDPLCGLIKSLYDIYEKPIELLWDTTKFGIPNVDASFFLTYSDVNETISGSWMSGAQAWVMVRCMDSLSLSPYTMQRIDVLNVNITLKHGLRNPNERST

SEQ ID NO: 149363 - protein, 84 aa, Glycine max
  Coding DNA Sequence Number=SeqID_57678
MLNLLEETTQKISWRPQELHTAWKSTLPITYHWINYSEDNFLRMGPKVETHFPIHSVSLPSMLKFFAILMFLVILLLLITKCEA

SEQ ID NO: 149364 - protein, 193 aa, Glycine max
  Coding DNA Sequence Number=SeqID_57679
TCKRNLQDSGTLKRVAWGLDVGTRNVEIYHTELDEFKAELERRNFHKRLTNLVDSSIDLALVKEFYANLYSPEGPSPKQTPVVLAEGESLPAYSRYCKMPTDIREIEVALCILGRGFVLNAEGHPGKILRKDLTTLAQVWSVLSYSNLAPTSHTSDLTLDRARLIFGLVSQLDMNVGALISGQITSMAQSNSS

SEQ ID NO: 149365 - protein, 127 aa, Glycine max
  Coding DNA Sequence Number=SeqID_57680
MKKWWATHLQSFADLVFASERINVGLKRGKSDHHTLINAKKTGANEEGEDEEKARAVTAIPIQPSFPPTQQCHYSANNKLSQPTLPREGDARLAGCVFHERNTCGVATNVYLRKTSKKPEKTRSTNL

SEQ ID NO: 149366 - protein, 182 aa, Glycine max
  Coding DNA Sequence Number=SeqID_57681
CGIVMLDFEIRTHFLHHLVIQIGTIVGNDLPRESVPTNQLPLDESDHYTPRDIGVGSHFDPFGEIIHCHENEAMTIRSLGFDGPYDVYPPHGKRPRGGHDVQRMWQSIDIVRERLTFMAFPYMDATITFHGEPVITCSQDFPGHSMPIGVRSERTLLDLLDHVVCLFGIHTSQEIHVMVSFI

SEQ ID NO: 149367 - protein, 65 aa, Glycine max
  Coding DNA Sequence Number=SeqID_57682
MLMFATGYYLFVWMRSLLASAPGRQALGPLTEQIDAIKDVSLIKDVSVFYAEGSSTKHGCLVSLA

SEQ ID NO: 149368 - protein, 269 aa, Glycine max
  Coding DNA Sequence Number=SeqID_57683
  Gene Ontology: Mol. function=enzyme regulator activity; Biological process=regulation of transcription, DNA-dependent
  Homolog annotation: Hit_ID=A9BM46; Match level="QueryCoverage=28%, HitCoverage=68%, E-value=9e-35, Identity=97%"; Hit description =Nitrogen regulatory protein P-II
  Pfam annotation: Domain name=P-II; Domain location=1-75; Score=-46.5; E_value=0.1; Accession=PF00543.13; Description=Nitrogen regulatory protein P-II
RLRDALRAIPNFPGVTLFRAEGFTAPAAIDKRSVKEELTDFSDKIMVCVLAEASMVEPIRAAITSACHSGQVGDGLGAGMQGDIKKSCIPELPQKRWSGIQLLEYGCHAGGRGFSAVHSARSRGYSSAGRALAWHARGHRPRTSPFHGEYRGSNPRRVAKFAALGSKERKSCLPGVVVQLVRIPACHAGGRGFESRPLRQIPCADPRVCADKKPPQGRPSFTDSSAPLHAPCAIVCLFVADAAVHLLRAGGSFGIFRWTGRRWPAGAPS

SEQ ID NO: 149369 - protein, 169 aa, Glycine max
  Coding DNA Sequence Number=SeqID_57684
MASMMEAMLGMRQLMEKNMATAAAVSSAAEADPTLLATVHHPSPNVVGREKSTQGHNSNPHLGYNRVAYPYGLLPNYTPPVMHDDVGHVSSPILEREPPQQPHEAHEDHQEHAQGDVDFYPPIPVEGPTPNTLPQHNLTAQPVFLSTEGPPPATEERRKLDVLEERLKA

SEQ ID NO: 149370 - protein, 232 aa, Glycine max
  Coding DNA Sequence Number=SeqID_57685
  Subcellular localization annotation: CTP_CleavageSite=56; ConfidenceScore=5.53e-01
LPSLGTGVWGANTFPVRKYNSRTFHQKVRRSRLFRFFRRFPQINVGGDSARIPFVEHASRESRVALPPKGRLRQGPNVKTNPLASHGGASVNAVVEDGPSRTKRLGDVATSRCFIYQSLQAACMVSRDGDERDECLFHLGESHDMETCPVVEELLQRLMDCGQLEVFIGGKEEPQICMQSEEKKVPLTPKALVICFTRKGNGSTPIYPRAAPKPTPFAYQSDKAVPWKYTPP

SEQ ID NO: 149371 - protein, 443 aa, Glycine max
  Coding DNA Sequence Number=SeqID_57686
  Gene Ontology: Mol. function=transporter activity; Cellular component= membrane; Biological process=transport
  Homolog annotation: Hit_ID=A7MFA5; Match level="QueryCoverage=100%, HitCoverage=65%, E-value=0.0, Identity=90%"; Hit description =Putative uncharacterized protein
  Pfam annotation: Domain name=BCCT; Domain location=1-269; Score =245.0; E_value=1.7e-70; Accession=PF02028.8; Description=BCCT family transporter
MALIVLSVVIATISVTSGVDKGIRILSELNVALALGLILFVLFMGKTDFLLNALVLNVGDYINRFMGMTLNTFAFDRPTQWMNSWTLFFWAWWVAWSPFVGLFLARISRGRTIREFVLGTLIIPFTFTLLWLSVFGNAALYEIIHGDAGFAQEVMAHAERGFYSLLAQYPAFKFSASVATITGMLFYVTSADSGSLVLGNFTSKLKDINSDAPNWLRIFWSVAIGVLTMGMLMTNGISALQNTTVIMGLPFSFVIFFVMAGLYKSLKVEDHRRASASRDTAPYIPASNDRLSWKKRLSRLMNYPGTRYTQQMMETVIYPAMQDVAKELELRGGRVLLESVAPEEGQPLGYLDLRVHLGEEQDFVYQVWPQQYSVPGFTYRARSGKSHYYRLETFLLEGSQGNDLMDYNKEQVIIDILDQYERHLNFIHLHREAPGSNITYPSV

SEQ ID NO: 149372 - protein, 199 aa, Glycine max
  Coding DNA Sequence Number=SeqID_57687
  Gene Ontology: Mol. function=unfolded protein binding; Cellular component=cytoplasm; Biological process=cellular protein metabolic process
  Homolog annotation: Hit_ID=Q13ZW7; Match level="QueryCoverage=100%, HitCoverage=37%, E-value=1e-75, Identity=75%"; Hit description=60 kDa chaperonin 2
  Pfam annotation: Domain name=Cpn60_TCP1; Domain location=1-185; Score= -242.6; E_value=0.0013; Accession=PF00118.15; Description=TCP-1cpn60 chaperonin family
KIKARVQSIRTQIEEATSEYDKEKLRERVAKLAGGVAVIKIGAATEVEMKEKKDRVDDALHATRAAVEEGIVPGGGVALLRARSRISALKGENDDQEAGVRIVLRAIEEPLRAIVKNAGEEPTVVIAKVLEATGNTGYNAATGEYVDMVETGVVDPTKVTRTALQNAASIAGLILTTDATVAELPKEEKKTSAVPEMDY

SEQ ID NO: 149373 - protein, 280 aa, Glycine max
  Coding DNA Sequence Number=SeqID_57688
  Homolog annotation: Hit_ID=Q6WAY6; Match level="QueryCoverage=65%, HitCoverage=29%, E-value=2e-21, Identity=35%"; Hit description =Putative uncharacterized protein
ELNCGKQVENGVVGVPRKCLEVKARVLASQDEWDPFMDIMALLIFGVVLFPNVDGLVDRTAIDVFLAFYDRKESPVVAILADLYDTFNRRCEKNNARIICCTPALYIWLVSHFFRQEMRHVCPLEGHRSCTEKKEANWDRLLASKEGVSVNWFPRWKEGRTGTLISCGKFPNVPLMGTRGCINYNHVLTIRQLEMPQRKDKELRGSSNGPIGGYHRWLKAYAQDLDWLPSLRTTKGMEGETPEEDEEENAELRDVNIATTKALEQETKKARKEEHGWNKF

SEQ ID NO: 149374 - protein, 79 aa, Glycine max
  Coding DNA Sequence Number=SeqID_57689
  Gene Ontology: Mol. function=ubiquitin-protein ligase activity; Cellular component=ubiquitin ligase complex; Biological process =protein ubiquitination
  Homolog annotation: Hit_ID=A7PI07; Match level="QueryCoverage=78%, HitCoverage=9%, E-value=6e-19, Identity=77%"; Hit description =Chromosome chr13 scaffold_17, whole genome shotgun sequence
PAPRHSRHLCIQDAAAAVIRTGSPHNRENVAAVLWSLCTGDPLQLKLAKEHGAEAALQELSENGTHRAKIKAGSILELL

SEQ ID NO: 149375 - protein, 121 aa, Glycine max
  Coding DNA Sequence Number=SeqID_57690
  Pfam annotation: Domain name=G-patch; Domain location=1-42; Score =20.0; E_value=0.00072; Accession=PF01585.14; Description=G-patch domain
MVVRVMLRNGFEPGMGLGKDCLGNADVVDIKGNPYKYGLGYEPGMQGRRNVPSRFRADRVWPGRISQCFTSTGMVSEEEVAAIEEEFPQDPPSFVQPCHPDSQVGNWRVISQSEVYTADSM

SEQ ID NO: 149376 - protein, 139 aa, Glycine max
  Coding DNA Sequence Number=SeqID_57691
MSTSSSIASTRIRYPIVRPPAIMQFRTFIEIPLFYHEQWAPNYPHEVRFKYNGATYPIRIQQHRGRYFFADGLSDVRADLKIYESIIINFFAYDDNTIFDLHFTPPLNQQTCGRPILHSRVHARRTEITQCIRDAPQPP

SEQ ID NO: 149377 - protein, 31 aa, Glycine max
  Coding DNA Sequence Number=SeqID_57692
MFYGVSYRTRDRARVMGKVEKVQEQMKADME

SEQ ID NO: 149378 - protein, 80 aa, Glycine max
  Coding DNA Sequence Number=SeqID_57693
  Subcellular localization annotation: CTP_CleavageSite=73; ConfidenceScore=5.05e-01
SLKEERNANLIYTGSATSRAYVQSSSNLHSLTFVGLHALTFRGLHVLTIRGLHVLTFRGLRVLTSEDYTSSPSEDYTSSP

SEQ ID NO: 149379 - protein, 180 aa, Glycine max
  Coding DNA Sequence Number=SeqID_57694
MDNEEGVQEQMKADLSALKDQMASISEVMLKLQKTIEDKATATASSTVREAEPVLQPALNPGLDRNTVVFGRRYSPQAYPYGLPSDFTPRATPEDLSQAPTFEGQLPPYEDYPGQDNGEGDTHRGPLLHLKDPSPHELPQPNIARHISASPTPVKESVPFAEDKGKIEALEERLRAVEGL

SEQ ID NO: 149380 - protein, 127 aa, Glycine max
  Coding DNA Sequence Number=SeqID_57695
  Homolog annotation: Hit_ID=Q6WAY6; Match level="QueryCoverage=51%, HitCoverage=11%, E-value=2e-07, Identity=42%"; Hit description =Putative uncharacterized protein
MGTRGCINYNPVLPIRQLGYPMRGAPLEEDLMPIIARGFNSTNAKAIQKVRKAWEMEQKKDKELRGSSNGPISGYHRSLKAYMQGLDWLLNLRTTKGVEVEVSEEDEEVQALRTKLEKTQIVKEKFK

SEQ ID NO: 149381 - protein, 62 aa, Glycine max
  Coding DNA Sequence Number=SeqID_57696
  Subcellular localization annotation: CTP_CleavageSite=30; ConfidenceScore=5.41e-01
MLATHSGYRAMAKKPASNCFLTSFIFKDFRASSFSVSALPGNTRDLEVIGAVQCQNSNWAYL

SEQ ID NO: 149382 - protein, 283 aa, Glycine max
  Coding DNA Sequence Number=SeqID_57697
MASRKCKSIGSRPTTQYARRRFHSLDAWNWYTNNVLGRNILLERKVELYHTELDDFKTKLERRNFHKCLTNLVDGSIDLALVKEFYGNLYSSVGPSPKQARVRGHLVKIDADNLNTFLETPVVLAEGKTLPTYSRYCRLPTDYREIEATLCIPGRGFILNAEGHPGRILRKDLTTLAQVWSVLSYSNLAPTSHTSNLTVDRARLIFSLVSRMDMNIGALMKGSDSSQLNLNSNVQMHWMLSPEVRLIGESSNDNPAHLHGDSNITSDQVSSVHIGNVVASGVM

SEQ ID NO: 149383 - protein, 202 aa, Glycine max
  Coding DNA Sequence Number=SeqID_57698
  Homolog annotation: Hit_ID=A5BSR3; Match level="QueryCoverage=36%, HitCoverage=23%, E-value=6e-10, Identity=43%"; Hit description =Putative uncharacterized protein
DQDDVEDTVYEKYNISKEKWAQLCQTRRDPSWEDVRKKAQAIQKQNTAPHVLSRGGYDYLEQKLLAEKTKKKLEEAAQSGSVDGVIDPSSPIRRHVKWKMARTKKTGEMTTEAAKEIVEKIDSFEEQATQGSFIPHGRQDVLTPTIGCPKHPGRVRAARVGVTIKQYFGSTPQTSRSSSSLPPEELQQLTQQIRDQLEESIT

SEQ ID NO: 149384 - protein, 218 aa, Glycine max
  Coding DNA Sequence Number=SeqID_57699
MEEGFSHGSVPIIFSRPFMKTTQTTIDVYAGTLSMEFGDIVVHFNILDAMKHPSEDHSIFRAEIIDQIVDDYMFDFDFVLHGRKHPFLSDLHTCHSLCIESKSEFEFDPISDFYAKSKFEFESGSDFLGVVPLDVDFLESKCTNHVVGSTYTSDFLYEPAPTLELKPLPTTLKYAYLEDKEKFLVIIFASFVAEQEEKLLLVLKKHKKAIGRTLADIP

SEQ ID NO: 149385 - protein, 191 aa, Glycine max
  Coding DNA Sequence Number=SeqID_57700
  Homolog annotation: Hit_ID=Q84VH5; Match level="QueryCoverage=100%, HitCoverage=28%, E-value=9e-65, Identity=68%"; Hit description =Envelope-like protein
MATSPKETSASGSPSVPSSPHQEQPEFNIQPIQIIPGSAPVPEKLVPKRQQGVKISENPSLATSPREVDTEMDKKIRSIVSSILKNASVPDADEDVPTSSTPNVSVPDADKDVPTSSTPNAEVLPSPSEEESTEEEDQATEETPAPRAPEPTPGDLIDLEEVESDEEPIANKLAPGIAERLQSRKGKTPIK

SEQ ID NO: 149386 - protein, 60 aa, Glycine max
  Coding DNA Sequence Number=SeqID_57701
STLEDPTTPGQFRAEVAWPGDWPEAQAGEAPPEAPGDGEEAHEDEEMADLLDFLGGSGDT

SEQ ID NO: 149387 - protein, 317 aa, Glycine max
  Coding DNA Sequence Number=SeqID_57702
  Gene Ontology: Mol. function=chloramphenicol O-acetyltransferase activity; Cellular component=integral to membrane; Biological process=response to antibiotic
  Homolog annotation: Hit_ID=P62577; Match level="QueryCoverage=60%, HitCoverage=97%, E-value=1e-110, Identity=90%"; Hit description =Chloramphenicol acetyltransferase
  Pfam annotation: Domain name=CAT; Domain location=6-188; Score=417.3; E_value=2.2e-122; Accession=PF00302.9; Description=Chloramphenicol acetyltransferase
MEKKITGYTTVDISQWHRKEHFEAFQSVAQCTYNQTVQLDITAFLKTVKKNKHKFYPAFIHILARLMNAHPEFRMAMKDGELVIWDSVHPCYTVFHEQTETFSSLWSEYHDDFRQFLHIYSQDVACYGENLAYFPKGFIENMFFVSANPWVSFTSFDLNVANMDNFFAPVFTMGKYYTQGDKMLNELQQYCDESNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 149388 - protein, 86 aa, Glycine max
  Coding DNA Sequence Number=SeqID_57703
MIMRGQDIYSSEEEATSSPSSSGSEGEAKGDEHIEEVYPYEEGHIFLGRPWQFEKKATHNGLTNEITLTHGSKKIQTCSLDTFTSC

SEQ ID NO: 149389 - protein, 84 aa, Glycine max
  Coding DNA Sequence Number=SeqID_57704
MNIEESIHITFDESNAILSRKNMLDDIADSLEHMNIHEQDSKGNDKETMKILQKKSNPMMNFQENGKLQEIIPSTTLLVISQKG

SEQ ID NO: 149390 - protein, 144 aa, Glycine max
  Coding DNA Sequence Number=SeqID_57705
DAGSRQARQGASAGVGGCRGWLNYAASEQIVLRVHHMRAIGAGLFAITPAGERGMCCKAIKLGNARVFPVTTLIPTKLNEQNASERNGIKARRTHQYGGEVYSLSINAREGNYEKGTSRIHMEIGHLDRPIPIASRKLPGSQLH

SEQ ID NO: 149391 - protein, 88 aa, Glycine max
  Coding DNA Sequence Number=SeqID_57706
MAHENPPYLAFCTPGQNEIKNKIQGYQREANKNIYIFLNEHQGMKGMEHCVPVSSSMRFFIVIHLFIYSPEHKVQDHHRIQTQTTHRE

SEQ ID NO: 149392 - protein, 67 aa, Glycine max
  Coding DNA Sequence Number=SeqID_57707
MGHLSDQGVPTDSKRIKVIPEWPTPPSVEERIPEFQEPMNLRSNPFQGGGNDAILPPRALDRRLQED

SEQ ID NO: 149393 - protein, 95 aa, Glycine max
  Coding DNA Sequence Number=SeqID_57708
MKEISQDEGEEIRGEERRKILKELRKEKHASCSSHNSCKSLSEEICDYYEGRHRSHLRPHSYRREKERKPQEANINLPYFHGKDNVEANLDWEIR

SEQ ID NO: 149394 - protein, 132 aa, Glycine max
  Coding DNA Sequence Number=SeqID_57709
MECLEGAWETLEGNTRCRFRGTIRFTATSLVHLDEPVRTLQRTVEWILPTPTPYRLVEPVQVIEVTSSEEDPEEDPEELPSEPAVDAINFLEGNEDPLPEVDSPEEVMSASEVDSTEDSGSREMATSGGSSS

SEQ ID NO: 149395 - protein, 124 aa, Glycine max
  Coding DNA Sequence Number=SeqID_57710
  Subcellular localization annotation: CTP_CleavageSite=20; ConfidenceScore=5.46e-01
MLVRMIRTRLFAAARVKSCPSMHSSSVIASLSSCARTVGAPPISGGGPGTVKRKLLVWIWSPLKVRTRSPLKVRACSPFKARMCSPLEVRACSPLLVRTCSPLKARTCSPLKARTCSPLNGEGN

SEQ ID NO: 149396 - protein, 213 aa, Glycine max
  Coding DNA Sequence Number=SeqID_57711
  Homolog annotation: Hit_ID=A5BZH4; Match level="QueryCoverage=39%, HitCoverage=13%, E-value=2e-08, Identity=43%"; Hit description =Putative uncharacterized protein
  Pfam annotation: Domain name=zf-CCHC; Domain location=186-203; Score =22.3; E_value=0.00064; Accession=PF00098.14; Description=Zinc knuckle
MSLHSSSSVNGEGSTPKDPLKTREKRKRKKRVEEISQDEKEKLREEERRKILKELRKEKDASYSSHNSCKSLSEELRDYYEGRHRAHPRPHSHWREKEKKPQEANINLLYFHGKDNVEANLDWEITVEQQLKRKSTSKSYGSHSYPKKDQGQDILGVTPSKPKDDKGKTVEKQPLKASMQEKTSSIKCFKCLGKGHITSQCPTKKTMIMRGPK

SEQ ID NO: 149397 - protein, 86 aa, Glycine max
  Coding DNA Sequence Number=SeqID_57712
MSLHILLFLCVLLGFPQGFMSAGQNRLRPWSDTGTKLKAETNQGKTVLRDGRKQRLGSRPIDRHPLPSFGETLSAAAGQPYPLNSR

SEQ ID NO: 149398 - protein, 67 aa, Glycine max
  Coding DNA Sequence Number=SeqID_57713
MTMSEILSAGMEFDNVVAILEFWYEYVSTNWRTHLRLSEIGGNKKEKVELEKKMERTTLQVCLLQRE

SEQ ID NO: 149399 - protein, 69 aa, Glycine max
  Coding DNA Sequence Number=SeqID_57714
MGLRTRFEGGGLANSARQSIRGAPGSMANNAKQLIRGCRNLPFGGRATRDSRDACSTKGIRAESPPTFI

SEQ ID NO: 149400 - protein, 129 aa, Glycine max
  Coding DNA Sequence Number=SeqID_57715
  Homolog annotation: Hit_ID=A5BSR3; Match level="QueryCoverage=85%, HitCoverage=30%, E-value=1e-10, Identity=40%"; Hit description =Putative uncharacterized protein
MKGIRKKAQEIQKFNDCPHVLSRGGYELLDKKLMEEKSKRGHEEHSCTESPTLNVDPPSLVARHLKWKIARTKRHGQMTSEVAQEIADKIDSLQEQATQGSFVLHGRQDILNTALDRPEHPGRVRVAGT

SEQ ID NO: 149401 - protein, 254 aa, Glycine max
  Coding DNA Sequence Number=SeqID_57716
  Gene Ontology: Mol. function=calcium ion binding; Cellular component =cell projection
  Homolog annotation: Hit_ID=UPI00016621D1; Match level="QueryCoverage =90%, HitCoverage=40%, E-value=5e-17, Identity=30%"; Hit description =UPI00016621D1 related cluster
FPTSNVLAFRGLHTIAFRGLHILAFRGLHLLAFRGLHILAFRGLLALAFRGLHVSAFRGLHALAFRGLQVLVFKGLHVLAFRGLDALTFIGLHALAFRELHALTFRRLHALTFRGLHVLTFRGLHALAFRGLQVLAIRGLHALAFRGLHVLAFRGLHVLAFKGLHALAFRGLHVLAIRGLQILTFRGLHALTFRGLHVLAIRGLHALAFRGLHILPFRGLHVLAFKGLHAIAFRGLHVLVLRGLHVLSSEGCTP

SEQ ID NO: 149402 - protein, 135 aa, Glycine max
  Coding DNA Sequence Number=SeqID_57717
RGLHVLAFRGLHVLTFRGLHVLAFRGLHVLTFRGLHVLTFRGLHALTFRGLQVLAFRGLHALAIRGPHALTIRGLHALAFKGLALPIKGRVVQPFLGHPLILEERPTVLAQLEREAITQLLCIPGQDFIRAAAKR

SEQ ID NO: 149403 - protein, 187 aa, Glycine max
  Coding DNA Sequence Number=SeqID_57718
MASKIQILPVVGVVAMYIMNSIITVLYFNGRVYEDNDGVIFEGSKKAIQIKRGNSFNALKKKIGDKQICDDEDVETMIEIFQQQQQMLVLELYVEKDVAGGSMFHAANSVTSCGGNVSHHESELPRNISNLHVDEDDDDDDYLASNSYVEESFDEDDSDDGISDTDDEVTDIVEPVSIVHPSEGKCL

SEQ ID NO: 149404 - protein, 53 aa, Glycine max
  Coding DNA Sequence Number=SeqID_57719
MFREETGQKHENGSVFSKVGAFRNIFEVGLLKEEATGRQAPPYFVEKWFPRLP

SEQ ID NO: 149405 - protein, 141 aa, Glycine max
  Coding DNA Sequence Number=SeqID_57720
  Gene Ontology: Biological process=thiamin biosynthetic process
  Homolog annotation: Hit_ID=Q1GY92; Match level="QueryCoverage=98%, HitCoverage=22%, E-value=2e-58, Identity=76%"; Hit description =Thiamine biosynthesis protein ThiC
MPMNAIDKNIKFVNADAKVDEAATKPFAKSRKIYVEGSRPDIQVPFREISLSDTPSSFGGDTNPPVVVYDTSGPYTDPNVEIDIRNGLPALRAQWIMERGDVEQLDGPTSEFGHQRLVDPQLAEMRFNLHRKPLRAKAGQN

SEQ ID NO: 149406 - protein, 137 aa, Glycine max
  Coding DNA Sequence Number=SeqID_57721
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=37%, HitCoverage=50%, E-value=4e-24, Identity=100%"; Hit description=LacZ protein
MGSFATYPLTGGRRETRCPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 149407 - protein, 215 aa, Glycine max
  Coding DNA Sequence Number=SeqID_57722
  Gene Ontology: Cellular component=extracellular region; Biological process=pathogenesis
  Homolog annotation: Hit_ID=Q26EM3; Match level="QueryCoverage=34%, HitCoverage=25%, E-value=2e-17, Identity=53%"; Hit description =Putative uncharacterized protein
MNHLKTGFSFFSPSAYKNYKYNGKELQETGMYDYGARMYMSDIGRWGAIDPLAEQMRRHSPYNYAFNNPISFIDPDGRQGTDWIKKDNQWTYDANITTAAQAKAAGADDFAKNGTVISDAKIGSNGEPGYVKLGEGGNASYSDFNGYIGSVMSQIQSYTAGNYVRETPSLNTQEGAFANPSAQLASTMLSAMQEAPLAVAPELIAAKYFRGVTFY

SEQ ID NO: 149408 - protein, 305 aa, Glycine max
  Coding DNA Sequence Number=SeqID_57723
  Gene Ontology: Mol. function=nucleoside-triphosphatase activity; Cellular component=signal recognition particle; Biological process =SRP-dependent cotranslational protein targeting to membrane
  Homolog annotation: Hit_ID=Q6FA31; Match level="QueryCoverage=28%, HitCoverage=23%, E-value=1e-40, Identity=96%"; Hit description=Cell division protein
  Pfam annotation: Domain name=SRP54; Domain location=172-283; Score= -43.8; E_value=5.2e-08; Accession=PF00448.13; Description=SRP54-type protein, GTPase domain
GHQDLFILRSDLPSQWLLFLSAVPPVQLLTGWCVTAKAPPDISAGKCSGHAARRVPFAIQAAQLLGRAIGAGLFAITPAGERGMCCKAIKLGNARVFPVTTLANWSSTAVAAALELVDPPGCRNSIIIANLTERTARGDLIYSHALYKALQEELVALLAPRVKPLHIDPNKSPYVILMVGVNGVGKTTTIGKLAKRLQGEGKKVMLAAGDTFRADQAYRYRRPRGGARYQLLFPLVRVNFELGVIMVIAVSFGKPVVPAALMNRPTRGERRFAYWALAECILAYYVGTDEGVSEVLHVAGEKRLH

SEQ ID NO: 149409 - protein, 115 aa, Glycine max
  Coding DNA Sequence Number=SeqID_57724
MGEVEEIQEKMKADVEAIKEKMATMMEAMMSVKKIMEANAVAISATSVVAKVNPTSPSGINEPSNLRYEMGKLDHLEERLKAIEGGKDYAFANLEELSLEPNIITPPKFKELDFD

SEQ ID NO: 149410 - protein, 48 aa, Glycine max
  Coding DNA Sequence Number=SeqID_57725
  Subcellular localization annotation: CTP_CleavageSite=18; ConfidenceScore=5.03e-01
MRWVKRASIAKCSFSALSATEESGRTSSSRSSAKRSSCLQPGSTHNWH

SEQ ID NO: 149411 - protein, 128 aa, Glycine max
  Coding DNA Sequence Number=SeqID_57726
  Homolog annotation: Hit_ID=Q5QJQ3; Match level="QueryCoverage=59%, HitCoverage=89%, E-value=5e-28, Identity=59%"; Hit description =Putative uncharacterized protein
MAYERGGDFLEDARKILNREVRGPRQSRFSIGSAPLTSITKSDAQISGGETRQDYKDTRRFPLAAPSQFAPSWTVCTNPPFSPTAAPYPVTIVLSPTRKDMQKHHWQQPLVIDFRGVSLEVMRRLRLN

SEQ ID NO: 149412 - protein, 94 aa, Glycine max
  Coding DNA Sequence Number=SeqID_57727
GSAHKTPSGLGGAQQGPGVSDSGITPARHSVDPEKSNRVLELPALITGLCWFYGVSVAPSKGHQALLPIELSLRSTAPPGRRRAKHPQQHWDGR

SEQ ID NO: 149413 - protein, 166 aa, Glycine max
  Coding DNA Sequence Number=SeqID_57728
MTRRDKIWSFCTLVSSRGGGPDDTRRYLTVIRTLLGGGPDDTRRHLTVIRTLVSSRGGRPDDMRRYLTVIRTLVSSRGGGPDDTRRHLTVIRTLVSSRGGGPDDTRRHLKVIRTLVSSRGDGPDETQRPVRSFCTLVSSRGGGPDDTRRYLTVIRTPFVIQRRRAR

SEQ ID NO: 149414 - protein, 349 aa, Glycine max
  Coding DNA Sequence Number=SeqID_57729
  Gene Ontology: Mol. function=sequence-specific DNA binding; Cellular component=intracellular; Biological process=DNA mediated transformation
  Homolog annotation: Hit_ID=P30852; Match level="QueryCoverage=98%, HitCoverage=91%, E-value=1e-116, Identity=63%"; Hit description =Protein smf
  Pfam annotation: Domain name=SMF; Domain location=41-249; Score =361.6; E_value=1.3e-105; Accession=PF02481.6; Description=SMF family
MALLAASHIDDAWLQQHGLDDTQRQQFLALCPRQLEKTQRWLQQAQHHLIACSDAHYPARLREISRYPAALYIAGDLSALATPQLAVVGSRHCSPYGREWGSWFTQQLALSGLTITSGLARGIDGVAHRAALEVQGKTLAVLGSGLNHLYPKSHQPLAQEIIANGGALVSELPLSMAPHAVNFPRRNRIISGLSHGVLVVEASLKSGSLVTARYALEQNRNVYALPGALGNPGCEGTHWLIQQGALLVAHPNNILEDLHSALQWLPASISETIYSQLSDDVPLPFPSVLANVGDEVTPVDVVAERAGQPVPVIAAQLLELELAGWIAAVPGGYVRLRRACHVRRTYVLV

SEQ ID NO: 149415 - protein, 145 aa, Glycine max
  Coding DNA Sequence Number=SeqID_57730
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=35%, HitCoverage=50%, E-value=2e-22, Identity=96%"; Hit description=LacZ protein
MTPVNRKAGTGERTREPPGGKSNSCSPGDPLLLERPPPRRSSNSPYSESYYNSLAVVLQRLDWENPGVTQLNRLAAHPPFASWRNSEEARTDRPSQQLRNLNGEWDAPCSGALSAAGVVVTRSVTATLASADVRRCFCRYAPPRQ

SEQ ID NO: 149416 - protein, 281 aa, Glycine max
  Coding DNA Sequence Number=SeqID_57731
  Homolog annotation: Hit_ID=UPI00016621D1; Match level="QueryCoverage =59%, HitCoverage=41%, E-value=3e-15, Identity=33%"; Hit description =UPI00016621D1 related cluster
IFRGLHVPAFRGLHALAFRGLHVLAFRGIHALAFRGLHALAFRGLHVLAFRGLHVLTFNGLHVLAFRGLHVLTFSGLHALTFRGLHVLAFRGLHVLTFRGLHVLPFRGLYALAFVGLDALTFKGLHALTFRGLHILAFRGLHALAFIGQHALAFRELKLLCLPEQDFTQPLQGDECGSCTPPQLRSTPAKVLVGLCRHDIVDASSIGACRPRIFFINGFLCFLEDEWQRNGERERERRRHFKEKMSLEEAHHHRRPWIRAWRKKEMNEGRGREEHEILCSK

SEQ ID NO: 149417 - protein, 78 aa, Glycine max
  Coding DNA Sequence Number=SeqID_57732
  Gene Ontology: Mol. function=structural constituent of ribosome; Cellular component=ribonucleoprotein complex; Biological process =translation
  Homolog annotation: Hit_ID=A6H5N0; Match level="QueryCoverage=75%, HitCoverage=48%, E-value=1e-26, Identity=100%"; Hit description =Ribosomal protein S12
  Pfam annotation: Domain name=Ribosomal_S12; Domain location=1-77; Score=43.7; E_value=6.5e-10; Accession=PF00164.16; Description =Ribosomal protein S12
MDRILKEKISCRSSSTCNLGFEITAYIPGIGHNLQEHSVVLVRGGRVKDLPGVRYHIVRGTLDAVGVKDRQQGRSSAL

SEQ ID NO: 149418 - protein, 83 aa, Glycine max
  Coding DNA Sequence Number=SeqID_57733
MGKEMITMIVDTLPVFYYEKVVGYTPLSFADFVFVGERIEVRLRRGKFDYPALVNEEAAANEENEKEEGIHVVIAVPTWLNFS

SEQ ID NO: 149419 - protein, 129 aa, Glycine max
  Coding DNA Sequence Number=SeqID_57734
MSEFTSNSPRISANPHQLDLAPYASGSYNAQWNAPELLHDKHMWHSSCILGKMEGGVWHWMCNRQALADLGIAFVDDWVNTGNMSTIVATYPSVGRRRETHGNKGSGVVYAQGRVDKSGALAPTYPQLR

SEQ ID NO: 149420 - protein, 293 aa, Glycine max
  Coding DNA Sequence Number=SeqID_57735
  Homolog annotation: Hit_ID=A5B5G7; Match level="QueryCoverage=71%, HitCoverage=14%, E-value=2e-08, Identity=25%"; Hit description =Putative uncharacterized protein
FTSQETWERYTDIVVPRKLLPERNEVVYYTEFDEFKEELERRHWDEKLSDFFDNSIDINIVKEFYANLYDLEDKSPKQVRVRGHLVKFDEDTFNTFLKTHVVLEEGENLCTYSRFAILRPDPQELAAKLCIPGRGFKLNADGQPLKILRKNMTTLAQTWSIFSFSNLIPASHTSDVTLDIAKLIYGIIMKMDMNLGYLISHQISLVAQHDTSRLGFPTLIIALCKARGVQSDSRSLESLSPAINLAYIKKNCWNLDDPTVTFRGPRKAKGNRSEAPTISAPPETPAPSSSTAP

SEQ ID NO: 149421 - protein, 233 aa, Glycine max
  Coding DNA Sequence Number=SeqID_57736
  Gene Ontology: Mol. function=4 iron, 4 sulfur cluster binding; Cellular component=mitochondrion; Biological process=biotin biosynthetic process
  Homolog annotation: Hit_ID=P36569; Match level="QueryCoverage=50%, HitCoverage=33%, E-value=2e-62, Identity=97%"; Hit description =Biotin synthase
  Subcellular localization annotation: CTP_CleavageSite=47; ConfidenceScore=5.29e-01
MGNTAEHHVRHLSPAAGWRPDFRRGWCNRGSPPTRRTCRLPDAGRPPAAARRRWPTRSGNRVTGGSWRCRGARYDVGQTPGRKAVIDILVNQIELRLVDSISTIFKLATLFRFGDAMMADRIHWTVGQAQALFDKPLLELLFEAQTIHRQHFDPRQVQVSTLLSIKTGACPEDCKYCPQSSRYKTGLEAERLMQVEQVLESARKAKANGSTRFCMGAAWKNPHERDMPYLQQM

SEQ ID NO: 149422 - protein, 111 aa, Glycine max
  Coding DNA Sequence Number=SeqID_57737
MVFEILAIKISIPVNIGSNQAQSFKKRILSSQEKDRALRHPYQTRAKARIISEIEKVQEQMKADMEAMKEKMTMMMEEMMSTRKMMEDNTTTIVVASTTTKMDPIHPIGFN

SEQ ID NO: 149423 - protein, 147 aa, Glycine max
  Coding DNA Sequence Number=SeqID_57738
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=35%, HitCoverage=50%, E-value=4e-24, Identity=100%"; Hit description=LacZ protein
MVRTFLQNTVALTGLPMILPSESDLTCYPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 149424 - protein, 134 aa, Glycine max
  Coding DNA Sequence Number=SeqID_57739
MTQELVTRGDTLTVIRTSSFSHPKGGGPDDTRRYLTVIRTLVSSRGGGPDDTRKYLTVTRTLVSSRGSGPDDMRRYLTVIRTLVSSRGGGPDDTRRYLTVIRTLLSSRGGGPDDKQRQNLVILHPCVIQRRRAR

SEQ ID NO: 149425 - protein, 223 aa, Glycine max
  Coding DNA Sequence Number=SeqID_57740
  Homolog annotation: Hit_ID=A1G005; Match level="QueryCoverage=28%, HitCoverage=17%, E-value=4e-23, Identity=85%"; Hit description =Putative uncharacterized protein
RQRVRAAAAAHAHGRSLELVSRERQWEFVPARGGEVGDVSADNARWALDEAGLRALAGVRAERGIYPVVEALRIEVGVRAACCADGSDPRSRSGQAFSLQRGLHAGVGIHARLVGGQVVQAGQVDLGAGGPAQGDVEVRIGEAAEAGQPRLVGQLLVGGLEQATQALVRGGADRIELALVGDELARREQRREGRMHIGIDEGQPAGGFGALARAAIATEAGLR

SEQ ID NO: 149426 - protein, 221 aa, Glycine max
  Coding DNA Sequence Number=SeqID_57741
  Gene Ontology: Mol. function=DNA-directed DNA polymerase activity; Cellular component=extrachromosomal circular DNA; Biological process= DNA replication initiation
  Homolog annotation: Hit_ID=Q0H045; Match level="QueryCoverage=96%, HitCoverage=65%, E-value=6e-81, Identity=71%"; Hit description =Replication initiation protein
  Pfam annotation: Domain name=Rep_3; Domain location=15-163; Score =25.4; E_value=2.2e-05; Accession=PF01051.12; Description=Initiator Replication protein
FAKLCGIPSSRSSKQLRERISPSLKRIASTTISFSSKSGDDAKEYITHLVQSAFYDTKKDIVILQADPKLFELYEFDHKVLLQLKAINALKRRESAQALYTYIESLPKNPAPISLARLRERLNLRSPVFSQNQTVRRAMEQLKEIGYLDYSEVQKGRSVYFQVHNRYPKLRAPKTEQLEAPKATTKTKEPLDPQLQEKIELLDKLGISLQDLERFLSLSST

SEQ ID NO: 149427 - protein, 38 aa, Glycine max
  Coding DNA Sequence Number=SeqID_57742
GDARVHECVFQERKMRGVATNVYSRKTSENRKDVIYKL

SEQ ID NO: 149428 - protein, 258 aa, Glycine max
  Coding DNA Sequence Number=SeqID_57743
  Gene Ontology: Mol. function=motor activity; Cellular component=cell projection
  Homolog annotation: Hit_ID=UPI00016621D1; Match level="QueryCoverage =98%, HitCoverage=41%, E-value=8e-17, Identity=32%"; Hit description =UPI00016621D1 related cluster
HVLTFRGLHTLICRGLCVRPLRGLHALAFRGLHTLIFRGLYVLPLRGQHVIAFIGLHALAFRGLHVLAFRGLHILTFRGLHTLIFRGLHVLTFRGGLHVLIVRGLHAFTFVGLHALTFRGLHVLAIRGSCTFTFKGLPVLTSRGLHVLASRGLHVLAFRGLHVLAIRGLHVLAFRGLHVLTFRGLHSLTFVGLHALTFRGLHVLAFRGSCTFTFRGLHVLASKGLHVLAFRGLHVLAIRGLHVLTFRGLRVLTFRGLR

SEQ ID NO: 149429 - protein, 133 aa, Glycine max
  Coding DNA Sequence Number=SeqID_57744
LCQSFGVPVVPSKVIRPPITRAFIEKYCTQRQAQGDAPQAADAPPPHQASPAGSFDTEQYLRHLMSLSLQSQGFTSFPCPTPDQFRAEVAWPGDWPEARAGEAPAEAPDEADEAREDEEMADLFDFLGGSGAT

SEQ ID NO: 149430 - protein, 211 aa, Glycine max
  Coding DNA Sequence Number=SeqID_57745
FSSYRMQKVYTNTHSGISARQRDSKVSMTDLVSAEDDVNLHVSTGLSAAIDEGRRRPTLVSACVSGFSSYRMQKVYTNNHSGISARQRDSKVSMTDLVSAEDDAFRLTDKQKVYMDNHSGISGRQRDSKVSMTDLVSAEDDVAEDDVSLCVLSGFLSYRMQKVYTDNHSGISGRQRDSKVCMTDLVSAEDNLNLHVSTGLSAAIDEGRRRR

SEQ ID NO: 149431 - protein, 70 aa, Glycine max
  Coding DNA Sequence Number=SeqID_57746
QEIAQKPLEGPRFDNYYLHPVATYPSAGGRRETRGMRVPRKEYARSRHQRFFEENVRKTGKDAIYELLSE

SEQ ID NO: 149432 - protein, 151 aa, Glycine max
  Coding DNA Sequence Number=SeqID_57747
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=34%, HitCoverage=50%, E-value=4e-24, Identity=100%"; Hit description=LacZ protein
  Subcellular localization annotation: CTP_CleavageSite=45; ConfidenceScore=5.04e-01
MPSENRIQPGFQYGRPFCPSARRRPPESNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 149433 - protein, 63 aa, Glycine max
  Coding DNA Sequence Number=SeqID_57748
MSSSLDTITKCPSTMNFNFWWSVEGTTPTEWIHGRPKRQLEVDLSPNLSAGAVEGTNYHGTWL

SEQ ID NO: 149434 - protein, 43 aa, Glycine max
  Coding DNA Sequence Number=SeqID_57749
LADSNDEMSIDLRKNPLQEGGDDAFLPRRGPIPRAMARRLQED

SEQ ID NO: 149435 - protein, 84 aa, Glycine max
  Coding DNA Sequence Number=SeqID_57750
MTNIAARLKTLGMAVNENFIVQYVSSEETRFLFKNQESHLVHYVSHQGTGVGKRLVKKHDRGKGPLKINDNSTCNLDFRRIKEQ

SEQ ID NO: 149436 - protein, 279 aa, Glycine max
  Coding DNA Sequence Number=SeqID_57751
  Gene Ontology: Mol. function=cation transmembrane transporter activity; Cellular component=integral to membrane; Biological process=cation transport
  Homolog annotation: Hit_ID=Q47GU7; Match level="QueryCoverage=83%, HitCoverage=22%, E-value=1e-70, Identity=56%"; Hit description=Heavy metal efflux pump CzcA precursor
MVGDVNNTVQTALAGNAANTFYDGDRHFDVTLRLDRPFRDSVDDIDELPIALPNGAGSIPLSEVAEVSIKQGASRVSREAGARIVSIKANITDRDQGSFVKEAMQTVKAKVKLPPGYTMTWGGQFENQQRAMKRLMVIVPLSVLLIFVLLFWAFKSVKNALLVLLMIPFTLVGGLAGLAIAGLHLSVSAAVGFIALAGISVQNGVIMVEQIKKLMREGQSVTESVIEGAVARVGLNAGRVIPWYRFRNTTAFCGGDCGWPDYCHSVHFAVTAAVVPAIF

SEQ ID NO: 149437 - protein, 154 aa, Glycine max
  Coding DNA Sequence Number=SeqID_57752
  Pfam annotation: Domain name=Transposase_23; Domain location=34-104; Score=-6.8; E_value=0.0066; Accession=PF03017.5; Description =TNP1ENSPM transposase
MQSQGLALPLVGPSVPQVNTKESCVDPSGSDPETGDSDRCGLYIEANPAHLVALGRVYEGSTIVHKTPLLSGQVKVGVEEVKDLDASIPVPNDEVSLVGHAIDTFLTWPKHLVKPLSQQAIVSPAKPPQTPDPEVDDPLYLMTLTILELFLRPY

SEQ ID NO: 149438 - protein, 139 aa, Glycine max
  Coding DNA Sequence Number=SeqID_57753
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=37%, HitCoverage=50%, E-value=4e-24, Identity=100%"; Hit description=LacZ protein
  Subcellular localization annotation: CTP_CleavageSite=33; ConfidenceScore=5.01e-01
MKHFTDTLISANIKQSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 149439 - protein, 95 aa, Glycine max
  Coding DNA Sequence Number=SeqID_57754
MNLKLIVRMHSILLRCLTVETMFCSGLDPLLMKRICGGHYKEHNANSCTTIKQIYNARNAYRSSIRGSDTEMQHLMKLLERDQYIHWHRLKDEDM

SEQ ID NO: 149440 - protein, 43 aa, Glycine max
  Coding DNA Sequence Number=SeqID_57755
MTCCSRRNKRMTKLGLCLSSGPPPLDDKKGADNRKVSPRATSS

SEQ ID NO: 149441 - protein, 121 aa, Glycine max
  Coding DNA Sequence Number=SeqID_57756
  Gene Ontology: Mol. function=nucleic acid binding; Cellular component= nucleus; Biological process=regulation of transcription
  Homolog annotation: Hit_ID=A2Q2U3; Match level="QueryCoverage=100%, HitCoverage=22%, E-value=3e-53, Identity=85%"; Hit description=CENP -B protein; Homeodomain-like
  Pfam annotation: Domain name=CenpB-DNA-bind; Domain location=1-56; Score=61.9; E_value=2.1e-15; Accession=PF09091.2; Description =Centromere binding protein B, DNA bind
MEKVVYEWFLQHQERVNITRELILQKARDIMKLVYPHDNSDFNFSIGWLGKFKHRHGIKSFRHFGESGFVDVQDMEQKLVSIREKINQFPMKDVFNMDETGLFYRLQADHSLATKQLEGRK

SEQ ID NO: 149442 - protein, 123 aa, Glycine max
  Coding DNA Sequence Number=SeqID_57757
  Subcellular localization annotation: CTP_CleavageSite=22; ConfidenceScore=5.22e-01
MARTCSPLKVRTCSPLNVRTCSPTKVKAHDPLTARTFSPLKLKVHDPLKARTRSPLKVKARTYSPLEVRACSPLVVRTCSPLKARTCSPLTVRYPRVHPYEKARDRLIERAGHPKFKRFGHLD

SEQ ID NO: 149443 - protein, 86 aa, Glycine max
  Coding DNA Sequence Number=SeqID_57758
  Subcellular localization annotation: CTP_CleavageSite=28; ConfidenceScore=5.15e-01
MVKVGTSYVPINVSFSPKLLAQGFFPVEAQQGQIFRTSLVFRAPVAYHGFYQLFPPVQLLTGMVYVQFGTQAYRRTSALASVAGAT

SEQ ID NO: 149444 - protein, 150 aa, Glycine max
  Coding DNA Sequence Number=SeqID_57759
GSHPQRHPVDLKKYNRALGFPALVTGLCRPYRAPVPPASSYHHDIGKDRARKTPSGPEEGQQGLGVASSKYGSLSVQGSASCPQQGHQAPYQSSFHQEVLRPQTDAGRDTTVALGWPVAGNRRTVTTSRVHLCSSTKRFEYCLHQVQSQR

SEQ ID NO: 149445 - protein, 69 aa, Glycine max
  Coding DNA Sequence Number=SeqID_57760
MSPPPLEPHNHSQTHLKLSGRLPLQAMFSAGGLDGACMLSATLDRLAHISGFRLSACFSRSVDGLKQCA

SEQ ID NO: 149446 - protein, 143 aa, Glycine max
  Coding DNA Sequence Number=SeqID_57761
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=36%, HitCoverage=50%, E-value=4e-24, Identity=100%"; Hit description=LacZ protein
MKHFTDTLISANISICLPSARKASPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 149447 - protein, 88 aa, Glycine max
  Coding DNA Sequence Number=SeqID_57762
MHRRPQTHCHHLIRQIQLGHLAWSGIYSTWFSSRRPTTGGRAEVAWPRDCPEAQAGEAPVEAPDDAEEARMDEEMSDLLGFLGGSGAT

SEQ ID NO: 149448 - protein, 116 aa, Glycine max
  Coding DNA Sequence Number=SeqID_57763
MNSLREHAALSEFISTHYMASRKHKSIGSRPTTQYDTRRFSSLDAWTRYTDNFLGRNILLEREVEIYHSELDEFKAKLERRNFHKCLTNLVDGSIDLALVKEFYTNLYSSEDHPPK

SEQ ID NO: 149449 - protein, 244 aa, Glycine max
  Coding DNA Sequence Number=SeqID_57764
  Gene Ontology: Mol. function=carbohydrate binding; Cellular component= periplasmic space; Biological process=carbohydrate biosynthetic process
  Homolog annotation: Hit_ID=A6T9V4; Match level="QueryCoverage=100%, HitCoverage=45%, E-value=1e-123, Identity=88%"; Hit description =Putative enzyme
  Pfam annotation: Domain name=MdoG; Domain location=35-244; Score= -214.4; E_value=2.1e-05; Accession=PF04349.3; Description=Periplasmic glucan biosynthesis protein, MdoG
MAVAAVCGTSGVASLFTKAAFAADSAIADGQTRRFDFSVLQAMAHDLARQPWGGAPRDLPPTLANLTPQAYNSIQYDAAHSLWNNVEERKLDIQFFHVGMGFRRRVRMFSLDAQSQQAREIHFRPELFQYNDAGVDTKQLEGQTDLGFAGFRVFKAPELARRDIVAFLGASYFRAVDSTYQYGLSARGLAVDTFTDTPEEFPDFTSFWFETVKPGATVFTVYALLDSLSVTGAYKFTVNCQQTQ

SEQ ID NO: 149450 - protein, 94 aa, Glycine max
  Coding DNA Sequence Number=SeqID_57765
MTNRLRYLLFPLTKIQGTNRLRFLCLNTLEGTSFVVQVERTSTWVVILRIREGTSLVDQFKWSVHPLGCSKRTREGFYKVIGNLKNRWLLGDWM

SEQ ID NO: 149451 - protein, 118 aa, Glycine max
  Coding DNA Sequence Number=SeqID_57766
MAASDHAILRDREHIPTKRSLQELTSQDELLAHNKLLSKQLEALTKTLSCVICGGAHDSGCCIPTEDTTPEVNYTGNQPRPNFNADRPSSYFGANIEKNPKEECKAVMTSSKMVSMDE

SEQ ID NO: 149452 - protein, 47 aa, Glycine max
  Coding DNA Sequence Number=SeqID_57767
MAEKPNTWENSLRIKEGSFVGKLEEESFLEKLGRATHTLPIAKLTPC

SEQ ID NO: 149453 - protein, 52 aa, Glycine max
  Coding DNA Sequence Number=SeqID_57768
SVFRVTSYDEDMTKSKGKDPLEGLGGPMTRARARKSKEALQQVLSILLNTSP

SEQ ID NO: 149454 - protein, 31 aa, Glycine max
  Coding DNA Sequence Number=SeqID_57769
MVLLAKGVTVVEAVVVVVDMRVVETMVVVEK

SEQ ID NO: 149455 - protein, 235 aa, Glycine max
  Coding DNA Sequence Number=SeqID_57770
  Gene Ontology: Biological process=transposition, DNA-mediated
  Homolog annotation: Hit_ID=Q6UUU1; Match level="QueryCoverage=25%, HitCoverage=40%, E-value=3e-18, Identity=78%"; Hit description =Putative uncharacterized protein
MVKVGTSYVPINVSFRQKLAQGFPVLQWLLFLSAVPPVQLLTGWCVTAKAPPDISAGKCSGHAARRVPFAIQAAQLLGRAIGAGLFAITPAGERGMCCKAIKLGNARVFPVTTLKELKIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 149456 - protein, 114 aa, Glycine max
  Coding DNA Sequence Number=SeqID_57771
  Gene Ontology: Biological process=transposition, DNA-mediated
  Homolog annotation: Hit_ID=Q1J7G7; Match level="QueryCoverage=28%, HitCoverage=45%, E-value=3e-11, Identity=100%"; Hit description =Transposase
VLQWLLFLSAVPPVQLLTGWCVTAKAPPDISAGKCSGHAARRVPFAIQAAQLLGRAIGAGLFAITPAGERGMCCKAIKLGNARVFPEFDGTAAKAIAPRAEIATQDFLKNWQAS

SEQ ID NO: 149457 - protein, 99 aa, Glycine max
  Coding DNA Sequence Number=SeqID_57772
  Homolog annotation: Hit_ID=A0ST23; Match level="QueryCoverage=26%, HitCoverage=53%, E-value=1e-07, Identity=100%"; Hit description =Putative reverse transcriptase
  Subcellular localization annotation: CTP_CleavageSite=42; ConfidenceScore=5.04e-01
MANLAVRNGCDTMIWIRDATAAESSLSIPSTSRGGPVPAFVPFSEVGKPVVPAALMNRPTRGERRFAYWALAECILAYYVGTDEGVSEVLHVAEKKGCT

SEQ ID NO: 149458 - protein, 133 aa, Glycine max
  Coding DNA Sequence Number=SeqID_57773
  Homolog annotation: Hit_ID=Q6WAY6; Match level="QueryCoverage=64%, HitCoverage=15%, E-value=2e-07, Identity=36%"; Hit description =Putative uncharacterized protein
MGTRGCINYNPVLAIRQLGYPTRGAPLEDKLTPVISRGFNKTNVETLQKVRKAWEVLQKKEKELRGSNNGPIGGYRKWLKAYVQGLDWLPSLRTAKREEVEAPEEDKEVQALRTELDQAQIVKERFKSAALKI

SEQ ID NO: 149459 - protein, 140 aa, Glycine max
  Coding DNA Sequence Number=SeqID_57774
MSYANLLPSLLSNQLAVDSLNVRTNPLANHGGLTVNAVEEWESRGLKQIGDVSTSRRFILEALREADVIDLDGNKGDLCLMHPGASHDVETCPIVEELLQGMINRGQIEIHSAKKEEGEGHYHLEALRLPALNSKDAYTL

SEQ ID NO: 149460 - protein, 265 aa, Glycine max
  Coding DNA Sequence Number=SeqID_57775
  Gene Ontology: Biological process=transposition, DNA-mediated
  Homolog annotation: Hit_ID=Q6UUU1; Match level="QueryCoverage=22%, HitCoverage=40%, E-value=3e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPEFDPYSLWVVVHACGIEVHAVSRLVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 149461 - protein, 278 aa, Glycine max
  Coding DNA Sequence Number=SeqID_57776
  Gene Ontology: Biological process=transposition, DNA-mediated
  Homolog annotation: Hit_ID=Q6UUU1; Match level="QueryCoverage=21%, HitCoverage=40%, E-value=4e-18, Identity=78%"; Hit description =Putative uncharacterized protein
MVKVGTSYVPINVSFRQKLAQGFPVLQWLLFLSAVPPVQLLTGWCVTAKAPPDISAGKCSGHAARRVPFAIQAAQLLGRAIGAGLFAITPAGERGMCCKAIKLGNARVFPVTTLNSILPVQFLGLGPSVVSEGSPSVAPPEVSEFRTFCPISSSLSIPSTSRGGPVPAFVPFSEVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 149462 - protein, 137 aa, Glycine max
  Coding DNA Sequence Number=SeqID_57777
  Gene Ontology: Mol. function=endonuclease activity
  Homolog annotation: Hit_ID=Q9AY32; Match level="QueryCoverage=35%, HitCoverage=72%, E-value=2e-12, Identity=79%"; Hit description=RRNA intron-encoded homing endonuclease
QSKSLNEDPLEGKSGASSRVKKLVVGPWVGSIGPPPVCTGRLVPSAGDALLSLTGRVVASGADSDPIVLAFGIGVMINKDSRGHSYFIVRGITDVLLGLRWHPYEKSKSLGSGGSMVARLKLKGIDGRAPPGVEPAA

SEQ ID NO: 149463 - protein, 66 aa, Glycine max
  Coding DNA Sequence Number=SeqID_57778
MTKLGLCLSSGPPPLDDKRVRITVRYLRVSSGPPPLDDTRVDKSGALAPTYPPSKRKSDLRSSFFK

SEQ ID NO: 149464 - protein, 72 aa, Glycine max
  Coding DNA Sequence Number=SeqID_57779
MMAHQRASEVRLMGVLSKGGKMRGAATNVYLWKTSEKPKETGQKENSKFGSCRQKRGSCSYVPFIEEEIRPT

SEQ ID NO: 149465 - protein, 45 aa, Glycine max
  Coding DNA Sequence Number=SeqID_57780
MGQMIGDEGWARGLRTSLGVGVGTWGASLWVGALGCTGAELEAFP

SEQ ID NO: 149466 - protein, 49 aa, Glycine max
  Coding DNA Sequence Number=SeqID_57781
MPKDRGRIVIIKKGEIVDKGSSRCFDDAKRSHASQSFIQDKEIKDIQDG

SEQ ID NO: 149467 - protein, 71 aa, Glycine max
  Coding DNA Sequence Number=SeqID_57782
MQVGSATFIIRVIKHSSICSGDSKILQVASRFQDYLLSATSLFQDVKTSHVTSAFCSPCLHALTAASSISY

SEQ ID NO: 149468 - protein, 97 aa, Glycine max
  Coding DNA Sequence Number=SeqID_57783
MSDFLFDGGLLSFETNVGGANTFLKRKYNSRQTWEVLIPFVLTGFLWFFRRFPQINVGGDSVHLSSFGKCTCEPRLARPQKGMLRQLATPLGTIFVS

SEQ ID NO: 149469 - protein, 168 aa, Glycine max
  Coding DNA Sequence Number=SeqID_57784
  Subcellular localization annotation: CTP_CleavageSite=73; ConfidenceScore=5.45e-01
MVKVGTSYVPINVSFSPKVGPGLSRYQQPWTPGSCYLDISMRQTNSVKLIGQSRPRGARTTFVPFMSTEPDISASVKPGVPKSELTTPRLNCVAAQLPAFQFGPCRANCLRGQRAGIECGFAYYARALSGVCILAYYGEFLGLHRGGGTALELVEFPPGQEFDPLSQA

SEQ ID NO: 149470 - protein, 172 aa, Glycine max
  Coding DNA Sequence Number=SeqID_57785
  Pfam annotation: Domain name=Transposase_23; Domain location=65-124; Score=0.8; E_value=0.00097; Accession=PF03017.5; Description =TNP1ENSPM transposase
  Subcellular localization annotation: CTP_CleavageSite=32; ConfidenceScore=5.06e-01
MELDAIKSELSQIHTQQSAPPRPSNPDVFVARVSTKESYAEAANNVVGNERSTFDTCSMGFYIVCGDSTQLVAGGKVFGVGGTIHTVAYGDDVVRVCVDTIYDGEAVVPLPTSKIQYVRDAVNSFIGWPRHLVKPLSYDSDLNVRKPVEHSGDAKLAESSGSAVGGEPIWTS

SEQ ID NO: 149471 - protein, 152 aa, Glycine max
  Coding DNA Sequence Number=SeqID_57786
GLHVLTFVGLHALTFRGLHILAFRGLHVLTLRGLNVLALRGLHVLTIRGLHALTSRGLQVLALRGLHVLTIRGLHALTSRGLHVLALRGLLTLALGTSYPHLQRIHDVGYNVQDILPENTGRQDKSQMKNGSCRIHDVGYDVQDILPENTGH

SEQ ID NO: 149472 - protein, 167 aa, Glycine max
  Coding DNA Sequence Number=SeqID_57787
  Gene Ontology: Mol. function=aspartic-type endopeptidase activity; Biological process=proteolysis
  Homolog annotation: Hit_ID=A5B3J2; Match level="QueryCoverage=98%, HitCoverage=31%, E-value=2e-13, Identity=33%"; Hit description =Putative uncharacterized protein
MHRSPTSNLVPLDLEIEATLRKNRAERRRKLLQDRTVASILEEETHFSDSFSPDSPSSRESATQLPETTIMADEQHQRITLEDYSSSSVLQFFTSIARPEVQAHNINYPHSLIHLIQENLFQGLPNEDPYAHLTMFIEICKIVKIAGVPDEAIRLGLFSFSLAGEAK

SEQ ID NO: 149473 - protein, 187 aa, Glycine max
  Coding DNA Sequence Number=SeqID_57788
  Homolog annotation: Hit_ID=UPI00016621D1; Match level="QueryCoverage =87%, HitCoverage=41%, E-value=3e-16, Identity=34%"; Hit description =UPI00016621D1 related cluster
MTGSLDESISCFLRRVDPWVLVPIAFRGLPVLTFRGLQVLAIRGLHVLALRGLHVLTFRGLHALAFRGLYVLTFRGLHVLAIRGLHVLTFRGLHALTFRGLHVLTFRGLHVLAFIGLHAFTFRGLHALAFRGLHVLTFRGLHTLTFRGLDVLAFRGLHAFAFRGLHVLAFRGLHALAFKGLYALAFK

SEQ ID NO: 149474 - protein, 57 aa, Glycine max
  Coding DNA Sequence Number=SeqID_57789
MPEIKKKILMHNQGVNSNSNLGPSGTFWKLGCLRRKQLGGKLLHVFEKWFPGLPRLP

SEQ ID NO: 149475 - protein, 434 aa, Glycine max
  Coding DNA Sequence Number=SeqID_57790
  Homolog annotation: Hit_ID=Q6WAY4; Match level="QueryCoverage=78%, HitCoverage=67%, E-value=6e-09, Identity=25%"; Hit description =Putative uncharacterized protein
MASQEEWVPFADILALLIFGVVLFPNVDGLVDLAAIDAFLAYHHSKESPVVAILADLFDTFDRRCEKNSARIVCYLPALCVWLVSHLFQQDIRHPCPFQSYRSCVEKRRVDWDQYLAGIGGSTINCLGYPMRGAPTEESLSPFLVRDFGTQSLKVVQRVHKAWKSPLRKDKELRGIRNGIIGSYHEWLRVHTRGLDWLSKLKVINEENFEAPEEDEEVQALKLELGKARLAKEKFKSAATNIRKECAELREENAAIARVLEQETKRAHKEEHRQDKFQGALWGNNNELKLRREERDQSRVYGMILKEELAACSRSKRSLAQHLEATEQSILSIIGQYKEELNQSLTHEQKLVEDFAQAYAEKEAIGRVIDVLHQEATMWMDRFALTLNGSQDLPRLLAKAKAIAEVCSAPEEIHGLINYYQHMIDLMAHIIRNR

SEQ ID NO: 149476 - protein, 191 aa, Glycine max
  Coding DNA Sequence Number=SeqID_57791
  Gene Ontology: Mol. function=sequence-specific DNA binding; Cellular component=intracellular; Biological process=response to DNA damage stimulus
  Homolog annotation: Hit_ID=Q2NV59; Match level="QueryCoverage=99%, HitCoverage=94%, E-value=7e-89, Identity=86%"; Hit description =Recombination protein recR
  Pfam annotation: Domain name=RecR; Domain location=28-69; Score=77.7; E_value=3.9e-20; Accession=PF02132.6; Description=RecR protein
  Pfam annotation: Domain name=Toprim; Domain location=71-164; Score =83.7; E_value=6e-22; Accession=PF01751.13; Description=Toprim domain
  Pfam module annotation: Pfam domain module=RecR::Toprim; Domain location=28-69::71-164
MEALRCLPGVGPKSAQRMAFQLLQRDRSGGMRLAQALTRAMSEIGHCADCRTFTEQDVCTICANPRRQQNGQICVVESPADIHAIEQTGQFAGRYFVLMGHLSPLDGIGPGDIGLDRLEQRLEKESITEVILATNPTVEGEATANYIAEMCGQYGVLASRIAHGVPVGGELEMVDGTTLSHSLAGRHAIKF

SEQ ID NO: 149477 - protein, 96 aa, Glycine max
  Coding DNA Sequence Number=SeqID_57792
MIMRGQDIYSSQDEVTTSPSYTESEETKGEESSEEIYLQEEGQPLMVKEECKEVSVSSKSIATPLGLESIPQVKEWLDKGLVRKSLNPCALLVPKI

SEQ ID NO: 149478 - protein, 128 aa, Glycine max
  Coding DNA Sequence Number=SeqID_57793
LERIDGGPALRGTRIRATWEYVSSVGGGQQGMVGLYVICGCGELSCTIARPPPMVPGDMSWGSGDLGDVRRAPGSLQIKGTKTTKQGGLCDIWVMASGNWKIVEASGNRLPVCVIDYTKEWVIGNRLP

SEQ ID NO: 149479 - protein, 88 aa, Glycine max
  Coding DNA Sequence Number=SeqID_57794
MMITKDDDKGDDKKLKGQSKDEFKMFKKKSRTLRDSRGRMNSRIKIQGSSFKNQDQDSRFKIQDSRFKIQDSRIKRRLNQDKYEKNFS

SEQ ID NO: 149480 - protein, 272 aa, Glycine max
  Coding DNA Sequence Number=SeqID_57795
  Gene Ontology: Mol. function=chloramphenicol O-acetyltransferase activity; Cellular component=integral to membrane; Biological process=response to antibiotic
  Homolog annotation: Hit_ID=P62577; Match level="QueryCoverage=56%, HitCoverage=69%, E-value=3e-90, Identity=100%"; Hit description =Chloramphenicol acetyltransferase
  Pfam annotation: Domain name=CAT; Domain location=1-143; Score=302.6; E_value=7.5e-88; Accession=PF00302.9; Description=Chloramphenicol acetyltransferase
MNAHPEFRMAMKDGELVIWDSVHPCYTVFHEQTETFSSLWSEYHDDFRQFLHIYSQDVACYGENLAYFPKGFIENMFFVSANPWVSFTSFDLNVANMDNFFAPVFTMGKYYTQGDKVLMPLAIQVHHAVCDGFHVGRMLNELQQYCDEWQGGAPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 149481 - protein, 204 aa, Glycine max
  Coding DNA Sequence Number=SeqID_57796
GLHVLTIRGLDALTSRGLHVLALRGLHALTLGTSYPHRQRTTRPRLERTTRPHHQRAGRPHLQRTTCPRLERVTRPHLGELHVLVNGGLHALTLRGLHVLAIRGLHALTSRGLHILALRGLHALTFRGLCVLIFSVLHIHTLREFKFPFNGSWAPPDIGGRPTVRAQPEREAITQLLCILGQDFTRAAAKRRVRIMRTNMTTLT

SEQ ID NO: 149482 - protein, 253 aa, Glycine max
  Coding DNA Sequence Number=SeqID_57797
  Gene Ontology: Mol. function=motor activity; Cellular component=cell projection
  Homolog annotation: Hit_ID=UPI00016621D1; Match level="QueryCoverage =85%, HitCoverage=46%, E-value=4e-26, Identity=38%"; Hit description =UPI00016621D1 related cluster
MSSPSEGCTPSPSEDCMSSPLEDYTSSPSEGLHILTFRGLHVLTFRGLHALAFKGLHVLTFRGLHALAFRRLHVLTFRGLHALAFRGLHALTFRGLHVLTFRGLHILTFRGLHVLTFRGLHVLTFRGLHVLTFRGLHALAFKGLHALPFRGLHVLAFRGLHALTFRGLDILTFRGLHTLAFTGLHVLAFRVLDVLTFRRMDALTFRGLHALTLRRLHGPPLERTTRPCLRRATIPQLQRTTRPLFQRATSPRV

SEQ ID NO: 149483 - protein, 120 aa, Glycine max
  Coding DNA Sequence Number=SeqID_57798
MVAKHVARTIARRTNNAPTTLQSWAWYRMPFIAPRVPRPETTFSLAKRWSGGRLEYRATPHGDLVGYKSHKDHMESHELRFGLQQEIPVDPMNLYLLHQINIRGNHYTDWMEYHAEWINI

SEQ ID NO: 149484 - protein, 126 aa, Glycine max
  Coding DNA Sequence Number=SeqID_57799
MESIAGYYGSQSDIRVKSYCRLNLLRTSTYNFEHSDLLRDSIRHPKLRYSISSVSIYYGTQSDIRVKSNCRLNLLRASIFHFKRLDILRDSIRHPSKKLLSFEFAQSFYIQFRAFRYITGLNRTSE

SEQ ID NO: 149485 - protein, 98 aa, Glycine max
  Coding DNA Sequence Number=SeqID_57800
MVEEEQARIGGYPSSEASNKCENYKEEARKKTQKHKPKRVESVNADAEAFAEALEHTKKRDTGHQSVSLENKTGDSTMLKIGDSAKVVIKTRHEGKKA

SEQ ID NO: 149486 - protein, 95 aa, Glycine max
  Coding DNA Sequence Number=SeqID_57801
MPISPYESICWDHAHKTPSGPREVQQGPGVSISWLQSSVSPIGCPSTPARSWHCDIGIAPARHPVDPKKSNRVLGFPALITGLCQFYGVLVAPNK

SEQ ID NO: 149487 - protein, 270 aa, Glycine max
  Coding DNA Sequence Number=SeqID_57802
DSLEEQVTRGEFVSQGRQDILNTTIGRPDHGGRVRAAGSGVTISQYYGRTSRALSTSSIAFTKEQLAEIVGTIREQVMKEIKEENKRSLQVWKNELKDAIIIDIFNRDKDSTPANFDLNVLGACMSTKESNAEIAVNLSGEVHVGCVTPPMGLYVQSQHCTKLVALGKIHDGPSTIHCVAYADDVVRVSVKQVIDGEPEVPLPTSEIKYVRDVVNTFIAWPLPLHSGITPDKVLIKTLVDIYDKLVEFVWDLTEFGIPNVNSSLFLTIIP

SEQ ID NO: 149488 - protein, 100 aa, Glycine max
  Coding DNA Sequence Number=SeqID_57803
MASNSQQFSARSDAIVIRGVHEVATNSSSSGETKKLEGKLDALVNLVTQLAMNEKSAPVARLCGLCFSANHHTDLCPSVQQSEAIEQLEAYAANIYNRPP

SEQ ID NO: 149489 - protein, 65 aa, Glycine max
  Coding DNA Sequence Number=SeqID_57804
MEKKESHEDSTSVGFNHFSVSLTFENSIGAIGGKTGGICREPLEMPLSLSEDTGFTPHVVIKSFV

SEQ ID NO: 149490 - protein, 259 aa, Glycine max
  Coding DNA Sequence Number=SeqID_57805
  Gene Ontology: Biological process=transposition, DNA-mediated
  Homolog annotation: Hit_ID=Q6UUU1; Match level="QueryCoverage=23%, HitCoverage=40%, E-value=3e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLEDSDWPYLGHMPIYGPITVPRVGTVTGSALIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 149491 - protein, 139 aa, Glycine max
  Coding DNA Sequence Number=SeqID_57806
MSKSFEFGMTDSLDESISCFLIRMDPRVLVPWSSEDYTPRQQRAARPHLKRTVRPHFQRTACPHLQRATRPRHQRTACPHLQRATRPHLQRTTRPRLERTTRPRLERTTRPHHQRAARPHLQRTTCPRLERATRPHLGY

SEQ ID NO: 149492 - protein, 95 aa, Glycine max
  Coding DNA Sequence Number=SeqID_57807
MNLGARCNKASPLPLPLKNEEKPSEILVILLDIWGARPSEIRVIPPSRVVSVVGEVINVLMWLIWLLRLRRSIVNVCSISFRMLNLLQVAAWKGR

SEQ ID NO: 149493 - protein, 132 aa, Glycine max
  Coding DNA Sequence Number=SeqID_57808
MVAWPGTQPSLHREDEGPTTQVPQHVEDESYEATIPEPFVIGEEAEETQVRQVVAATPERSLEATSEPSTQGEDIPLPQPTADPFTPLLEMPEDSTTSVLAMDTSPPATPVLHLTDEEDVQTQDTQDQSQEF

SEQ ID NO: 149494 - protein, 107 aa, Glycine max
  Coding DNA Sequence Number=SeqID_57809
  Subcellular localization annotation: CTP_CleavageSite=38; ConfidenceScore=5.12e-01
MKNSSWSLQTSGKSVPGYEKKMQLPQEPLNKKPRGLARKSMAVTNFMELWGQQQSKRNLSQHLCETETNMLAIVSKYREELNLATTHEHKVADEYAQVYAEKEARGR

SEQ ID NO: 149495 - protein, 66 aa, Glycine max
  Coding DNA Sequence Number=SeqID_57810
MLAIISKYQKELNLAMAHEHKVADEYAQVYAKKDARGRVIDALHLEATIWMDQFALTLNGSQELPR

SEQ ID NO: 149496 - protein, 220 aa, Glycine max
  Coding DNA Sequence Number=SeqID_57811
  Gene Ontology: Biological process=transposition, DNA-mediated
  Homolog annotation: Hit_ID=Q6UUU1; Match level="QueryCoverage=27%, HitCoverage=40%, E-value=2e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 149497 - protein, 65 aa, Glycine max
  Coding DNA Sequence Number=SeqID_57812
MDEDQLTYYSAMSKEVDMDFQDAQDCGVNEGHPDCSDVFNTSQVFATREDVLKWARTVAHETVLL

SEQ ID NO: 149498 - protein, 192 aa, Glycine max
  Coding DNA Sequence Number=SeqID_57813
YIFCGTSRGYIYLGLTENKRGYISCGSVLVKGTSTRVSKRTKEVSSKTSFTSALGIDEYFQSVKLYLMPRYVGTPHSVNPCKEPEDEHEMELQRLNQNEENDKEKRSVALKVSSSIQEENEEEDHLQMMKKIFPSLLRTFRNTSIKEELTGVRISIMEENHTMILKSLGVTNATKLVTSRPTIRQMKNGRRK

SEQ ID NO: 149499 - protein, 276 aa, Glycine max
  Coding DNA Sequence Number=SeqID_57814
  Gene Ontology: Cellular component=membrane; Biological process =transposition, DNA-mediated
  Homolog annotation: Hit_ID=Q6UUU1; Match level="QueryCoverage=21%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPVTTLNSIISDNFVPHFFEVLNWDVFSIILAEKDIPNLKQIIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 149500 - protein, 35 aa, Glycine max
  Coding DNA Sequence Number=SeqID_57815
MSKRLQEDWGRAAEEGPRVLMSLRVDLRAHGPRTP

SEQ ID NO: 149501 - protein, 81 aa, Glycine max
  Coding DNA Sequence Number=SeqID_57816
MEIYVSDQLGKKVVIIKKGETVEAKLHDESRMIQRCFDDNKGDDKKLKGQSKNEFKMFKIESRTLQDSRIKLSRIKIKIQD

SEQ ID NO: 149502 - protein, 117 aa, Glycine max
  Coding DNA Sequence Number=SeqID_57817
MDSSSLSPFRGLGNRSLNLKVPLQRTLADGGHPAQGTLSCLPKSKAPARWIVVKCNRQKETTECGYYVMHWMSTIILGTFTNNWEAYFNDPRPLELERLKALRIQWAQFYLRIRDQA

SEQ ID NO: 149503 - protein, 338 aa, Glycine max
  Coding DNA Sequence Number=SeqID_57818
  Gene Ontology: Mol. function=metalloendopeptidase activity; Cellular component=membrane; Biological process=proteolysis
  Homolog annotation: Hit_ID=Q6D7R6; Match level="QueryCoverage=99%, HitCoverage=69%, E-value=1e-116, Identity=63%"; Hit description =Putative exported protein
  Pfam annotation: Domain name=Peptidase_M48; Domain location=4-117; Score=-32.4; E_value=0.003; Accession=PF01435.9; Description =Peptidase family M48
MEEQKRSAPLTWVGALGSILLALASLQAGMAALTGTLAGTQQGIISFTQGNEQEADRIGIQVLQRAGFDPQVMPAFLQKLADQSRFSSKPPEILLTHPLPDSRLADARNRANQMRPVVVQSSQDFYMAKVRALGMYATGRNQLTDDLLNEYAKGNTREQQAAQYGKAVQFLQAKDFANAKKIIAPLLAKQPDNLWFLDIMTDIDIGLNQPQQAISMLNAARGSQTSPVLQLNLANAYVEAKQPANASRILNRYTFAHPDDLNAWDLLAQASAAQGLRDEELSARAESLALNGQLDQAITTLSSASAQVPLGSLKQARYDARIDQFRELQRRFKQYAKG

SEQ ID NO: 149504 - protein, 92 aa, Glycine max
  Coding DNA Sequence Number=SeqID_57819
MGSSQMPSLKKRFYQVKVKSLGTTSLKELGQLMGQLQRQAFHKAYGKICDLAMVDVSTEAIASLARYYDQPMRCFTFGDFHLSPMVEELKRS

SEQ ID NO: 149505 - protein, 37 aa, Glycine max
  Coding DNA Sequence Number=SeqID_57820
MEENFESALSANKEAISNASKNLMESSIRAQDDMPYT

SEQ ID NO: 149506 - protein, 127 aa, Glycine max
  Coding DNA Sequence Number=SeqID_57821
MLDQFASFLQGFIRDVVDVKADGNYGYRSIAALLGMGENSWPLVRNELIKEVGKWSHDTLNLFSGETSNQTIINSRLAFIYPNGSIIHNDTGVYFQTSTPVSIRVPNRCDFASLKTRIHNTLQLSDK

SEQ ID NO: 149507 - protein, 86 aa, Glycine max
  Coding DNA Sequence Number=SeqID_57822
MGQLQQQAFRKVYGKIWDLARDFQLVPTVKEFEEILGCPLGGRKPYLFSGFYPSTTRVAKEVFGGKGKGLGKIKANGLLLSSSWRF

SEQ ID NO: 149508 - protein, 83 aa, Glycine max
  Coding DNA Sequence Number=SeqID_57823
  Gene Ontology: Mol. function=lipid binding; Biological process=lipid transport
  Homolog annotation: Hit_ID=B0L632; Match level="QueryCoverage=67%, HitCoverage=55%, E-value=2e-23, Identity=82%"; Hit description =Protease inhibitor/seed storage/LTP family protein
MVASLVLSRTPPLIALLGFLCVRKEKGAEIEKLGKNPSCLCAVMLSNTAKMSGADPKVAITIPKRCNLANRPIGYKCGPYTLP

SEQ ID NO: 149509 - protein, 110 aa, Glycine max
  Coding DNA Sequence Number=SeqID_57824
MGIVNKARVLVVLVILIASSVAEKPSVVEARTLSLTSSHQGYSKFFATLGLVCKCCDGVGAFDLDNLIFVEPNDDAQSEEDLDDDDGDGDGDESDDIHGDDPIRGLDMLL

SEQ ID NO: 149510 - protein, 52 aa, Glycine max
  Coding DNA Sequence Number=SeqID_57825
MSVKNLVGHPGVHDKTNHTLLYDYPIDSRAKRNLHIHVVSLISNIQRLLAVN

SEQ ID NO: 149511 - protein, 83 aa, Glycine max
  Coding DNA Sequence Number=SeqID_57826
MRLEPEKKRRIYGGCHRKGFGMPEDYGWEGKSGKFVYFNNPMWPAFTFSVNFRYIESSYRRCSAAVACLNHDHLLAGYSQIMY

SEQ ID NO: 149512 - protein, 72 aa, Glycine max
  Coding DNA Sequence Number=SeqID_57827
MKLSSTQSPELVAEVSYVSDYGQEKKLHHKSLVVVFVASLFVEPESIGFSPNKDLLFVVDLFCLTGVAEVTD

SEQ ID NO: 149513 - protein, 184 aa, Glycine max
  Coding DNA Sequence Number=SeqID_57828
MKGTFYPELVKVFYTCARTNMEGNLYSTVNGVEMIIDATVWKAVARLDMGGVQKFEESADGYNKMQTYRGMLLDLARNLSNHRGIGGLTNDDLQIVYGLKSNIMLKSQRLVDYEFPYVVLASRFIDYFNIDVSNGIVEFTKASNEIIERHLKKLGMRYVDHEWIMVEEPPTTANIDQMEEEEEA

SEQ ID NO: 149514 - protein, 61 aa, Glycine max
  Coding DNA Sequence Number=SeqID_57829
MANSEWLSRNQIRFLETYSEDSKVEKLGVAITKIDPVLSRSPFELTPTPRGPKSAEDQTKS

SEQ ID NO: 149515 - protein, 110 aa, Glycine max
  Coding DNA Sequence Number=SeqID_57830
MRWQVGIRFEEPKGISEWYYSIFGALIWRRELTCLTLLLLIGSETILFRVGSLGIGIHSTRHRECCLPRKIIHHCYVTEDRKDHTNIMLEEEEVYRELLRDLKPSFEEED

SEQ ID NO: 149516 - protein, 51 aa, Glycine max
  Coding DNA Sequence Number=SeqID_57831
  Subcellular localization annotation: CTP_CleavageSite=25; ConfidenceScore=5.20e-01
MKYVSAVVRICSLQPPLPNNNNKTSSSRKVAPRRGVDWKEKRLARPAVSKM

SEQ ID NO: 149517 - protein, 327 aa, Glycine max
  Coding DNA Sequence Number=SeqID_57832
  Subcellular localization annotation: CTP_CleavageSite=48; ConfidenceScore=5.30e-01
DTPTYGINMSHTKIPNCIPPRTESYFKSFMPSLGRATQTGHRPGSLLQSSKTKGGPQLLTLMGSPIPFIALHLGCCRRKHERTRTSCWTSYSATPNQSSWSASFERSKGTWARPRSSASAGHIGKCSMKGSSSGPRTCNGVAQFGQLKLTPYCSDTHRGRTKSKLTLDNLSFLTRKMFIEAGGLDKPTTLRFVEVTTLDIRQPFSPKALLVSPSTEAHTLLAQQPGGWAIKLLSYYAIVTTQTIKDPGIPSNVINNQEIVEPILATIYPNISLLQILESTIFNKKVSCHELEHDDEAIMLWGNGLVQSSQDEYYLINEVKLGSSEWR

SEQ ID NO: 149518 - protein, 309 aa, Glycine max
  Coding DNA Sequence Number=SeqID_57833
  Gene Ontology: Mol. function=aspartic-type endopeptidase activity; Biological process=RNA-dependent DNA replication
  Homolog annotation: Hit_ID=Q69F85; Match level="QueryCoverage=27%, HitCoverage=4%, E-value=1e-10, Identity=36%"; Hit description=Gag -pol polyprotein
MSGIIFPPRFIDNFNTLIECFSIHPDLKYYPRDSVAFHAPRPTARQVHGHTKTDLHQLDERHKPHKRRPLPKRPRYERYKPLTAKHTTILEEAFNLEEQDLEDTKRSNIGTTKQIEEEIEQKTEEDKDISNNGMSDNLHKNKNPPRILESQNININASSQQSLPPMIFTDKDFKSINPVNQDNLVVVSIIIVNLMVSKVLIDMGSSTNLLYWKTFQRLEVSLDTVHPYIIPLLDFTGKRVETRGYMDWADCNRQGRLKESTIVLSRELEGSPIIALTVYQASLDNEFDIDPRDNTSNRGLKPIKELVKL

SEQ ID NO: 149519 - protein, 115 aa, Glycine max
  Coding DNA Sequence Number=SeqID_57834
  Homolog annotation: Hit_ID=A5BEE6; Match level="QueryCoverage=52%, HitCoverage=11%, E-value=4e-08, Identity=48%"; Hit description =Putative uncharacterized protein
MERPHKEELINLKAEHNQLEAHFRCPHSDEHSAHTLSEHTQEESHARHPANLYTNDDAILCYVFPKSLKGATLTWYSGLPLRSIDNFNTLVEHFNVQYATSRSHHMTSAAMARQQ

SEQ ID NO: 149520 - protein, 290 aa, Glycine max
  Coding DNA Sequence Number=SeqID_57835
MVRSTSILDLPLPPPRTTSQGSLCRLDNATKTPDLPSLWNVELKGSQFIKTKALLSKHDADMMNYIGKIAKAKAKLKVIVEVKMRLKVEAIIEIQEKDDIEGLNTKLDKLVKDDVNFKRLVETLSYQLAAEEEKKKSIVVERDDALEIVDLKKEKEKLNANKLKEIQHAYVLGYDKGFKKALHKVALLAPKLDLNKFSVAMYIRDGKLVRENQIDTFNESEENEVNSKVGDSKQDPAPIVARVDYVEVSYFGHLVIKGNFFVVRKFTTKVPLPAMEDKPKEGATKVMDSP

SEQ ID NO: 149521 - protein, 230 aa, Glycine max
  Coding DNA Sequence Number=SeqID_57836
  Gene Ontology: Mol. function=transporter activity; Cellular component= membrane; Biological process=oligopeptide transport
  Homolog annotation: Hit_ID=A5AH99; Match level="QueryCoverage=59%, HitCoverage=33%, E-value=1e-29, Identity=42%"; Hit description =Putative uncharacterized protein
  Pfam annotation: Domain name=Ribosomal_S17; Domain location=167-214; Score=14.5; E_value=0.00024; Accession=PF00366.11; Description =Ribosomal protein S17
MSSWFLPGLKPCDHNNICTETRKIHEVSFVADQFDDNHAEERKQKISFFNWWSCGLCSGLILGSTVTVYVQDHVNWGVSDIILKLVMAISLLIFLIGRFLLLLFPNELLYPSNPTQLYEVSKSEGNTERFLAHTQTLKFLIKIIGTHIDKKCPFTGNVSIRGRILAGTCHSAKMTRTIIVMRNYLHFIKKYQRYSPSIPLANLKDSVSFNVLKVIPAGSSSGAKKVFTGM

SEQ ID NO: 149522 - protein, 184 aa, Glycine max
  Coding DNA Sequence Number=SeqID_57837
  Subcellular localization annotation: CTP_CleavageSite=56; ConfidenceScore=5.21e-01
MFILTPIAINSSLTSERTHVSSASDSNISSGSLRFLQLFLQDPFSYSSNCFDRIPKRQRDGEEIETSTFYENWDVTFDSRTKKKVLQTIGERWRQFKSDLMRKLALAADKDGMDDTVFEKYDISKEKWTQFCQTHRDPSWEFGSTEGVIDPPSPIRRHVKWKMVRTKKVGQMTSEVAKEIAENI

SEQ ID NO: 149523 - protein, 92 aa, Glycine max
  Coding DNA Sequence Number=SeqID_57838
MGLFPNIFLRGALFSRKPHAWHHHYWRFRGGADTWRWCRHSHQRLAFVLTWHWSRKKQWRVEEGASQTGVLKALGCSNVAQSEVQAATGTCH

SEQ ID NO: 149524 - protein, 80 aa, Glycine max
  Coding DNA Sequence Number=SeqID_57839
MEPFMKYESDNTKTKKHIWTLQLTQEMLDDPEPLKLPHCTEVPLKACGNHMTVLRRHDPPLQLKVETLNPAIGGKGVVQP

SEQ ID NO: 149525 - protein, 124 aa, Glycine max
  Coding DNA Sequence Number=SeqID_57840
  Homolog annotation: Hit_ID=Q2HTF7; Match level="QueryCoverage=83%, HitCoverage=71%, E-value=8e-10, Identity=41%"; Hit description =Putative uncharacterized protein
MKMLEDSFESVAFEVVEDSFEGLAVEIVKDSVESLAVEVVENSFKGLAMEIVEDSFEGVDVIKDADENKVKSKRFDESIDHGSEIVVVPKGFPTINLNKIPEDHSHYHMLLKVGLFKGGFQPSS

SEQ ID NO: 149526 - protein, 97 aa, Glycine max
  Coding DNA Sequence Number=SeqID_57841
MDTGVRSLKSNNGLNFGLAIEKPIKVDKNNLNIHCGSPYFVCKTWLLWARSKELQQDCFKGNNEPPIEVPNHTNDNTSASSEGPSDVMAHGEWMVVK

SEQ ID NO: 149527 - protein, 54 aa, Glycine max
  Coding DNA Sequence Number=SeqID_57842
MKGLIVEELLEAIVPTVEASFMNEFKIESRTLQRSRGNLISRIKNQDSRFKIQE

SEQ ID NO: 149528 - protein, 48 aa, Glycine max
  Coding DNA Sequence Number=SeqID_57843
MAICVKKWNLLLDYGFLNYSRKCLVQVKGINETLGLIRILVMDLKRAN

SEQ ID NO: 149529 - protein, 171 aa, Glycine max
  Coding DNA Sequence Number=SeqID_57844
  Homolog annotation: Hit_ID=Q6UUU1; Match level="QueryCoverage=35%, HitCoverage=40%, E-value=1e-18, Identity=78%"; Hit description =Putative uncharacterized protein
MNDSDTDGDDAREKKGTHSSAKPKPLLPHSYQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 149530 - protein, 609 aa, Glycine max
  Coding DNA Sequence Number=SeqID_57845
  Gene Ontology: Mol. function=sequence-specific DNA binding; Cellular component=nucleus; Biological process=regulation of transcription, DNA-dependent
  Homolog annotation: Hit_ID=A5AHA1; Match level="QueryCoverage=100%, HitCoverage=100%, E-value=1e-174, Identity=55%"; Hit description =Putative uncharacterized protein
  Pfam annotation: Domain name=Homeobox; Domain location=390-448; Score= 8.7; E_value=0.0015; Accession=PF00046.20; Description=Homeobox domain
  Pfam annotation: Domain name=POX; Domain location=225-346; Score =186.6; E_value=6.3e-53; Accession=PF07526.2; Description=Associated with HOX
  Pfam module annotation: Pfam domain module=Homeobox::POX; Domain location=390-448::225-346
MAEGFEAYHVPQQSRRDKLRVVATQNQHGLVEPSSLLPLYDPSSFISSDLLTSFHNGQKHNLGCGMKEERANLMMGFAAAAGGGGVMNNGSSSSCCSSNSSSVSYLDPESSLPLNQATIQVINNSNNNNMFLYQAQNLREFDQGYNNNNNNNSEIMVFKPEPLSLSLSSHNNGVNLQRYGSVVYGDKVGGVGGGGGGGVVIYGGSGLNEVSRCTVPMGPFTGYASILKGSRFLKPAQQLLEELCDVGGVCAEKIVADASLMEPIPPESSSEDPLGDHGGDQGRKKSRLLTMLDEVYRRYRQYYQQMQAVVTSFEYVSGLSNAAPYASLAIKAMSKHFRCLKNAITDQIQFANKAHFHISNRKDESPRFGNSDRGPYGQRPGFLEHQPVWRPQRGLPERAVTVLRAWLFEHFLHPYPTDTDKLMLAKQTGLSRSQVSNWFINARVRLWKPMVEEIHMLETRQAPKNLQKEEHCTNKPSDHLPSDNSIVSENPSTSTDKFQEAPYKRAINELPNIPVRTQEQLNLPCTSNQPGGVGVSMGGSASNSVSLTLGLYQNHGIGLAEPFPLNAAQRFGVALETNNEGYVMSDYESQNRHFGRDVIGGQLLHDFVG

SEQ ID NO: 149531 - protein, 84 aa, Glycine max
  Coding DNA Sequence Number=SeqID_57846
  Gene Ontology: Mol. function=nucleic acid binding
  Homolog annotation: Hit_ID=A5C693; Match level="QueryCoverage=70%, HitCoverage=27%, E-value=9e-14, Identity=61%"; Hit description =Putative uncharacterized protein
MTGDASKFTHISPKKSGHVTYDDNNKGRILGVGKIGTNSSTSIENVLLVEGLKHSLLSIKNKTMINVFLVKMMSLGYGIEELPI

SEQ ID NO: 149532 - protein, 37 aa, Glycine max
  Coding DNA Sequence Number=SeqID_57847
MEVTYLSLMEEGLKNICHGVAAEDKGEEVRGGAIHWE

SEQ ID NO: 149533 - protein, 116 aa, Glycine max
  Coding DNA Sequence Number=SeqID_57848
MEPSSIKPNTCECYFQDYFNKHSKVKHCFKIKILPQNKVFPRDQGSGNRLPGNSVIEASLVEANDDIIEIVPGVAPTHPKPVSNVDEQLFLLSMIQQMKIGQDDSKRSMEAQNLSL

SEQ ID NO: 149534 - protein, 144 aa, Glycine max
  Coding DNA Sequence Number=SeqID_57849
  Homolog annotation: Hit_ID=A5C8K0; Match level="QueryCoverage=61%, HitCoverage=4%, E-value=7e-12, Identity=42%"; Hit description =Putative uncharacterized protein
MEIFIQSIDPGAWNAIIKGPFIPTKELNGELIPKEWNEMRDDEKRKVQDYQKAKYILTSSLSFDELFRTATCKSEKEIWNMLEVIREGTMDQGHIKSKCPIYLRKHGGEKKGKKDRKQKKAYIAWEDNASTTSNSSSDEEIANV

SEQ ID NO: 149535 - protein, 84 aa, Glycine max
  Coding DNA Sequence Number=SeqID_57850
MELLLLRVGLREEERTSIARFLSELNMKVRDKVKLLPYKDLDDLVQLCIRVEQQLKSKPTSKSYGPGKPPLALPYLLSIRLFLK

SEQ ID NO: 149536 - protein, 53 aa, Glycine max
  Coding DNA Sequence Number=SeqID_57851
MVFSSTSLHQEHLNTTRSIIVEWRRKKDDWRHHFKEKMSQEEAHHHRKPWIRA

SEQ ID NO: 149537 - protein, 166 aa, Glycine max
  Coding DNA Sequence Number=SeqID_57852
  Homolog annotation: Hit_ID=Q2AA51; Match level="QueryCoverage=38%, HitCoverage=19%, E-value=9e-08, Identity=42%"; Hit description =Retrotransposon gag protein
  Pfam annotation: Domain name=Retrotrans_gag; Domain location=59-147; Score=17.6; E_value=0.0011; Accession=PF03732.8; Description =Retrotransposon gag protein
MKLLQDKIVASILEEETHFSDLLSPDSPSSRESATQLPEVMTMAEEHDQRITLEDYSTREAKRWLHSFKGNNLKTWEEVVEKFLKKYFPESKTVEGKAAISSFRQFPDESLSEALERFRGCTICGEAHETGQCIPIEETLKKFIIWEINSDREYSRTIFRLLARSL

SEQ ID NO: 149538 - protein, 112 aa, Glycine max
  Coding DNA Sequence Number=SeqID_57853
MTRGNPGDLQPFDPEIDRTFHRLVRHSVHPGHSVHCEHLEHSVEGDSDFEHSTTNFYTENMAQPPPRERNLKEMAAPDFTYESLCIQYLDEGVPYVLKTGLIHLLRKFHGLA

SEQ ID NO: 149539 - protein, 209 aa, Glycine max
  Coding DNA Sequence Number=SeqID_57854
MRIRRSKSLAFVNHPTFCYRDPRVWWHTETPNGNPHTPFAIERHESLVACGDTLRLSAPRHSETPSSIDKQPPMWSFVPFPKMSASSDTNIVIYTLCQPGASEPVDTQRLTSSSAPLSSRDGESDDMRRYPSETASPMTCGDTQVVIRTNQLLLISTREVRWQAEIPQVVIRTNALLLILTREVRCQAEIPQVVIRTHTVLLPRPVRSQ

SEQ ID NO: 149540 - protein, 89 aa, Glycine max
  Coding DNA Sequence Number=SeqID_57855
MAKIQGPKEGKTYSNIYKEWTQPWLMGSEIYPKVHENPRAFFSSSSPVLLESSMQYPWRVGLHHPLPLGKDLTSNPEVLDTLGFLPRHL

SEQ ID NO: 149541 - protein, 98 aa, Glycine max
  Coding DNA Sequence Number=SeqID_57856
MSRNFTYCATKGAKYLEAVKQRLHAMKQWSPDEYRIFIYQIEVVWRQATTACGGHHWSWVVKEKIALRKLVLLSENPLLALSATSHAERVASSGWNCT

SEQ ID NO: 149542 - protein, 37 aa, Glycine max
  Coding DNA Sequence Number=SeqID_57857
MEMAPKKLLAKRDRKATVGEGSSAAPQGEIEFDGHRF

SEQ ID NO: 149543 - protein, 212 aa, Glycine max
  Coding DNA Sequence Number=SeqID_57858
  Subcellular localization annotation: CTP_CleavageSite=71; ConfidenceScore=5.06e-01
MWLHLDASSTSRCKQHAWSPVAETKGTNVCFTSGSHTIWKPVPRWKNCFNGSWTRGSLKCPTEGGKNHRFACSRKKRRKGTRSTPIYPQTAPKPTPFAYQSNKAVPWKYTPLVFGERVATEVDSMSAKVSNITGLSDVTRSGRVFAPPHSAEFPSKGKVPMVQEPIDIATPSKEVDPPVVKGAEKKESLQGKTVTLEEAHEFLRLIQQSELR

SEQ ID NO: 149544 - protein, 91 aa, Glycine max
  Coding DNA Sequence Number=SeqID_57859
MAPNSKVERPMNENAIPGLRKRLRMENFTKQSTHSSKLEGGGHMNENRNSWGSQKGLRMENCTKQSLRMKLQTRRWRTHERKRNSWGSEKA

SEQ ID NO: 149545 - protein, 97 aa, Glycine max
  Coding DNA Sequence Number=SeqID_57860
MVLGKPWSLTTSLKKSFEMWEASSTLWHDIKCAILLNLSTTTKIESTPLWVLGSPRTMMQSYLARALDRRLQVEWAKDAREGPRVLMSLRVDFGPMG

SEQ ID NO: 149546 - protein, 155 aa, Glycine max
  Coding DNA Sequence Number=SeqID_57861
HPLDPDNSNRALGFPGLITGLCQSFGVPVAPSKVIQLPITRAFIEKYCTARQAQGGDPQAPDAPPPPPQANPTGSFNMERPMTLYQLSLSLQSQGFASFPCPTPDQFRAEVAWPRDCPEAQAGEAPAEAPDEADVAREDEEMTDLLDFLGGSGAT

SEQ ID NO: 149547 - protein, 115 aa, Glycine max
  Coding DNA Sequence Number=SeqID_57862
  Subcellular localization annotation: CTP_CleavageSite=44; ConfidenceScore=5.33e-01
MVKVGTSYVPRSTSHIPKLALVRPYRAYTWPSSLFEYPSQVFIRASASGRVSHSGNLSVRNCCGQRAIGAGFALLRQGERAECHTGINVGYTGRVFSEVLHVAGEKGCTGASVEL

SEQ ID NO: 149548 - protein, 123 aa, Glycine max
  Coding DNA Sequence Number=SeqID_57863
  Homolog annotation: Hit_ID=Q6WAY6; Match level="QueryCoverage=69%, HitCoverage=15%, E-value=1e-08, Identity=38%"; Hit description =Putative uncharacterized protein
MGTRGCIRYNPVLAIRHLGYPMRGAPLEKELAPVISRGFNKTNMETLQKVRKAWEVVQKKDKELRGSNNGPIGGYRKWLKAHVQGLDWLPSLRTAKREEVEAPEEDEEVQALRTELKQAQTVK

SEQ ID NO: 149549 - protein, 166 aa, Glycine max
  Coding DNA Sequence Number=SeqID_57864
MASMMEAMLGMRQLMEKNMPTVAAVSSAAEADPTFLATAHHPPPNVVGREKSTQGHNSNPHLGYNRVAYPYGLSPNYTPPIMHDYAGHVSSPFLEREPPQQPHEAHEDHQEHAQGDVDFYPPIPVEGSAPNTLPQQNLTAQPIFLSVEGPPPAAEEEGNSITSRRD

SEQ ID NO: 149550 - protein, 230 aa, Glycine max
  Coding DNA Sequence Number=SeqID_57865
  Gene Ontology: Cellular component=mitochondrion
  Homolog annotation: Hit_ID=A6H595; Match level="QueryCoverage=30%, HitCoverage=80%, E-value=8e-28, Identity=85%"; Hit description =Putative 23S ribosomal RNA
MDVDKILPSSSTLGWHSLKVKGEVQTKKGLWWIPRHPETRKGVVSDEMLRGVENKRRSGDSRYRSTFRTAAESTGRQETTCLNRENGVVGELYKCRAARRSSRECCTLDGESPVAESITSLRSDPSSMGHVESRVNQQGPPCKAKYSWVTDSEVVPMSRRLIGSGLVRETTGAVAKASLHRAIDEAWVKLSGGPEPTDVEESADELWLGVKCHSNPELAGSPRNALRRSS

SEQ ID NO: 149551 - protein, 95 aa, Glycine max
  Coding DNA Sequence Number=SeqID_57866
MVKVGTSYVPINVSFSPKVGPGLPGINRDTRIYVFCEVIIRHSCPSCSATDGVAAQLLGRAIGAGLFAITPAGERGMCCKAIKLGNARVLPVTTL

SEQ ID NO: 149552 - protein, 34 aa, Glycine max
  Coding DNA Sequence Number=SeqID_57867
MLNGMPRNSSMQAGLVADLGTTFVVDWVVGNEKG

SEQ ID NO: 149553 - protein, 135 aa, Glycine max
  Coding DNA Sequence Number=SeqID_57868
MDEDQWMHDSIMSKEVDMNEENEKESGLNEENGEEPSVHQHVDCSDAFNTSQVFVTHDDALHWAQCVAYDIGFVAVIMRSDTDTRIRGRTSFVLIGCEMSDQYRARKKDLVRTITSSRKRGYSFKLRVKPVVGGE

SEQ ID NO: 149554 - protein, 155 aa, Glycine max
  Coding DNA Sequence Number=SeqID_57869
  Pfam annotation: Domain name=Retrotrans_gag; Domain location=5-84; Score=4.2; E_value=0.021; Accession=PF03732.8; Description =Retrotransposon gag protein
ERPKGGFNRLRNGLKTWDEVVEKFLKKYFPESKTTEGKAAISSFHQFPDESLSEALERFRGGKIKLKTPEEATELIENMSAIDHAILRDKTHQPTKKSLLELSSHDTLLAQNKLQVVPSVVRLMKHANVFSLNKTLKKFIIWEINSNKGILKEDF

SEQ ID NO: 149555 - protein, 110 aa, Glycine max
  Coding DNA Sequence Number=SeqID_57870
MAVQLIRDRVEMECLEGAWETLEGNTRCRLRGTIRFTATSLGAIPENLHGRFAHGGVDTPDSYPDSRLVENLYVQVIEAKSEQTLRRIVALGEMALVSGGSYIIVDSSSD

SEQ ID NO: 149556 - protein, 178 aa, Glycine max
  Coding DNA Sequence Number=SeqID_57871
MAPTRHPLDPDKSNRALGFPALITGLCQSFGVPIAPSKVIRPPITRAFIEKYCTQRQAQGDAPQAAGAPPPHQASPAGSFDTEQYLRHLVRQQAANHQAHVQTHDCLYQMSLSLLSQGFTSFPCPTPDQFRAEVAWAGDWPKTQAGEAPAEAPDEADEAREDEEMTDLLDFLGGSGAT

SEQ ID NO: 149557 - protein, 91 aa, Glycine max
  Coding DNA Sequence Number=SeqID_57872
MAPDRNQLQSMTKREHESIKEYAQRWRDLTAQVVPAHDGEGDDYNYVERHRPATDPQLRVFTPPARRSSSKGNAPWRKSHRVMHGAPPRKK

SEQ ID NO: 149558 - protein, 161 aa, Glycine max
  Coding DNA Sequence Number=SeqID_57873
MYNTTITYIGLHYSAHWQMVVILPKENLVVWFCSLHNRPDNYFKGINNRSLLFFNTFALALLNKINILMFLVFNNALKGLDDTPQPKSKAGARWIVVKCNRQKGSTECGYYVMHWMSTIILGNFRNNWEMYFNDVRLLEAERLKAFRIQWTQYYLKVRYQT

SEQ ID NO: 149559 - protein, 144 aa, Glycine max
  Coding DNA Sequence Number=SeqID_57874
MPPHNTFHNHYMQLKGVSQGFSSLLIDYTALAGNRLPEASTRFQSPFLSLVIDYTPGQSITRGFLSFLTSFSSLELAYLGTSQVLTDRLCPGWVGIGQAWFWAIAPNLTSPRSPDPRDISPGTTLWSTIKAGSFTLQHFLISSL

SEQ ID NO: 149560 - protein, 265 aa, Glycine max
  Coding DNA Sequence Number=SeqID_57875
  Subcellular localization annotation: CTP_CleavageSite=49; ConfidenceScore=5.01e-01
MVKVGTSYVPINVSFSPKVGPGLPGINRSTPGVYLFMEMCYFRSQRIYSAQYRAPRGDAAKLTDSLVCSPVQLLTGWCIRSQFGTQAYEPDISAGKCSLGCDAAANSHTAALNAAATGRAFPFGKPCQAAQLLNESANARAIECGPFAITPAALKGGCVHTGDYYVGTDNARVFPVRSAFVRKKATGASVRICEYRLTIGSANSSLTELATARSFDCGERSEHGPTTGCGIVLEARNTTYYRDSERAAAKPFFHRLRPPDKHHEI

SEQ ID NO: 149561 - protein, 275 aa, Glycine max
  Coding DNA Sequence Number=SeqID_57876
MAKFDPEIVLEFYAHGWPTVEGVRDMRSWGQECEYGQRRNRSDGFDEEAIAQLLCIPGQDFARTAAGRRVRIMHTNMTTLTQIWMTLLLSNILPSDHNSDLPLPKCQLVYAILTRMSVHVAQLIADAIYIFAGMAPTRHPLDPDKSNRALGFPSLITGLCQSFGVPVAPTKAGQAGAFDMEQYLRHLVRQQAANHRAHVQTHDCLYQMSLSMQSQGFASFSCPTPDQFRAEVAWPGDWPEAQAGEAPPEAPGGGEEAHEDEEMADLLDFLGGSGD

SEQ ID NO: 149562 - protein, 186 aa, Glycine max
  Coding DNA Sequence Number=SeqID_57877
RFKSAALKIRKENAELRDINMATARALEQETKRALKEDHGRDKFCGALWGSNSELKLRREERDQSQVDSLILKDELKFCSRSKRNLSQQICETKTYMLAIIIKYQEELNLATAHEHRVADEYAQVYAEKEARGRVIDSLHQEATMWMDRFALTLNGSQELPRLLAKAKAMADTYSAPEEIHGLLSY

SEQ ID NO: 149563 - protein, 209 aa, Glycine max
  Coding DNA Sequence Number=SeqID_57878
MVPRKEEWGQNKFRWALWGSNNELKLQRVERDQSRVEGIILEDELKACQRSKRCLSDQLSKTEENMWAIIDQYKEKLSLAATHEQRLEDEYAKVEPRLLAKAKAMADVYSAPEEVHGLLDYCARTNEGRYGGLEGSSSFHDGSHVKHEEEAMLSMKRIMESNAAAVTAASATAEADPTHPFATNQAHQPTSDMVGQKGEVLGNTGGPQI

SEQ ID NO: 149564 - protein, 17 aa, Glycine max
  Coding DNA Sequence Number=SeqID_57879
MQWKNASDWSGVSHRTI

SEQ ID NO: 149565 - protein, 140 aa, Glycine max
  Coding DNA Sequence Number=SeqID_57880
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=62%, HitCoverage=75%, E-value=9e-25, Identity=68%"; Hit description=LacZ protein
MKHFTDTLISANITLASNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 149566 - protein, 113 aa, Glycine max
  Coding DNA Sequence Number=SeqID_57881
MGDPISRLSFPGRTHCLSLKKACAALNSLEYLSLAKACLHFFSGENTETFSSLTSYPELRRSEFLIGGYVGARASLLSTIPPFVAMTQKLVARGDTLRLSAPRHSVTPSVIDE

SEQ ID NO: 149567 - protein, 128 aa, Glycine max
  Coding DNA Sequence Number=SeqID_57882
MESNAATAAVASTAVEADPALPTATHHPVPNMVGRERSTPGHVNNPHPGYNKGAYPYGLSPNYTPPAMHKGVGHITPLIIEGEPPQHLDGVHENPREHAQEGIDSYSPFPAKGLVPNSLPQPNIMGEP

SEQ ID NO: 149568 - protein, 93 aa, Glycine max
  Coding DNA Sequence Number=SeqID_57883
MYDIIKEYARSPVESPTITTCSSTGVRKGLSYGPRVRLPLKENAWSRHQRLFKENVGKTKMEKVEGLRILKMRVRELFTHGKGISTPCARHKR

SEQ ID NO: 149569 - protein, 99 aa, Glycine max
  Coding DNA Sequence Number=SeqID_57884
GNPGDLQPFDPEIDRTFHRLVRHSVHPGHSVHFEHPNHFEHFVAGDSECSDFEHSAINFHTENMTQPPPRERTLREMAAPDFTYESLCIQYLDEGVPYC

SEQ ID NO: 149570 - protein, 108 aa, Glycine max
  Coding DNA Sequence Number=SeqID_57885
  Subcellular localization annotation: CTP_CleavageSite=55; ConfidenceScore=5.55e-01
MRNFAKVSTVLRRSSSVLHRSSIFNGLSSLVTDVWGANTFPARKYNSRTFHLKVRRSRLFRFFRRFPQINVGGDSARIPFVEHASRKSRVALPPKGRLRQLATPLGTV

SEQ ID NO: 149571 - protein, 143 aa, Glycine max
  Coding DNA Sequence Number=SeqID_57886
MAVQLIHDRVEMECLEGVRETLEGNERCRFRGTIRLTATSLVHPEEPARTLQRTVEWILPTPTPYRLVEPVQVIEVSSSEEDPEEDPEKLPPEPAVDALDFPEGDEDPLPDVDSPEDVMSASEVDSTEESGPGWIATSGDSSS

SEQ ID NO: 149572 - protein, 113 aa, Glycine max
  Coding DNA Sequence Number=SeqID_57887
METGNLVPLDLEIEATLRRNGAERKRKLLQDRTVASILEEETHFSNFTSSDSQSSRESATYLLEVVPLADEHQQRVTLEDYSSSLVFQFFTSIARPKVQAHNINYPHSLIHLI

SEQ ID NO: 149573 - protein, 178 aa, Glycine max
  Coding DNA Sequence Number=SeqID_57888
MVPWASRDNRDEPGLMLICEVIPSPRCSSGVSWSISCPFLSATDGDGVRHNSTQAYQPDISAGKCSLGCQTLTLTTPAALNACRYRARPIRHSGCATVREGPIVNCYDFLCGREWKSSHRGGVPAELVDPPGYRNIRSAFQVAHDSSTLGRLDCGERKWLTNGAEISWKMPGRYLTGK

SEQ ID NO: 149574 - protein, 82 aa, Glycine max
  Coding DNA Sequence Number=SeqID_57889
MAKFDPEIVLEFYAIAWPTEEGVRDMRSWVRGQWIPFDADALSQFLGDPLVLEEGQECEYSRRRNRADGFDEEAIAQLLCIR

SEQ ID NO: 149575 - protein, 217 aa, Glycine max
  Coding DNA Sequence Number=SeqID_57890
  Homolog annotation: Hit_ID=UPI00006A2D9E; Match level="QueryCoverage =69%, HitCoverage=82%, E-value=3e-09, Identity=14%"; Hit description =UPI00006A2D9E related cluster
MRGPLDESISCFLIGVDPWVLEPIAFRGLHVLAYRGLHILTSRGLHVLAFRGLHALAIRGLHILAFRGLHAFTFRGLHVLAFRGLHAFAIRGLYALAFKGLHVLAFRGLHALAFRRLHALAFGGLHVFTFRGLHALAFRGLHALIFRGLHALAFRGVHVLAFRGLHALAFRGCTPSPSEGYTPSPSEGYTSSSSEDYTSSPSEDWTSSPSEDYTSSP

SEQ ID NO: 149576 - protein, 214 aa, Glycine max
  Coding DNA Sequence Number=SeqID_57891
  Gene Ontology: Mol. function=ATP-dependent DNA helicase activity; Biological process=DNA repair
  Homolog annotation: Hit_ID=A1SXR9; Match level="QueryCoverage=96%, HitCoverage=65%, E-value=3e-35, Identity=34%"; Hit description =Putative uncharacterized protein
MNKVIIASAGAGKSTFVVSEALKAVTSGKRILITTFTEACRDEINVKIIKENGKSGVKPYKVAGRPIYWGEKDFRQHYFSSDFMLYSDKMAKLSLRCDEKSNGKVIARLGSCFDEIYVDEVQDLAGYDLEILQTLFRSPIKITLVGDPRQATYSTVNTEKNAKYKKAAIVNFFDDKAAGVTVDDKMLNENFRCFHEINDFANKLYPAFAPSASN

SEQ ID NO: 149577 - protein, 411 aa, Glycine max
  Coding DNA Sequence Number=SeqID_57892
  Gene Ontology: Mol. function=transporter activity; Cellular component= integral to membrane; Biological process=transport
  Homolog annotation: Hit_ID=A8G7W2; Match level="QueryCoverage=96%, HitCoverage=95%, E-value=1e-111, Identity=50%"; Hit description =Major facilitator superfamily MFS_1
  Pfam annotation: Domain name=MFS_1; Domain location=21-364; Score =108.2; E_value=2.5e-29; Accession=PF07690.7; Description=Major Facilitator Superfamily
  Pfam annotation: Domain name=Sugar_tr; Domain location=13-403; Score=- 152.3; E_value=0.0049; Accession=PF00083.15; Description=Sugar (and other) transporter
  Pfam module annotation: Pfam domain module=MFS_1::Sugar_tr; Domain location=21-364::13-403
MARYQPISQLTGRVLLFPLALVLFEFATYIAHDMIQPGMLLVTAEFNVGPEWVSTSLTAYLMGGVVLQWLLGPLSDKYGRRPVLLFGILFFAVACVLTTWVSNIEQFVTLRFIQGISLCFIGAVSYAAVQEAFDEALAVRMMALMANVALLAPLAGPLAGAAWLTVGEWRSMFWLFAVCSLLAFVVLWRIMPETAGDRSHSIALPNLARGYGRLARDKQVMYGSFAIGLVFIPILTWVALSPVILMHEEGLSRLQYALLQLPVFLAMIAGNLTLGKLAGRVAIEQPVKFAAWPILLGLSIALVANLLNSHSYLLLTAGLSLYAFGAGMVNAGLYRLTLYSSSEGKGSIAAMLGMISILTLAAGIEVAKSGYFSGGTPWFSAINFVAGVLWFGLVTLFLRERKRRSRLTSVE

SEQ ID NO: 149578 - protein, 568 aa, Glycine max
  Coding DNA Sequence Number=SeqID_57893
  Gene Ontology: Mol. function=hydrolase activity, acting on carbon -nitrogen (but not peptide) bonds; Cellular component=integral to membrane
  Homolog annotation: Hit_ID=UPI00006DBC1C; Match level="QueryCoverage =73%, HitCoverage=93%, E-value=3e-90, Identity=41%"; Hit description =COG0402: Cytosine deaminase and related metal-dependent hydrolases
  Pfam annotation: Domain name=Amidohydro_1; Domain location=69-383; Score=79.5; E_value=1.1e-20; Accession=PF01979.11; Description =Amidohydrolase family
  Pfam annotation: Domain name=Amidohydro_3; Domain location=69-381; Score=-45.9; E_value=0.00016; Accession=PF07969.2; Description =Amidohydrolase family
  Pfam module annotation: Pfam domain module=Amidohydro_1::Amidohydro _3; Domain location=69-383::69-381
MTDYTRNIVNNEYVNPPLTLIRNATILSMAESAGNHERGDILISGSTITAVGQNLDAHGAYVIDATNMIAMPGMVDSHRHAWEGQLRRINPNATCLDDYSNATHFSFAKYYRPSDIYVGNLLTALGAIDAGITTIIDNSHNSRSAAHSDAAVEALLDSGIRAIHASGAPVAGEWDKAHWPGNWQRLQEKYFKDNPESLVSLGVMAQLEPELWAEARRLGLPIVTEFFGAEMASELESLHQKGLLGPDNIFNHCTALPDEGWEILREAGVRVNVCPRSDSHYGIENGMFAIEAAQRHGINPGLSVDNETSYSTDMFMEMRVAFYLQRVMGMHRQHCCDSDRTLTTLPAAQLLKSATVDGAFCAGLQDKLGSLTPGKQADLVLISATDLNLYPNGNAFGTVVHATERSNIDTVMIGGRIVKQNGKVLGVDSERLRAAIDESHNPEQPACKRTRRRLGHRRVVFLFGWGIQPRNLLAAARGIIHLTCRHSFSACVESGRRTDRCLRAVQLRGACTENWFFSPARAGYCRAVALISDDRPFWSAGRDQAAGFNTQAGRNAGHADRARRHALR

SEQ ID NO: 149579 - protein, 77 aa, Glycine max
  Coding DNA Sequence Number=SeqID_57894
MSGGNGRGKIAATQNPTKDKASFLHENFVEEEPQLLVVFVVTAAILEEEHMACLDQQHSGGRDRLLLCGGLAHLRFG

SEQ ID NO: 149580 - protein, 161 aa, Glycine max
  Coding DNA Sequence Number=SeqID_57895
MWAFLTGRQIDWAHLVRYRMHKALRANAPLPYPQLITLFLRHFQIPLDDEPFFQVKRSFAIGAGVVTSFGYRKDQNGQWLKKDALPPQDERTPSPPPQREDSALLNEVLTELRGLRSYVGERFDSLDTRFAGMDIRLTQVEEDVSFIRTCFDPPPPPPSSS

SEQ ID NO: 149581 - protein, 143 aa, Glycine max
  Coding DNA Sequence Number=SeqID_57896
  Gene Ontology: Mol. function=nucleic acid binding; Biological process= DNA integration
  Homolog annotation: Hit_ID=A5AV98; Match level="QueryCoverage=78%, HitCoverage=17%, E-value=2e-22, Identity=42%"; Hit description =Putative uncharacterized protein
MTVADSIKTSLPNTDNAKEFMGLVGESSQTDDKSLAGTLMSILTTIKFDGLRTMHEHVIEMTNIASRLKTLGMTVNENFLVQFMFNSLSSNMLVQEETGLKNQGSHSVYYVSHQGNQGAEKKFMKKHDKGKGSLKINDDSLQI

SEQ ID NO: 149582 - protein, 62 aa, Glycine max
  Coding DNA Sequence Number=SeqID_57897
  Subcellular localization annotation: CTP_CleavageSite=31; ConfidenceScore=5.05e-01
MPANFADLVFARERIESGLRKGKSSSHPTPSGMTRVPSVRTIVEFPDTTLTPASRSNIRYDT

SEQ ID NO: 149583 - protein, 80 aa, Glycine max
  Coding DNA Sequence Number=SeqID_57898
  Gene Ontology: Mol. function=aspartic-type endopeptidase activity; Cellular component=chromatin; Biological process=chromatin assembly or disassembly
  Homolog annotation: Hit_ID=Q2R4T1; Match level="QueryCoverage=76%, HitCoverage=3%, E-value=4e-09, Identity=50%"; Hit description =Retrotransposon protein, putative, Ty3-gypsy subclass
MNDQTGHPKATGRVFTLNGIEASKSKDLIQETKVAMCDLPIVREFPEVFPEDISGLPPEREIEFSIDLGTRCWTHIHSHL

SEQ ID NO: 149584 - protein, 219 aa, Glycine max
  Coding DNA Sequence Number=SeqID_57899
  Gene Ontology: Mol. function=1-acylglycerol-3-phosphate O -acyltransferase activity; Cellular component=membrane; Biological process=phospholipid biosynthetic process
  Homolog annotation: Hit_ID=A7MP85; Match level="QueryCoverage=85%, HitCoverage=76%, E-value=9e-87, Identity=80%"; Hit description =Putative uncharacterized protein
  Pfam annotation: Domain name=Acyltransferase; Domain location=58-186; Score=160.2; E_value=5.4e-45; Accession=PF01553.12; Description =Acyltransferase
MKICRKCVLSAAVAVAYRADCSGSIAWNIWCLFSPRNPRHVATFGHMFGRLSTVFGVKVELRKPADAESYGNAIYIANHQNNYDMITAANIVQPTTVTVGKKSLLWIPFFGQLYWLTGNLLIDRDNRAKAHGTIGELVAQFKKKKISFWMFPEGTRSRGRGLLPFKTGAFHAAVAAGVPIIPVVVSNTHGKIKLNRWNNGLVIVEMLPPVDTTQFETTS

SEQ ID NO: 149585 - protein, 103 aa, Glycine max
  Coding DNA Sequence Number=SeqID_57900
  Subcellular localization annotation: CTP_CleavageSite=31; ConfidenceScore=5.35e-01
MLSVSSARSVRRLSLPTLSAPSSLSGYSLTRAKHKNGAKRAFEDRKPFLRLKLEKSKSRTEAQNRARKPKTSAFKRILGLGVISRFLEVEETSPPLCNLLFSS

SEQ ID NO: 149586 - protein, 153 aa, Glycine max
  Coding DNA Sequence Number=SeqID_57901
MDNEEGVQEQMKADLSALKDQMASITEAMLKLQKTLEDNATTTASNAVRVAEPVLQPIINLGRDRNPTMFGRRYSPQAYPYGLPPDFTPRAAPEEVSQAPTFEGQLPPYADYPLQEDDEGDAHLGPLLPLKDPAPHELPQPNIVRHVPSSPAP

SEQ ID NO: 149587 - protein, 244 aa, Glycine max
  Coding DNA Sequence Number=SeqID_57902
KEVVQEVEKPARESRESGRDRNKNRNRRDRQRERNQERGERPAKEENTHNKQRQERQAQEKPAQKDRQERQAAQDTAKTDVNQPALTTQASENKQERGERGNRRNRHGRRDRRQRDESSPATTATANVTADTATVDAAPVVTAEIAPAAQEVANVKTAAKTVDPVAQAPVTEPVAEKNESTKAETSTAPSEESSTEKKAPRSRSRTSKSSKTRDKQAADKTEAPAIELVETTSAHSFSGSNVRD

SEQ ID NO: 149588 - protein, 63 aa, Glycine max
  Coding DNA Sequence Number=SeqID_57903
MFKIESRTLQDSRGKLKNTSRFKRKVDFKNQESRSRFKTQGSIIKRRLNQDKYEKIDLVIDYQ

SEQ ID NO: 149589 - protein, 152 aa, Glycine max
  Coding DNA Sequence Number=SeqID_57904
MATMMEAMMSMKKIMEADVVTVAATSTIAKVNPMPPSGLNQMNHPTSGMTHEIPHHNLADFEPWLGYATEGQAVGGIPLQNTLEGPQYHPQLHLLHSTTSKKPHAMAEMGKLDRIEEWLKDIEGGEDYAFADLEELFLIPEHGHSQVQGAGL

SEQ ID NO: 149590 - protein, 179 aa, Glycine max
  Coding DNA Sequence Number=SeqID_57905
MTQKLVARGDTLRLSAPRHLVTPSVIDEQRPIWSSAPFPEMSASSGGDFFKSHKIRRSKSLAFVGRPTRSVILTLRSCDMRRQNLVIPHPFAIQTQSCPMVRRDKIWSFCTPLSSRGGGPDDTRRQNLVIPHPFVIQTQPCPMATQRQKLVILHSLSSRSGGPDDMRRQNLVIPHPFAI

SEQ ID NO: 149591 - protein, 90 aa, Glycine max
  Coding DNA Sequence Number=SeqID_57906
MLANDRAILSVATYPSAEGRRVTRGMRVPRKEYARSRHQRLFEENVGKTGKDAIYELLSERFGSCIYVRGRVFPFAPTYSSIWDEKIRPT

SEQ ID NO: 149592 - protein, 199 aa, Glycine max
  Coding DNA Sequence Number=SeqID_57907
MSKSRGFGMTGPLDESISCFLIRVDPWVLVPITFRGLHVLALRGLHVLAIRGLHVLAIRGLHVLAIRGLHALTSRGLPVLALRGLHALTLGLHALTFRGLHVLAIRGLHALTFRGLQVLALRGLHALTLGLHVLAIRGLHVLAIKGVHVLAIRGLHALTLGLHVLALRGLHVLTFRGLHAVTFRGLHVLALRGLHALTL

SEQ ID NO: 149593 - protein, 76 aa, Glycine max
  Coding DNA Sequence Number=SeqID_57908
MELASVCVCVFVSLCLYVCLSMCCVCLWLSVFVCLSVSLCVCDTGSKGSLNCKHHQPHDEGSSIKSMLYKLFGGEQ

SEQ ID NO: 149594 - protein, 42 aa, Glycine max
  Coding DNA Sequence Number=SeqID_57909
MDKSLKVEEDEGREKERRSMKFCASNEPTNPRSSPRFSTKCG

SEQ ID NO: 149595 - protein, 72 aa, Glycine max
  Coding DNA Sequence Number=SeqID_57910
MDGQRAETNFAPFIILEQEVGWNNKLGGQRVETNSAPFIIQEQQVEWNNKLGGKRAETNFVPFIIHEQRVEW

SEQ ID NO: 149596 - protein, 126 aa, Glycine max
  Coding DNA Sequence Number=SeqID_57911
  Homolog annotation: Hit_ID=A7PJ72; Match level="QueryCoverage=65%, HitCoverage=9%, E-value=2e-15, Identity=56%"; Hit description =Chromosome chr12 scaffold_18, whole genome shotgun sequence
  Subcellular localization annotation: CTP_CleavageSite=35; ConfidenceScore=5.04e-01
MFFSIQPESETLILQTATLPPVPTSTPQPPEFKVRAHHNPVTTSIASTEVSHKVSFRNNAPSWKHHILEAKTPLLQTSLRARPPKVKTSLELEQEELKKIPNVKARPLNKKMKILQDQNPWTTIWG

SEQ ID NO: 149597 - protein, 49 aa, Glycine max
  Coding DNA Sequence Number=SeqID_57912
MKGRRHKYGFNNNKREKAEKVKVVDDETGDKHQLDEVLRRNILLVDMVT

SEQ ID NO: 149598 - protein, 198 aa, Glycine max
  Coding DNA Sequence Number=SeqID_57913
MNWSASWRNSSSTTATSLRVDLLEAGHGGADLLDFAGGEVLEDLGRGVFTQRHHQDGAARHADHRDGARILVRHRAGAFQVVLVTVGFLGAGQILGLALGFDALGLGHFRIDRRVQVVAHRAAHLAVQPQGQHATHQPGQDGLEQRDHFRIAPHRQGRRAVVELAVDQVQRIATAFGIAHRLAHQVGELAQFLGWQGL

SEQ ID NO: 149599 - protein, 145 aa, Glycine max
  Coding DNA Sequence Number=SeqID_57914
MGEVEEVQEKMKADTESLKEKMAIMMEAMMSIKEIMEVSAAYRTQLKLSKVNPMPPSNINQMNHPTSDVMGKDLGSMDDPMMCKFKTSTPSHHMACLPTIHHPMWHTFPMRMSITPLPYSLKADNLIMHMSLKPWGRHMRCPTTI

SEQ ID NO: 149600 - protein, 134 aa, Glycine max
  Coding DNA Sequence Number=SeqID_57915
MAPKKLSTKRSRRDTTGEGSSTASEFDSHWFQSAEHQQRFEAIKGWSFHKERRVQLREDEYPDFQGEIARRHWAQLVTSMAKFDPEIVIEFYANAWPTEEEVRDMRSWVRGHWIPFDADAISQFLGDPLILEED

SEQ ID NO: 149601 - protein, 159 aa, Glycine max
  Coding DNA Sequence Number=SeqID_57916
  Gene Ontology: Mol. function=chloramphenicol O-acetyltransferase activity; Biological process=response to antibiotic
  Homolog annotation: Hit_ID=Q6UUU1; Match level="QueryCoverage=37%, HitCoverage=40%, E-value=1e-18, Identity=78%"; Hit description =Putative uncharacterized protein
MPLAIQVHHAVCDGFHVGRMLNELQQYCDEWQGGAHQNLSFQIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 149602 - protein, 47 aa, Glycine max
  Coding DNA Sequence Number=SeqID_57917
MELERLIKRLSESGIDDVGYDVCMIHDFEGELYEYDLEGETAAADDD

SEQ ID NO: 149603 - protein, 50 aa, Glycine max
  Coding DNA Sequence Number=SeqID_57918
MDLGASMRSSNGDFPPWNAAEDKGEEVASLRSFLKKTSLRNFFEKTSLRS

SEQ ID NO: 149604 - protein, 272 aa, Glycine max
  Coding DNA Sequence Number=SeqID_57919
  Gene Ontology: Mol. function=motor activity; Cellular component=cell projection
  Homolog annotation: Hit_ID=P15305; Match level="QueryCoverage=98%, HitCoverage=94%, E-value=3e-18, Identity=24%"; Hit description =Dynein heavy chain
TSRPLLQRTTTSRFIGLYVLAIRGLHLLAFIGLHALTIRGLHILTFRGLHVLAFRGLHTLEFRGLHVLAFRLHALTSRGLHVLAIRGLHVLPFRVLHVLLFRGLHALAFRGLHVLPFRGLHVLTFRGLHVLAFRGLHAHKGLHVLAFKGLHLLAIRGLHILTFRGRHVLACRGLHALNFRGLHVLTFRGGLHVLAIRGLHVLSFRGLHALTFRGLHVLAIIGLDVLAFRGLHVLAFSGLHVLISRGLHVLAFIGLHALTFRGIHDLAFRGLH

SEQ ID NO: 149605 - protein, 51 aa, Glycine max
  Coding DNA Sequence Number=SeqID_57920
MGEALTSRNSTRNTSLATIWKVFPAYMSFMASLAKRRKCKEDVFFVTFMPP

SEQ ID NO: 149606 - protein, 313 aa, Glycine max
  Coding DNA Sequence Number=SeqID_57921
  Homolog annotation: Hit_ID=Q6WAY6; Match level="QueryCoverage=99%, HitCoverage=64%, E-value=2e-21, Identity=25%"; Hit description =Putative uncharacterized protein
MDQVQHQAFNKVYGKIWDLTMIEVSVEAIASLTQYYDQSLRCFTFGDFQLAPTIEEFEGILRCRLGGRKPYVFFGFYPSMARIAKLVKISKQELERMKQNRNGVARIPRKRLEEKAEALASQGEWASFINVSAFASVWNGTIPECRQVGRSSGDQCLSCLSPQQGKPGMTEASTSWFPRWKEGGTGVLSSCEGFSIVPLMGTRGCINYNPVLAIRQLGYPMRGAPPEEIITPFIAQGFSEANAKILQKICKASNRVGRKDKELRGSSNGVIGGYHKWLKSRMQGLTWLPKLKSLSRKDAEILEESEKVQALKA

SEQ ID NO: 149607 - protein, 173 aa, Glycine max
  Coding DNA Sequence Number=SeqID_57922
  Subcellular localization annotation: CTP_CleavageSite=41; ConfidenceScore=5.31e-01
MAEPSKKRKGSSSTAAAAAHRHHGPSEAPTTPIHPSLSSPRSSTLFSSDDQRLRYLSQFSSRIILDPKYLDIDFFNDETLDCYQVFQNSGLVDFMSLKLPHYPELLKVFYFNLKIQEGIISSEVHGIPMVIDQSLFFSLTHLPSQGAPFEGTIVDDWKFDYSSHDTRRMVCND

SEQ ID NO: 149608 - protein, 163 aa, Glycine max
  Coding DNA Sequence Number=SeqID_57923
MFRDARNENKRPYWIGDRVWNDLLSHWNAPEYRSKCAHAKKIRHLKRVGVCKQVVLSACRIMPFACVGESQLTPLDPAGEQRLRSRCWVAAARPKHKGCLYGTGDLAHTYKCGNDSFMQHMQGSSNRATDATEINRLREELRQSKEEMHIFQSVVLQFPPPEV

SEQ ID NO: 149609 - protein, 22 aa, Glycine max
  Coding DNA Sequence Number=SeqID_57924
MVLFGNLVQPPIVDAYSPIFGN

SEQ ID NO: 149610 - protein, 161 aa, Glycine max
  Coding DNA Sequence Number=SeqID_57925
  Subcellular localization annotation: CTP_CleavageSite=22; ConfidenceScore=5.32e-01
MVKVGTSYVPINVSFSPKVWPRALARVNRDTRIYLFAKCSSGVSGFYQLFPPVQLLTGVLRQSAKAYRPDISAGKCKAWGATVPRHSVRNCSGRDLIGALAINESAKREGRRFAYWALSRSVYWLTMLALMRVSVNVMTHYVAEKKARTRWRLAQNSDPPG

SEQ ID NO: 149611 - protein, 88 aa, Glycine max
  Coding DNA Sequence Number=SeqID_57926
  Subcellular localization annotation: CTP_CleavageSite=50; ConfidenceScore=5.51e-01
TDKATWQRSSFSFKGQLGAGAAVACPPIPIRSFPRSDNIGRLALPSLGISTSTSTDPMACPIRNFSSPCHPEVLTKRRAPTFEGQLPP

SEQ ID NO: 149612 - protein, 149 aa, Glycine max
  Coding DNA Sequence Number=SeqID_57927
  Gene Ontology: Mol. function=phosphoprotein phosphatase activity
  Homolog annotation: Hit_ID=A5AWR0; Match level="QueryCoverage=77%, HitCoverage=16%, E-value=5e-15, Identity=36%"; Hit description =Putative uncharacterized protein
MEARNTYISHEMRRVYDYSSRGECTITLQDVSVLLELLGVRPQEGELQGSVVKLSWLAHHFSQINIHDGNIEQLQRFIRAWILRFIGGVLFVDKSRSKVSLREICSATDYKIKSIGSVCILIQMWAWERCTTLAPKRTPPVIENKPLGH

SEQ ID NO: 149613 - protein, 163 aa, Glycine max
  Coding DNA Sequence Number=SeqID_57928
  Gene Ontology: Mol. function=chitin binding; Cellular component =extracellular region; Biological process=chitin metabolic process
  Homolog annotation: Hit_ID=UPI00006A17C9; Match level="QueryCoverage =84%, HitCoverage=100%, E-value=4e-14, Identity=32%"; Hit description= UPI00006A17C9 related cluster
  Subcellular localization annotation: CTP_CleavageSite=21; ConfidenceScore=5.06e-01
VRACSPTKVRTCSPLMARACSPMMARTCNPLKVRACSPTKVKAHDPLTARTCSPLKLKVHDPLKARTCSPLKVKARTYSPLEVRACSPLVVRTCSPLKARTCSPLTVRARTCSPLEVRACSPLMVRTCSPLKARTCSPLNGEGRAALCWRGRVVLSRGGRVAL

SEQ ID NO: 149614 - protein, 296 aa, Glycine max
  Coding DNA Sequence Number=SeqID_57929
  Gene Ontology: Biological process=transposition, DNA-mediated
  Homolog annotation: Hit_ID=Q6UUU1; Match level="QueryCoverage=20%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPVTTLANWSSTAVAAALELVDPPGCRNSILKTLLLEDLFYRKKWGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 149615 - protein, 314 aa, Glycine max
  Coding DNA Sequence Number=SeqID_57930
  Homolog annotation: Hit_ID=Q6WAY6; Match level="QueryCoverage=22%, HitCoverage=12%, E-value=1e-11, Identity=45%"; Hit description =Putative uncharacterized protein
TQDTVSASKLSLMREKGRVDWDQHLAGIRGSAINWFPRWKEGKEGVLFSCGDYPNVPLIGTRGCINYNPVLAIRQLGYPMRGAPTEGSLSPFLVKDLGPQGRQRQTEAPKGAFIGGYQENFEAFPEVQDEEARLLGQGRNVQIVLWVSTHFRKECTELQEENAVIRKRAWNLKKPNSRRHKEELARERQGDMGAQEKWGPFADILALLIFGVVLFPNVDGLVDLAAINAFLAYHHSKESPVVAILADLFDTFDRRCEKNSARIVCCLPALCVWLVSHLFQQDTDTRVRFKVIAHARKGESIGTTFGWDRGSASM

SEQ ID NO: 149616 - protein, 249 aa, Glycine max
  Coding DNA Sequence Number=SeqID_57931
  Gene Ontology: Mol. function=transporter activity; Cellular component= outer membrane-bounded periplasmic space; Biological process=transport
  Homolog annotation: Hit_ID=P0AEQ5; Match level="QueryCoverage=99%, HitCoverage=100%, E-value=1e-122, Identity=89%"; Hit description =Glutamine-binding periplasmic protein precursor
  Pfam annotation: Domain name=Lig_chan; Domain location=82-249; Score=- 131.0; E_value=0.026; Accession=PF00060.17; Description=Ligand-gated ion channel
  Pfam annotation: Domain name=SBP_bac_3; Domain location=28-246; Score= 317.8; E_value=2e-92; Accession=PF00497.11; Description=Bacterial extracellular solute-binding proteins, family 3
  Pfam module annotation: Pfam domain module=Lig_chan::SBP_bac_3; Domain location=82-249::28-246
MMKSLIKVSVAALALAFSLSSTAADKKLVVATDTAFVPFEFKQGDKYVGFDIDLWDAIAKQLKLDYTLKPMDFSGIIPALQTKNVDLALAGITITDERKKAIDFSDGYYKSGLLVMVKADNNDVQSVKDLDGKVVAVKSGTGSVDYAKANIKTKDLRQFPNIDNAYMELGTNRADAVLHDTPNILYFIKTAGNGKFKAVGESLEAQQYGIAFPKGSDELRTKVNGALKTLKENGTYNEIYKKWFGTEPK

SEQ ID NO: 149617 - protein, 292 aa, Glycine max
  Coding DNA Sequence Number=SeqID_57932
  Gene Ontology: Biological process=transposition, DNA-mediated
  Homolog annotation: Hit_ID=Q6UUU1; Match level="QueryCoverage=20%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPGELELHRGGGRSRTSGSPGLQEFDEFGVDQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 149618 - protein, 173 aa, Glycine max
  Coding DNA Sequence Number=SeqID_57933
  Homolog annotation: Hit_ID=A5BSR3; Match level="QueryCoverage=61%, HitCoverage=34%, E-value=2e-09, Identity=33%"; Hit description =Putative uncharacterized protein
MATPRIFPPLESAPVSLAFARPQKDMLRHLRTGRRHGKWPNQYKSTRTKKTGHMTSEAAKEIANKIDAFEEQASQGSFVAHGRHDVLTTAIGRPEHPGRVRVAGASVTIKQYFGLASRTSYTSSSMAPKDLHQLKQQIRDQLEDSFTEKFQSQMQSQGLALAPKPEVGRSATR

SEQ ID NO: 149619 - protein, 54 aa, Glycine max
  Coding DNA Sequence Number=SeqID_57934
MATKMKRCPFEALGSIAPITSMPHIENDYNAANMFNGHGVSIGMGTKGSLMHLQ

SEQ ID NO: 149620 - protein, 180 aa, Glycine max
  Coding DNA Sequence Number=SeqID_57935
MYPPLELIHKRCTLSCSQSTTQVDVPSTCTTKDVPSNVLRQRSQAVKPLILCEWGYKIILSREKGDTKEFMRLVLCSFGKGKRVIQKEFRQLVLGEFFLAKGEEMKRMNSTSFQGLENQKTLESFWHKEEEEVQRDSRLVKDFNELIGLIERLIENAKQSLAFIDSSCLVKRTILKSYNF

SEQ ID NO: 149621 - protein, 70 aa, Glycine max
  Coding DNA Sequence Number=SeqID_57936
  Homolog annotation: Hit_ID=UPI0000ECBAF8; Match level="QueryCoverage =58%, HitCoverage=48%, E-value=1e-16, Identity=100%"; Hit description= UPI0000ECBAF8 related cluster
MAFALANRREEVLTSIQGMQAWHWPSFYNVVTGKTLALPNLIALQHIPLSPAGVIAKRPAPIALPNSCAA

SEQ ID NO: 149622 - protein, 107 aa, Glycine max
  Coding DNA Sequence Number=SeqID_57937
MMFEILEPCRVLRLGTSSKKYMFKIKERKFPIKEEAKKEGKEIPNQRVGEREKRKERKFPIKEWEKEKRKERKFPTKEWEKVKKKEAPGQRNQKHLKCREVFGPDNI

SEQ ID NO: 149623 - protein, 70 aa, Glycine max
  Coding DNA Sequence Number=SeqID_57938
MGKAEEVQEQMEADMEAMKEQMATMMEAKMIMKKIMEANVVTIAATSTVAKVNPMPPSGINQMNHPTSDM

SEQ ID NO: 149624 - protein, 108 aa, Glycine max
  Coding DNA Sequence Number=SeqID_57939
MEKSTVDTLIAISPNTWHASKFIHISLQDKYVIYGDNKRRPHFSPRKVNMRFMETTNKGHLINNRNNYKWKLEVGSGSYSKLEVGNESYWKLKVENGGWKLEGEVTKS

SEQ ID NO: 149625 - protein, 147 aa, Glycine max
  Coding DNA Sequence Number=SeqID_57940
MTGRLLAGSLAFESRILHYLIVRILLPRSSNLAQVSEEYLIVMWAFHKGASVIASFGYIKEHDGSWVKKGTINVGEEGHEGEDSSLLLKILERFDGLQTFVGERFDTLELQVDMRFNEMESRMTKVEEDVSYIRSSFDLPPPPPPSS

SEQ ID NO: 149626 - protein, 39 aa, Glycine max
  Coding DNA Sequence Number=SeqID_57941
MKRCMMRSRKPDMGLSVTMHHQKRKTLDEASLLASESGT

SEQ ID NO: 149627 - protein, 118 aa, Glycine max
  Coding DNA Sequence Number=SeqID_57942
MIKESKELASMSMDALFGKLLAYEHELIQQSHAKETEKKRDYTQENLGLMVKKFGKFLKRSKDRKFSKPSKKGKATTTHSHALNAGSKATSNLIVPSTLKNNLLRRKERRIENRKMPT

SEQ ID NO: 149628 - protein, 405 aa, Glycine max
  Coding DNA Sequence Number=SeqID_57943
  Homolog annotation: Hit_ID=Q84VH5; Match level="QueryCoverage=99%, HitCoverage=58%, E-value=1e-153, Identity=72%"; Hit description =Envelope-like protein
  Subcellular localization annotation: CTP_CleavageSite=24; ConfidenceScore=5.26e-01
MATSPKETSAPGSPSVPSSPSSTKAPANQERPEFNIQPIQMIPGSAPVPEKLVPKRQQGVKISENPSLATSPREVDTEMDKKIRSIVSNILKNASVPDADEDVPTSSIPDVAVPDAEKDVPTSSTPNTEAVSSPSKEESTEKEEQATEETPAPRAPEPAPGDLIDLEEVESDEEPIANKLAPGIAERLQSRKGKTPIKRSGRIKTMAQKKSTPITPTSSRRSKVAIPLKKRKEISSSDSDDDVELDVSTSKRTKTSGKKVPGNVPDAPLDNISFHSIGNAERWKFVYRRRLAVERELGRDALDCKEIMDLIKAAGLLKTVTKLGDCYESLVREFIVNIPSDITNRKSDEYQRVFVRGKCVKFSPAVINKYLGRPTDGVVDITVSEHQIAKESLPNKSSIGQRKGS

SEQ ID NO: 149629 - protein, 100 aa, Glycine max
  Coding DNA Sequence Number=SeqID_57944
MSTLSRATIPKYVLNFFLWGPLAFPVAGSTCTTGLSTPGGLVDNDRRHEALHVCFTADVEADASEVGGGGGGGEGGEGGGGGGGGGGVVEAGLHPCLDSI

SEQ ID NO: 149630 - protein, 301 aa, Glycine max
  Coding DNA Sequence Number=SeqID_57945
  Homolog annotation: Hit_ID=Q84VI1; Match level="QueryCoverage=80%, HitCoverage=52%, E-value=7e-74, Identity=69%"; Hit description =Envelope-like protein
MAQKKSTPITPTSSRRSKVAIPSKKRKEISSSDPDEDVELDVSTSKRAKTSGKKVPENVPDAPLDNISFHSIGNAERWKFVYQRRLAVERELGRNALDCKETMELIKAAGLLKTVTKLGDCYEGLVREFIVNIPSDITNRKSDEYQKVFVRGKCVRFSPAVINKIGAANWVPTNHTSTVATRENLPLSLHYKLVEGTHVPDIVSTSVSTSGKAAASGAVSKDALIAELKDTCKVLEATIKATTEKKMELELLIKRLSESGIDDEEAAEEEGEAAEEEEEAAEEEEDAAEETESDDDSEATP

SEQ ID NO: 149631 - protein, 37 aa, Glycine max
  Coding DNA Sequence Number=SeqID_57946
MTPTHDALLYYNGRWNMPRQNEFVDLIKQVAPHGIPP

SEQ ID NO: 149632 - protein, 142 aa, Glycine max
  Coding DNA Sequence Number=SeqID_57947
  Homolog annotation: Hit_ID=A5AZG1; Match level="QueryCoverage=60%, HitCoverage=30%, E-value=3e-07, Identity=35%"; Hit description =Putative uncharacterized protein
  Pfam annotation: Domain name=zf-CCHC; Domain location=106-123; Score =22.6; E_value=0.00058; Accession=PF00098.14; Description=Zinc knuckle
MSHHSSSVNGEGRHRSHLRPHSHRREKERKPQEANIKLSYFHGKDNVEANLDWEIRVEQQLKKKSTSTSYGSHSYLKKDQGQGILGVTPSKPKDDKASMQEKTSSIKCFKCLGRGHITSQCPTTKTMIMRVSQPTLRREGDA

SEQ ID NO: 149633 - protein, 315 aa, Glycine max
  Coding DNA Sequence Number=SeqID_57948
  Homolog annotation: Hit_ID=Q2HW90; Match level="QueryCoverage=52%, HitCoverage=39%, E-value=8e-20, Identity=32%"; Hit description =Putative uncharacterized protein
KVYRKIWDLVMIEVSIGDIASLTQYYDQSLRCFTFGDFQLAPTIEEFEGILGCPIGGRKPYLFSGVRGIPSKCLEEKTETLASQGEWASFIDVLALLVFGTILFSNVDGLVDLATIDAFLAYHHNKESPVIVVLADMYDTLDLRCEKSNARIVCCTLAIYVWLVSHVFNHESRSVCPLQGHRMCSGKDKANWEELLAGMTRASISWFPQWKEGGEKIHLSYSMRGVPSEETIAPFIARGFNEANAKTLQRICKACVATYHSVGGRRVTRGMRVPRKEYAWSRHQRLFEENVGKTGKDVIYELLSERFRSCIYARG

SEQ ID NO: 149634 - protein, 215 aa, Glycine max
  Coding DNA Sequence Number=SeqID_57949
  Homolog annotation: Hit_ID=A6FJQ2; Match level="QueryCoverage=17%, HitCoverage=84%, E-value=6e-11, Identity=92%"; Hit description=50S ribosomal protein L5
MTVKTSDTCSSRRRSQLVCKRMPGADKPVRARQRMRKEKIPHQAPFAIQAAQLLGRAIGAGLFAITPAGERGMCCKAIKLGNARVFPVTTLSTLEDPRFLPCGTFAMLPWSSFQLTASSGYRARIRNHGHSCFLRETCRASCINESANARGEAVCVLGALPLPRSLTRCARSFGCGERYQLTQRRSFAPSWAVCTNPPFSPTVAPYPVTIVLSPT

SEQ ID NO: 149635 - protein, 66 aa, Glycine max
  Coding DNA Sequence Number=SeqID_57950
MEKSEKKNFSEKKMKKAYITWDDNDMESSEDSENEEINLCLMGKSYESDEEMHLLIGIKSQSNLQS

SEQ ID NO: 149636 - protein, 83 aa, Glycine max
  Coding DNA Sequence Number=SeqID_57951
MQKKKEKRKSEAKALQNYDCGSFLMPLLLVFTVEAKLHDESRLIQRCFDDNKDDDKGNDKKLKGQSKNEFKIFKRKVEEHFKI

SEQ ID NO: 149637 - protein, 102 aa, Glycine max
  Coding DNA Sequence Number=SeqID_57952
CLMHSEAEALEHTKKRDTGHQSVSLENKTGDSTVLKIGDSAKVVIKQDMKGRKHKYGFKNNKREKTEKKRVVDDETGDKHELYEVLRIPSKRKYRCLNQRKK

SEQ ID NO: 149638 - protein, 83 aa, Glycine max
  Coding DNA Sequence Number=SeqID_57953
MGDSDKCGLKRVYEGSTAVHNIPLLHGQVKVDIEEIKDVDALVPVLTDELCLKQSFQIGRILRHLTETSMQVGNFDVYGFLEP

SEQ ID NO: 149639 - protein, 57 aa, Glycine max
  Coding DNA Sequence Number=SeqID_57954
MSHHQRKLCLENRVDDHGDDKEGGTGIVGASDGPWHRWPTAAVVVEEPFRFFIDSSI

SEQ ID NO: 149640 - protein, 185 aa, Glycine max
  Coding DNA Sequence Number=SeqID_57955
  Subcellular localization annotation: CTP_CleavageSite=43; ConfidenceScore=5.10e-01
MIFGLVSRMDMNIGVLISGQMTSIAQSNTSRLGFLALITALCRARGVVSDILTFERLSPVINLAYIRKNCWNPKDLTVSIRGVRRARARPTEFPSTSAAPTPASTSATPFVPAQTNSQRFEAMLQSIHQGQIILLQILQVVAPPRSIPSVEQFREMVAWPGTQPSFQREDEGPTAQVPYLYLNTQ

SEQ ID NO: 149641 - protein, 44 aa, Glycine max
  Coding DNA Sequence Number=SeqID_57956
QSEGGACHPARPGELGCFLQKAPPSRELPGRPKWAWLLFAPPGY

SEQ ID NO: 149642 - protein, 93 aa, Glycine max
  Coding DNA Sequence Number=SeqID_57957
  Subcellular localization annotation: CTP_CleavageSite=44; ConfidenceScore=5.21e-01
MTITENVNSKLTENSNVNIKSAVTSVTWLRFLPRNQVSQHALLRASEARLTGALSEGGKMRGVATNIYLWKTSGKLKETGQNENSKFGSCIYV

SEQ ID NO: 149643 - protein, 96 aa, Glycine max
  Coding DNA Sequence Number=SeqID_57958
MGEVEEMQKQMKADMEAMKEQMATMMEAMMSMKKIMDANAVAVAATSAVAKVNSMPPSGLNQMNHPTSAMVGKDLGSTPSQHMACLPTIHHPIWCT

SEQ ID NO: 149644 - protein, 181 aa, Glycine max
  Coding DNA Sequence Number=SeqID_57959
  Subcellular localization annotation: CTP_CleavageSite=95; ConfidenceScore=5.35e-01
MTLSSWQNKLNRYFMFKTLVMKGGQWFYTGKQLVLMPMATPSSSPPLHPPPSLPTEAASHSPSTLKWTRKATRLRSLATRPAGAGRPVVHVDPTTGMAVGPHKKKLRTYLGIVARDKAEFDIPEASDVRTKKKILQTMVERWRQFKSTLTSKWVLAIDKDSVDDTVCEKYGISKEKWAQCC

SEQ ID NO: 149645 - protein, 83 aa, Glycine max
  Coding DNA Sequence Number=SeqID_57960
  Subcellular localization annotation: CTP_CleavageSite=42; ConfidenceScore=5.45e-01
MQQGQPYIPIVGFPDPNYGLKAVNQNKLPSPIMSSPSAPLCVAQRPLSFTFIGPNTVFYIPNRRVFQRKCKNILLRYPRHKRY

SEQ ID NO: 149646 - protein, 146 aa, Glycine max
  Coding DNA Sequence Number=SeqID_57961
  Gene Ontology: Biological process=transposition, DNA-mediated
  Homolog annotation: Hit_ID=Q1J7G7; Match level="QueryCoverage=22%, HitCoverage=47%, E-value=2e-10, Identity=93%"; Hit description =Transposase
MVKSWNLLRADQRLIFVKSWPRASRYQQGHQDLFIVRSDLPSQVLQWLLFLSAVRPVQLLTGWCVTAKAPPDISAGKCSGHAARNHHTRRAYCAGAGGVPFPIQDAQGVGRKMGKGVFAIRAPAERGMWRKSKKLGGARVFPVTTL

SEQ ID NO: 149647 - protein, 17 aa, Glycine max
  Coding DNA Sequence Number=SeqID_57962
MADQQATKSKAKGRKIP

SEQ ID NO: 149648 - protein, 58 aa, Glycine max
  Coding DNA Sequence Number=SeqID_57963
MPTSSVKGADDHVGLRLSITLEATSSWVMVTESSVVDKSEAFAPTYPPMRNSDLRSSG

SEQ ID NO: 149649 - protein, 120 aa, Glycine max
  Coding DNA Sequence Number=SeqID_57964
MKVLQPRHLNNMSQNQKMITHLKPPSLELLIVKKKRLETRSNEAAHHGPLPALADAPFPRADPSSPQHATDSSIPILEIHEGQTILVLPLDTSPPVTPVWYLTDEKNVQIQDNQDQSQEF

SEQ ID NO: 149650 - protein, 66 aa, Glycine max
  Coding DNA Sequence Number=SeqID_57965
MQMRAHTAYLRQITKQTEKNAMCSDLGHVTPLPRKKPSRSVISSSIRDSSALPGDPAGSSPAWASG

SEQ ID NO: 149651 - protein, 71 aa, Glycine max
  Coding DNA Sequence Number=SeqID_57966
MSVKVHPIAFLCFLSTSNNFSFSSAAKEAEMITGNFPCTQMGGNRVGEEEEGPQPVPHKASQKYMYFPQHG

SEQ ID NO: 149652 - protein, 237 aa, Glycine max
  Coding DNA Sequence Number=SeqID_57967
  Gene Ontology: Mol. function=[isocitrate dehydrogenase (NADP+)] kinase activity; Cellular component=cytoplasm; Biological process =glucose metabolic process
  Homolog annotation: Hit_ID=A6TGR8; Match level="QueryCoverage=100%, HitCoverage=39%, E-value=1e-126, Identity=90%"; Hit description =Isocitrate dehydrogenase kinase/phosphatase
  Pfam annotation: Domain name=AceK; Domain location=1-237; Score =200.4; E_value=4.3e-57; Accession=PF06315.2; Description=Isocitrate dehydrogenase kinasephosphatase (AceK)
MAIGCQKHAKTESYREYLRYVTTADEQFIEAPGIRGMVMLVFTLPGFDRVFKVIKDKFAPQKEMTAAHVRACYQLVKEHDRVGRMADTQEFENFVLDKQQIDPALMTLLLQEASGKITDLGDKIVISHLYIERRMVPLNIWLEQSEGQALRDAIEEYGNAIRQLAAANIFPGDMLFKNFGVTRHGRVVFYDYDEICYMTEVNFRDIPPPRYPEDELSGEPWYSVSPGDVFPEEFRHW

SEQ ID NO: 149653 - protein, 147 aa, Glycine max
  Coding DNA Sequence Number=SeqID_57968
MPLSPVILVTLADNELMSVASSFLSLGGAYLHRTAWLFQYGKGTGLTTEGYRGFGEAGSLVKYITKGLDLRGLSDSTALTAPPSMIGERVCFHVGPILLKRQPSGVYQMLDLVFKGQAFFGGVARGFPMVRTSCVRVIPLWGVWSYA

SEQ ID NO: 149654 - protein, 254 aa, Glycine max
  Coding DNA Sequence Number=SeqID_57969
  Gene Ontology: Mol. function=hydrolase activity; Cellular component =outer membrane; Biological process=phospholipid catabolic process
  Homolog annotation: Hit_ID=A5FNM2; Match level="QueryCoverage=99%, HitCoverage=66%, E-value=2e-71, Identity=51%"; Hit description=Zn -dependent hydrolase of the beta-lactamase fold-like protein precursor
LDGVKILVDPVFSGKASPIPGSVTAYKGSDIYTVADLPEIDYLLLSHDHYDHLDYETIKELQKKTKHVVCGLGNGAHFERWGYTPDQIIEKDWYESVNVKPGFTIFTESTHHDSGRGFRSGQALWLSFLIQTPSMKVYYSGDGGRDDRFKSIGSKYGKIDWAIMECGQYNKAWQSVHELPEEVALGTKELGAQNLLPVHNSKFTLANHPWKEPLEKITALSKNQSYRLATPMIGELVHLDKTDQKFNEWWKNVQ

SEQ ID NO: 149655 - protein, 135 aa, Glycine max
  Coding DNA Sequence Number=SeqID_57970
MGSSQAPSLKKRFYQVKVKSLGITSLKELGQLMGQLQRQAFRKAYAKIWDLAMAEVSTEVVASLAQYYDRPLRSSLCQTGLRFRDCNHIVEIVFMKIIFATYPLRSKKSRKGKSPEKGTPRALLLFLLLPEFVFV

SEQ ID NO: 149656 - protein, 34 aa, Glycine max
  Coding DNA Sequence Number=SeqID_57971
MTPMVPKWWFFLVGGLKTKSYLGGLTMEGKGNKL

SEQ ID NO: 149657 - protein, 303 aa, Glycine max
  Coding DNA Sequence Number=SeqID_57972
  Homolog annotation: Hit_ID=Q3JKL4; Match level="QueryCoverage=99%, HitCoverage=29%, E-value=2e-73, Identity=53%"; Hit description =Putative uncharacterized protein
AQVGQALDVRVPAQRVHAAAGDADVAQQQLHHGAGADDLRTDRVLRPAQRVQDGGGPVGGGGGRQHLADLQELVARRAADAFDHLFGIARVVLLEQLVDRTRMRQRRVGLDVAVIAALVVPTGLVVGPLVGVVAGVQARVEREVLAHDVGKVGVVAHVLVLDLVVIQQVLDDATQEDDVGAGAYGRVEVRHGCRAREARIHDDQLRLVMGFRFRDPFEPARVGLGGIAAHDQYYVRVLDVDPMVRHRSTAKRRGKTCHRRAMSDTGLVVERQHPHAAHGLVRDVADLVAACRGGQHAGGQPPG

SEQ ID NO: 149658 - protein, 234 aa, Glycine max
  Coding DNA Sequence Number=SeqID_57973
  Homolog annotation: Hit_ID=A5B5V0; Match level="QueryCoverage=100%, HitCoverage=52%, E-value=6e-10, Identity=25%"; Hit description =Putative uncharacterized protein
MEFFSNENFECFQAFENSNLIPFMSLKLPVYSELVKAFYSNLKIHEGTLISEVYGIKKVIDQSLFYNLTKLPSEGVPFEGALIDEWKFDFSVHDARRLVCTNQVDMTGRLLAGSLAFESCILYYLIVRILLPRSSNLAQVSEEDLIVMWAFHKGLQIDWAHLVRYRMHKALRLNAPLPYPHLVTLFLQHFNIPLDSEPYVPIKRSFLIGASVIASFGYIKEHDGSWVKKGARNV

SEQ ID NO: 149659 - protein, 100 aa, Glycine max
  Coding DNA Sequence Number=SeqID_57974
MGEVEGIKEKMATMMEAMMSVKKIMEANAVAIAATSVVAKVNLMSPSGINQMNHPTSDMVGKDLGSTGSPHNVQIQNKHAFPPYGLASQLYATQSGVHSQ

SEQ ID NO: 149660 - protein, 118 aa, Glycine max
  Coding DNA Sequence Number=SeqID_57975
DTARRSRTTERSESVSEEAEERPIRKPPLPARWPIHKCSWHDRFPDWKAGTDNNFTQETAMTMFIEFELGTTWIPSFKTSFNTSFITSPMVSFTLGTLSFTGSTATLMGSINFSPIAK

SEQ ID NO: 149661 - protein, 114 aa, Glycine max
  Coding DNA Sequence Number=SeqID_57976
MDEDQWIYDSIMSEKIGMDDENEQECGVNEQHVDCSDAFNTSQVFATRDDILQWARSVAHENRFVEVIMRYDTNTGVISIGLGRKILLEEILGVGNVSVPSSFVGNQWLDDKVG

SEQ ID NO: 149662 - protein, 130 aa, Glycine max
  Coding DNA Sequence Number=SeqID_57977
MEGFGGSGGTPYGGKRNDYHDGRHSAGVLLREVGKFDYVAPASTSNKRFRMAGAKRKERDAHAQRSSAPSQRAPAQALVPARPRPAGDFNHGTSSNPGRNPLVKKLLEFVPIPMSYGDLLPSLIANQLAV

SEQ ID NO: 149663 - protein, 268 aa, Glycine max
  Coding DNA Sequence Number=SeqID_57978
  Gene Ontology: Biological process=transposition, DNA-mediated
  Homolog annotation: Hit_ID=Q6UUU1; Match level="QueryCoverage=22%, HitCoverage=40%, E-value=3e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPVTTLANWSSTAVAAALELVDPPGCRNSMAIVLIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 149664 - protein, 259 aa, Glycine max
  Coding DNA Sequence Number=SeqID_57979
  Gene Ontology: Mol. function=nucleic acid binding
  Homolog annotation: Hit_ID=Q2AA09; Match level="QueryCoverage=78%, HitCoverage=81%, E-value=6e-15, Identity=27%"; Hit description =Retrotransposon gag protein
  Pfam annotation: Domain name=Retrotrans_gag; Domain location=46-127; Score=2.4; E_value=0.032; Accession=PF03732.8; Description =Retrotransposon gag protein
MAQPPPRERTLRGMAAPDFTYESLCIQYPDEDVPYVLKTGLIHLLPKFHGLAEGVAKDWLYYLTPRSITSWDDLKRVFLEKIFPASRTTAIRKDISGLSNMERSMIDAASGGALGDMTPAEARNLIEKMASNSQQFSARNDAIVIRGVHEVATNPSASSETKKLEGKLDALVNLVTQLALNQKSVPVTRVCGLCSSADHHTDLCPSMQQPGAIEQPEAYAANIYNRPPQPQQQNQPQQSNYDLSSNRYNPGWRNHPNLR

SEQ ID NO: 149665 - protein, 34 aa, Glycine max
  Coding DNA Sequence Number=SeqID_57980
MARTHIPVEAEIHLTTAFKIAPCVASLVNVRTYM

SEQ ID NO: 149666 - protein, 33 aa, Glycine max
  Coding DNA Sequence Number=SeqID_57981
MGVGVGVGVDEDGGEGEGTLEVGEMGTCNLKGP

SEQ ID NO: 149667 - protein, 157 aa, Glycine max
  Coding DNA Sequence Number=SeqID_57982
  Homolog annotation: Hit_ID=Q1RSH0; Match level="QueryCoverage=68%, HitCoverage=52%, E-value=5e-08, Identity=30%"; Hit description=H+ -transporting two-sector ATPase, alpha/beta subunit, central region, related
MAWKPVCGDKIRFWKDRWLGEESTLQQKYSQLFSISKQQNDFISTMGSFSQNIWRWDLKWRRHLFEHEEGVAVAFMEDITAYTLQNHLKDKLLWKADPSGLYSTRYPQRRPSSPGGSSKIGSLLELICIEEMWSCRILPAPSVTEEIRIDGVDGGLP

SEQ ID NO: 149668 - protein, 753 aa, Glycine max
  Coding DNA Sequence Number=SeqID_57983
  Homolog annotation: Hit_ID=A8GBW9; Match level="QueryCoverage=60%, HitCoverage=84%, E-value=0.0, Identity=87%"; Hit description =Putative receptor precursor
QSLGYVDNGYNTGLNANWRYDMWLENAPIKNPFLGLRCINWYAGCNMDTSLILPQTTDEKGFYGAVVTPGGAKWMHGMMSPSFYQYLKQMAAGDAFSMQINGCQTSVAYDAAAGGRCQDQASGSWYKRTVTHSKAAHLRFINTNAVSEVFVNSDGVPIIGEGNADCKNQTIGARSGIMCKMVSYDLQTDGSVSNTSIHVFPAINHAALSSAVNAADLQFSLNGNTWKNTSGTGSYYTFNELKSSNAVYVFFSSNFFKQMVALGISDSGTRDLINFRFQNTTSPESGWYEFSTSNQLIIKPRDFSISIISDDYDNSPHREGYVGPAEPALEFGYLVTTSGKTAADQVRVMATGPTQAINGVNYCLFSSADNSTQVPFPATLGITTSTNGQQSFAAGCDGQWHDMTNALWSSTPWNDISGEVGVLNKTRVTFSIPMNNPISLRTVDGNGWYGDVSAAGQSVKLMLIGLLCLSFPFTAAAINVGTLTFAMDQDRSFTAKRVLNNNRSARLYQVSIRAIDRPGEREVRSRPADGELLFAPRQLTLQAGQAEYYKFFYRGPQDNRERYYRVSFREVPTRLFEPGPRRGAGVNLGADRGDGHHSGGASASGKLCLSASIPSAVRSPTPATPTSSSCSSRAANSTDEEGVPEYLRPGDTLTHADIRLKGQKFIIYNDKFISLNIAIVQLQNASHDHQAQSAGRAPGAAQDRRAHEQIGAQRLRNTGAAVADLHHHPIVLPPQPHADVAARAAYGEWRCPA

SEQ ID NO: 149669 - protein, 270 aa, Glycine max
  Coding DNA Sequence Number=SeqID_57984
  Homolog annotation: Hit_ID=A5AZG1; Match level="QueryCoverage=35%, HitCoverage=30%, E-value=1e-07, Identity=35%"; Hit description =Putative uncharacterized protein
  Pfam annotation: Domain name=zf-CCHC; Domain location=81-98; Score =19.0; E_value=0.002; Accession=PF00098.14; Description=Zinc knuckle
IKLPYFHGKDNEEAYLDWEIRVEQKLKRKSTLKSYGYDSYPKKYQGLGILGATPSKPNDDKGKTIEKQPPKASMQEKTSSIKCFKCLGRGHITSQCSTKKTMIMRSQDIYSSQDEATTSPSSSESEEAKGEESSEEIYPQEEGKPLMVKEECKETLVRIATPLRLEFIPQVKELLDEGLVRKSLNPCALLVPKIGIIRHQIPKIGGMMKALGGATLICKITRAPNIFMICVHRDSLGSPMNPKRIKVIPEWPAPPCVLRKKAQSFKNLGI

SEQ ID NO: 149670 - protein, 106 aa, Glycine max
  Coding DNA Sequence Number=SeqID_57985
  Gene Ontology: Mol. function=chitin binding; Cellular component =extracellular region; Biological process=chitin metabolic process
  Homolog annotation: Hit_ID=UPI00006A17C9; Match level="QueryCoverage =87%, HitCoverage=89%, E-value=7e-09, Identity=33%"; Hit description =UPI00006A17C9 related cluster
  Subcellular localization annotation: CTP_CleavageSite=66; ConfidenceScore=5.44e-01
MRTRSSLKATACSPLKFRTCRLLKARECSPIMARTCSPLKARTCSPLKARTCSPLKARTCSPLKVRACSPTKVKARTCSPLMARTCSPLKKIGTSTQGSTFMRKQE

SEQ ID NO: 149671 - protein, 34 aa, Glycine max
  Coding DNA Sequence Number=SeqID_57986
ITLGYLRMSPRFSQVGVTDLGVCADNPWVSPHAT

SEQ ID NO: 149672 - protein, 91 aa, Glycine max
  Coding DNA Sequence Number=SeqID_57987
  Gene Ontology: Mol. function=hydrolase activity, acting on acid anhydrides, catalyzing transmembrane movement of substances; Cellular component=proton-transporting ATP synthase complex, catalytic core F(1); Biological ...
  Gene Ontology: Cellular component=process=plasma membrane ATP synthesis coupled proton transport
  Homolog annotation: Hit_ID=P56757; Match level="QueryCoverage=73%, HitCoverage=18%, E-value=4e-21, Identity=63%"; Hit description=ATP synthase subunit alpha
  Pfam annotation: Domain name=ATP-synt_ab_C; Domain location=1-84; Score=64.7; E_value=3.1e-16; Accession=PF00306.18; Description=ATP synthase alphabeta chain, C terminal domain
QFAELEAFAQFASDLDKATQNQLARGQRLRELLKQSQSAPLTVEEQIITIYTGTNGYLDSLEIGQTFTGEAEVLLKEAIQEQMELFLLQEQ

SEQ ID NO: 149673 - protein, 96 aa, Glycine max
  Coding DNA Sequence Number=SeqID_57988
MKMNPWPRHGLLIISCTELLGVGSHFLNQIPSLNSGPRCREEFLQERPLKVIPTGNGPGSKGVSHRGTDNMKLLKMLMRIFTCKTMNLGSKCIVQS

SEQ ID NO: 149674 - protein, 396 aa, Glycine max
  Coding DNA Sequence Number=SeqID_57989
  Homolog annotation: Hit_ID=Q6WAY6; Match level="QueryCoverage=58%, HitCoverage=38%, E-value=4e-27, Identity=34%"; Hit description =Putative uncharacterized protein
MANQGDWVSFMDVLALLIFGVVLFPNVDGLVDLAAIDAFLAYHHSKESPVVAVLADLFDTFNRRCEKSSAWIICCLPALCVWLVSHLFQQDTRHPCPLQSHRSCTEKRRIDWGQLLAGIGGRTINWFPRWKEGNEGVLFSCGGYPNIPLIGTRGCINYNPALAIRQLGYPMRGAPMEESMSPFLVRDFGAQNFKAIQRIHKAWETPLRKDQELRGIRNDIIGYHEWLKVHIRGLDWLAKLKVVSEESFEAPEEDKEVQALKSELGKAKLAKKKFKLAATHIRKECAGLREENATTARALEQETKRARKEEYGRNKFRGALWGSNNELKLRKEERDQSRAHSMVLKEELVACSRSKRSLSQRLCETETNMLAIIAKYQEELGLATAHEHRIADEYAQ

SEQ ID NO: 149675 - protein, 37 aa, Glycine max
  Coding DNA Sequence Number=SeqID_57990
MNRVEEKSPEFQEPRDLRSNPFQGGGNDAILPRKGIG

SEQ ID NO: 149676 - protein, 59 aa, Glycine max
  Coding DNA Sequence Number=SeqID_57991
MGLNQFRFFNMVHDILVKVKLEVTRTSTVLNVFGSKQSSDRKMQGSRMKTKGMQFGEQK

SEQ ID NO: 149677 - protein, 88 aa, Glycine max
  Coding DNA Sequence Number=SeqID_57992
MTEARQKGVRKNELKSSVWGTYWLKTEENEERTMNVEEPRKHYGNVTEAPRLRFSSRKQFSSAILREYEVPRRLNPLPSSFRPLFIAK

SEQ ID NO: 149678 - protein, 68 aa, Glycine max
  Coding DNA Sequence Number=SeqID_57993
  Homolog annotation: Hit_ID=UPI0000ECBAF8; Match level="QueryCoverage =60%, HitCoverage=48%, E-value=1e-16, Identity=100%"; Hit description= UPI0000ECBAF8 related cluster
MAHATQEPKFGIGVTSMQAWHWPSFYNVVTGKTLALPNLIALQHIPLSPAGVIAKRPAPIALPNSCAA

SEQ ID NO: 149679 - protein, 138 aa, Glycine max
  Coding DNA Sequence Number=SeqID_57994
  Homolog annotation: Hit_ID=A2Q3G4; Match level="QueryCoverage=84%, HitCoverage=32%, E-value=2e-09, Identity=31%"; Hit description =Ovarian tumour, otubain
SMSWMSLVDCPSEQQFDECLKKVESAHWALKRVLHNSLGDLCNIWDAMNNMMMLQHMEIKASFETSTYVVGHVFKKTLYKRLLGMISRTAHGLSCAYELSKYGVGCILLDSIHMFWRRLIFSDQGLSEPEISIKEEME

SEQ ID NO: 149680 - protein, 237 aa, Glycine max
  Coding DNA Sequence Number=SeqID_57995
  Gene Ontology: Biological process=transposition, DNA-mediated
  Homolog annotation: Hit_ID=Q6UUU1; Match level="QueryCoverage=25%, HitCoverage=40%, E-value=3e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLVGMFNFGLIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 149681 - protein, 41 aa, Glycine max
  Coding DNA Sequence Number=SeqID_57996
MEEKLACETSMEAGSLSFTKVVSLRNFLEKLELSYRHPSNN

SEQ ID NO: 149682 - protein, 187 aa, Glycine max
  Coding DNA Sequence Number=SeqID_57997
  Gene Ontology: Mol. function=aspartic-type endopeptidase activity; Biological process=RNA-dependent DNA replication
  Homolog annotation: Hit_ID=A5ASL2; Match level="QueryCoverage=99%, HitCoverage=25%, E-value=2e-15, Identity=31%"; Hit description =Putative uncharacterized protein
  Subcellular localization annotation: CTP_CleavageSite=19; ConfidenceScore=5.10e-01
PQNSDKLSSQTVQNPRNVSAITLRSGNQIQVPPPVATPAPELVKLHSTPEKEDEIVSQKRKLPNKNFHAGGPSSSNSDLQRPLIPLPFPPRAIPNKKMKEAEKEILETFRKVEVNIPRYAKFLKEMCTHKRKLKGNERISMDRNVSALIGKSVPHIPEKCKDPDVVIHLANRSVSYPTGFIEDVLVR

SEQ ID NO: 149683 - protein, 794 aa, Glycine max
  Coding DNA Sequence Number=SeqID_57998
  Gene Ontology: Mol. function=hydrolase activity, acting on glycosyl bonds; Cellular component=cell outer membrane; Biological process =cell wall organization and biogenesis
  Homolog annotation: Hit_ID=Q6D8K0; Match level="QueryCoverage=41%, HitCoverage=92%, E-value=1e-154, Identity=80%"; Hit description =Membrane-bound lytic murein transglycosylase C precursor
  Pfam annotation: Domain name=HHH; Domain location=142-171; Score =22.1; E_value=0.002; Accession=PF00633.14; Description=Helix-hairpin- helix motif
  Pfam annotation: Domain name=HhH-GPD; Domain location=78-210; Score =90.7; E_value=4.7e-24; Accession=PF00730.16; Description=HhH-GPD superfamily base excision DNA repair protein
  Pfam annotation: Domain name=Iron_traffic; Domain location=381-468; Score=191.4; E_value=2.2e-54; Accession=PF04362.5; Description =Bacterial Fe(2+) trafficking
  Pfam annotation: Domain name=SLT; Domain location=629-757; Score =156.3; E_value=8.2e-44; Accession=PF01464.11; Description =Transglycosylase SLT domain
  Pfam module annotation: Pfam domain module=HHH::HhH-GPD::Iron _traffic::SLT; Domain location=142-171::78-210::381-468::629-757
GNGHYAKLSNRSKPLQSSGLHPDVSVLEFLPDCRVNTENFLLMMQAPQFAQQVLEWYQRFGRKTLPWQLEKTPYKVWLSEVMLQQTQVATVIPYFERFMARFPTVADLAAAPLDEVLHLWTGLGYYARARNLHKAAKQVVELHGGVFPPHFDDVAALPGVGRSTAGAILSLSLGLHFPILDGNVKRVLARCYAVSGWPGKKEVEKRLWQISEDVTPAEGVSQFNQAMMDLGALVRTRFRSKCDICPLNSGCAAYAQGNWADYPGKKPKVTLPERSGWFLMLQHGDEVFLEQRPPVGLWGGLFCFPQFTSEQALTDWLAARGIHAKPQQLTAFRHTFSHFHLDIVPMWLAWPSSGSLMDEAGAAPSPAASTANQFDRRGRVMSRTIFCTYLQRDAEGQDFQLYPGELGKRIYNEISKEAWQQWMSKQTMLINEKKLNMMNPEDRKVLEKEMVNFLFEGKDVHIEEWVKDTNGFDILMGQFAANIENIWGINEVLIAGPKDYVKYSDNYYTRSHINFDSGSITIETISGTDPMASLRQAIITTLLIGDDPGNVDLYSDANDIQISKEPLLYGQVLDNTGQPIRWQGRAGNFADYLIQNKLQKRTSGLHVIWSVTIPMVPNHLDKRAHKYLPLVRKAAEQYGVDASLILAIMQTESSFNPYAVSNADALGLMQVVQHTAGVDVFRMKGKWGKPSRSYLLDPANNIDAGTAYLSLLQKSYLGGIQDPLSRRYAVITAYNGGAGSVLRVFSSDKDRAFATINGMSPSQVYQTLTTNHPSAESRRYLYKVSQAQRSYHRY

SEQ ID NO: 149684 - protein, 357 aa, Glycine max
  Coding DNA Sequence Number=SeqID_57999
  Gene Ontology: Mol. function=pyridoxal phosphate binding; Cellular component=cytoplasm; Biological process=amino acid metabolic process
  Homolog annotation: Hit_ID=Q58PU0; Match level="QueryCoverage=98%, HitCoverage=49%, E-value=1e-159, Identity=74%"; Hit description=SpeC
  Pfam annotation: Domain name=OKR_DC_1; Domain location=1-206; Score =58.1; E_value=3.1e-14; Accession=PF01276.11; Description=OrnLysArg decarboxylase, major domain
  Pfam annotation: Domain name=OKR_DC_1_C; Domain location=214-347; Score=278.0; E_value=1.9e-80; Accession=PF03711.6; Description =OrnLysArg decarboxylase, C-terminal domain
  Pfam module annotation: Pfam domain module=OKR_DC_1::OKR_DC_1_C; Domain location=1-206::214-347
TSQIHKKDNHIRGQKRFCPHKRLNNAFMLHASTSPFYPLFAALDINARMHQGEAGRSMWHDCVTLGIEARKAILERCSLIQPFLPEQVHGKPWQAAETATIAADPAYFSFEPGAKWHGFAGYDAGQYLVDPCKLLLTTPGIDATSGEYTRFGIPATILANYLRENGIVPEKCDLNSILFLLTPAETPEKMAHLVAMLEQFEQHVREDALLAEVLPSVYRRHVERYQGYTLRRLCQEMHDLYVSYDVKDLQRDMFRQACFPKVEVNPQDAHQAYIRGDVELVPIASAEGRIAAEGALPYPPGVLCVVPGETWGGAVQRYFLALEAGINLLPGFSPELQGVYTEEDDSGHKRLVANMML

SEQ ID NO: 149685 - protein, 226 aa, Glycine max
  Coding DNA Sequence Number=SeqID_58000
  Subcellular localization annotation: CTP_CleavageSite=17; ConfidenceScore=5.64e-01
MALTRPAARIAPSAPVCAPAAWVRKPPCAMINSTFTGSGRCGSCARCLLTLSINARAACSRCSALPMVAILSVMASRRLSPLTSTTVTPASATCCNTSDGLASALATDIRQPGGRRRMLAGAVARHQLRLRIQRVDDLRYIAPDSNDALRRPRRQRQQSKQCQDQRFHAAAPVGVSAITCSRQRACSGVPSLRWPYSWAICVPSAANSSRLVTKPSPPGLRVTQLS

SEQ ID NO: 149686 - protein, 603 aa, Glycine max
  Coding DNA Sequence Number=SeqID_58001
  Gene Ontology: Mol. function=iron ion binding; Cellular component =cytoplasm; Biological process=iron ion transport
  Homolog annotation: Hit_ID=Q5PKX4; Match level="QueryCoverage=40%, HitCoverage=96%, E-value=5e-60, Identity=48%"; Hit description =Putative uncharacterized protein yqjH
  Pfam annotation: Domain name=FAD_binding_9; Domain location=32-145; Score=143.2; E_value=7e-40; Accession=PF08021.2; Description =Siderophore-interacting FAD-binding do
  Pfam annotation: Domain name=PadR; Domain location=301-382; Score =66.0; E_value=1.3e-16; Accession=PF03551.5; Description =Transcriptional regulator PadR-like family
  Pfam annotation: Domain name=SIP; Domain location=151-253; Score =26.0; E_value=6e-07; Accession=PF04954.4; Description=Siderophore -interacting protein
  Pfam module annotation: Pfam domain module=FAD_binding_9::PadR::SIP; Domain location=32-145::301-382::151-253
MATSSRRETLPNPTHHRAPQRVRNELRFRHITVASKTRVADAFWRIVFSGSDLAGFHSPSFDDHIKVFFPDTPGGALALPHMTDEGIVWPDGVRPAARDYTPLAFNGSDSLTLDFYIHDGGVASSWASAAQPGDRIAMGGPRGSCVVPVDYACQIYVCDETGLPAFKRRYQEMQAQQIHLLACVDEPVGRAYLGDLPDVTVSWLGSGKMQTEALTPLLDPIMLPADDYFIWLTGEGAAVKQLSDYFTQQRAAHSDLAPDYYQPPSTDPGKAMKPQRDVPEHADAAQRASCAGARRKRRERMLDASDIRLLMLHFLASGAAHGYELIKSVEELSKGEYSPSPGIIYPNLTLLEEMDAIRVVDAQATRKAYALNDAGRALLAENGENVAHSTGGAGDPYASLYAQSSVIAGADFTGHGGDCRGGAAGRGREDRQQLSALRFLLVHVPHFAIRPADIAHPLLQCCRIGKAAFLFAFPNYLTINADLEHAAAAGLERDCAEIAGEGMQQLLRHPRRTQQPVTLGTVVNGYCRFICHTIPPASLRHRGQLYTAAVHSSAHDTVPQGTVQQRLCKVAVLASAIHAACSYAASDSSTLARSAENNSSNEP

SEQ ID NO: 149687 - protein, 289 aa, Glycine max
  Coding DNA Sequence Number=SeqID_58002
  Gene Ontology: Mol. function=unfolded protein binding; Cellular component=plasma membrane; Biological process=response to stress
  Homolog annotation: Hit_ID=A4W6D5; Match level="QueryCoverage=100%, HitCoverage=45%, E-value=1e-112, Identity=74%"; Hit description =Chaperone protein dnaK
  Pfam annotation: Domain name=HSP70; Domain location=1-257; Score =67.1; E_value=6.1e-17; Accession=PF00012.11; Description=Hsp70 protein
MVQAKVAEFFGKEPRKDVNPDEAVAVGAAVQGGVLAGEVKDVLLLDVTPLSLGIETMGGVMTSLISKNTTIPTKHSQVFSTAEDNQSAVTIHVLQGERKRSADNKSLGQFNLDGIQPAPRGMPQIEVTFDIDADGILHVSAKDKNSGKEQKITIKASSGLNEEEIEKMVRDAEANAESDRKFEELVQTRNQGDQIAHSTRKQLDEAGDKLSAEDKAPIESALNELNTALKGEDKAEIEAKMQALMEVSSKLMELAQQQAQAGAADAGDASAKKDDDVVDAEFEEVKDKK

SEQ ID NO: 149688 - protein, 116 aa, Glycine max
  Coding DNA Sequence Number=SeqID_58003
MAPKKLPSKRARKTVTGEGSSTTPPVEIDILLSDHNSDLTLPKSQLVYSIMTQISVHVAQLILDFIHQFVGIAPPRNPVDPENSNKALGFPILITGLCQFYRVTVTPMKLIRPPIN

SEQ ID NO: 149689 - protein, 83 aa, Glycine max
  Coding DNA Sequence Number=SeqID_58004
PLGPSGIFLQKAVASGGSNPARLGELGGNHLPYFAINRGGSEEEKAEALPKRFRNVFREESRKGFNRSSTFFIRSSSFFDLQR

SEQ ID NO: 149690 - protein, 160 aa, Glycine max
  Coding DNA Sequence Number=SeqID_58005
  Homolog annotation: Hit_ID=Q5XM22; Match level="QueryCoverage=50%, HitCoverage=45%, E-value=2e-27, Identity=71%"; Hit description =Resistance-like protein HAAS-2
MQEKALGSPIQLNFRGGGEHLLATPHCHIISGEEARAETVRAHGAYVRLSWLREVYESRCQARRWIVATRAYLLHLVGCTLFANKSATHVHVVHPEAFRDLGQTGGYAWGVAALVHISGYMSTFAVFISASLIMRMLRLPFVPRGTYDEGAHEGDPGSAV

SEQ ID NO: 149691 - protein, 185 aa, Glycine max
  Coding DNA Sequence Number=SeqID_58006
MTTRPHHQRAARPYLQRTTCPRLERATRPHLGGLDVLALRGLHVLTIRGLHALPSTSEDYMSSPERVIVLTFRVHVTLTVRGLHALTFERTTRPHHQRTTCSPFSKGGMPSPSEDYMSSPSECYALTNRGLVTLTLRGLHVLALRGLHVLTIRGLRALTSRGLHVLALREGYTSSPSKGHVPSPL

SEQ ID NO: 149692 - protein, 287 aa, Glycine max
  Coding DNA Sequence Number=SeqID_58007
  Gene Ontology: Mol. function=electron carrier activity; Cellular component=integral to thylakoid membrane; Biological process =electron transport
  Homolog annotation: Hit_ID=P49161; Match level="QueryCoverage=100%, HitCoverage=100%, E-value=1e-144, Identity=83%"; Hit description =Apocytochrome f precursor
  Pfam annotation: Domain name=Apocytochr_F_C; Domain location=202-287; Score=183.1; E_value=7.3e-52; Accession=PF01333.10; Description =Apocytochrome F, C-terminal
MQTRNAFSCIKEGITRSISISIMIYIIIRAPISNAYPIFAQQGYENPREATGRIVCANCHLANKPVDIEVPQAVLPDTVFEAVVRIPYDMQVKQVLANGKKGALNVGAVLILPEGFELAPPDRISPEIKEKIGNLSFQNYRPTKKNILVVGPVPGQKYKEITFPILSPDPTTKRDVHFLKYPIYVGGNRGRGQIYLDGSKSNNNVYNATAAGPELLVSEGESIKLDQPLTSNPNVGGFGQGDAEIVLQDPLRVQGLLFFFASIILAQIFLVLKKKQFEKVQLSEMNF

SEQ ID NO: 149693 - protein, 198 aa, Glycine max
  Coding DNA Sequence Number=SeqID_58008
  Gene Ontology: Mol. function=structural constituent of ribosome; Cellular component=intracellular; Biological process=translation
  Homolog annotation: Hit_ID=A4DID9; Match level="QueryCoverage=25%, HitCoverage=44%, E-value=5e-19, Identity=86%"; Hit description =Putative uncharacterized protein
  Subcellular localization annotation: CTP_CleavageSite=63; ConfidenceScore=5.15e-01
AHIDGKVWHLDVGSSPPGAVVCSKGWAVRPLKRYVSWVQNVVRQFGPYPDREGRTSGVPVIVPTVNAGASGSTAETAMGSLPQRGWSERSFENSREGVEEPHQSIPNLVVKLYCGDDTVGEAGERKCSHFLGYSGEQISSGDDGVGPVAQRIRARGYEPRCRGFESLLAHNRPKKGRIFPSGGRKIMIGLADPKLWNL

SEQ ID NO: 149694 - protein, 91 aa, Glycine max
  Coding DNA Sequence Number=SeqID_58009
MSVHVAQLIAHAIYLFTGMPPIRHPLDPDKSNTALGFPALITGLCQSFGVPVTPSKVIRPPITWAFIEKYCTPRQAQGDAPQDADAPPPPH

SEQ ID NO: 149695 - protein, 352 aa, Glycine max
  Coding DNA Sequence Number=SeqID_58010
  Homolog annotation: Hit_ID=Q6WAY6; Match level="QueryCoverage=54%, HitCoverage=30%, E-value=7e-20, Identity=35%"; Hit description =Putative uncharacterized protein
IPPNVDGLVDLAAIDAFLAYHNHKESPVVAMLADLYDTFDRRCEKSNTRIVCCTPALYVWLVSHLFRQEVRHACPLESHRSCTEKEGANWDRLLASKEGASVNWFPQWKEGRTGVLISCGGFPNVPLMGTRGCISYNPVLAIRQLGYPMRGAPLEDELMLVISRGFNKTNVETLQKVRKAWEVLQKKDKELRGKPLKGEEVEAPEENEEVQPLGWNSSKPKQSKKGALWGCNSELKLRREERDQSRVHGMVLKEELAACPRSKKSLAQHLEATEQSMLAIIGQYKEEFNQSLTHEQKLVEDFAQAYAEKEARGRVIDALHQETTMWMDRFALTLNGSQDLPRLLAKARAIAE

SEQ ID NO: 149696 - protein, 271 aa, Glycine max
  Coding DNA Sequence Number=SeqID_58011
MAPRKLASKRSRKDKAAEGTSSAPEYDGHRFRCAVHQQRFEAIKGWSFLLERRVQLRDDEYTDLQEEIGHRRWTSLVTPMAKFDPEIWIPFDADAIGQLLGYPLVLEEGQECEYGQRRNRSDGFDEEAIAQLLCIPGQDFAQTVAGRRVRIMRTNMTTLTQIWMTLLLSNILPSDHNSDLPLPKCQLVYAILTRMSVHVAQLIADAIYIFAGMVPTRHPLDPDKSNRALGFPSLITGLCQSFGVPVAPTKVIRPPINRAFIEKYCTQRQAQ

SEQ ID NO: 149697 - protein, 123 aa, Glycine max
  Coding DNA Sequence Number=SeqID_58012
MSKSCGFGMTGPLDESISCFLIRVDPWVLVPITLRGLHVLAIRGPHVLALRGLHALTSRGLHVLALRGLHALTLGTCTYHLERTTCPRHQRTACPQLQRASRPRHQRTTRPRLERATRPHLGY

SEQ ID NO: 149698 - protein, 334 aa, Glycine max
  Coding DNA Sequence Number=SeqID_58013
  Gene Ontology: Mol. function=RNA-directed DNA polymerase activity; Biological process=RNA-dependent DNA replication
  Homolog annotation: Hit_ID=Q0ZCD0; Match level="QueryCoverage=46%, HitCoverage=13%, E-value=9e-09, Identity=28%"; Hit description =Integrase
MAQPPPRERTLREMAAPDFTYESLCIQYPDEDVPYVLKTGLIHLLPKFHGLAEGVAKDWLYYLAPRTTAIRKDISGIRQLSGESLNMERSMIDAASGEALGDMTPTEARNLIEKMASNSQQFSARNDAIVIRGVHEVATNPYASSETKKLEGKLDALVNLVTQLALNQKYVPVARVCGLCSSADHHTDLCPSMQQPGAIEQPKAYAANIYNRPPQPQQQNQPQQSNYDLSSNRYNPGWRNHPNLRWSSPQQQQQQPAPSFQNAAGPSRPYIPPPIQQQQQPQKQPTVEAPPQPSLEELVRQMTMQNMQFQQETRASIQSLTNQMGQLATQLNQQ

SEQ ID NO: 149699 - protein, 71 aa, Glycine max
  Coding DNA Sequence Number=SeqID_58014
MANQPVGHFALFGEDGLNCGYRSGVAPAFFAAASREGTCRRWIAPAPPFCSSSLLRPNEKYHYGRGFPPAM

SEQ ID NO: 149700 - protein, 74 aa, Glycine max
  Coding DNA Sequence Number=SeqID_58015
MTKARQKGVRKVKEMRAERNSSSLLPLFIRKWERSLPPSSPRRARWLPPEATAFWRNLLEGPSGPGCYLHPHFY

SEQ ID NO: 149701 - protein, 115 aa, Glycine max
  Coding DNA Sequence Number=SeqID_58016
  Homolog annotation: Hit_ID=Q3V0I3; Match level="QueryCoverage=77%, HitCoverage=56%, E-value=4e-08, Identity=35%"; Hit description=Adult male testis cDNA, RIKEN full-length enriched library, clone:4930588P05 product:...
  Homolog annotation: Hit description=hypothetical Dictyostelium (slime mold) repeat/Cysteine-rich region profile/Insect antifreeze protein containing protein, full insert sequence
  Subcellular localization annotation: CTP_CleavageSite=32; ConfidenceScore=5.26e-01
MARTCSPLKGRMSSPLKVMAWTCSSLKVRACSPMMARTCGPLIGGHVVHSKGEDVSPLKVRACSPLMARTCSPLKVRACNPLIVKTCSPLKVRACRPLMARTCSPIKARMSSPLK

SEQ ID NO: 149702 - protein, 188 aa, Glycine max
  Coding DNA Sequence Number=SeqID_58017
MAILIANTSTTFHRDERLGNTHDMHGKLKQVYDPNMRKMQGSCMSKHEDKNGTYVHYDAMKRCLCVKKVIWTFQLPVIKDETNIQRMRDDMMQMRKSAIVGCITPFEKHIVAVGTTNNNMLSKIKTLDEGSLLSRKSETQHDHKFTSTPYIPMNPSVGPSISMCVFQERKMRGVATNVYLRKTSEKPE

SEQ ID NO: 149703 - protein, 99 aa, Glycine max
  Coding DNA Sequence Number=SeqID_58018
MEKGYTLHFEGGVCKILDNKNKRLLHEKNSKHDEQRSSKHKGDTMKCVKGCPSSQSLNFSPKTSGAWRAKDLLELIHTDLWTRTPSHENKYFILFIDLL

SEQ ID NO: 149704 - protein, 163 aa, Glycine max
  Coding DNA Sequence Number=SeqID_58019
GLGFPALNTGLCQSFRVPVAPTKVIRPPITRAFIEKYCTQRQAQGDAPQVVDAPPPHQAGQAGSFDTERYLRHLVRQQAANHRAHVQTHDCLYQLSLSMQSQGFTSFSCPTPDQFRAEVAWPGDWPEAQAGEAPPEAPGDGEEAHEDEEMANLLDFLGRSGAT

SEQ ID NO: 149705 - protein, 147 aa, Glycine max
  Coding DNA Sequence Number=SeqID_58020
  Homolog annotation: Hit_ID=Q9SJS1; Match level="QueryCoverage=38%, HitCoverage=7%, E-value=3e-08, Identity=51%"; Hit description =Putative Athila retroelement ORF1 protein
MRLRTASGDVVPINLEIEATCRRNNAARRRREQDTEGSSHTSPPLSPHHAEMDGEQARRVTLEDFSNTATPQFFTSIARPEVQAANISYPHSLIQLIQGNLFHGLPSEDPYAHLASYIEICNTVKIAGVPEDAERQNDGCTPSKATA

SEQ ID NO: 149706 - protein, 163 aa, Glycine max
  Coding DNA Sequence Number=SeqID_58021
  Subcellular localization annotation: CTP_CleavageSite=56; ConfidenceScore=5.53e-01
YAQHPPSFSAHTGNASSSAPVQPKAPTQREAPQVPTLNTTRPADLLSSLIANHLVVVTPGKVLQPPFPKWYDPNATCKYHGEDRPNVRTNSLANHGGGAVNAVESDRPRRSKPLRDVATPRRFIFEALQKGGVIPHSGLKEGKNNIYECSPRMGAVLRSPNPW

SEQ ID NO: 149707 - protein, 199 aa, Glycine max
  Coding DNA Sequence Number=SeqID_58022
MASNCQQFSAKNDAIVLRGVHEVATDSSSSTENKKLEGKLDALVNLVTQLAMNKKSALVARVYGLCSSADHHTYLCHSLQQSGVNEQPEAYAANIFNRPHRQQNQQQQNNYDLSSNRYNPRWRNHPNLRWASPPQQQQPVPPFQNAAGPSKPYVPPPIQQQQQQRQQATEAPPQPSLEELVRQMIIQNMQFQQETRASI

SEQ ID NO: 149708 - protein, 62 aa, Glycine max
  Coding DNA Sequence Number=SeqID_58023
MSIFPCESIGWSMPSRHRDCARKTPSGPGEAQQGHGVSSSGYGHLLVIQGARSPQQGHVVIT

SEQ ID NO: 149709 - protein, 151 aa, Glycine max
  Coding DNA Sequence Number=SeqID_58024
MAKFDPEIVLEFYVNAWPTEEGVRDMRSWVRGQWIPFDADAIGQLLGYPLVLEEGQECEYGQRRNRSDGFDEEAIAQLLCIPRQDLARTAAGRRVRIMRTNMTTLTQIWMTLLLSNILPRGGGNSDLPPAEVSAGVRHPDADEHPCGSVNR

SEQ ID NO: 149710 - protein, 167 aa, Glycine max
  Coding DNA Sequence Number=SeqID_58025
  Pfam annotation: Domain name=Transposase_23; Domain location=51-121; Score=4.0; E_value=0.00044; Accession=PF03017.5; Description =TNP1ENSPM transposase
  Subcellular localization annotation: CTP_CleavageSite=34; ConfidenceScore=5.15e-01
MASFSQMQSQIQSQMQSQGLALPPEPLVGPSGARVNTKGSCVDPSGNDPEAGDSDRCGLYIAADPARLVALGRVYEGSSVVHNTPLLPGQVKVSVVEVTNADAPVPVPTDEVSLVGQALHTFLAWPTHLVKSLSQQVAVSLAKPPPKPDPEVDDSIYLMTLTIPELF

SEQ ID NO: 149711 - protein, 95 aa, Glycine max
  Coding DNA Sequence Number=SeqID_58026
TLVSTVTPLGLEIIAQLKELLDEGLVRKSLNPCALLVPKIDIMRHQIPMIGGVEGRSPEFQEPLDLRRLQEDWVRDAREDLRILMSHRIDFGHIG

SEQ ID NO: 149712 - protein, 68 aa, Glycine max
  Coding DNA Sequence Number=SeqID_58027
ALGFPALITGLCQSFGVPVAPSKVIRPPITQAFIEKYCTQRQVQGDAPQAAGAPPPHQAGPAGSFDTE

SEQ ID NO: 149713 - protein, 104 aa, Glycine max
  Coding DNA Sequence Number=SeqID_58028
MKKRDTGHQSVSLENKTGDSTVLKIGDSAKVVIKQDMKGRRHKYGFNNNKREKPEKIMGSPPAFPPPPPSPPHSPPPPAPSDASGSPSTVKRTRKALRLRSLST

SEQ ID NO: 149714 - protein, 67 aa, Glycine max
  Coding DNA Sequence Number=SeqID_58029
MPKDRGTCLDFRDCHHQKGGDCRQMIKLNVLMMPKVHMRLKALLETKKLKIFKMNDQDKSLVLERVY

SEQ ID NO: 149715 - protein, 277 aa, Glycine max
  Coding DNA Sequence Number=SeqID_58030
IVPLPTSEIQYVRDAVNSFIGWPRHLVKPLSYDSDLNVRKPVEHSSDAKLAGESDPLGELMKILFYVYQNPVEVPWEAHQFGLPEIGAKFYITHADLAEIISGDKCLNIAILQLWTIFMNECGRSKADQSLYGLLEPQSIQNAKERRQQCQQYIETWVKESQRQLYLGAYLHQAHWQLFVLHPRENTVVWFCSLRKKPDINMKGAINSKNGCHIYAILLTSAMKTITSSFEGMSNQGAPRWVEPKSNVQSGGFECGYYVMHWMWCIVTADLKDDWHK

SEQ ID NO: 149716 - protein, 74 aa, Glycine max
  Coding DNA Sequence Number=SeqID_58031
EKSCDLVGVLAEFSAYALFFLAVIACARIDGDPVLRETRIWATWEYVSLDGGGQQGMSGTWRYVAGVRRPWGRQ

SEQ ID NO: 149717 - protein, 123 aa, Glycine max
  Coding DNA Sequence Number=SeqID_58032
  Pfam annotation: Domain name=Retrotrans_gag; Domain location=14-89; Score=25.6; E_value=0.00017; Accession=PF03732.8; Description =Retrotransposon gag protein
MKPPDVQEDHIFLKAFPHSLEGVAKDWLYYLAPRSITSWDDLKRVFLEKFFPASRTTTIRRISQRSMIDAASGGALGDMTPAEARNLIEKMASNSQQFSARNDAVATYPSAGGRRVTRGMRLP

SEQ ID NO: 149718 - protein, 134 aa, Glycine max
  Coding DNA Sequence Number=SeqID_58033
MVGYTPSSFIDLVFASERIEVGLKRGKFNHPALMNEKTGANEEGEDEGETHAVTAIPIRPSFPPTQQCHYLANNNPSPYPPPSYPQRPSLNQPQNPPSTQPMLNTTFSINQNTNQGRNFVAKACRIHPNSGVLC

SEQ ID NO: 149719 - protein, 225 aa, Glycine max
  Coding DNA Sequence Number=SeqID_58034
MHEHPLILLVKKNLQDDSLIIEETEVNSKFEKVLEAFNEMHEETQRLAISNYKLRSDLKWHITKLASTQSELVKLKHESEKLVSSYKAIGCVCVSNSLNMDDYKSLPNEFEKFKKDYYEELIKLQTEFSYLKYLFRKMNKEKNDLSHFLSVQKHTTSKTGLGYNKQTKFFKKTKFASSKKVNPNRVSKKKNIMYPKLDAKTYHCCMKRGHTSCKCYVRRFDVLRA

SEQ ID NO: 149720 - protein, 102 aa, Glycine max
  Coding DNA Sequence Number=SeqID_58035
MGFPAFITGLCQSFGVPFTPSKVIRPPITWAFIEKYCTARQAQGGYLQAPDAPPPPPQADPAGSFGTERYLRHLVRQQVANHRAHVQTHDSLYQLSLSLQSQ

SEQ ID NO: 149721 - protein, 124 aa, Glycine max
  Coding DNA Sequence Number=SeqID_58036
  Subcellular localization annotation: CTP_CleavageSite=72; ConfidenceScore=5.24e-01
MNCIFIHVSSTFEFGAMRSDCLVKFSILNLFRSPMNCVFVHVSSTFDFGAMRSDCLVKFSILNLFRSPVNCVFVHVSSTFEFGAMRSDCLVQFSILNLFRSPMNCVFALMCPPFTSGELCVEIA

SEQ ID NO: 149722 - protein, 172 aa, Glycine max; identical to SEQ ID NO: 122376
  Coding DNA Sequence Number=SeqID_58037
  Homolog annotation: Hit_ID=A6FJQ2; Match level="QueryCoverage=22%, HitCoverage=84%, E-value=3e-11, Identity=92%"; Hit description=50S ribosomal protein L5

SEQ ID NO: 149723 - protein, 100 aa, Glycine max
  Coding DNA Sequence Number=SeqID_58038
  Gene Ontology: Mol. function=heat shock protein binding; Biological process=response to stress
  Homolog annotation: Hit_ID=A7NWU0; Match level="QueryCoverage=98%, HitCoverage=68%, E-value=5e-20, Identity=45%"; Hit description =Chromosome chr5 scaffold_2, whole genome shotgun sequence
  Pfam annotation: Domain name=DnaJ; Domain location=11-72; Score=10.8; E_value=0.00037; Accession=PF00226.22; Description=DnaJ domain
MLLDKNDIQETHYEVLHVKEHANYEEIRAGYRSVVLSLHPDRLLKTSKTSSNLSLRKDVLAADVAEDLSLQDMMIEDDGEALELFYQCRCGDYFSVDSWN

SEQ ID NO: 149724 - protein, 171 aa, Glycine max
  Coding DNA Sequence Number=SeqID_58039
MDQPTLRVHIEQRVLNRSVLINLRFENSAMNFTPFGNNSKLITFAKCLGKLVCLGACLEHKPVGEVARDNIGSVHVDECEEVWKKLQFSLGAEDQTLGEHLYMEMSRDGAKTHGAVLACTDGAVLPVSQVFDAIRELGNEGVEQWDPLVLTSASLLSIYPAPLMIAFLRAL

SEQ ID NO: 149725 - protein, 65 aa, Glycine max
  Coding DNA Sequence Number=SeqID_58040
MGGGGCMTARPADDKGEYNSLGRKTWKSSTKGADDHNLSLRANGLACLWMAKEADDHNLSPRSFY

SEQ ID NO: 149726 - protein, 71 aa, Glycine max
  Coding DNA Sequence Number=SeqID_58041
  Subcellular localization annotation: CTP_CleavageSite=60; ConfidenceScore=5.06e-01
MALVLMAPSSWTRHVAKEAPFPAAFSLLLSWLWKRQQQWRLQCRKSCSPSFSILVTLEISVVGVDERMKFE

SEQ ID NO: 149727 - protein, 45 aa, Glycine max
  Coding DNA Sequence Number=SeqID_58042
MPQYKNLPDTRGTIIGNEDIDSIRWPGFAWRRLKRRGIDDVVMRK

SEQ ID NO: 149728 - protein, 99 aa, Glycine max
  Coding DNA Sequence Number=SeqID_58043
MWDFTSHLYSKNLSLKCKSHPHASFPLEVKPLSSTSIPWWPLKFICSRYLHSCSTHQIRCLDPPLGRLSIQGIHRPRIHHRHLTHLSWSPNQIINSDTN

SEQ ID NO: 149729 - protein, 156 aa, Glycine max
  Coding DNA Sequence Number=SeqID_58044
  Homolog annotation: Hit_ID=A5AF73; Match level="QueryCoverage=54%, HitCoverage=7%, E-value=2e-08, Identity=36%"; Hit description =Putative uncharacterized protein
MSGTSKVLPALHSIKSLPPKFKIITGNPTSDLMENHGDAKLRSSDVIGSGSPENDVLIAEVAEEAWDRAGDMGVYDEDSVYNKKCVSLEDRPSIADEDLESIPLPSHQFQSPLGNTGGVIRHLMLRRRLLFILFIIFLYGPLQLRSELQSTHNFVN

SEQ ID NO: 149730 - protein, 78 aa, Glycine max
  Coding DNA Sequence Number=SeqID_58045
  Subcellular localization annotation: CTP_CleavageSite=60; ConfidenceScore=5.48e-01
MIKVTNPRYLSEELGYTSWARSLSPTAHSHTSCSSPSKPTTSSKASSFSSSFHSLSSPTSSSLNPPASRSLSLSPSPA

SEQ ID NO: 149731 - protein, 41 aa, Glycine max
  Coding DNA Sequence Number=SeqID_58046
MPHAQNAEEEEEEEEEEEEEEEEEEEEEEEEEEAINLTMFF

SEQ ID NO: 149732 - protein, 61 aa, Glycine max
  Coding DNA Sequence Number=SeqID_58047
MGSKHKNKVEKAGEGDKDKDLDAGGFRDEEVGEDNEWNEEEKEEALDEVVGFDGDEHEVWE

SEQ ID NO: 149733 - protein, 169 aa, Glycine max
  Coding DNA Sequence Number=SeqID_58048
TKPDLNKTFKEAAKSIEMAQVQISLMARDHKILVSIANKKNTDASIKNLEVQVGQLAKELSKHGSGSFSATTQDNTGKKNKEGSEEENNKNDEVGTSFVVQVEGTSTWVVVTENKRGFISCGSIQVEGTSTWLFKENKGGYIPCGSFLVKAFTRLKRNLKDRRSLGDWM

SEQ ID NO: 149734 - protein, 24 aa, Glycine max
  Coding DNA Sequence Number=SeqID_58049
KESIYEEDHRPTSSNGAYITFELE

SEQ ID NO: 149735 - protein, 276 aa, Glycine max
  Coding DNA Sequence Number=SeqID_58050
FPDLRESEVGASEAHIMVEDQPRRVTLEDYSSSIVPQFFTSIARSEVQAHNITYPHSLIQLIQGNLFYGLSNEYPYAHLATYIEICNTMKIASVSEDALKDLGRGCREISEEVVEKFLKKYFLESKTAEGKSKQLLDASARVKIKLKTPEEAIELIENMAASDHAILHDRTHVPTKRSLLELSSQDALLEVAAYVEEHMNLVVAFPWMMLQRKSHPGNQFNKDQGVPSNRPQNQGPSLYERTTKLEETLAQFMQIADNSSRGFGANTEKNPKEECK

SEQ ID NO: 149736 - protein, 208 aa, Glycine max
  Coding DNA Sequence Number=SeqID_58051
MCSMQDSLEDQTSQGSFVTHGRQDVLTAVIGQPEHPGHGLTLPPEPEVGPSVGRVSTKESCVDPSGNDPDTGDLNKCGLYIKENPPCLVALGRVYEGSTTVHNIPLLHDQVKVGVEEVRDTDAPILVPTEEGAVGPAKPADRPEHDVDDPLYFMTLTIPQLFLKPLQVTWDATVFGVFNEDFPLYIKYEDLSEIVHGGQCLSISVIQL

SEQ ID NO: 149737 - protein, 81 aa, Glycine max
  Coding DNA Sequence Number=SeqID_58052
  Gene Ontology: Mol. function=transferase activity, transferring glycosyl groups; Biological process=metabolic process
  Homolog annotation: Hit_ID=A7M6J3; Match level="QueryCoverage=85%, HitCoverage=15%, E-value=5e-21, Identity=69%"; Hit description =Glucosyltransferase
MPFLAALKPPIGAEAIESALPEGFNERTKGRGVVHGDWVQQLLILSHPSVGCFVTHCGSGSIQLIDSIQLQTHHGREIKPS

SEQ ID NO: 149738 - protein, 146 aa, Glycine max
  Coding DNA Sequence Number=SeqID_58053
  Homolog annotation: Hit_ID=A5BSR3; Match level="QueryCoverage=54%, HitCoverage=25%, E-value=2e-11, Identity=45%"; Hit description =Putative uncharacterized protein
AEFEIPEASNSRTKKKVLQNVGERWRQFKSDLTRKWALAADKDGVDDTICEKYGSTEGVINPPSPIRRHAKWKMARTKKTGQMTSEATKKIVEKIDSLEEQTSQGSFVPHGRQDLLTAAIGRPKHPGRVRAAGADVTIKQYFGLAP

SEQ ID NO: 149739 - protein, 396 aa, Glycine max
  Coding DNA Sequence Number=SeqID_58054
MSITKLNLHRSERGYDEDIGKRSWVVDEPQRLAPSSIIIQVCWFVAVSGWSGSDLALLYDVVDINTPLLKTNLVLKELKWLNNGVIIGVGSRKWGGVIGNGPVVKFQKTNMKNGFNINPVADAREVRSESMASIVEEPWRYNGSEGEGGKGSRYVPLEYLSTTTMIVVKPLETGAPDMWSSPDTLVGVTPLKGNWEWITVIAELVSRGSWIKRLRPHWKNHPYIVWYNHTQAAWRAFCSCGNNCLLKKAMGWEFCNRTVPKAVLEAFDFMINGMNPVRPRKPLKSEGDAEVGQSSMACILAGFGATPSDDTIWPSLFRDVPSRKEKNGGVTQPKGQNLELIMFVMYAEHDFMNVGIIDSKLMKTLTEEVVVVLRNYHQIDEEDGPGKGVYGGQREV

SEQ ID NO: 149740 - protein, 280 aa, Glycine max
  Coding DNA Sequence Number=SeqID_58055
MTETKCPKYSTCLYANEHFDNFIKNCPISSISKAVSKRMRTKYVFHGHLEGGRGVTKPKRRSSFENQEASPSSSSNSSMVGMGKRFCNGVPGVIINAKSPRPIVFLNQEYRIRKEMNGVIGWPRRGQGGWCLKEKRVAGVERVKVEEVGLRVGDMVMVEEGKVDGFGPGNSDIGQEAFLPKVEPRLRPGPVGFRWDHHSGTGQNKPQGPKGILAMKRFGHSGGSFHQIVELPTSLAEDVMRNGTGSQMKKKVEKSVVGIAVVVEWFPGWSFAGVARPIWR

SEQ ID NO: 149741 - protein, 394 aa, Glycine max
  Coding DNA Sequence Number=SeqID_58056
  Subcellular localization annotation: CTP_CleavageSite=50; ConfidenceScore=5.36e-01
MDAPSSQDTLAPPHPLPTLVASKATGAMAQVPKKVAPKKQQPSSTTKCLRALNETKSDEDGLVFRKKKVAPPLDETTAPQMNKVKPNPQVIHFKKKKKTESTTGMDNEIQHQAPLSPIHLDRFQHQGQPTIEPNLTVEDTTRYFTMEAKKTVTLKLDTKFDQNDAMLFYFKDMYENSRLMSISNYEKEDTFNHMRMVQILRPTNIYRFNDWKMCPKSAMQRVVVIAWARHPILKEHPFSPYHKPWEKLNCQLMEMQKEAEAKKQQEKLKSKELFNNLHVHLGPHVNVVEPPLVEVTSQSIPENVLTTINTSGTPREITPLIVVASNESSLRSFNDSILFNVNLLMQQRLPPTVQPPPLPPTTPAPAPIENHVPVPPPSPPKSPSSIPQPLSTTG

SEQ ID NO: 149742 - protein, 128 aa, Glycine max
  Coding DNA Sequence Number=SeqID_58057
MATKPVFIVEMKIVPIPEKCVRSLSARRSNGQRGVPDSDELHHRHTDVDVLAGPGKGEKHTVEDDKGLLEVAKDGEEACIERHHGPQQRAQQQGRQGGAPPRPKGCRGTGQGEALDELASFEGGELEG

SEQ ID NO: 149743 - protein, 242 aa, Glycine max
  Coding DNA Sequence Number=SeqID_58058
  Pfam annotation: Domain name=zf-C2HC_plant; Domain location=118-172; Score=37.6; E_value=4.5e-08; Accession=PF07567.3; Description =Protein of unknown function, DUF1544
MDISDSRLLRVYEFTSVPRVNSEANSQTRSRLGGLGFASSLLVHFFFLPQSLTLSHNHPIGELEELFRASEDDLILRWSTTVADNHVHLEAASPNSHEVHDEHNPSSRSKNAPGNRTNIGWKHETDVLGNGKKVKYNYCSKINNGGIFIFKHHLAGTRWDSEPCASVLEEVKMLMMNVVAEVANASEKRKKLNSIHEEGTEGVEVESNSSQSGIQRKWMLGFKGRGKQNLFRLVVVREFKQL

SEQ ID NO: 149744 - protein, 72 aa, Glycine max
  Coding DNA Sequence Number=SeqID_58059
  Homolog annotation: Hit_ID=A7QQC6; Match level="QueryCoverage=72%, HitCoverage=7%, E-value=1e-09, Identity=57%"; Hit description =Chromosome undetermined scaffold_142, whole genome shotgun sequence
MDIDYAIRKDEPPAITNECSPAVVALYERWERSNRLNVISLRPKSRPGYIDLSTNMKKSETCLRPLMTGSSH

SEQ ID NO: 149745 - protein, 123 aa, Glycine max
  Coding DNA Sequence Number=SeqID_58060
MGDCLEDMICDLGQESFQQTHAPMYDTLQTDSKKPLWKEQCHNLGRLISVEAKLHGESKGDSKNNSRVQDKNQEEFKAQEESLESRIKIQGSRSQESRFKTQDSRIKRRLNQDKYEKFSSKTE

SEQ ID NO: 149746 - protein, 300 aa, Glycine max
  Coding DNA Sequence Number=SeqID_58061
  Gene Ontology: Mol. function=protein dimerization activity
  Homolog annotation: Hit_ID=A5AFJ0; Match level="QueryCoverage=28%, HitCoverage=23%, E-value=2e-13, Identity=44%"; Hit description =Putative uncharacterized protein
MENAKEKIKCNFNNIMKSYDLVWKIIDERWDHQLHRPLHVAAYYLNPHLHYEPTFRHDDPQLKVNKIEKSIALPFDEIESDDEWITEKGYNDEDEQPQAEGDGGNVELVGDVGGSSNDLVVDAFDLDNLILVNLMMMHNLRKTLMMMEMLHSSHCSNIFINERCDTSNDIISFTNNVTLNIIIELHIFLNCRLKLSNRLHVLISNTLISYINSNISLSNLSLLGLFNITLVPSLRNGVVPNIPKPPWLCISAVLGEKNYFHEENPSRSASVTLPRRFREQIGEGFPSFFTILRSFFVLQR

SEQ ID NO: 149747 - protein, 477 aa, Glycine max
  Coding DNA Sequence Number=SeqID_58062
  Gene Ontology: Mol. function=carbon-nitrogen ligase activity, with glutamine as amido-N-donor; Cellular component=mitochondrial matrix; Biological process=branched chain family amino acid metabolic process
  Homolog annotation: Hit_ID=A5BWC9; Match level="QueryCoverage=25%, HitCoverage=25%, E-value=2e-34, Identity=59%"; Hit description =Putative uncharacterized protein
  Pfam annotation: Domain name=Amidase; Domain location=2-395; Score= -42.5; E_value=2.7e-09; Accession=PF01425.12; Description=Amidase
  Pfam annotation: Domain name=DUF707; Domain location=156-453; Score= -100.4; E_value=0.031; Accession=PF05212.3; Description=Protein of unknown function (DUF707)
  Pfam module annotation: Pfam domain module=Amidase::DUF707; Domain location=2-395::156-453
MSIIELNQFVSECGFEDRGVSLLLNVAEIRVERGEPIYVLDGVPISVKDEINCLPYPTTGSDDAYCVKRLRLFGAIIVRKTNMHELGSRTSGINSHDGPTRNPYDTNKIAGGSSSGSASLVSVGLCPIALGVDWGGSVTMSAALCGVVGLNNETLMIWVPTNPRGAERLPPRIVIWREKGSSIDNVKSFTQSSNHNPSYMDLTFKPKYLVTFTVGYEQKKNIVVAVKKAKINLPRLSLTKSISDIKLAKYRKLKKSREVADAIVKNNQDLVLRYKAVINDGLKLDLGHTLSLEKTRENHNANDFLRSDFSNSNHAVQSLEHVTIVMEQMLRLLHTCALPLEDVDFINYDGKTMNKLLLELSKEVTQFGRVFECIMETYLSLREHLDRMFDSAKALAFENVPTRDNIKEAIFKTLIRNRMFENSHIRLSLTQGKKLCNQHYMVEATRLCWMRLPGFIVIDLENCAINITWMTLPGYVG

SEQ ID NO: 149748 - protein, 93 aa, Glycine max
  Coding DNA Sequence Number=SeqID_58063
MKMMSMEGRYGGMCMMAMATLVASFFFVQSKLECPIFGTLLLFILKGNNFTHRLITNAKFKELPLFVPLHDFEDQIAKAKKSTSVPPAISDQT

SEQ ID NO: 149749 - protein, 53 aa, Glycine max
  Coding DNA Sequence Number=SeqID_58064
MVEQATQVFYVQDPCDERCSYMATPSSLPPSPPESIAPSSLSMSKKTRKATQL

SEQ ID NO: 149750 - protein, 37 aa, Glycine max
  Coding DNA Sequence Number=SeqID_58065
MRSFYGDFHHGDAAEDKGEEVRGGMDTLERAKCFPID

SEQ ID NO: 149751 - protein, 712 aa, Glycine max
  Coding DNA Sequence Number=SeqID_58066
  Gene Ontology: Mol. function=protein serine/threonine kinase activity; Cellular component=integral to membrane; Biological process=recognition or rejection of self pollen
  Homolog annotation: Hit_ID=A7P165; Match level="QueryCoverage=95%, HitCoverage=95%, E-value=1e-129, Identity=45%"; Hit description =Chromosome chr19 scaffold_4, whole genome shotgun sequence
  Pfam annotation: Domain name=B_lectin; Domain location=58-170; Score =139.1; E_value=1.2e-38; Accession=PF01453.15; Description=D-mannose binding lectin
  Pfam annotation: Domain name=PAN_2; Domain location=336-405; Score =110.5; E_value=5.1e-30; Accession=PF08276.2; Description=PAN-like domain
  Pfam annotation: Domain name=Pkinase_Tyr; Domain location=525-670; Score=-131.7; E_value=0.00024; Accession=PF07714.8; Description =Protein tyrosine kinase
  Pfam annotation: Domain name=S_locus_glycop; Domain location=184-319; Score=104.5; E_value=3.3e-28; Accession=PF00954.11; Description=S -locus glycoprotein family
  Pfam module annotation: Pfam domain module=B_lectin::PAN_2::Pkinase _Tyr::S_locus_glycop; Domain location=58-170::336-405::525-670::184 -319
MADVVDQDSNIVFFHGVSQYVTDGETLVSNSGVFELGFFSPGKSTKRYLGIWYKNITSDRAVWVLNRENPINDSSGILTLSTTGNLELRQNDSVVWSANYKEEAQNPVAELLDTGNFVVRNEGDTDPETYSWQSFDYPSDTLLPGMKLGWDLRTGLERKLTSWKSPDDPSAGDFSWGLMLHNYPEFYLMIGTHKYYRTGPWNGLHFSGSSNRTLNPLYEFKYVTTNDLIYASNKVEMFYSFSLIKNSSIVMIVNINETMSDIRTQVWSEVRQKLLIYETTPRDYCDVYAVCGAYANCRITDAPACNCLEGFKPKSPQEWSSMDWSQGCVRPKPLSCQEIDYMDHFVKYVGLKVPDTTYTWLDENINLEECRLKCLNNCSCMAFANSDIRGGGSGCVLWFGDLIDIRQYPTGEQDLYIRMPAKESINQEEHGHNSVKIIIATTIAGISGILSFCIFVIYRVRRSIAGKLFTHIPATKVMTVPFYIYGLENLRPDNFKTKENIERQLKDLDLPLFDLLTITTATYNFSSNSKIGHGGFGPVYKGKLADGQQIAVKRLSSSSGQGITDGYMAPEYAVDGLFSIKSDVFSFGILLLEIICGNKNRALCHGNQTLNLVGYAWTLWKEQNVLQLIDSSIKDSCVIPEVLRCIHVSLLCVQQYPEDRPSMTLVIQMLGSETDLIEPKEPGFFPRRFSDEGNLSTIPNHMSSNEELTITR

SEQ ID NO: 149752 - protein, 363 aa, Glycine max
  Coding DNA Sequence Number=SeqID_58067
  Pfam annotation: Domain name=DUF1723; Domain location=188-237; Score =42.6; E_value=1.4e-09; Accession=PF08330.1; Description=Protein of unknown function (DUF1723)
MEEINQDEKEKIREEERRKILKESHLGPHSHRREKERRPQEANINLPYFHGKDNVEAKLDWEIRVEQQLKRKSTSKSYGFHSYPKKDQGQGILGVTPSKPKDDKGKTIEKQPLKASMQEKPSSIKQQEAALVTEDVEHVDHAAEEEHPELKLSSHVRKVKKFGRPSPEIEGLVVVTGLSPLITCSLDIGERGLVSTFAERWHKETSSFQLSVGEDTITLDDVTLLLHLTITGAFHNFEALHVDDVVFLLVELLGVPKRQEMRRYNTTTQNPHTGSYMGGAAVLVHLYDNLNDASKSNVWQLHFPLVAYAIAAGDYDERKPHACHWKSRKAFPVSMYLKRLDRLMSDAMCWIPYGDHHALESFN

SEQ ID NO: 149753 - protein, 152 aa, Glycine max
  Coding DNA Sequence Number=SeqID_58068
  Pfam annotation: Domain name=zf-CCHC; Domain location=80-97; Score =22.6; E_value=0.00057; Accession=PF00098.14; Description=Zinc knuckle
EHEMELQRLNQNEETDKKKRSIALKASSSMQEGNEEDESEDEEDFSLFVKKFQKFVKKRRIERRQNFNNGRKSQEDSQILRCYKYNQLGHIKSNCPSNEEWPDKSDKKRYEERRTKKVYIAWDGNDSSNGSEKEINLLTKDYESDENISQEN

SEQ ID NO: 149754 - protein, 124 aa, Glycine max
  Coding DNA Sequence Number=SeqID_58069
MAFRDSGNADSFHHSSSSLFSSEEQQIQYTNLFSSRSIIDPKFINMDFFSNESFECIQTFENSNLIPFMSLKVPVYTELVKAFYSNLEIQEGTLISEVYGIKMVIDQSLFYDLTQLSSEGVPFE

SEQ ID NO: 149755 - protein, 282 aa, Glycine max
  Coding DNA Sequence Number=SeqID_58070
  Gene Ontology: Mol. function=motor activity; Cellular component=cell projection
  Homolog annotation: Hit_ID=UPI00016621D1; Match level="QueryCoverage =67%, HitCoverage=40%, E-value=5e-21, Identity=36%"; Hit description =UPI00016621D1 related cluster
VDSRGSHKGLHALTFRGLHALAFRGLHVLAFRGLHVLAFRGLHVLTFRGLHALTIRGLHVLAFVGLQALTFRGLHVLTFKGLHALNFRGLHALAFRGLHVLAFRRLHVLTFRGQHVLAFRGLRVLAFRRLHTLTFRGLHALTFKGLHVLTIRGLHALAFRRLHVLAVRELHVLAFKGRHVLDFRGLHALAFRGLHVLIFILGPPPDIGGRPTVRAQPEREAIAQLLCIPGQDFTRAAAQKRVQIVRTNMTTLTQIWMTLLLSNILPSDHNVDLPLRKYQLGP

SEQ ID NO: 149756 - protein, 328 aa, Glycine max
  Coding DNA Sequence Number=SeqID_58071
  Gene Ontology: Mol. function=cysteine-type endopeptidase activity; Cellular component=endoplasmic reticulum; Biological process =proteolysis
  Homolog annotation: Hit_ID=O65039; Match level="QueryCoverage=40%, HitCoverage=41%, E-value=6e-51, Identity=68%"; Hit description =Vignain precursor
  Pfam annotation: Domain name=Peptidase_C1; Domain location=161-310; Score=69.0; E_value=1.6e-17; Accession=PF00112.14; Description =Papain family cysteine protease
  Pfam annotation: Domain name=Root_cap; Domain location=159-212; Score= 30.9; E_value=2.1e-06; Accession=PF06830.2; Description=Root cap
  Pfam module annotation: Pfam domain module=Peptidase_C1::Root_cap; Domain location=161-310::159-212
MEKWKQLYLAIKRELDEPTQRTYDGDGLYWKAEENDIQMEKQKKELQEKEETIKASNTSDFVPASGNRLSHRDDKVDCLIVKWDDELVNIPTYGEAKWRANGEERQVVMERTNETNSVTVTISGLVELDIHFFQLDRTCTKVHNYQLPTDYSFSHLETQLWFEKSIDNFEGVLGQTYRPGYVSPVKRGVPMPIMASNYPYEAKDGTCDASMVNEPAVSIDGHENVPVNNEAALLKAVAHQPGVFTGNCGTALDHAVAIVGYGTTQDETKYWIVKNSWGSEWGEKGYIRMKRSISVNKGLCGIAIEASYPIKKSSSKPREHSSYPKDEL

SEQ ID NO: 149757 - protein, 85 aa, Glycine max
  Coding DNA Sequence Number=SeqID_58072
  Homolog annotation: Hit_ID=A7Q336; Match level="QueryCoverage=95%, HitCoverage=4%, E-value=4e-07, Identity=33%"; Hit description =Chromosome chr12 scaffold_47, whole genome shotgun sequence
MDLSVLAPEISFSSLSDSLVSWAETTWVVNMTSFTEDKFDILKHNNLNSAKAIKGVLVIQIGVNEQVLYMHWSRAASIILDNCAL

SEQ ID NO: 149758 - protein, 216 aa, Glycine max
  Coding DNA Sequence Number=SeqID_58073
MWLNRLDVLTRCNIGVGEDPLGKLMRILYDVYMKLIQLPWDGTKYGLPNVEASFFITHADLTEILSGDKCLNTSVLQLWMMFMDDYSTSRGNGSVYGFLEPQCIHNAKDKCQQCQDYIETWVKESQRQLYLGAYLNHSMKAITSTFKDDIGEIVIEMIYEQLRQQHNCGCELQFRTMICIIDAKHVLALTSVIIFFLYEGLQTVFEENNSRDIGLP

SEQ ID NO: 149759 - protein, 65 aa, Glycine max
  Coding DNA Sequence Number=SeqID_58074
MVFVCTKYLRVWPSYPRIIMSCGCFGLSTLKRKMNPSRTPNEIDGEGLRRGSSSSLNDILNIGST

SEQ ID NO: 149760 - protein, 116 aa, Glycine max
  Coding DNA Sequence Number=SeqID_58075
MFFAEGLDLGLFDPFKDMRDSELLDEEEITAPEKNVGKEENVRRAFTKHDTQWLSARKMPEEDELSGSLSALLQFIKRINSAHLLSERSALSQNPVMHAKRSRFMLSARARTNPPI

SEQ ID NO: 149761 - protein, 45 aa, Glycine max
  Coding DNA Sequence Number=SeqID_58076
MGISIANDSMNVLQSMSDGVSLVSKGGKFEFGFFSPGDRGRTRIK

SEQ ID NO: 149762 - protein, 116 aa, Glycine max
  Coding DNA Sequence Number=SeqID_58077
MEEAVQSRSTEVVIDPLSPIRRHVKWKMAHTKKTRQMMFESTKEIAMKIDLLTAAIGRPEHLGCVRAAGAGVTIKQYFGSAPRTSHTSSSMTPEELEQLTQQIRDQLEESITEKVT

SEQ ID NO: 149763 - protein, 163 aa, Glycine max
  Coding DNA Sequence Number=SeqID_58078
  Homolog annotation: Hit_ID=A7PLR8; Match level="QueryCoverage=66%, HitCoverage=9%, E-value=1e-14, Identity=45%"; Hit description =Chromosome chr14 scaffold_21, whole genome shotgun sequence
MTEDNGKKGNVLKNETLKNVRFVRSSADSVRNIGSLGNNHLTEVKENGVNGDGQKNGANIQTSDRKHAKVYPTEARNGILDNKIDYLENKIKMVEGELREAATIEAALYSVVADHMALTTGLIALESKTFSSFTLAVVLLTIKDKLFQDKATAGNTHLRWRGL

SEQ ID NO: 149764 - protein, 47 aa, Glycine max
  Coding DNA Sequence Number=SeqID_58079
MMVLCKSRRRHQRAIIAISVGNLDTSRRIAQSVSLVRKERNSLRSKL

SEQ ID NO: 149765 - protein, 126 aa, Glycine max
  Coding DNA Sequence Number=SeqID_58080
MGGTKRILVIIPKVVISLLTVSRGIKRIAQQCFFFTSGMLRNFTNYLTMGVKYLEAVKRRLHATKQWSPDEIRVPLTSIRGRILPKKEGMIKDYLRRKSLAWVGSTWIDQSLEQGVRDFNKSLARD

SEQ ID NO: 149766 - protein, 94 aa, Glycine max
  Coding DNA Sequence Number=SeqID_58081
MKVVIAKCAVCIKIIVIIDEMYESAEKWCKKGFKNLTGTQLMHRRCNNFQKIRSADTAKKARDTLEKSYAGDSKLKKVKLQTLRRQYELLQMSD

SEQ ID NO: 149767 - protein, 93 aa, Glycine max
  Coding DNA Sequence Number=SeqID_58082
  Gene Ontology: Mol. function=hydrolase activity; Cellular component =cytoplasm
  Homolog annotation: Hit_ID=A7PCF0; Match level="QueryCoverage=49%, HitCoverage=3%, E-value=2e-13, Identity=86%"; Hit description =Chromosome chr2 scaffold_11, whole genome shotgun sequence
MFTTHIKLTTQEEVALELHASLGVPVYVNHGLSVDFVLKSTSFDRMQGAMKPLLWMRQVLLALCRDCRPWIFFINEVLCFLKINDSRTEKEKR

SEQ ID NO: 149768 - protein, 59 aa, Glycine max
  Coding DNA Sequence Number=SeqID_58083
  Subcellular localization annotation: CTP_CleavageSite=50; ConfidenceScore=5.03e-01
MVSARALPTFLWRRSNCWSYKVPSRQFKSYEARTPHPLVVSGCPTRVRVRVQHDTDTDK

SEQ ID NO: 149769 - protein, 107 aa, Glycine max
  Coding DNA Sequence Number=SeqID_58084
MEDNKERMWIGFSSLKCGSNDFQDYFDDAKESRVKQVPKNQTSRIKSQRIKIQEQLSFKIQDSKTIKIKIQDSRFKIQEKLISRFKRRNREATVKTSQGKYFSKIQA

SEQ ID NO: 149770 - protein, 76 aa, Glycine max
  Coding DNA Sequence Number=SeqID_58085
  Subcellular localization annotation: CTP_CleavageSite=28; ConfidenceScore=5.06e-01
MCPLLSSAEPLVTGVATCPSAGGRRVTRGMRVPRKEYARSRHQRLFEENVGKTGKDVIYELLSERLGSCIYAQGRY

SEQ ID NO: 149771 - protein, 246 aa, Glycine max
  Coding DNA Sequence Number=SeqID_58086
  Gene Ontology: Mol. function=diaminopimelate decarboxylase activity; Cellular component=chloroplast; Biological process=lysine biosynthetic process via diaminopimelate
  Homolog annotation: Hit_ID=A6TDH9; Match level="QueryCoverage=100%, HitCoverage=58%, E-value=1e-120, Identity=86%"; Hit description =Diaminopimelate decarboxylase
  Pfam annotation: Domain name=Orn_Arg_deC_N; Domain location=32-246; Score=219.9; E_value=6e-63; Accession=PF02784.7; Description =Pyridoxal-dependent decarboxylase, pyridoxal binding domain
MPRSLNTTDTDLTADNLLRLPAEFGCPVWVYDAQIIRHQIAQLSQFDVVRFAQKACSNIHILRLMREQGVKVDSVSLGEIERALAAGYDPVQHPDDIVFTADLIDRATLERVKALQIPVNAGSVDMLSQLGEVSPGHRVWLRVNPGFGHGHSQKTNTGGENSKHGIWFSQLPQALEVIRRHSLQLVGIHMHIGSGVDYGHLEQVCGAMVRQVVEFGQDLQAISAGGGLSIPYHEGEEAIDTDHYFG

SEQ ID NO: 149772 - protein, 391 aa, Glycine max
  Coding DNA Sequence Number=SeqID_58087
  Homolog annotation: Hit_ID=Q6WAY4; Match level="QueryCoverage=55%, HitCoverage=39%, E-value=3e-11, Identity=27%"; Hit description =Putative uncharacterized protein
MANQGDWVPFMDVLALLIFGVVLFPNVDGLVDLAAIDAFLAYHHSKESPVVAVLEDLFDTFDRRCEKSSARIMCCLPALCVWLVSHLFQQDTRHPCPLLSHRSCTEKRRMDWDQLLAGIGGRTISWFPRWKEGKEGVLFSCGRYPNIPLTTRVPHEGSTDGRKHVSFPYEGSRRTKFKTIQRIHKAWETPLRKDQELRGIRNGIIGGYHEWLKVRIRGLDWLAKLKVVSEENFEAPEEDEEVQALKSELGKAKLAKEKFKLAATHVRKECAGLREENAITARALERETKRARKEEYGRNKFRGALWGSNSELKLRREERDQSRAHSMVLKEELIACSRSKRSLSQRLCETETNMLAIIAKYQEELGLAAAHEHRIADEYAQVYAEKEARGR

SEQ ID NO: 149773 - protein, 84 aa, Glycine max
  Coding DNA Sequence Number=SeqID_58088
MGEALVLTLVLNLVGRIVLGHGQKSRQVDGWKSTKVLRDGCKWGIGSRSTDRCPFLALDKQRTSLEGSPVSFEFTVFITIVCFK

SEQ ID NO: 149774 - protein, 51 aa, Glycine max
  Coding DNA Sequence Number=SeqID_58089
MTLRQHGLSLGSSSSMDSFASWRRNGSGMEKEEREETPLQGEDESRRSSPP

SEQ ID NO: 149775 - protein, 199 aa, Glycine max
  Coding DNA Sequence Number=SeqID_58090
  Homolog annotation: Hit_ID=B0JCV8; Match level="QueryCoverage=67%, HitCoverage=20%, E-value=1e-08, Identity=28%"; Hit description =Misfit TNP1-like protein
STLEDPLIWEDIQAEFDIPEASDSRTKRKLLQTDGVEDTVCDKYDISKEKWSQFCQTRRDPSWEDVRMKAQAIQKQNTAPHVLSRGGYDYLEQKLLAEKTKKKMQEAAQSGSVDGVIDPPSPVRRHAAKEIAEKIATQGSFVSHGRQDVLAAAIGRPEHPGRVRAAGAGVTIKQYFGLAPRTSHSASSLPPDELQQLTQ

SEQ ID NO: 149776 - protein, 91 aa, Glycine max
  Coding DNA Sequence Number=SeqID_58091
MEVDEPWLGLWLPLNYQVGMGASDVRHWKCDRQTLWLILGMAFVDNWAVGKEKTHIDPFTGKDQIRKALKVLSTFGRILLKESCPLFAHVL

SEQ ID NO: 149777 - protein, 401 aa, Glycine max
  Coding DNA Sequence Number=SeqID_58092
  Homolog annotation: Hit_ID=Q6WAY6; Match level="QueryCoverage=71%, HitCoverage=58%, E-value=4e-33, Identity=30%"; Hit description =Putative uncharacterized protein
MEPLQMQAFRKTYGKILELTIAEVSIEAIASLTQYYDQPLRCFTFGDFQLVPTIEEFEEILGCPLGGRKPYLSSRCLPSLSRIATVVKDSARGLDRIKQTRNGIAGLPRRYLEDKARGMANQGDWVPFMDVLALLIFRVVLFPNMDGLVDLVAIDAFLAYHHSKESSVVAVLADLFDTFDRRRIDWDQLLAGIGGRTISWFPRWKEGKEGVLFSSGGYPNIPLVGTRGCINYNPALAIRQLGYPMRGAPTEESMSPFLAWETPLRKDQELIGIRNGIIGGYHEWLKVHIRGLDWLAKLKVVSEESFEAPEEDEEVQALKSELGKAKLAKEKFKLATTHIRKECAGLREENAITARALEQETKKARKEEYGRNNFAELYGVAIVNSSCEGKRGTSREHIAWF

SEQ ID NO: 149778 - protein, 158 aa, Glycine max
  Coding DNA Sequence Number=SeqID_58093
MTLLLSNILPSDRNANLPLQKYQLGSHPQRHPVDLKKSNRALGFPALVTGLYRPYRAPVPPSKFMSSCIGKECLSPPARSSGPPTNRAFIKKFCVSRQAQGETPQQPGDGRQRATDAPPSPLEFTSAHPQKGLSIAYTTWPTNRRPSPKPKVSKVLGQ

SEQ ID NO: 149779 - protein, 142 aa, Glycine max
  Coding DNA Sequence Number=SeqID_58094
GYTPSPWVLVTLTVERTTRPRLERTTRPRLERTTRPHHQRAARPHLQRTTCPRLERATRPHLGYPHRQRTTRPRLERTTRPHHQRAAHSYLQRTTFTLTVERTTRPRLERTTRPHHQRAARPHLQRTTCPRLERATRPHLGY

SEQ ID NO: 149780 - protein, 82 aa, Glycine max
  Coding DNA Sequence Number=SeqID_58095
MRKPKGSLSTKARAKREEAKEKDTEIPIPTHHPGDSKLSNEYILSLIRFSFDKENHSNKGLYYLQRAKYGRGQKEDSILEHQ

SEQ ID NO: 149781 - protein, 162 aa, Glycine max
  Coding DNA Sequence Number=SeqID_58096
MERSMIDAASGGALGDMTPAEARNLIEKMASNSQQFSAINDAIVLRGVHEVATDSSSSTENKKLEGKLDALVNLVTQLAMNQKFAPVARVCGLCSSADDHTDLCPSLQQSGFNEQPEAYAANIYNRPPQQQNQQQQNNYDLSSNNYNLGCRNHPNLRWTSPP

SEQ ID NO: 149782 - protein, 48 aa, Glycine max
  Coding DNA Sequence Number=SeqID_58097
MELASCGIKSIFIKGMMQSYPARALDRKLQVDWARDAREGPRVLMSLR

SEQ ID NO: 149783 - protein, 257 aa, Glycine max
  Coding DNA Sequence Number=SeqID_58098
AWENPLRKDKELRGIRNGIIGGYHEWLKVRTRGLDWLSKLKIINEENFEASEEDEEVRALKTELGKARLAKEKFKLVATDVQKECAELREENAATARALEQETKRARKEDHGRDKFRGALWGSNNELKLRREERDQSQAHSMVLIEELAACSRSKRSLSQRLCETETNMLAIVSKYQEELNLVEAHEHIVADKYAQVYTKKEARGRVIDSLHLEATMWMDRFALTLNGSQELPIASQGQSNGGHLLRPRGDPRTSQL

SEQ ID NO: 149784 - protein, 197 aa, Glycine max
  Coding DNA Sequence Number=SeqID_58099
MSHHESELPRNISNLHDDDDEDDDDDYLASNSYVEESFDEDDSDDGISDTDDEVTDIVEPVSIVHPTEGVPEIQNPFWNDAMHYNNINWSHPDEEDICGLDMPTTFNVGQELYVGMDFDSKDAVKNALKQYVMKVHKSFKVVETKSHKYIVCCPNNTVESPCPFYMRAILSKKTDAWKVTQWGWTAHMSKYDYDTRP

SEQ ID NO: 149785 - protein, 96 aa, Glycine max
  Coding DNA Sequence Number=SeqID_58100
MAEKPRRVTLEDYSSSSVPQFFSSIVQPEVQEQTITYPPSLIQLIQKNLFHGLPNEDLYAHLATYIVICNTIRLVGVPEDAIRLSLFSFSLSREAK

SEQ ID NO: 149786 - protein, 80 aa, Glycine max
  Coding DNA Sequence Number=SeqID_58101
MSQPTLRWEGDAGLAGASSKGGKCAESPLTFIRGKHRKNWKMFGLRTLSVKGSGVVFMHGEGCFLCSYVFLNCDKEIKPT

SEQ ID NO: 149787 - protein, 152 aa, Glycine max
  Coding DNA Sequence Number=SeqID_58102
  Subcellular localization annotation: CTP_CleavageSite=70; ConfidenceScore=5.20e-01
KARGERSEAPSTSASSEAPTPSSSTLPPSFSIEIPMIPSAPTQIPLPAPLSTGQSIIMKSLQGLCLPSIMSMEEFDAQVAWPGDQPSSSGGGGASTAQEPVAKEPPAPPPAPSPIATEEETTPAQTPQPSPPSAPAPEETHPSALDLNEDQP

SEQ ID NO: 149788 - protein, 218 aa, Glycine max
  Coding DNA Sequence Number=SeqID_58103
  Subcellular localization annotation: CTP_CleavageSite=23; ConfidenceScore=5.59e-01
MAESSKKHKGSSSSTTTTGHRHRGSSDDSPTPPNPSLSSPCSLNLFSTDIQRERYYSSFSNCVILDPKYLDSEFFEGENFDCYQLFQNYELVDFMTLKLPYYPKLVRVFYNNLEIHDGFIFYEVHKIPVVVDRSLFYSLTKLSNQGVPFEGTLVDYWKPIYSSHDARKMVCVENADMNGRLLAGSFTFECRIMHYILCRVLLPRSTNLAQASEEDLIL

SEQ ID NO: 149789 - protein, 139 aa, Glycine max
  Coding DNA Sequence Number=SeqID_58104
  Gene Ontology: Mol. function=phosphoprotein phosphatase activity
  Homolog annotation: Hit_ID=A5BKF0; Match level="QueryCoverage=72%, HitCoverage=51%, E-value=1e-12, Identity=37%"; Hit description =Putative uncharacterized protein
ATITLQDVSILLGLRTDGAPLIGSTNLDWADLCEELLGVRPQEGELEGGVFFVNKSSSRVSLREMCSATDYKVKSIGGMCILIQMWAWERCTTLTPKRTPPVIENKPLGHMWMRRGNQHIGNDDLRLFRRKLDLMKRHE

SEQ ID NO: 149790 - protein, 129 aa, Glycine max
  Coding DNA Sequence Number=SeqID_58105
ATLPEGRKADRYPVSGRVGTGERTRELPGGNACLWKNASNAAFLRFLAFCWPFAHMFFPALSPDSVDNRITAFEKRKSAQYANRLSPRVGRFINAAGTTGFPTGKRAVSATQLMARIDILTLGQDLGIL

SEQ ID NO: 149791 - protein, 163 aa, Glycine max
  Coding DNA Sequence Number=SeqID_58106
  Homolog annotation: Hit_ID=A0ST23; Match level="QueryCoverage=27%, HitCoverage=91%, E-value=1e-11, Identity=73%"; Hit description =Putative reverse transcriptase
MTVKTSDTCSSRRRSQLVCKRMPGADKPVRARQRMRKEKIPHQAPFAIQAAQLLGRAIGAGLFAITPAGERGMCCKAIKLGNARVEQKIMLKLHNIKIVDDMFGGSDIAILMRKTVSGTELEFVIMVIAVSFGKPVVPAALMNRPTRGERRFAYWALFRFLAH

SEQ ID NO: 149792 - protein, 174 aa, Glycine max
  Coding DNA Sequence Number=SeqID_58107
MASSELKVIDEEDFEAPKEDEEVRALKLELGKARLAKEKFKSAATHIRKECTELQEENAATAKALEQETKRARKEEHGREKFRGALWGSNNELKLRREERDRSRVHGMILKEELVACARSKRSLAQHLEATEQSMLAIIGQYKEELNQSMAHEEKASGGFCTSVRRKRSKREGD

SEQ ID NO: 149793 - protein, 101 aa, Glycine max
  Coding DNA Sequence Number=SeqID_58108
MGDQEEVQEQMKADMSALKEQMASMMDAMLGMRQLMENNAATAAAVSSAAEADPTLPATAHHPIPNVVRRERSTLGHISNPHPGYDRVAYPYGLPPNYTPP

SEQ ID NO: 149794 - protein, 104 aa, Glycine max
  Coding DNA Sequence Number=SeqID_58109
MACTQFQIYTRFSSNFSQHQLDLAPYTSEPYNAQWDTPRLLRDKHTLRSSRILGEMKVDEPWLGLWLPLNYQVFSLQNSFLGWCSWFVLKVMFVIGSAIDRLCG

SEQ ID NO: 149795 - protein, 126 aa, Glycine max
  Coding DNA Sequence Number=SeqID_58110
MLESFKQQEQMSVLELYIEKDVAGGSIFHSANLLTSCGNNLSYNETQPPTNMSNLHVDEDDDDYLVSNSYVEESLDEDDSVDDISDTDDEVTDIIQPSHPDEEDICGLTIPSTINVGQRIICWHGI

SEQ ID NO: 149796 - protein, 101 aa, Glycine max
  Coding DNA Sequence Number=SeqID_58111
MGVRSPSLSEIPSKGKAPMTQESAGATTPSKEVDPPAVKGAEKKEGHQGKAVTLEEAHEFLRLIQQTSLMQSYPARALDRRLQVDWARDPREGPRVLMSLR

SEQ ID NO: 149797 - protein, 170 aa, Glycine max
  Coding DNA Sequence Number=SeqID_58112
  Homolog annotation: Hit_ID=Q2HW90; Match level="QueryCoverage=54%, HitCoverage=18%, E-value=5e-07, Identity=37%"; Hit description =Putative uncharacterized protein
MPSLKKRFYQVKVKSLGITSLKELGQLMGQLQRQAFRKAYGKIWDLAMVEVSTEAIASLAQYYDQPLRKHVENGVVGIPRKYLEEKARILVGKGEWAPFIDFLTLLIFGGALFPNVDGLVDLAAIDAFLAYHNHKESSVVAMLADLYDTFDRRCEKSNTRIVCCTPALYV

SEQ ID NO: 149798 - protein, 103 aa, Glycine max
  Coding DNA Sequence Number=SeqID_58113
MAFLGETSSQTIVNSRTTNAILNLLERPNIPTHDAVLYYNGRWNMPRQNNFVGYAFTGINPKKFDIPKGCSIDQLNDLIKQVAPKGNPSHGIHESQVIRRLFY

SEQ ID NO: 149799 - protein, 77 aa, Glycine max
  Coding DNA Sequence Number=SeqID_58114
MTLLLSNILPSDRSADLPLRKYQLTSSGPGEVQQGPGVPSSSYGPLDRAHKILGGPRGAQQGPGVSGSGYGPLLVLQ

SEQ ID NO: 149800 - protein, 148 aa, Glycine max
  Coding DNA Sequence Number=SeqID_58115
METIAMTAQLIHDRVEMECLEGVWETLEGNARCRFRGTIQLTATSLVHPEEPARTLQRTVEWILPTPTPYRLVEPVQVIEVPSSKEDLEEDPEELPPEPAVDAIDFPEGDEDPLPDVDSLEDVMSASEADSTEESGPGGIVTSGDSLS

SEQ ID NO: 149801 - protein, 265 aa, Glycine max
  Coding DNA Sequence Number=SeqID_58116
  Homolog annotation: Hit_ID=UPI000065F7CF; Match level="QueryCoverage =53%, HitCoverage=16%, E-value=1e-08, Identity=33%"; Hit description =Homolog of Homo sapiens "Leucine-rich repeats and IQ motif containing 1
LHVLTIRGLHALTSRGLHVLALRGLHALTLGLHILTIRGLHALTSRGLHVLALRGLHALTLGTSYPHLQRAASPHLQRTTCPRLERATRPHLGGLQALTFRGLHVLALRGLHALTLGTSYPHRQRATRPHLERTTRPRQQRAARPHLQRTTPPRLERTTCPHHQRAARPHLQRTISPRLERATRPHLGGLHVLTIRGLHALTSRGLHVLALRGLHALTLGLHALTIRGLHALTSRGLHVLALRGLLALALGTSYPHLQRTTCPHL

SEQ ID NO: 149802 - protein, 149 aa, Glycine max
  Coding DNA Sequence Number=SeqID_58117
THLLLEVASPLPLPSPFHCHSSSKKPRDPLMKKILGLQAPMELASHSMDFPKTQLVTVLWVKHPHHYMVPLGCGFSMENNDGLWWLMVAHTPTVNEGWAALLPRQLHTKFREDPTVNEGWAVYLPRQLHVAFSRSFIKRLPPEASSWLL

SEQ ID NO: 149803 - protein, 109 aa, Glycine max
  Coding DNA Sequence Number=SeqID_58118
MQIVATYPSAGGRRETRGMRVPRKEYARSRHQRLFEENVGKTGKDAIYELFSERFGSCIYARGRGETLRRWTINDLLFLKGEKRYGIGPLMISWGWSTKSGAFAPTYPQ

SEQ ID NO: 149804 - protein, 28 aa, Glycine max
  Coding DNA Sequence Number=SeqID_58119
MVPFIAPVQGFEAQSLSFAMTLQQGTYW

SEQ ID NO: 149805 - protein, 75 aa, Glycine max
  Coding DNA Sequence Number=SeqID_58120
ELVQVIEVASSEEDPEEDLEELPPEPAVNALDFLEGDEDPLPEVDSPEEVMSASEADSTEDSGPGEMAISGGSSS

SEQ ID NO: 149806 - protein, 101 aa, Glycine max
  Coding DNA Sequence Number=SeqID_58121
  Homolog annotation: Hit_ID=A5BTR2; Match level="QueryCoverage=100%, HitCoverage=5%, E-value=1e-22, Identity=59%"; Hit description =Putative uncharacterized protein
MRLHYKERRTPAITDESNPTTVALCEPCVRSNQLSVMFIKTKILARIHRSVDQHEKVRDFLKAIDDQFISSDKALANTLIMKFSFLWLTNVKGVRENVMQM

SEQ ID NO: 149807 - protein, 179 aa, Glycine max
  Coding DNA Sequence Number=SeqID_58122
  Homolog annotation: Hit_ID=UPI00016621D1; Match level="QueryCoverage =67%, HitCoverage=40%, E-value=4e-11, Identity=35%"; Hit description =UPI00016621D1 related cluster
MTKDNDCTSKPYTGAMRGIVHEPQVNIRADQKMTDPLDESISCFLIRLDPWVLVPTTFRGLYVLTLRGLHVLAFRGLHVLTFRGLHALTFSRLHTLTFRGSCTFTFKGLDVLSSRGLHVLTFRGLRVLAFKGLHILTFRGLHALAFRGLHALAFRGLHALAFRGLRVLTFSGLHIHTLR

SEQ ID NO: 149808 - protein, 154 aa, Glycine max
  Coding DNA Sequence Number=SeqID_58123
  Homolog annotation: Hit_ID=Q2HST2; Match level="QueryCoverage=76%, HitCoverage=29%, E-value=7e-09, Identity=26%"; Hit description =Peptidase aspartic, active site
GKGKVVEEQDGEAPHASNKDIPAKGPPEKKDGKKEVSLEEASEFLRIIQQSEFKVIEQVNKTPARGLAVGVTYELRASSGSASKSSERGPCGPRYLGRRFRRAVKCMDHIVAKVLIDNGSSLNVMPKSTLEKLPFNASHLKPSSMVVRAFDGTR

SEQ ID NO: 149809 - protein, 64 aa, Glycine max
  Coding DNA Sequence Number=SeqID_58124
MAFVDNWAVGKEKVCYWLSNDIVGMTKFASFQTHIDPFTVKDQIRKALKVPLELPGLSTFGRIL

SEQ ID NO: 149810 - protein, 213 aa, Glycine max
  Coding DNA Sequence Number=SeqID_58125
WYLEICRGGQETLGTSGGVLLPKTKLDQSRPNPGIVGNWELMEASGNRLPACVIDYTEEWVTVPRGSLGTLEGNTRCRFRGTIRFTATSLVHPDEPACMLQRTVKWILPTPTPYRLVEPVQVIEVTSSEEDPEEDPEELPPEPVVDALDFLEGDEDPLPEMDSPEEVMSASEADSTEDSGPREMATNLMYRNLMIVYMWLKPPPWTPLLWMTL

SEQ ID NO: 149811 - protein, 115 aa, Glycine max
  Coding DNA Sequence Number=SeqID_58126
  Homolog annotation: Hit_ID=A7Q9S0; Match level="QueryCoverage=100%, HitCoverage=38%, E-value=5e-10, Identity=36%"; Hit description =Chromosome chr5 scaffold_67, whole genome shotgun sequence
QVSKSEKSESGFSNEEYQEYLRLKSEKSSNQASSSSAPCFSTTCVSQSIGSPSPWILDSGAFDHISGNKSSFSSISFPKVPHLVTVANGSKVASQGSGQVSLSPSLKLNSVLFVP

SEQ ID NO: 149812 - protein, 35 aa, Glycine max
  Coding DNA Sequence Number=SeqID_58127
NQESRFKDQAFKTQDSRIKRRHNQDKYEKVFSKTE

SEQ ID NO: 149813 - protein, 371 aa, Glycine max
  Coding DNA Sequence Number=SeqID_58128
  Gene Ontology: Mol. function=transcription regulator activity; Cellular component=nucleus; Biological process=regulation of transcription
  Homolog annotation: Hit_ID=A7PLB8; Match level="QueryCoverage=17%, HitCoverage=29%, E-value=2e-21, Identity=87%"; Hit description =Chromosome chr7 scaffold_20, whole genome shotgun sequence
  Pfam annotation: Domain name=HLH; Domain location=120-169; Score =48.1; E_value=3.1e-11; Accession=PF00010.17; Description=Helix-loop -helix DNA-binding domain
MEELKAQIESYFKGDGHVLPSIMEATLKWKLSGKLEGTNDKLMEELRMCPLDDVDDWDFEDINYNDEEINDLYNADRDIPGIDSDENPNFVNPQLLFPLLYSSQQIPIPPLCSSSKRSRAVEFHNLYEKRRRSRIKEKMKALQNLIPNSNKTNKALMLDEAIEYLKQLQLQEQRNVKFLLRTNDVVALTMEEDPCKGSQRKCSLAKGMNKDDLARMLIAKLDFFLLHMLVTVTLKNTTLSLHSTQIHQNNQSVLLGAPSIFAGASSNSLSLPPSLPPVLAFFFLLTPHHFFFFFLTPYLTSLAFFFLSLYPGLKKASPTIVILHAVFVPPVSVVFFLRVGSPCSATAPPLMLSSPGKLRVVFSLRASALLR

SEQ ID NO: 149814 - protein, 146 aa, Glycine max
  Coding DNA Sequence Number=SeqID_58129
  Homolog annotation: Hit_ID=Q51617; Match level="QueryCoverage=28%, HitCoverage=59%, E-value=1e-14, Identity=95%"; Hit description =Putative uncharacterized protein
  Subcellular localization annotation: CTP_CleavageSite=77; ConfidenceScore=5.19e-01
MTVKTSDTCSSRRRSQLVCKRMPGADKPVRARQRVLAGVGAGLTMRHQSRLCVRRKYRIRRHSPFRLRNCWEGRSVRASSLLRQLAKGGCAARRLSWVTPGFSQSRRCKTTASAKLACLQVDSRGSPGRTKRNSNQRGNCAERAIV

SEQ ID NO: 149815 - protein, 110 aa, Glycine max
  Coding DNA Sequence Number=SeqID_58130
MVRTRGLGCALGHVTGRGVGRGDRDDSDDAPQRRRPTASARRQRVPVTAVHNEPVVHAPDVEADIFPDDPMAPTDVEDTGADIPADTGAQAAEDEHEGFSGGPSDPSVLT

SEQ ID NO: 149816 - protein, 80 aa, Glycine max
  Coding DNA Sequence Number=SeqID_58131
MSQPTLRREGDARLAGCVFHERNTRGVATNVYLRKTSEKPEKTRSTNFLVKGSGVVFTHGEGDHFKALDLKNDPFYLVGN

SEQ ID NO: 149817 - protein, 34 aa, Glycine max
  Coding DNA Sequence Number=SeqID_58132
MEKTRYHAYLNNSGSAIQETQGYHCSRLVRTICT

SEQ ID NO: 149818 - protein, 162 aa, Glycine max
  Coding DNA Sequence Number=SeqID_58133
MSHHSSSVNGKGTSHKDPLSRILDELSSLKLWKEKLKRKEKGKERVKINQDEREQIREEERRKILKELRKEKYVSYSNHNSCKSLSEELRDYYEGRHRSHLRPHPHMREKERKPQEANINLPYFHGKDNVEANLDWEIRVEQQLKRNSTSKSYGSHSYPKKD

SEQ ID NO: 149819 - protein, 158 aa, Glycine max
  Coding DNA Sequence Number=SeqID_58134
MAPTRHPLDPDKSNRALGFPALIIGLCQSFGVPVAPSKVIRPPITRAFIEKYCTQRQVQGDAPQAADAPPPHQAGPAGLFDTEVVFAAFDESALQSQGFTSFPCPTPDQFRAEVAWPGDWPEARAGEAPAEAPDEADEAREDEEMTDLLDFLGGSGAT

SEQ ID NO: 149820 - protein, 279 aa, Glycine max
  Coding DNA Sequence Number=SeqID_58135
  Gene Ontology: Mol. function=oxidoreductase activity; Cellular component=membrane; Biological process=electron transport
  Homolog annotation: Hit_ID=A6TAM5; Match level="QueryCoverage=100%, HitCoverage=50%, E-value=1e-107, Identity=50%"; Hit description =Putative nitrite reductase [NAD(P)H] large subunit
  Pfam annotation: Domain name=Pyr_redox; Domain location=142-231; Score=93.6; E_value=6.2e-25; Accession=PF00070.18; Description =Pyridine nucleotide-disulphide oxidor
  Pfam annotation: Domain name=Pyr_redox_2; Domain location=4-274; Score=144.0; E_value=4.1e-40; Accession=PF07992.5; Description =Pyridine nucleotide-disulphide oxidore
  Pfam module annotation: Pfam domain module=Pyr_redox::Pyr_redox_2; Domain location=142-231::4-274
MMRRLVIIGNGMAATRLAEKLAARAQGRFIITLIGDEPQPAYNRIQLSPVLGGEKTAAQIQLLPTEWYAQHGVRVRLGEAVSEVDVAGRRLRVGGDWLEWDELVFATGSQPFIPSLPGIERPQVFAFRTLADVKDILAIPGPAVVIGGGVLGVEVAAALRRHGGEVTLLHRGSGLMEPLTDAFAAEQLKQQLEARGIRCELESRIAAIDEQHVRLEDGRAFAASRVVLATGVRPDIRLAARSGVACQRGIIVDRRMATSLPGISAIGECCEIDGQIWGL

SEQ ID NO: 149821 - protein, 219 aa, Glycine max
  Coding DNA Sequence Number=SeqID_58136
  Gene Ontology: Mol. function=protein binding; Cellular component =cytosol; Biological process=transport
  Homolog annotation: Hit_ID=A6TAN2; Match level="QueryCoverage=100%, HitCoverage=100%, E-value=1e-113, Identity=89%"; Hit description =Cation transport regulator
  Pfam annotation: Domain name=AIG2; Domain location=42-149; Score=9.7; E_value=0.0029; Accession=PF06094.3; Description=AIG2-like family
  Pfam annotation: Domain name=ChaC; Domain location=40-209; Score =303.8; E_value=3.3e-88; Accession=PF04752.3; Description=ChaC-like protein
  Pfam module annotation: Pfam domain module=AIG2::ChaC; Domain location=42-149::40-209
MNADCKTAFGAIEESLLWSAEQRAASLAATLACRPDNGSVWIFGYGSLMWNPALEYSESCTGTLPGWHRAFCLRLTAGRGSAHQPGRMLALKEGGRTTGVAYRLPDETLEQELTLLWKREMITGCYLPTWCRLELDDGRTVNALVFIMDPRHPLYESDTSAQTIAPLIARASGPLGTNAQYLFSLDQELRKLGMRDASLDDLIIQVRHLVGEASQPGLA

SEQ ID NO: 149822 - protein, 121 aa, Glycine max
  Coding DNA Sequence Number=SeqID_58137
MGTNQNGKRFYQVKVKGLDVTSLKELGRLMGPLQRQAFRKVYGKILDLTVAEDALFGGENRILFSGFLPSLSKVAAVIGDSAKELDRMKQIRNGVVGLPRKYLEDKARDMASQEKWGPFAD

SEQ ID NO: 149823 - protein, 133 aa, Glycine max
  Coding DNA Sequence Number=SeqID_58138
MTRGNPSDLQSFDPEIDMTFHRLVRHHLVPFEHPEHSGIGDFEHYNFEHSDFAHSENMAQPPPRERTLREMAALDFTYKSLCIQYPDEDVPHVLKIGLIHLLPKFHGLAEGVAKDWLYYLAPRSIRSWDDLKR

SEQ ID NO: 149824 - protein, 371 aa, Glycine max
  Coding DNA Sequence Number=SeqID_58139
  Homolog annotation: Hit_ID=Q6WAY6; Match level="QueryCoverage=50%, HitCoverage=31%, E-value=6e-18, Identity=35%"; Hit description =Putative uncharacterized protein
AIDAFLAYHDHKESPVVVMLADLYDTFDRRCEKSSTRIVCCTPALYVWLVSHLFCQEVRHACPLESHRSCTEKGGANWDRLLVNKEGASFNWFPRWKEGRIRVLISCGGFPNFPLMGTRGCISYNPVLAIRQLGYPMRGAPLEEELAPVISRGFNKTSVETLQKVRKAWEVVQKKDKELRGSSNGPIGGYHKWLKAHVQGLDWLPSLRTAKREEVEAAARREEHGQNKFLGALWGSNNELKLRREERDQSQVDSLILKDELKVCSRSKRNLSQRLCETETNMLSIVSKYQEELNLATAHEHKVVDEYARVYEEKEARGRVIDSLHQEATTWMDQFALTLNGSRELPRLLAKAKAMADTYSAPEEIHGLLSY

SEQ ID NO: 149825 - protein, 109 aa, Glycine max
  Coding DNA Sequence Number=SeqID_58140
MSSSALLSSRDGELDDMRRYSSGYPCKPCLLILTREARWQAELSEWLSVLRRYLLILTREVRWRRYPSDYPKTLICYPSDSESGSMQSLTSSSAPFDNERQASPLARRD

SEQ ID NO: 149826 - protein, 102 aa, Glycine max
  Coding DNA Sequence Number=SeqID_58141
FKIKINFKFHEKKSRRFKNQEKFDFKIQEKMNSRFKRRNQEDFTMEARLTGALSKGGKMRGVATNIYLWETSEKPKVNKSGALAPTYPPSKRKSDLRSSFLR

SEQ ID NO: 149827 - protein, 152 aa, Glycine max
  Coding DNA Sequence Number=SeqID_58142
  Homolog annotation: Hit_ID=Q51617; Match level="QueryCoverage=36%, HitCoverage=79%, E-value=5e-13, Identity=70%"; Hit description =Putative uncharacterized protein
  Subcellular localization annotation: CTP_CleavageSite=17; ConfidenceScore=5.68e-01
MLCKKAVSSFGPPIVVRSKLAAVLSLMVMAALHNSLTVMPSVRCFSVTGVSRGPFVSRVSVMTVKTSDTCSSRRRSQLVCKRMPGADKPVRARQRMRKEKIPHQAPFAIQPAQLLGRAIGAGLFAITPAGERGMCCKAIKLGNARVFPVTTL

SEQ ID NO: 149828 - protein, 131 aa, Glycine max
  Coding DNA Sequence Number=SeqID_58143
MCKCRSHRNLSPLRPSKFSFEYFATTTKICTDDRSARARALGFAATAAPSYSSGLGPCPDGRRISTFHDHRPACLNRPTPFVGSKVSAQLGTVTQLSGSSRIASSAYQKWPTWSSRFHGAAQQSSRTVLPI

SEQ ID NO: 149829 - protein, 418 aa, Glycine max
  Coding DNA Sequence Number=SeqID_58144
  Homolog annotation: Hit_ID=Q84VI1; Match level="QueryCoverage=90%, HitCoverage=63%, E-value=0.0, Identity=79%"; Hit description =Envelope-like protein
TRAPRAPEPAPGDLIDLEEVESDEEPMANRLAPGIAERLQNRKGKTPLKRSGRIKTMAQKKSTPITPATSRRSKVAIPSKKRKEISSSNSDDDVELDVSTSKRAKKSGRKVPGNVPDAPLDNISFHSIGNVEKWKYVYQRRLAVERELGRDALDCKETMDLIKAAGLLKTVTKLGDCYEGLVREFIVNIPSDISNRKSDDYQRVFVRGKCVRFSPAVINKHLGRPTDGVIDIDVSEHQIAKEITANEIGAAYWVPTNHTSTVATESFAIKLPIAFPTVLCGIMLSQHPNMLNYTDSVMKRESPLSLHYKLFEGTHVPDIVSTSVSTSGKAAASGAVSKDALIAELKDTCKVLEATIKATTEKKMELELLIKRLSESGIDDEEAAEEEGEAAEEEEEAAEEEEDAAEETESDDDSEATP

SEQ ID NO: 149830 - protein, 85 aa, Glycine max
  Coding DNA Sequence Number=SeqID_58145
MFVGYVGRSGGSNTRPLRVTPLSPVILVTLADNELMSVASSFLSLGGVYLHGTAWLFWYGTGTGLAAGGYRGFCGAASLVTYITK

SEQ ID NO: 149831 - protein, 70 aa, Glycine max
  Coding DNA Sequence Number=SeqID_58146
MGEVEDVQEQMKANMEAMKEQMATMMEAMMSMKKIMEANAVTIVATSTVAKVNPMPPSGLNQMNHPTLDM

SEQ ID NO: 149832 - protein, 96 aa, Glycine max
  Coding DNA Sequence Number=SeqID_58147
MTKLEEFISQFMQVSMSNQNRFESTIENLEVQINPKDECKVVMTRSKMVSMNESEKRIGEEKQQLVSEPASIPVVEPLNETKEEEKQKIISRRRYQ

SEQ ID NO: 149833 - protein, 211 aa, Glycine max
  Coding DNA Sequence Number=SeqID_58148
  Gene Ontology: Mol. function=transmembrane receptor activity; Cellular component=intrinsic to membrane; Biological process=innate immune response
  Homolog annotation: Hit_ID=Q9FXZ2; Match level="QueryCoverage=100%, HitCoverage=48%, E-value=5e-93, Identity=83%"; Hit description =Resistance protein LM12
  Pfam annotation: Domain name=NACHT; Domain location=1-151; Score=4.8; E_value=2.5e-05; Accession=PF05729.3; Description=NACHT domain
  Pfam annotation: Domain name=NB-ARC; Domain location=1-211; Score= -5.1; E_value=6e-10; Accession=PF00931.13; Description=NB-ARC domain
  Pfam module annotation: Pfam domain module=NACHT::NB-ARC; Domain location=1-151::1-211
MVGIHGLPGVGKTTLAVAVYNSIVDHFEASCFLENVRETSNKNGLVHLQSVLLSKTDGEIKLANSREGSTIIQRKLKQKKVLLILDDVDEHKQLQAIIGNPDWFGRGSRVIITTRDEHLLALHKVKITYEVRELNKKHALQLLTQKAFELEKEVDPSYHDILNRAITYASGLPLALEVMGSNLFGKSIEEWESALDGYERIPDKKIYDILK

SEQ ID NO: 149834 - protein, 222 aa, Glycine max
  Coding DNA Sequence Number=SeqID_58149
MTTLTQTWMTLLLSNILPSDHNFDLPLPKCQLVYAILTRMSIDVAQLIIDAIYLFAGMPPTRHPLDPDKSNRALGFPALITGLCQSFGVPVTPSKVIRPPITRAFIEKYCTPRQVQGGDPQAPDAPPPPPQADPAGSFDTERAHVQTHDCLYQFSLSLHSQGFLPFPCPTPDQFKAEVAWPGDWPEAQAREAPAEAPDDADEARMDEEMTDLLNFLGGSGAT

SEQ ID NO: 149835 - protein, 148 aa, Glycine max
  Coding DNA Sequence Number=SeqID_58150
  Homolog annotation: Hit_ID=Q6WAY4; Match level="QueryCoverage=86%, HitCoverage=23%, E-value=6e-11, Identity=35%"; Hit description =Putative uncharacterized protein
MGTNQNGKRFYQVKVKSLDVTSLKELGRLMGPLQRQAFRKVYEKILDLAAAEVFTEAVVSLAQYYDQPLRCFTFGDFQMVPTIEEFEEILGCPLGGRKPYLFSGFLPSLSKIAVVIGDSAKELDRMKQTHNGVVALPRKYLEGKARDM

SEQ ID NO: 149836 - protein, 126 aa, Glycine max
  Coding DNA Sequence Number=SeqID_58151
MPISPCRCIGWDRAHKTPSGPEEVQQGPGVSSSGYGPLNRTHKDTQWTRRSPTGPWGFQLWLRASVVLQGARSPRQGHVIIGIAPARHPMDPKKSNRVLELSSSNYRSLPVHRSACHLQQGHQAPY

SEQ ID NO: 149837 - protein, 202 aa, Glycine max
  Coding DNA Sequence Number=SeqID_58152
MQSPVMSSPLGKDFLFGEGEVVVGCDVIDESPKAFYGDVLGYMSFIQDFYQQSSMGLRAHEQFQKRDSSRGFVELLNHFELALLNNAEELAGLLERYLFLVTTLFSLGKTFHRNILTRSGDHFDIWPFRHPCLPLSVCKLRRQVRGHEYMAAAGYAAQPYDIGYFGRQRADVGSFFLPIAQRRVPPRNCMAVLVWKRNRSNY

SEQ ID NO: 149838 - protein, 80 aa, Glycine max
  Coding DNA Sequence Number=SeqID_58153
MTPEDLEQLTQKIMDQLEESITEKMQSQGLALPPESEVGPSTARVSIKESRVDSSGNDLDMGDSEKCGLYVEENPPAWLP

SEQ ID NO: 149839 - protein, 86 aa, Glycine max
  Coding DNA Sequence Number=SeqID_58154
MGKAEEVQEKVKADMEAMKEKMVIMMEAMMSMEKIMEANAIAVAATSVAAKVNPTSPSGINQMNHPTSDMVGKDLGSTRNPRYAQI

SEQ ID NO: 149840 - protein, 166 aa, Glycine max
  Coding DNA Sequence Number=SeqID_58155
  Pfam annotation: Domain name=Transposase_23; Domain location=45-115; Score=-1.4; E_value=0.0017; Accession=PF03017.5; Description =TNP1ENSPM transposase
  Subcellular localization annotation: CTP_CleavageSite=28; ConfidenceScore=5.03e-01
MQSQIQSQMQSQGLALPPEPLVGPSSPRVSTKGSCVDPSGNDPETGDSDRCDLYIEADPARLVALGRVYEGSTVVHNTPLLPDQVKVSVEEVTDANAPLPVPTNEVSLVRQTLHTFLAWPTHLVKSLSQQVVVSPAKPLPKPDPEVDDPLYLMTLTIPELFLRHYQ

SEQ ID NO: 149841 - protein, 60 aa, Glycine max
  Coding DNA Sequence Number=SeqID_58156
MMVDIQCGYYVMHWMSTIILGTFRNNWEAYFNDPRPLEPMRLKALRIQWAQFYLRVRDQA

SEQ ID NO: 149842 - protein, 74 aa, Glycine max
  Coding DNA Sequence Number=SeqID_58157
  Subcellular localization annotation: CTP_CleavageSite=45; ConfidenceScore=5.18e-01
MKNGGKSSRNRSWKRLGSVTKAPRHGFSSRKHFFSLILREKREVVAAQLAQASWVASTKRHRLLLEHPGRPKWV

SEQ ID NO: 149843 - protein, 233 aa, Glycine max
  Coding DNA Sequence Number=SeqID_58158
  Subcellular localization annotation: CTP_CleavageSite=58; ConfidenceScore=5.49e-01
MDMNIGALISGQMTSIAQSNTSRLGFPTLITALWATTELPSTFAAPTPTSTSAAPSVPAQTYSQHFKAMLQSIHQGQIILLQSLQVVATPGSNPLVEQFREMIAWPRTQPSLHREDKGPTAQVPKHMEDESSEATILEPFVLGEEEGETQVRQVVAVTPERSLEATSEPPAPLVDLPSPQRTTNPSTPILEMPEDQTTLVLTMDTSPPATPVLHLTNEEDVQTQDTQDQSQEF

SEQ ID NO: 149844 - protein, 93 aa, Glycine max
  Coding DNA Sequence Number=SeqID_58159
MSNEELKLQDPRCRIQCPGHPARKYWKLLYNAQSCRIQDVGYNVQDIWPENTGHINLFSGRMIDLIQHKLLQPRITHCYKNMEAARVLYQVRD

SEQ ID NO: 149845 - protein, 190 aa, Glycine max
  Coding DNA Sequence Number=SeqID_58160
MTMIVDTLPVFYYGKRWATHLQSFEDLVFASERIDVGLKKGKFDHPTRTTEKTGANKEGEDEGETHAVTAIPVRPSFPPTQQYLYSANNKLSPYPPPSYPQRPSLNLPQSLSTALPMTNTTFSTNQKHQPRTITLAKVHQPPFIREYDSNATCACHGEAPGRSIEHGRALKRKVQGLIDTGWLKFEENCV

SEQ ID NO: 149846 - protein, 100 aa, Glycine max
  Coding DNA Sequence Number=SeqID_58161
MEANAVTISATSTVAKVNPTSPSGINQRNHPTSDMVGRDLGSTDDPHDVQIQNKHAFPPYGLPLNYTPPNVAYTPSENVNNSTPIPIESQQPQTDHAHVS

SEQ ID NO: 149847 - protein, 187 aa, Glycine max
  Coding DNA Sequence Number=SeqID_58162
  Gene Ontology: Mol. function=ribose-5-phosphate isomerase activity; Cellular component=intracellular; Biological process=pentose -phosphate shunt, non-oxidative branch
  Homolog annotation: Hit_ID=A6X0Q4; Match level="QueryCoverage=98%, HitCoverage=79%, E-value=3e-96, Identity=97%"; Hit description =Ribose 5-phosphate isomerase
  Pfam annotation: Domain name=Rib_5-P_isom_A; Domain location=5-182; Score=335.4; E_value=1e-97; Accession=PF06026.5; Description=Ribose 5-phosphate isomerase A (phosphoriboisomerase A)
QRLQIIGVPTSERTAKLCEELGVPLTTLDETPHLDLTVDGADEVDTNLSLIKGGGGALLREKIVAAASDAMIVIADSSKVVEALGRFPLPIEVNRFGLGATMHAIEEAAAKCGLAGPLALRLKDGSPFVTDGGHYIVDASFGRIPDPKTLSDALFAIPGVVEHGLFIGLARAAVVAGNDGIRTMNRS

SEQ ID NO: 149848 - protein, 96 aa, Glycine max
  Coding DNA Sequence Number=SeqID_58163
FLEKKSSKKNVYPEEILGTEAFSGRGKFRKKVFRKLLRPIPEEVFRENTSGSTSSGIGLSNFRKTFFRNLPLPEKASVPKISSGYTFFLLLFFSKN

SEQ ID NO: 149849 - protein, 78 aa, Glycine max
  Coding DNA Sequence Number=SeqID_58164
MGVLEVVRNEKQRWRGSVSSGILKGREAKRKEWFDSYLLCVNLNIFSEGRAWHRRVTSRHIYKAESGEVVPQALVGLE

SEQ ID NO: 149850 - protein, 32 aa, Glycine max
  Coding DNA Sequence Number=SeqID_58165
MELSSGRMIGSSKEVDGLYFFEDESSPKEKLH

SEQ ID NO: 149851 - protein, 76 aa, Glycine max
  Coding DNA Sequence Number=SeqID_58166
MGGVEEVQEQIKADMEAVKEQMATMMEAMISMKKIMEVNAVAVAATSVVAKVNLTPPSGLNQMNHPTSDMVGKDLG

SEQ ID NO: 149852 - protein, 81 aa, Glycine max
  Coding DNA Sequence Number=SeqID_58167
IRRSKSPAFVDHPTFCYRDPRVRWHAETPYGYPHLVIRRPLVGLTSKDQCGHLHPFRRCQHLPSLAFVDRLMLSVIPTREV

SEQ ID NO: 149853 - protein, 149 aa, Glycine max
  Coding DNA Sequence Number=SeqID_58168
MARTRGLGRALGRLIGRHRQDDHDAVDVPERRRPTASTRKQRVHQMTADAPDMAEDVPDITEDVPDMAEDAPEMTVDVQGDDDAAEGFPGGPRDPSVLTSFADHVAHTVTLIGRPVPEIEGLVGATGLSPLIDCSVVTGDPGLISTFVE

SEQ ID NO: 149854 - protein, 95 aa, Glycine max
  Coding DNA Sequence Number=SeqID_58169
MVMPRPESSLRPRRRISLTCRSSRASSTSVEEPRHAVEVCDDIAKRLECHLSQGVVTPGSSTHEVIEECLRLARSVTQDHLVYVRSRRRRHTNQA

SEQ ID NO: 149855 - protein, 64 aa, Glycine max
  Coding DNA Sequence Number=SeqID_58170
MVETVCEGEALTDSSECRPWGSSGLSAPISLCRSHMVGAFSQNSMTLTGLPMISLSESDLTYPL

SEQ ID NO: 149856 - protein, 161 aa, Glycine max
  Coding DNA Sequence Number=SeqID_58171
VSVEEVRDADAPVPVPTDKVVVSPPKPPPKPDPEVDDPLYLMTLTIPELFLRPYQVRWDATVFGVVNPDFLRNRTRWSMSQHISVTVVDSPQSIQRSGQSQFESESYIKSWMQSSQRDVYLGAYLNGPDNYRKGIINSAIKGLDDAPQPKSKAPVRWIVVK

SEQ ID NO: 149857 - protein, 153 aa, Glycine max
  Coding DNA Sequence Number=SeqID_58172
MWDVTVFGVFNLDFPLYIKHKDLSEIAHGDQCLSISVIQLCILHLTETSMRAGNSDVYGFLEPQSIQRSGQSQFESESYMKSWMQSSKRDVYLGAYLNAALKGLDDTPQPNSKAGARWIVVKYFNDVRSLEAERFMALCIQWTQYYLKVRNQT

SEQ ID NO: 149858 - protein, 74 aa, Glycine max
  Coding DNA Sequence Number=SeqID_58173
MRLLLHLPLVKLKKQKGKNLHKIVEASFMMMNQAILMMPKAQVIDSRLQDQASRIQSKIPEKKSRSNKSRLHIG

SEQ ID NO: 149859 - protein, 164 aa, Glycine max
  Coding DNA Sequence Number=SeqID_58174
VDPWVLVPITFRGLHVLANRGLHALTFRGLHVLALRGLHALTLGTSYPHRQRTTRPRLERTTRPHHQRAARSYLQRTTCPRLERATRPHLGGLHVLALRGLHVLTTRGLHALTSRGLHVLALRWLHALTLGTSYLHLQRTTRPRLQRVMYLQLQRTTRPRRQRV

SEQ ID NO: 149860 - protein, 134 aa, Glycine max
  Coding DNA Sequence Number=SeqID_58175
MEVFTEAIVSLAQYYDQPLRCFTFGDFQIVPTVEEFEEILGCPLGGRKPYLFSGFLPSLSKIAAVVGDLARELDRMMQTRNGVVSLPHKYLEGKVMQSYPARALDRRLQVDWARDPREGLRVLMSLRVDFEPMG

SEQ ID NO: 149861 - protein, 281 aa, Glycine max
  Coding DNA Sequence Number=SeqID_58176
  Gene Ontology: Biological process=response to stress
  Homolog annotation: Hit_ID=A9INC7; Match level="QueryCoverage=29%, HitCoverage=59%, E-value=1e-13, Identity=48%"; Hit description =Universal stress family protein
  Pfam annotation: Domain name=Usp; Domain location=2-88; Score=12.5; E_ value=0.093; Accession=PF00582.17; Description=Universal stress protein family
DMIDEYYVREGQEAADEARKLLDVTGTDYTSHVEFGKPAIEIHAYAQEHQCARIVMGTRGHGALAGVLIGSVANQVVQLAEVPVTLAGRQRRQGQRHAQPAQRRWPRADLATIGAGQVPHDVQAQAGTWPLLVHAHATLEDAFALVFGDARAVVVDHDAQAVWRGRLGADADAPRGPFAGVVEQVAGHFLQVLLLAAKLEPVVVDLALRHRNLFTHQAGEGALFAHRRVAQDGQRRLDRMRQVAGLGPRPLHDVGVDRQDAVDIIDQRLDFAGKTALDAHA

SEQ ID NO: 149862 - protein, 127 aa, Glycine max
  Coding DNA Sequence Number=SeqID_58177
MTRGNPSDLQPFDPEIDRTFHRLVRHHFIPFDHSEHSITGESVHFVIGDFEHPDLEHYNFEHSDSEHSDFAHSENMAQPPPRERTLREMAAPDFTYESLCIQYPDEDVPYVLKTGLIHLLPKFHGLA

SEQ ID NO: 149863 - protein, 178 aa, Glycine max
  Coding DNA Sequence Number=SeqID_58178
  Gene Ontology: Mol. function=nucleoside-triphosphatase activity; Cellular component=intracellular; Biological process=regulation of transcription, DNA-dependent
  Homolog annotation: Hit_ID=A6TCS7; Match level="QueryCoverage=97%, HitCoverage=29%, E-value=2e-53, Identity=62%"; Hit description =Putative helix-turn-helix, Fis-type
  Pfam annotation: Domain name=HTH_8; Domain location=135-175; Score =32.8; E_value=1.2e-06; Accession=PF02954.10; Description=Bacterial regulatory protein, Fis family
  Pfam annotation: Domain name=Sigma54_activat; Domain location=1-101; Score=-43.6; E_value=1.3e-12; Accession=PF00158.17; Description =Sigma-54 interaction domain
  Pfam module annotation: Pfam domain module=HTH_8::Sigma54_activat; Domain location=135-175::1-101
EKEVAPLGSSRSWPVNFAVICATHRDLAQRVAAGEFREDLLYRLQEFALTLPPLRAWPNVAGFIRDLWQELGAAQRGVQLSPALLTALAQQPWPGNVRQLRSLLRVLLALADEGETLTESHLPAEYRRPPAPPLRERHDEQLISETLQRYDGNISKAAQALGVARSTLYRRAARDRGD

SEQ ID NO: 149864 - protein, 88 aa, Glycine max
  Coding DNA Sequence Number=SeqID_58179
MKSADKRGYHMVIHTVHQPGANEPVDAQRLMSSSAPSVIMTHEVRFTLVVQRYSSPTTHEILLCWAGMIKFDSAWKRRGYPILSLSRH

SEQ ID NO: 149865 - protein, 174 aa, Glycine max
  Coding DNA Sequence Number=SeqID_58180
MTGLLDESISYFLIRVDPWVLVPIAFRGMHALTFRGLHVFAFRGLHALTFRGLHAFAFRRLHALAFRGLHALAFKGLHALAFRGLHVLTFRGLHVLAFRGLHVLTFRGLHVLAFRGVHVLPFRGLQVLTFKGVQVSCLQRTTCPHHQRTTHPHLQRTTCPRLQRTTHPHLQRTT

SEQ ID NO: 149866 - protein, 135 aa, Glycine max
  Coding DNA Sequence Number=SeqID_58181
MVRTCSNRKERRVFGKGFPGSRKYLRSTRLGQERGLRIIGRFELANGRVEVIKLAYGRVEVQDSKISGLSTISDQTPQNQLRLRAIWITVLRSSYVHLLPAFRFLLNNFTFCKLQNHQVFVATMNIRNLTFKANT

SEQ ID NO: 149867 - protein, 115 aa, Glycine max
  Coding DNA Sequence Number=SeqID_58182
LHNVPVPFLSLVIDYTPLVIDYQKPSWLPDLVFKPETIPHISIKFYSWPATTSPLALWSLFLLSVDCQELACLGTSQVLTDRLCPGWVGIGQAWFWAIAPHLTSPRSPDPRDISP

SEQ ID NO: 149868 - protein, 153 aa, Glycine max
  Coding DNA Sequence Number=SeqID_58183
MSKSCGFGMTGPLDESISCFLIRVDPWVLVPITLRGLHVLALKGLHVLTIRGLHALTSRGLHVLALRGLPALALGTSYPHLQRATRPRHQRTACPYLQRATRPHHQRTACPHLQRAARPHLERTTRPRHQRAACPHLQRTTHPRLERAARPHL

SEQ ID NO: 149869 - protein, 217 aa, Glycine max
  Coding DNA Sequence Number=SeqID_58184
  Homolog annotation: Hit_ID=Q2HTA0; Match level="QueryCoverage=40%, HitCoverage=13%, E-value=2e-12, Identity=43%"; Hit description=IMP dehydrogenase/GMP reductase, related
  Pfam annotation: Domain name=DUF1723; Domain location=20-69; Score =50.2; E_value=7e-12; Accession=PF08330.1; Description=Protein of unknown function (DUF1723)
IEGLVAAAGLSPLIGCFVVTGDPELISAFVERWHRETNTFPLPVEELTITLDDVSSLLHLPISGAFHNFHALSVDEAIFLLIELLEVSAEEARAETTRSRGAYVRLGWAFRDLSQSGGYAWGVAALVHMYDQLDEASRTTTRQIGGAGSISTFRVCISASQMMRTRRRPHCFLVADDEGASDFIVLGSAEMGSYGGHSSTGEGATAVWLHSEHPSAA

SEQ ID NO: 149870 - protein, 96 aa, Glycine max
  Coding DNA Sequence Number=SeqID_58185
  Subcellular localization annotation: CTP_CleavageSite=58; ConfidenceScore=5.12e-01
MDLKKSNRALGFPALVTGLCRPYRAPVPPSKFMSSWHRDCARKTPSGPEEGQQGLGVASSKYGSLSVLRSARRPNKVIRPHINRAFIKKYCAPRRA

SEQ ID NO: 149871 - protein, 76 aa, Glycine max
  Coding DNA Sequence Number=SeqID_58186
MTKVNQEPFLGQNLGVEESNFDSLGRIDGDPVLRETRIWATWEYVSSVGGGQQGMVGLCAHCGCGKLVVHHRPTAT

SEQ ID NO: 149872 - protein, 106 aa, Glycine max
  Coding DNA Sequence Number=SeqID_58187
  Subcellular localization annotation: CTP_CleavageSite=21; ConfidenceScore=5.10e-01
VPPVQLLTGWWVTAKAPPDISAGKSSGHAARRVPFAIQAAQLLGRAIGAGLFVITPAGERGMCIKAIKLGNARVFPVTTVKRRPVNCNTTHYRANWSSTAVATARE

SEQ ID NO: 149873 - protein, 84 aa, Glycine max
  Coding DNA Sequence Number=SeqID_58188
  Homolog annotation: Hit_ID=A0ST23; Match level="QueryCoverage=30%, HitCoverage=53%, E-value=1e-07, Identity=100%"; Hit description =Putative reverse transcriptase
  Subcellular localization annotation: CTP_CleavageSite=42; ConfidenceScore=5.84e-01
MAAKFSPSRPSFSATPSAWSKQTSSLSIPSTSRGGPVPAFVPFSEVGKPVVPAALMNRPTRGERRFAYWALAECILAYYVGTDE

SEQ ID NO: 149874 - protein, 29 aa, Glycine max
  Coding DNA Sequence Number=SeqID_58189
ARTLSPGKDKSKDFEGTELEFVIMVIAVS

SEQ ID NO: 149875 - protein, 69 aa, Glycine max
  Coding DNA Sequence Number=SeqID_58190
MSVKTLVGRLGVHDKTNHTLARRPAKSLQPYGINIGLKEHSNRVTPKAYTPKSSSGPLPLDSGPTQKIF

SEQ ID NO: 149876 - protein, 127 aa, Glycine max
  Coding DNA Sequence Number=SeqID_58191
  Homolog annotation: Hit_ID=A5B322; Match level="QueryCoverage=58%, HitCoverage=27%, E-value=8e-07, Identity=36%"; Hit description =Putative uncharacterized protein
MIMGGQDIYSNQDEATTSPSSSESEEAKESSEEIYPQEEGQPLMVKEKCKEVSISSKRNNQHENTEKGTLYCITFLNFLNSDQGVPTDPKRIKAIPDWPTQPSIREIWGCHDLTNFYKRCQGKEPRV

SEQ ID NO: 149877 - protein, 157 aa, Glycine max
  Coding DNA Sequence Number=SeqID_58192
  Gene Ontology: Mol. function=tetracycline:hydrogen antiporter activity; Cellular component=integral to membrane; Biological process=response to antibiotic
  Homolog annotation: Hit_ID=Q8GEG0; Match level="QueryCoverage=74%, HitCoverage=96%, E-value=2e-25, Identity=56%"; Hit description =Putative uncharacterized protein
  Subcellular localization annotation: CTP_CleavageSite=51; ConfidenceScore=5.11e-01
MTMITPSSKLTLTKGNKSWYRAPPRDVPCPQDLSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 149878 - protein, 119 aa, Glycine max
  Coding DNA Sequence Number=SeqID_58193
AKVLVDNGSSLNAMPKATLDKLPFNASHIRPSSMIVQAFDGSPLDSFDWGGPVNTTPEVEICGGWAIDYSFGRRRHTHELSFFYALCGGCGGVLGNFLSSIGSCEKCLRGVSPGIAALN

SEQ ID NO: 149879 - protein, 249 aa, Glycine max
  Coding DNA Sequence Number=SeqID_58194
  Gene Ontology: Mol. function=4 iron, 4 sulfur cluster binding
  Homolog annotation: Hit_ID=A6THS6; Match level="QueryCoverage=100%, HitCoverage=97%, E-value=1e-130, Identity=95%"; Hit description =Putative uncharacterized protein yjiL
  Pfam annotation: Domain name=BcrAD_BadFG; Domain location=1-242; Score=300.4; E_value=3.4e-87; Accession=PF01869.11; Description =BadFBadGBcrABcrD ATPase family
IDSGSTATKGILLADGAIVRRFLSPTPFRPADAIHEAWETLRADLAATPFLTLTGYGRQLVDFADKQVTEISCHGLGARLLAPETRTVIDIGGQDSKVIQLDAQGNLSDFLMNDKCAAGTGRFLEVISRTLGASVDQLDAITEGVEPHAITSMCTVFAESEVISLRSAGVAPEAILAGVINAMARRSANFIGRLSAQGPLLFTGGVSHCAAFARMLETHVGMPVATHPDAQFAGAIGAALIGQRQRRRG

SEQ ID NO: 149880 - protein, 160 aa, Glycine max
  Coding DNA Sequence Number=SeqID_58195
  Gene Ontology: Biological process=transposition, DNA-mediated
  Homolog annotation: Hit_ID=Q1J7G7; Match level="QueryCoverage=25%, HitCoverage=71%, E-value=3e-12, Identity=74%"; Hit description =Transposase
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPVTTLNSMPPIVFQNLCNKLGMMNIHSQLEGGGDLKLHHVKV

SEQ ID NO: 149881 - protein, 83 aa, Glycine max
  Coding DNA Sequence Number=SeqID_58196
MPLKGKQLVVYPCKHFGGPSVSPITTPLVFPNKAIEGGEDYAFVNLEELFLVPNIITPPKFKVPDFDKYKGTTCPKNHLKMYC

SEQ ID NO: 149882 - protein, 41 aa, Glycine max
  Coding DNA Sequence Number=SeqID_58197
MTVANDIKITLPKIDSAKEFMSKLIQEETGLKNQGSHSVYY

SEQ ID NO: 149883 - protein, 91 aa, Glycine max
  Coding DNA Sequence Number=SeqID_58198
GLWLPLHYRVDIGASQHRTPEFGVNPTCFLLQNSFLVGVLVRAKGMAFVDNWVVGKEKGKLGRIGMAITAWVSPSFSSSSFAPVFSFLKAG

SEQ ID NO: 149884 - protein, 91 aa, Glycine max
  Coding DNA Sequence Number=SeqID_58199
VPPVQLLTGWCVTAKAPPDISAGKCSGRVPFAIQAAQLLGRAIGAGLFAITPAGERGMCCKAIKLGNARVFPEFDSRFKISKIKIKNQEKA

SEQ ID NO: 149885 - protein, 202 aa, Glycine max
  Coding DNA Sequence Number=SeqID_58200
MKDKRDEEEKLEKQKKKKDSKALSSKANGKEKEEKDSSKKIVKKENHFATKGDIKRALLLEQSFNFLLSRETSLSTVIPLELEVIPQVKELLDEGVPTNPKRIKVIHEWTTPPTPLIELVRNHVPSWEDSQEMGVEGRSPEFQEPLDLRSMGVATYPSAGGRRETRGMRVPRKEYARSRHQRLFGENVGKTGKDEIYELFSE

SEQ ID NO: 149886 - protein, 75 aa, Glycine max
  Coding DNA Sequence Number=SeqID_58201
MTNANCPQESLHSVSNGNLRFTQHEEQLFIEKITLMRVPKDHHILNIITHTMHSYIEELLNQLGQNKHYNQFAVA

SEQ ID NO: 149887 - protein, 59 aa, Glycine max; identical to SEQ ID NO: 136093
  Coding DNA Sequence Number=SeqID_58202
  Homolog annotation: Hit_ID=A0PAV3; Match level="QueryCoverage=64%, HitCoverage=17%, E-value=5e-07, Identity=76%"; Hit description =Restriction endonuclease

SEQ ID NO: 149888 - protein, 42 aa, Glycine max
  Coding DNA Sequence Number=SeqID_58203
MADAPATLASMFQLTPHEDLPYIEFWCRGKPAHYCQVEEEWD

SEQ ID NO: 149889 - protein, 136 aa, Glycine max
  Coding DNA Sequence Number=SeqID_58204
  Homolog annotation: Hit_ID=UPI00006A2D9E; Match level="QueryCoverage =97%, HitCoverage=85%, E-value=7e-14, Identity=15%"; Hit description =UPI00006A2D9E related cluster
MALESIAFRGLHVLAFRGLHVLAFRGLHALTFRGLHDLTFRGLHVLAFRGLHPLAFRGLHVLAFRGLHAFAFRGLHALAFKGLHILAFRRFHVLTFRGLHSLAFVGLHALTFRGLHALAFRGLHTLTFRGLHVLAL

SEQ ID NO: 149890 - protein, 48 aa, Glycine max
  Coding DNA Sequence Number=SeqID_58205
MGNNANILLREEKIPKLREKRAFTYYRDGAIQPPGEKLPNHLTLHHSI

SEQ ID NO: 149891 - protein, 130 aa, Glycine max
  Coding DNA Sequence Number=SeqID_58206
MHTRQDFTRAAAKRQRPQCRSPPADVSVGLCRPDIGKYAYGSTDFLYHPLFAGIMLARLPVDPEKSNRFYGVPVTPGKVIRSPTNQAFIKKYCAPRQAQGETPQQPGDGWQRATNTPPPPLEFISAHPQN

SEQ ID NO: 149892 - protein, 114 aa, Glycine max
  Coding DNA Sequence Number=SeqID_58207
MLRQSSQAVKPLNLCEWGYKRILRREKGDTKEFRRLVLCYFGKGRRETQKEFTRLVLGEFFLAKGEEMKRKNSTVFKVWKTRKLWKKKKKNKMKKHRFLKLGSKELLEKFVQDN

SEQ ID NO: 149893 - protein, 264 aa, Glycine max
  Coding DNA Sequence Number=SeqID_58208
  Homolog annotation: Hit_ID=A1FSR1; Match level="QueryCoverage=100%, HitCoverage=57%, E-value=1e-147, Identity=98%"; Hit description =Putative uncharacterized protein
  Pfam annotation: Domain name=Lysine_decarbox; Domain location=1-143; Score=164.8; E_value=2.3e-46; Accession=PF03641.5; Description =Lysine decarboxylase family
MKGPMKGATIAHAKQRRTVTRYIGLTEPGIIAAESPNPIVNHLVIMPDIEKRLEAFVRIGHGIIVFAGGVGTAEEILYLLGILLREENKDLPFPLILTGPTVAAPYFEQIDRFIRLTLGDAAAERYEIVIGDPVAVAKKMANGIKRVREHRLAQKDSFFFNWSIEIPWVYQQPFVPTHEAMAALDLHHGRAPHALAADLRRAFSGIVAGNVKEDGMRRIEQFGPFQIHGDPDMMQALDALLRAFVEQRRMKISGEYQPCYQVLA

SEQ ID NO: 149894 - protein, 108 aa, Glycine max
  Coding DNA Sequence Number=SeqID_58209
  Subcellular localization annotation: CTP_CleavageSite=33; ConfidenceScore=5.28e-01
MGALVNLCLRAAKASSCFLPHLKPTFFLTTSVRGAANVLKSLTNDEDMTKSKGKDPLEGLGGPMTRARARKAKEALQQVLSILFEYKPKFQGEKYKVVTWNKTQMGED

SEQ ID NO: 149895 - protein, 106 aa, Glycine max
  Coding DNA Sequence Number=SeqID_58210
MSPVESPTVATCPFAGERRRGSRVRFPKEERCAESPPTFICGKRRKNRRKLVEMKILSSGVVFTFEEDKSGALPPTYPPSKRKSDLRSSFWAISCFNLKQEIAQKL

SEQ ID NO: 149896 - protein, 50 aa, Glycine max
  Coding DNA Sequence Number=SeqID_58211
MGERRFNIMSWITISDASACVWSNHNELLRIVWSGLLNMNCGSSKKFEEC

SEQ ID NO: 149897 - protein, 45 aa, Glycine max
  Coding DNA Sequence Number=SeqID_58212
MNENAIHRAPKRVENGELHLAITTRSSKIEGGGHMNETQFMGLRK

SEQ ID NO: 149898 - protein, 131 aa, Glycine max
  Coding DNA Sequence Number=SeqID_58213
MGKCLALKYNVLHLIDARWLTSQEDRPNVKTNPLANHGGGAVNAIELGRPHRSKPLKDMTTPRRFIYEALQKGGVIPHAMEDLLQQMIDRGRLEVGDEGSKEQHICMQSTDEGRFGRPKPLVVSFTRDAAP

SEQ ID NO: 149899 - protein, 37 aa, Glycine max
  Coding DNA Sequence Number=SeqID_58214
MKMLLIPHDMNDSGMEKEEREETPLQGEDESRRSSPP

SEQ ID NO: 149900 - protein, 86 aa, Glycine max
  Coding DNA Sequence Number=SeqID_58215
NLRFWAATACAGGDRSSSEKSADIVSDIVDPAASLLHLAFILHCTTIPVFSGRMSGHCIRHRGSCNFTSALDFYLALCIVQPDLIP

SEQ ID NO: 149901 - protein, 82 aa, Glycine max
  Coding DNA Sequence Number=SeqID_58216
MNITSIIIKTLKQNGNLARLPIISLKTPYPRKSKEKEVHPNLKFRSPTRRHALHDSENALLSRFGAEMMAKGWSFVWSFNGE

SEQ ID NO: 149902 - protein, 273 aa, Glycine max
  Coding DNA Sequence Number=SeqID_58217
  Gene Ontology: Biological process=transposition, DNA-mediated
  Homolog annotation: Hit_ID=Q6UUU1; Match level="QueryCoverage=21%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPEFDLLLGYPMPPSKLWQLQFFQNVQSPHIDARKIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 149903 - protein, 150 aa, Glycine max
  Coding DNA Sequence Number=SeqID_58218
MLCWSRYKLVVKMEQNGEKSGDEIKVFPACVDQLLGKTWVVRFKHRIQMHQSSMLDFSEQEHHIQSVISTLGLQDEQCLSNKSAAVGAASSSQQDYHPTPLLSQSSKYDPGNAAFVTPAKRTSDQQGSSQFDSDDFTTYELSTNKHIKAK

SEQ ID NO: 149904 - protein, 129 aa, Glycine max
  Coding DNA Sequence Number=SeqID_58219
MAPRKLSAKRSRKDAAAEGTSAAPEFDNHRFRSAEHQQRFEAIKGWSFHRERRVQLRDDEYTDFQEEIARRRWTSLVTPMAMFDLDVVLEFYANAWPTEEGVRDMRSWVRGQWIPFDADALSQFLGDAL

SEQ ID NO: 149905 - protein, 120 aa, Glycine max
  Coding DNA Sequence Number=SeqID_58220
MVSRGIIPFEKHIAAVGTTNNNMLSKRKTLDEGSLLSSKSETQHDHRFTSTPYVSMDPGIRPLFNSLCVQKVESQPTLRRKGDAGLTGASSKGGRRAESPPTFIPGKRRKNQNVWSTNFK

SEQ ID NO: 149906 - protein, 108 aa, Glycine max
  Coding DNA Sequence Number=SeqID_58221
MGIYGSLSMNNNYLYSKLHSARITTFMTYKNIHDVQEHTRTSTVDSKGSLNCKHHEPHDEGSSIKSMLYKLLVNLRSGVFMLQIDGFWWKILIWLSQKFCSICKVDSN

SEQ ID NO: 149907 - protein, 173 aa, Glycine max
  Coding DNA Sequence Number=SeqID_58222
MGSVKRKFFQRAFGHHIQTGAIIDEYFGMTWSMHLTDTCKALLCPLPSAWISSSAKARLLLAKLDEAQSSRLFQKRDSSRGFVELLNDFELALLNNAEELAGLLERYLFLVTAIPSLRKTFHCNILIRSGDYFDILSCRHPCLPFSVCRLCWQVRGCEYATAASHAAQPCDIG

SEQ ID NO: 149908 - protein, 83 aa, Glycine max
  Coding DNA Sequence Number=SeqID_58223
  Homolog annotation: Hit_ID=A2Q1D6; Match level="QueryCoverage=87%, HitCoverage=11%, E-value=1e-11, Identity=46%"; Hit description =Ovarian tumour, otubain, related
MRSDTNIGSRGRTSFVLIGCERSGQYRSRKKDFVRRDTGSRKCGCPFKLRGKPVVGGQGWMVKLMCGSHNHELTKSLVGHPYA

SEQ ID NO: 149909 - protein, 94 aa, Glycine max
  Coding DNA Sequence Number=SeqID_58224
MAKFDPEVVLEFYANAWPTEEGVHDMYSWVRGQWIPFDADALSQFLGDPLVLEEGQECEFSQRRNRANGFDEEAIAQLLCTLGQDFARTAAGRR

SEQ ID NO: 149910 - protein, 71 aa, Glycine max
  Coding DNA Sequence Number=SeqID_58225
MPSPPLMVVKYCEFKGYWAALQRHFPLAQRREGVTIGRSRPYPPFAFIPKYLQAGDKQYAANRDRSSSYLG

SEQ ID NO: 149911 - protein, 95 aa, Glycine max
  Coding DNA Sequence Number=SeqID_58226
MGGMDECMKKCMTQMQFMNTGAREIVSVFKKVARTLRWFAKERGSKQNPCVMHMRKAQHESRIRFVPLFKGPIWERAKKVFSDNPQGGHISLDGL

SEQ ID NO: 149912 - protein, 206 aa, Glycine max
  Coding DNA Sequence Number=SeqID_58227
  Gene Ontology: Mol. function=endonuclease activity; Cellular component=cytoplasm
  Homolog annotation: Hit_ID=Q2HUP4; Match level="QueryCoverage=66%, HitCoverage=47%, E-value=1e-47, Identity=65%"; Hit description =Endonuclease/exonuclease/phosphatase
  Pfam annotation: Domain name=Exo_endo_phos; Domain location=1-205; Score=-13.2; E_value=0.028; Accession=PF03372.14; Description =EndonucleaseExonucleasephosphatase family
MFFVIALWHLICMCLQETKWTGEKAKELDNSGFKLWYTGKIRSRNGVGIIVDKEWKKDVVDVRRVGERIIALKLVVGQDTFNVISGYAPQVGLAEHFKVKVWEDLEGVLQDIPQGEKVFLGGDLNGHVGSVARGFEGVHGGFGLWEMNAEGKSILEFSEALDLSIANTWFKKREEHLITYKSGGTCSQIDFFLIRKSDRKYCLNCK

SEQ ID NO: 149913 - protein, 202 aa, Glycine max
  Coding DNA Sequence Number=SeqID_58228
MSLNSFLGRWVGEIKFFSGKILGLMVGYLLKINFQNYIKFIPKDYSFWQIWDLSFKMGGNGLSLRDEICLTLSNLLKPNVWVSNSFGILKSLLKPYHLFGDCFGIGFLLRITYLGDKLRLTMIFVPSIKANLSLPLICSSHVVKSCLCGGNSIHGCHNRPFNGRAMRDSRVRVPRKEYALSRHQRLFEENVGKTGKDVIYEL

SEQ ID NO: 149914 - protein, 178 aa, Glycine max
  Coding DNA Sequence Number=SeqID_58229
  Gene Ontology: Mol. function=DNA-directed RNA polymerase activity; Cellular component=chloroplast; Biological process=transcription, DNA-dependent
  Homolog annotation: Hit_ID=Q8HVY5; Match level="QueryCoverage=88%, HitCoverage=15%, E-value=2e-81, Identity=90%"; Hit description=DNA -directed RNA polymerase subunit beta
  Pfam annotation: Domain name=RNA_pol_Rpb2_1; Domain location=34-177; Score=49.8; E_value=9.5e-12; Accession=PF04563.6; Description=RNA polymerase beta subunit
MKNGSKSVEYCSIKFTGKLKMLGDGNEGMSTLPGLNQIQFEGFCRSIDRGLPEGLFKFPKIEDTDQEIEFQLFVETYQLLEPLINEKDAVFESLTYSAELYVSAGLIWKSSRDIQEQTIFVGNIPLMNSLGTSIQSPGIYSRSELDPSGISVYTGTIISDWGGRLELEIDRKARIWAR

SEQ ID NO: 149915 - protein, 48 aa, Glycine max
  Coding DNA Sequence Number=SeqID_58230
MSNATNEKHGCMRMMYSGSIANFYAGYGKWVYDPNMVGSWCLTHATKK

SEQ ID NO: 149916 - protein, 141 aa, Glycine max
  Coding DNA Sequence Number=SeqID_58231
MDPTTMLRMMHAPDLNSQMQCVFVEATQSYTVTPHQLGDHAWATRSFLPGDTPPSPRKYILPQFILSHMWHETMGVVKYLTMDELKRLSIPSEMLKFFNHSSFPHKGHPTRSLHSPMNVHNMHISMHFQHHQHSISISFST

SEQ ID NO: 149917 - protein, 126 aa, Glycine max
  Coding DNA Sequence Number=SeqID_58232
  Homolog annotation: Hit_ID=Q6UUU1; Match level="QueryCoverage=47%, HitCoverage=40%, E-value=1e-18, Identity=78%"; Hit description =Putative uncharacterized protein
RFAYWALAECILAYYVGTDEGVSEVLHVAGEKRLHRCVSRICDTGYIPLPRSLTRYARSFDCGERKWLTNGAEISWKMPGRYLTGKQFAPSWTVCTNPPFSPTAAPYPELGLGSHGAGLRLNWKDK

SEQ ID NO: 149918 - protein, 152 aa, Glycine max
  Coding DNA Sequence Number=SeqID_58233
  Pfam annotation: Domain name=zf-CCHC; Domain location=81-98; Score =18.6; E_value=0.0023; Accession=PF00098.14; Description=Zinc knuckle
MEHEMELQRLNQNEENYKKKRSIALKASSLVQEENEEEDSDDEEDFSFFVKKFQKYIKKRRIDRHQNFNNGRKSQDDSQVLRCYKFNQIGHIKANCPSNEEWSEKSEKKRFDERRTKKAYIAWDDNDSSDDSEKEINLLTKDYESDENISQG

SEQ ID NO: 149919 - protein, 77 aa, Glycine max
  Coding DNA Sequence Number=SeqID_58234
MRVVVGGDTEGLPKCFQGVYHQLLAFLRWFLSQVEMGKLGHMAGRRARFEFAHHGGCPSFLPKSLPTIISRLDDSLG

SEQ ID NO: 149920 - protein, 224 aa, Glycine max
  Coding DNA Sequence Number=SeqID_58235
  Homolog annotation: Hit_ID=Q2HW90; Match level="QueryCoverage=81%, HitCoverage=36%, E-value=2e-22, Identity=32%"; Hit description =Putative uncharacterized protein
MVEVSTESIASFAQYYDQPLRCFTFGDFQLTPTVEEFEEILGCPLGGKKPYLFSGFHPSLARISKIVKILTQELDRGKQVENGVVGVPRKCLEAKARTLASQDEWAPFVDVLALLIFGVVLFPNIDGLVDLATIDAFLAFHDRKESPVVAILVNLYDTFDRRCEKNSARIVCCTPSLYVWLVSHLFHQEVRHVCPLATAHAPRRRGKLGPTLSKQRRASVSWFP

SEQ ID NO: 149921 - protein, 68 aa, Glycine max
  Coding DNA Sequence Number=SeqID_58236
DLNSSNILYKGSLGVEMMYAPLELVGLGYSSSMDSFASWKMNGSGMEKEEREETPLQGEDESRRSSPP

SEQ ID NO: 149922 - protein, 127 aa, Glycine max
  Coding DNA Sequence Number=SeqID_58237
MDRAHKTPSGPEEVQQGPGVSNSGYGPLSVLQGARPPSEGSRPQDTQWTRRSPTGPWGFQLWLRASVSPIGCPFPQQGIAPTKTASGPGEVQQGPGVSSSGYGPLDRARKTPSGPEEVPQGLGVAKL

SEQ ID NO: 149923 - protein, 24 aa, Glycine max
  Coding DNA Sequence Number=SeqID_58238
MASGGYGRLTFVTLSGRTFATSWA

SEQ ID NO: 149924 - protein, 230 aa, Glycine max
  Coding DNA Sequence Number=SeqID_58239
IPQRTTLPRLERTTRPHHQRAARPHLQRTTCPRLERATRPHLGGLHALTLGTSYPRLERTTRPHHQRAARPHLQGLHVFALRGLHALTLGTSYCLIVEGTTHPRLERTTRPHFHSFLLTVPGPPPDIGGGPTVRAQPEREAITQLLCILGQDFTRAAAKRRQHSAQRPQCQSPPAEVSVGLCRPDMGIAPTKTPSEPEEVQQGPGVSSSGYGPLSVLQGARTPPARSRHH

SEQ ID NO: 149925 - protein, 72 aa, Glycine max
  Coding DNA Sequence Number=SeqID_58240
  Subcellular localization annotation: CTP_CleavageSite=31; ConfidenceScore=5.12e-01
GVYPDLSSLTGSGVYPDLSSLTGSGVYPDLSSFTGSGVYHDLSSFTGSGVIQTFVACIKRSTPTQCLSDFVS

SEQ ID NO: 149926 - protein, 193 aa, Glycine max
  Coding DNA Sequence Number=SeqID_58241
  Homolog annotation: Hit_ID=Q2AA09; Match level="QueryCoverage=83%, HitCoverage=51%, E-value=1e-07, Identity=27%"; Hit description =Retrotransposon gag protein
MERSMIDVASGGALGEMTPAEAKNLIEKMTSNSQQFSARNDAIVIRGVHEVATNSSSSGETKKLEGKLDALVNLVTQLAMNQKSAPVARLYGLCSSTDHHTDLCLSVQQSEAIEQPEAYAANIYNRPPQPQQQNQPQQNNYDLSSNRYNPEWRNHPNLRWSNPSQQQQQQKPYFQNVVGLSRPYVPPSIQQQQ

SEQ ID NO: 149927 - protein, 70 aa, Glycine max
  Coding DNA Sequence Number=SeqID_58242
MRMDRFALTLNRSQELPRLLAKAKAMADTYSAPKEIHRLLSYLLAIKIAIPWVMGLNQARAFTKRFIESS

SEQ ID NO: 149928 - protein, 106 aa, Glycine max
  Coding DNA Sequence Number=SeqID_58243
MGLTCQALKYLINEWQGKMILPSCLVQPPIVIADSPAVLHSCGDKLIPLIFYYCEACLLRNHLYWTHPLAVRIGVEGLIPGMSAKVHPMAFLCFLSTSSNLSSCSA

SEQ ID NO: 149929 - protein, 29 aa, Glycine max
  Coding DNA Sequence Number=SeqID_58244
MATLFVSDEVPSVVGTATMSTGGGPSGST

SEQ ID NO: 149930 - protein, 147 aa, Glycine max
  Coding DNA Sequence Number=SeqID_58245
MHARCGRTSPCSRWHTDLAQRTPHLLEPYDLSSASACRVYHHTTPMNRQAEQEWSGCIQTAARPSLVGNTQQQAPSAGDRNIMKSNESPGPLKGQSKNEFKIESRTLQDSRGKLISRIKIQEIKIQDSRIKRRLNQDKYEKVFSKTE

SEQ ID NO: 149931 - protein, 277 aa, Glycine max
  Coding DNA Sequence Number=SeqID_58246
  Gene Ontology: Biological process=transposition, DNA-mediated
  Homolog annotation: Hit_ID=Q6UUU1; Match level="QueryCoverage=21%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPVTTLNSIRFKSCFRANACEHTSHLNGRSPLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 149932 - protein, 206 aa, Glycine max
  Coding DNA Sequence Number=SeqID_58247
MGTRGCISYNLVLAIRQLGYPMRGAPLEEEIVPVISRGFNRPMWRHFRSLRTAKREEVEAPEEDEEVQALKAELEQAQTVKERFKSVALRIRKENAELRDINTATAKALEQETKRARKEEHGRDKFRGALWGSNSELKLRREERDQSRAHSMVLKEELAACSRSKRNLSQHLCETKTNMLAIVNKYQEELNLATAHEHKVADEYAR

SEQ ID NO: 149933 - protein, 91 aa, Glycine max
  Coding DNA Sequence Number=SeqID_58248
MEVGSGSYWKLEVGNESYWKLKVENGGWKLEGEVVVIIKKGENVNHEDFDDIKKNLLEKEGDVNHASFDGVEKKSYVCHHQKGGECECMYT

SEQ ID NO: 149934 - protein, 173 aa, Glycine max
  Coding DNA Sequence Number=SeqID_58249
  Pfam annotation: Domain name=DUF26; Domain location=93-133; Score= -4.4; E_value=0.023; Accession=PF01657.8; Description=Domain of unknown function DUF26
MESGHQIGRDRMKSKRFILIRPARFTKKYLKQYKPTIMENPYHSRASLLAVLVHADFTYENTVNSLLTSLVNSVAFANHNHNKFTVLASSDTIYSLFQCRSDLTLDCILQSKSLVRTCSNRKERRIFKKEFPGSKKYLRSTKLRQERGLRAIGQFELVYGRVEVEAARVLDLA

SEQ ID NO: 149935 - protein, 114 aa, Glycine max
  Coding DNA Sequence Number=SeqID_58250
MKTIDLKSKYVKLKPSLANLEKEEKDLEEQLKTIQDKLVTVRKQKDETIAAKAKVIKTQEETLAAAKIIAAPLVEQLQKEISPRKSGLVICRPQSFDQEAQQNETCLPALNIFA

SEQ ID NO: 149936 - protein, 58 aa, Glycine max
  Coding DNA Sequence Number=SeqID_58251
MALKLPRHTQPRQGRLGHNRCCLLDKAKGTKLTGVGGTLVPKVCNKPIPFQGRQTIPG

SEQ ID NO: 149937 - protein, 1330 aa, Glycine max
  Coding DNA Sequence Number=SeqID_58252
  Gene Ontology: Mol. function=aminoacyl-tRNA ligase activity; Cellular component=cytoplasm; Biological process=tRNA aminoacylation for protein translation
  Homolog annotation: Hit_ID=A7PSB7; Match level="QueryCoverage=33%, HitCoverage=100%, E-value=0.0, Identity=85%"; Hit description =Chromosome chr14 scaffold_27, whole genome shotgun sequence
  Pfam annotation: Domain name=Seryl_tRNA_N; Domain location=884-995; Score=148.8; E_value=1.5e-41; Accession=PF02403.13; Description =Seryl-tRNA synthetase N-terminal domain
  Pfam annotation: Domain name=tRNA-synt_2b; Domain location=1059-1233; Score=221.2; E_value=2.4e-63; Accession=PF00587.16; Description=tRNA synthetase class II core domain (G, H, P, S and T)
  Pfam module annotation: Pfam domain module=Seryl_tRNA_N::tRNA-synt _2b; Domain location=884-995::1059-1233
MAEEEEDDESFGDFTFASFPSQPTSNDTNPVDDDDDWGDFMNHSNQINGKPFDAFGVPTDPTNKHVNDNNGVAVQAEAAKKPKGAIPLSIFGEEEEEEEEQQEKPASANVFSNGGAVKRGSDSNGSVGISDLISSLYNQQRPQVDSHNNGSVSVSNVDAPNSTNSNGSKLNSDEVDEDDDGWEFKSAEWETGTKSQDVKVIDRIYLRLWIIELEAEENAGIDKYAETPKHDSGALDVGTVLDSSNGISDKAGGWHMEFEFSPRFASQDHINPQPSPKNESNDIGTGFAMFNQNFGEFSSGSGPGPNQNLEAPKKAGICATNMELLKFNGATPHGTIDSSLTSESHQSDEWNFGFNFNSSYVGEDNHSSDSYFKTKNNQDDNNRNNASPTNIDVDSHVNFFDSESDVTQHEKPLTSPENRREALPLSIFGDETPDTDEHPVSQDLSPYTPSSPIRNSFTSPGSNFSINDIWNLYNQAENQSSSNVTPKASENQIHAPPEVSGSSLVTGNDDLDDDFWDYKDAATETRFTNESAQKTSSPQVNENGLQSSPTFLNSDLTNGDDDFEDDSWEFKEATSGTINQDHTSTLDHRGLPQLSTKLEQVDYAEFYSKVKDELCNYVLFHLQNLKKTQNVAALSGEDAKAKALQEEISEFSKILHQDTMSIPNEYLSEDYCPRNVRFNELLEVLKEPKFQPVESEYQLASRLSMAEKDIKYGMELLKDTVSTLRILKLGSREEQSSYLTIWSKIAFVCSQELKHGAYVWKQAVLQNVHDQILSSQKGVQYILALGEIYRVAEIIEASAKLHKPWMLSGLEEALLSIANQNNFELDGISRELVESIKYIHELDEHALQSFVISGEQTTCQLSALPAGFIPVVAQVREVEGGVRMLDINLFREEKGHNPELIRESQRRRFASVEIVDEVINLDKEWRKRQFELENLRKEFNKINKEVSKLKRAGEDASKFITESEETKKSIAEKEVEVRETLNLLNSKLETIGNLVHDSVPISNDEANNVVVRSWGEKRVEPKLKNHVDLVELLGIADTKKGADVAGGRGFYLKGDGVRLNQALINFGLDFLDKREYTLLHTPFFMRKDIMSKCAQLAQFDEELYKVTGEGDDKYLIATAEQPLCAYHLDDWIHPTQLPIRYAGYSSCFRKEAGSHGRDTLGIFRVHQFEKVEQFCLTSPNDNDSWDMHEEMLKNSEDFYKALNLPYQVVSIVSGALNDAAAKKYDLEAWFPASQAYRELVSCSNCTDYQARRLEIRYGQKKSNEQMKQYVHLLNSTLTATERTICCILENNQKEDGVEIPEVLRPFMGGKTFLPFKSQPSNEAKGKKSKA

SEQ ID NO: 149938 - protein, 203 aa, Glycine max
  Coding DNA Sequence Number=SeqID_58253
  Gene Ontology: Cellular component=anchored to membrane
  Homolog annotation: Hit_ID=Q2HTL7; Match level="QueryCoverage=78%, HitCoverage=80%, E-value=6e-42, Identity=50%"; Hit description =Putative uncharacterized protein
MGHEDKEKDDDNNNTINNDDDDDDHVPQQQHTITCGHTRTRGDEEDLLHDINVYRKVLNLAVLDENEKASCLAEEIAEDLENTKCEDFRDYYPLPSYTSRIPSFQKSVNKCKININTTKDGVIMPVCVPKLDSDALFSNYTKSNRFSKYLNNSKYKIAGIGSEDDWMVLIISTNTSSGDFSSATSLLSGALKGHYLMMAFFLS

SEQ ID NO: 149939 - protein, 232 aa, Glycine max
  Coding DNA Sequence Number=SeqID_58254
  Homolog annotation: Hit_ID=Q84KA4; Match level="QueryCoverage=64%, HitCoverage=67%, E-value=3e-09, Identity=31%"; Hit description=Ctp
  Subcellular localization annotation: CTP_CleavageSite=47; ConfidenceScore=5.13e-01
MLKVKPYICTTHYPFSISDHPLSFPISILNPISLRLSQSHPTPTIPCAKRRGWSQPSNRKILQLASTVAFNLKILPEPFNSLAGEIARGDSQTLSFLVGGGRRGKIAPNRRVTKKKSAWFAFVLVCVAGGLWSWRIQEFDLFLRALSFCLAGISLLRLWLGKKAVREWVLGFFFGVVLILSSRLGKEDVKFWVHKLASSPVTQIVTTIKRSVQENAFELLLSSANGTWIHCF

SEQ ID NO: 149940 - protein, 99 aa, Glycine max
  Coding DNA Sequence Number=SeqID_58255
MEPQRSHYREITKIILEFMTAGEFSCEVGTDGKVLISGVTTTGENTVSRSCHEREMYMMAKFCPIRVLPFIPPHQAPTKVACMPCINAQSYHPQSYLSI

SEQ ID NO: 149941 - protein, 451 aa, Glycine max
  Coding DNA Sequence Number=SeqID_58256
  Gene Ontology: Mol. function=branched-chain-amino-acid transaminase activity; Biological process=branched chain family amino acid metabolic process
  Homolog annotation: Hit_ID=Q84L60; Match level="QueryCoverage=86%, HitCoverage=72%, E-value=1e-175, Identity=76%"; Hit description =Branched-chain amino acid aminotransferase-like protein
  Pfam annotation: Domain name=Aminotran_4; Domain location=258-451; Score=-82.9; E_value=9.3e-05; Accession=PF01063.10; Description =Aminotransferase class IV
MEVIHLWSAPRSLSTTVMYSFAQRDDIEVLDEPLYANFLRVTAVHRPYKEELLSKMESDGNKVVKDIIYRPGNSKYRFCKHMSKQRILGLPEDLMKKGKRFILIRNPLDILPSFDEVVPPSFFELGLAELVCIYNELCEIGKPPPVVDAAELQQDPEATLRALFNDLEIPFQPAMLNWEAGPKPIDGLWAPWWYKTVHKSTGFKEENKYPQIKSHKKIRYLEVGSKILAEEAIPSRHSLTYSSDLPVPANEKLLAWVGNEIVPRESAKVSVFDSVVQGGDSVWEGLRVYNGKIFKLEEHLDRMFDSAKALAFENVPTRDKIKEAIFKTLIRNGMFDNSHIRLSLTRGKKVTSGMSPALNLYGCTLIVLAEWKPPVYDNEHGIVLVTATTRRNSPNASSSVAATSPTTSALAACRMRSPSSATFASLPATARCSLTAVSSSMTMSPSSGSRR

SEQ ID NO: 149942 - protein, 144 aa, Glycine max
  Coding DNA Sequence Number=SeqID_58257
MYRFPLSFRIFLQHSKHISISIGRPHENCPSFNNLYMLDGQQISISSPGFIYESYEPREKIPFGKRKISMQQGQADILIVRFPDPNYGVKTPLPGQNEGDLVWILENKASNSALGQTPTSLYERVESISGFTKEHHLEIPTTPM

SEQ ID NO: 149943 - protein, 189 aa, Glycine max
  Coding DNA Sequence Number=SeqID_58258
  Gene Ontology: Mol. function=RNA-directed DNA polymerase activity; Biological process=RNA-dependent DNA replication
  Homolog annotation: Hit_ID=Q2HUJ1; Match level="QueryCoverage=82%, HitCoverage=71%, E-value=7e-12, Identity=28%"; Hit description=H+ -transporting two-sector ATPase, alpha/beta subunit, central region, related
MDFRRWRHDNTGFYSTNLPYKLLISAGVEEQVDTFPLLWKLKIPTKVAFMVWRALSNRLPSKDNLKKPNVINEEAKLMCGTCQHDFESTQHLFLSCKSGNANMAKMLCLDIPNIFHCPTWRFSGPSQAICRARNNKIFNNIEVDILKLMEDIKFQSWSWLYHQQPGSNHSIVLWSGNPVASIGGGKVKL

SEQ ID NO: 149944 - protein, 158 aa, Glycine max
  Coding DNA Sequence Number=SeqID_58259
MLESFKQQEQMLVLELYIEKDMAGGSMFHSGNSLTSCGNYLSNDETQSPTNMSNLHVNEDDDDDYLVSNSYIEESLDEDDSVDGIYDTDDKVTDMIQPVRIAHPAEVYKEFKIHFGMMLCIIIISTGVILMRRIFVVWRYHPVLMLAKNYMLAWTFVV

SEQ ID NO: 149945 - protein, 111 aa, Glycine max
  Coding DNA Sequence Number=SeqID_58260
  Gene Ontology: Mol. function=catalytic activity; Biological process =metabolic process
  Homolog annotation: Hit_ID=A2Q5Z6; Match level="QueryCoverage=72%, HitCoverage=24%, E-value=2e-33, Identity=81%"; Hit description =Phosphoglycerate/bisphosphoglycerate mutase
MLLKEDDHRHERRVVSSRIRFRKLSGGREDESFFESLWRDIHMNRLRHDPSNDLNFVIVSHGLTSRVFLMKWFKWTVEQFEHLNNFGNCEFRVMQLESDGEYSLAVNHTEE

SEQ ID NO: 149946 - protein, 180 aa, Glycine max
  Coding DNA Sequence Number=SeqID_58261
  Homolog annotation: Hit_ID=A7PFH0; Match level="QueryCoverage=18%, HitCoverage=12%, E-value=2e-08, Identity=85%"; Hit description =Chromosome chr11 scaffold_14, whole genome shotgun sequence
MGQLTSLSYFMVLHKCQMHTHFPMIATRHPAPATRFHDEVGGGALAYAILVRGDDNNAGDGVGELGLTIPLEEGRGGFGFWRGRGENGGGGGMRSWGRWWRREEGGEMRLGRGEREREKKMNDDEEEAQWLTSSFVVWLPFIRWDHTRYLAECEFEALKERVSGKRMGFRRVSCINASSE

SEQ ID NO: 149947 - protein, 271 aa, Glycine max
  Coding DNA Sequence Number=SeqID_58262
  Homolog annotation: Hit_ID=A7QWZ7; Match level="QueryCoverage=97%, HitCoverage=94%, E-value=1e-106, Identity=64%"; Hit description =Chromosome chr14 scaffold_211, whole genome shotgun sequence
MVEQSVLVLEKQGPNPVLSEGIHDWVFECHGLLHNAVLIIASFLFVLYLALQAKKSFLRLSHGRSYIIISYYASLWLVSILNLLWCFSQAWECSPGKEFAWNLLSLFTTSGMLFLEVSLLAFLLQGNSTSGLEALTRTFGISGIIVGFDILLKWNLWVIHKLLLTLVYGFILFMYHSRWRERLPARPAYYKYVTIMFILNAIALFACGITGNGAAFGFWLYHFTVVCYHAAYLPLLYITFLADFFQEEDLHLENVYYSEMKDAGFFEADWN

SEQ ID NO: 149948 - protein, 85 aa, Glycine max
  Coding DNA Sequence Number=SeqID_58263
  Subcellular localization annotation: CTP_CleavageSite=59; ConfidenceScore=5.21e-01
MYHFLFSVTTIQVDVPSTCTTKDVPSNVLRQSSQTGRIKRILRLCRFEFFDKGEGRHKRIQAVSPSFFWKREKRDTKRIQAVSPW

SEQ ID NO: 149949 - protein, 655 aa, Glycine max
  Coding DNA Sequence Number=SeqID_58264
  Gene Ontology: Mol. function=ATP-dependent helicase activity; Cellular component=proteasome core complex; Biological process =ubiquitin-dependent protein catabolic process
  Homolog annotation: Hit_ID=A9P853; Match level="QueryCoverage=89%, HitCoverage=92%, E-value=0.0, Identity=69%"; Hit description =Putative uncharacterized protein
  Pfam annotation: Domain name=DEAD; Domain location=46-222; Score =163.5; E_value=5.5e-46; Accession=PF00270.20; Description=DEADDEAH box helicase
  Pfam annotation: Domain name=Helicase_C; Domain location=307-416; Score=41.1; E_value=3.8e-09; Accession=PF00271.22; Description =Helicase conserved C-terminal domain
  Pfam annotation: Domain name=ResIII; Domain location=42-218; Score= -38.4; E_value=0.08; Accession=PF04851.6; Description=Type III restriction enzyme, res subunit
  Pfam module annotation: Pfam domain module=DEAD::Helicase_C::ResIII; Domain location=46-222::307-416::42-218
MAETHEDTPKETVHKEEEEEDQSFEELGVDARLLRALIKKRIEKPTPIQRVAIPLILEGKDVVARAKTGSGKTLAYLLPLLQKLFTANSDRKKLAPNAFVLVPTRELSQQVYAEVKSLVELCRVQLKVVQLNSNMLANDLRAALAGPPDILISTPACVAKCLSCGVLQAASINASLETLVLDEADLLLSYGYENDIKALTPHVPRSCQCLLMSATSRNRMGIPSYRFSADVDKLKKLILHNPFILTLPEVGNHKDEVIPKNVQQFWISCPASDKLLYILAVLKLGLVQKKVLIFTNTIDMSFRLKLFLEKFGIRSAVLNPELPQNSRLHILEEFNAGLFDYLIATDLSQSKEKDEVPKESIVGSRKSRKHAKIKLDSEFGVVRGIDFKNVYTVINFEMPQSVAGYVHRIGRTGRAYNSGASVSLVSTDEMDTLEEIRSFVGDDENKGTNSIAEFPLLTKNAVESLRYRAEDVAKSVTRIAVRESRAQDLRNEILNSEKLKTHFETNPKDLDLLKHDKILSKNAPPPHLRDVPEYLLDKPTKEAREMVKLARDAMGNNNRRKGSKRKLRKEGDPLKAIYATASSKRPHKARKTGGSDSLNSSDRHKHKKNKGPNIVKRKTVQISLSSMSLVSHGMWHAEDHIGDTRMSSHSKIVVA

SEQ ID NO: 149950 - protein, 62 aa, Glycine max
  Coding DNA Sequence Number=SeqID_58265
MSARVQPIAFLCFLRTDNNFSCSSTRETDIITGKLLLSSKLQFWCGRLDSGRKGDGFSACTT

SEQ ID NO: 149951 - protein, 41 aa, Glycine max
  Coding DNA Sequence Number=SeqID_58266
MGVPMATKPTRAFQDVPPEGGCFWRKQPSSPGRAELVWASW

SEQ ID NO: 149952 - protein, 38 aa, Glycine max
  Coding DNA Sequence Number=SeqID_58267
MHDSIMFEEVDMNVENEKDVGVKVEHIDCSDAFNTSQG

SEQ ID NO: 149953 - protein, 165 aa, Glycine max
  Coding DNA Sequence Number=SeqID_58268
  Homolog annotation: Hit_ID=O52175; Match level="QueryCoverage=49%, HitCoverage=94%, E-value=1e-32, Identity=85%"; Hit description =Salmonella berta plasmid pBERT, complete plasmid sequence
MAYERGGDFLEDARKILNREVRGPRQSRFSIGSAPLTSITKSDAQISGGETRQDYKDTRRFPLAAPSCALLFLPFGLPVSFRCYGRVCLIPRLTLSSGPTAAPYPVTIVLSPTRKDMQKHHWQQPLVIDLEELVLKSCAGLRLKLKGQVLVTALLQASYLGSKSW

SEQ ID NO: 149954 - protein, 54 aa, Glycine max
  Coding DNA Sequence Number=SeqID_58269
MEDAPVSPASPSRRRVGYDTIEDHIIAEEPRRVTQEDYSSSNVPQFFTSIAQPE

SEQ ID NO: 149955 - protein, 110 aa, Glycine max
  Coding DNA Sequence Number=SeqID_58270
MSTLKEQMDSMMEGMLGMKRLMESNAATATAASTAAEADPTLPITAHHPIPNIMGREGSTLGHVSNPHPGYNRGAYPYGLPPNYTPPAMHEDVGHVTPLILEGEPPRHPD

SEQ ID NO: 149956 - protein, 106 aa, Glycine max
  Coding DNA Sequence Number=SeqID_58271
MKAQVEKDEGPEAETLSRLLIVAEGPSNPCGVYPDLSSFTGSGVYPDLSSFTGSGVYPDLSSFTGSGVYPDLSSFTGSGVIQTFVACIKRSTPTQVHIIWYQSFGS

SEQ ID NO: 149957 - protein, 65 aa, Glycine max
  Coding DNA Sequence Number=SeqID_58272
MENSEKKNHSEKKLKAYITWDENDLESSEDSENEEINLCLMAKSYESDEEKRTWHINLLLQEKLQ

SEQ ID NO: 149958 - protein, 200 aa, Glycine max
  Coding DNA Sequence Number=SeqID_58273
DGPLGTSTLVSRGLYVLTFKGLHVLTFRGLHVLIFRGLHVLTFRGLHTLGSEDYTGLRALAFIGLHALTFRGLHVLIFRGLHVLTFRGLHALGSEDYTSSSSEDYMSSPFRGLRALAFIGLHALTFRGLHVLIFQRTTRPRLPRTTCPSPFRGLHELTFRGLHVLAFQRTTCPSPFTFLRTTRPYLSVGYTPLGLSKGLC

SEQ ID NO: 149959 - protein, 67 aa, Glycine max
  Coding DNA Sequence Number=SeqID_58274
DLEEDPVELPPEPTMDALDLPEDDEDPLPDVDSPEDIMSASEADSTEESGPGGTANSDDSSSEQMAP

SEQ ID NO: 149960 - protein, 119 aa, Glycine max
  Coding DNA Sequence Number=SeqID_58275
  Subcellular localization annotation: CTP_CleavageSite=56; ConfidenceScore=5.45e-01
LPSLGTDVWGANTFPVRKYNSRTFHLKVRRSRLFRFFRRFPQIDVGGDSARIPFVEQASRESRVALPLKGVPLESPQQLVSEPLVQVGDWLRQVCKYRRWPEWLAGRASTAGGHGYTRR

SEQ ID NO: 149961 - protein, 190 aa, Glycine max
  Coding DNA Sequence Number=SeqID_58276
  Gene Ontology: Mol. function=homocysteine S-methyltransferase activity; Cellular component=intracellular; Biological process=folic acid and derivative biosynthetic process
  Homolog annotation: Hit_ID=A6BXE6; Match level="QueryCoverage=68%, HitCoverage=10%, E-value=5e-53, Identity=74%"; Hit description=5 -Methyltetrahydrofolate--homocysteine methyltransferase
  Pfam annotation: Domain name=S-methyl_trans; Domain location=75-190; Score=-82.5; E_value=0.0011; Accession=PF02574.7; Description =Homocysteine S-methyltransferase
MSGGVGKPGLLRQLGALAAGAVRGFLPRFAGAGVAITSPQSLQYDWLAFSQRNDVDGARVSNKTATLQQQLAQRIMILDGGMGTMIQSYKLDEQDFRGSRFADWPCDVKGNNDLLVLSKPDVIREIHDAYLAAGADILETNTFNATPIAMADYEMAALSAEINFEAAKLARACADAWTAKTPDRPRYVAG

SEQ ID NO: 149962 - protein, 36 aa, Glycine max
  Coding DNA Sequence Number=SeqID_58277
MGSKIYPKVHENPKAFFSSSSPILLESSIQYPWGAF

SEQ ID NO: 149963 - protein, 224 aa, Glycine max
  Coding DNA Sequence Number=SeqID_58278
  Homolog annotation: Hit_ID=UPI00006A2D9E; Match level="QueryCoverage =72%, HitCoverage=85%, E-value=5e-11, Identity=17%"; Hit description =UPI00006A2D9E related cluster
LHALTLRGLHVLALRGLHVLIIRGLHALTSRGLHVLALRELPALALGLHGLAIRGLHVLTFVGLHALTFRGPHILTFRGLHALAIRGQHVLTFLGLHALTYRGLHVLANRGLHALTLRGLHVLANRGLHVLTIRGLHALTSRGLHVLALRGLPALAFGLHTLAIKGLHVLTFLGLHALTFRGLHVLANRGLHALTLRGLHVLALRGLHVLTIRGLHALTSRGLH

SEQ ID NO: 149964 - protein, 133 aa, Glycine max
  Coding DNA Sequence Number=SeqID_58279
MASRKLASKRSRKDKAAEGTSSAPEYDSHRFRSAVHQQRFEAIKGWSFLWERRVQLRDDEYTDFQEEIGRRRWASLVTPMAKFDPDIVLEFYANAWPTEEGVRDMRCYRLAPGISVGAGRGPRVRVWPEEEPV

SEQ ID NO: 149965 - protein, 37 aa, Glycine max
  Coding DNA Sequence Number=SeqID_58280
MIEGTADNLGTKDHNDQGIQGLGVNVDGSSLQKIACI

SEQ ID NO: 149966 - protein, 282 aa, Glycine max
  Coding DNA Sequence Number=SeqID_58281
  Homolog annotation: Hit_ID=A4WD45; Match level="QueryCoverage=88%, HitCoverage=71%, E-value=1e-111, Identity=82%"; Hit description =Putative uncharacterized protein precursor
  Pfam annotation: Domain name=DUF1176; Domain location=1-282; Score =301.9; E_value=1.3e-87; Accession=PF06674.2; Description=Protein of unknown function (DUF1176)
MTLTRSAGAKTDATLRIDLGGLDTPSVKEPEIASRLLLDNVPLKLDKQRWQLTPWHLKTDDAATITAFLKNIQEGKALTLRGGKQVISLSGLKAALLFIDAQQKRVGSETAWIKKGDDPPLSVPPAPALKKVATVNPTPTPLSHAELNDLLDYGTGRMNSSQCSLDPNRREVRVTALTDEKALLIVSCEAGAYNTVDLAWLVSRKKPFSARSVRLRLPFTPSSGSSEMELMNASFDEKTRELTTLALGRAAITGMGQMPGPRCGSPASFDLPGLQNIRTVGR

SEQ ID NO: 149967 - protein, 87 aa, Glycine max
  Coding DNA Sequence Number=SeqID_58282
MATMMEAMMSMKKIMEANAVAVIATSAVAKVNPMPPSGLNQMNHPTSARVGQMNPIYAQIQNKHAFPPYGLPPNYTPPNVAYTPNED

SEQ ID NO: 149968 - protein, 270 aa, Glycine max
  Coding DNA Sequence Number=SeqID_58283
  Gene Ontology: Mol. function=transmembrane receptor activity; Cellular component=membrane; Biological process=signal transduction
  Homolog annotation: Hit_ID=A2SCK8; Match level="QueryCoverage=95%, HitCoverage=65%, E-value=5e-47, Identity=42%"; Hit description =Methyl-accepting chemotaxis protein I
  Pfam annotation: Domain name=MCPsignal; Domain location=34-256; Score= 266.5; E_value=5.5e-77; Accession=PF00015.12; Description=Methyl -accepting chemotaxis protein (MCP) signaling domain
MVAPIHTVKQAAETIHVAAAEIEKGNNDLSRRTETQANALQETSANLETLTNNIRQTAEHAHQASLQASQANQMAVQGGEAFNALTTTMQGINETSAQIAQITSVIDSIAFQTNILALNAAVEAARAGEEGRGFAVVAGEVRNLAKRSAASAKEIKELIAASVSQTNASAKQVSQAGHTMHEIVNAVQQVSHSIQVISEASSQQSSGLEQIYESMTSIDETTQQNAALVEEAAAAAESMLEQVHTLVESVNQFKMDADDTNDHGRLRLIA

SEQ ID NO: 149969 - protein, 144 aa, Glycine max
  Coding DNA Sequence Number=SeqID_58284
  Homolog annotation: Hit_ID=A5BSR3; Match level="QueryCoverage=78%, HitCoverage=38%, E-value=4e-07, Identity=32%"; Hit description =Putative uncharacterized protein
MEEAAQSESTEALIDPLSPIRRHVKWKRARTKKIGQMTYEATKEILEKIESQGSFVPHGRQDVLIAAIGQPEHPGRVHAAGTGVTMKQYFESAPRTSRTSSSMDSKELEQLTQQIRDQLEESIIEKVTRQLMLSFSQMQSQFQS

SEQ ID NO: 149970 - protein, 85 aa, Glycine max
  Coding DNA Sequence Number=SeqID_58285
MSVRNCYDGQRAGIECGLFAITPAAKGGCVYWLTMLGLPRLTPTARSFDAATESGPYTGRNSITIVIFARKLNGSAEGRGKAVFP

SEQ ID NO: 149971 - protein, 88 aa, Glycine max
  Coding DNA Sequence Number=SeqID_58286
  Subcellular localization annotation: CTP_CleavageSite=68; ConfidenceScore=5.07e-01
MGIAPTKTPSGPEEVQQGPGVSSSGYGPLLVLQGARTPPSKVMPSRHRDRARKTPSGPEEGQQGLGVASSKYGSLSVLGSACRPQQGH

SEQ ID NO: 149972 - protein, 62 aa, Glycine max
  Coding DNA Sequence Number=SeqID_58287
MDECSVPVLLVIMDAKSYRQVYRVVQMFMCSILRTTFPNIDVSHEWTNSNKTLFSDVSSNLA

SEQ ID NO: 149973 - protein, 83 aa, Glycine max
  Coding DNA Sequence Number=SeqID_58288
MSRNLMDYAIIPSLASGMFQNFSDCALTCPFNSRHVTELHGLPNDECQVPQSGQARVAPQQTDDPRTKLGYDSCPSLLVFYWR

SEQ ID NO: 149974 - protein, 171 aa, Glycine max
  Coding DNA Sequence Number=SeqID_58289
MTADMVALKDQTASMMEAMLSMERIMESNAAAVVAASAATEADPTHPSAINQSHQPVPDMVGQGGEVLGSASGPHMGYIIGMLTPMAYPPIICRPLCTWPKRTPIMSFLLPLRVRNPNLWEVPVKNLGSMLKVTLIHIPHSPPRGRCLMLCLNPILRELLNPALYNCCISQ

SEQ ID NO: 149975 - protein, 270 aa, Glycine max
  Coding DNA Sequence Number=SeqID_58290
  Gene Ontology: Biological process=transposition, DNA-mediated
  Homolog annotation: Hit_ID=Q6UUU1; Match level="QueryCoverage=22%, HitCoverage=40%, E-value=3e-18, Identity=78%"; Hit description =Putative uncharacterized protein
WNSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGDCPASASQVARTTGTSHQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 149976 - protein, 102 aa, Glycine max
  Coding DNA Sequence Number=SeqID_58291
MLGKLGRIDGDPVLRETRIWATWEYVSSVGGGQQGMVGLCAICGCGKTCCAPSPDRHLVPHVMEWYQEICRGGQETLGTSSGVLLPKTKLDQSRPNPGIVSQ

SEQ ID NO: 149977 - protein, 288 aa, Glycine max
  Coding DNA Sequence Number=SeqID_58292
  Gene Ontology: Biological process=transposition, DNA-mediated
  Homolog annotation: Hit_ID=Q6UUU1; Match level="QueryCoverage=20%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGIRSIKAIVATPYNWILHSCQGIKSRLTNKYDQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 149978 - protein, 126 aa, Glycine max
  Coding DNA Sequence Number=SeqID_58293
  Subcellular localization annotation: CTP_CleavageSite=60; ConfidenceScore=5.02e-01
MRKGLLLFLPSIGGTKSDCSTSYPGQKLVPSILLFSVHERWLRSRTCMPCISCWNKCETNQTQRAGKQQMICALLFCAPSVNMCQTNPARTCYHRTFLAMAVCKESVELLLGLPTIHVWKEDDPKN

SEQ ID NO: 149979 - protein, 83 aa, Glycine max
  Coding DNA Sequence Number=SeqID_58294
MAPDRMQLQKVCKKGDGSFKEHAQKVEGSGGPGGTPNNGKGDDNRDGRHIIGKFDHPTRTTEKTGANKEGEDEGETHAVTAIP

SEQ ID NO: 149980 - protein, 72 aa, Glycine max
  Coding DNA Sequence Number=SeqID_58295
MTIMVSQRALLRASEGEAHGCAFQRRKDARSRHQRLFVENVGKTEGNRSTKAGLLLLRTLYQRGNQTYVVLS

SEQ ID NO: 149981 - protein, 42 aa, Glycine max
  Coding DNA Sequence Number=SeqID_58296
MAPRKLSLKRSRRDTAAKGTSAATEFDSHQEGVWDMRSWVRG

SEQ ID NO: 149982 - protein, 288 aa, Glycine max
  Coding DNA Sequence Number=SeqID_58297
  Gene Ontology: Mol. function=helicase activity; Cellular component =chromatin; Biological process=viral genome replication
  Homolog annotation: Hit_ID=Q2A9E0; Match level="QueryCoverage=98%, HitCoverage=19%, E-value=6e-77, Identity=49%"; Hit description =Putative uncharacterized protein
MDRPEYVWKQTWQWMVDDIVFNHRRQGIQLTDKEKMHLCLTEIENLLQANRKSLRDFPSMPYPLGYAAKMHQNNLIYNELAYNREILAAKFDKCYQSLTDEHASIFNKIMHVVATQSGGVYFLYGYGGTGKTFVWKTLSSAIRSTGGIVLTIASSGIASILLPGGRTTHSKFAILVPATKNSTCNIHQGSDLAELLHITKLIIWDEAPMCHRYSIEALDKSLQDIMHNNNPFGGKVIVFCGDFRQILPVVPRGNRSDIVYATLNSSYIWNHCQILKLTKNMRLAIKSY

SEQ ID NO: 149983 - protein, 131 aa, Glycine max
  Coding DNA Sequence Number=SeqID_58298
SCFGLRVVRSLEFYRWLRGLLLRVPESCKCCLLQVFLCKKNQSSLHRGEFTPSYKFLLGQHGKNLAIFLMKSLVTSVKIKSLLVRQIGIRLQGQEMANGVSFLAYYSKCFFDAHKETTMIIELQDEIGLRY

SEQ ID NO: 149984 - protein, 237 aa, Glycine max
  Coding DNA Sequence Number=SeqID_58299
MAKSSKKRKGSSSTTIAIGHHRHGTSGDPPTLVPPFLSSPQSSILFSCDDQHQRYYSQLCNRVILDPKYLDLEFFDGETIDCYQVFQNSTLVDLMSLKLPYFPKLVKVFYNNLKIQDGVLYFEVHHIPIVVDQSLFYSLTKLPSQGVPFEGTLMDEWKFDYSSHDARRMVCNDQANMIEKLLAGLFTFDCRIMHYIIVHILLPRSSNLAQASKEDLILLWAIQTVGSSGLRITKKGG

SEQ ID NO: 149985 - protein, 36 aa, Glycine max
  Coding DNA Sequence Number=SeqID_58300
MELTPPEKRYGPFPPRGHPKISSNSSTMGDSWKSPK

SEQ ID NO: 149986 - protein, 123 aa, Glycine max
  Coding DNA Sequence Number=SeqID_58301
  Gene Ontology: Mol. function=catalytic activity
  Homolog annotation: Hit_ID=A5BF43; Match level="QueryCoverage=69%, HitCoverage=20%, E-value=3e-18, Identity=50%"; Hit description =Putative uncharacterized protein
MKHMMLMPQNGGSRGDVHVEDNQNMSFPSWEGTFMRWFSEIDEKLAKNIDTDGFRGGSTSVSVIKQGDQVIIGNVGDSRAVLCRRAPDNHLIPVQLTVDLTPDIPTIFIKNLLDESFFQDFFG

SEQ ID NO: 149987 - protein, 182 aa, Glycine max
  Coding DNA Sequence Number=SeqID_58302
  Homolog annotation: Hit_ID=A8GIB7; Match level="QueryCoverage=100%, HitCoverage=100%, E-value=8e-97, Identity=93%"; Hit description=YaeQ family protein
  Pfam annotation: Domain name=YaeQ; Domain location=1-181; Score =420.4; E_value=2.6e-123; Accession=PF07152.3; Description=YaeQ protein
MALKATIYKAAVNIADMDRHFYHDATLTLAQHPSENEQRMMLRLLAWICHADERLVFTKGLSADDEPEIWQRNDHNGLEMWIEMGLPDEKRIRKACNQSPRVVLYAYGERAAHVWWQGMQGKVAGYKNLSVRFLDDEQLARLTALASRTMTLQATLQEGTIWLSDAQNSLEIQFAEWQQAQV

SEQ ID NO: 149988 - protein, 373 aa, Glycine max
  Coding DNA Sequence Number=SeqID_58303
  Gene Ontology: Mol. function=transferase activity, transferring glycosyl groups; Cellular component=cytoplasm; Biological process =carbohydrate metabolic process
  Homolog annotation: Hit_ID=Q608L7; Match level="QueryCoverage=49%, HitCoverage=37%, E-value=1e-51, Identity=54%"; Hit description=4 -alpha-glucanotransferase
  Pfam annotation: Domain name=Glyco_hydro_77; Domain location=1-190; Score=-204.4; E_value=0.00051; Accession=PF02446.8; Description=4 -alpha-glucanotransferase
  Pfam annotation: Domain name=ROK; Domain location=175-350; Score =123.4; E_value=6.5e-34; Accession=PF00480.11; Description=ROK family
  Pfam module annotation: Pfam domain module=Glyco_hydro_77::ROK; Domain location=1-190::175-350
AAWEIPAYEPTAMNGAWYEAPGQALLQAISETFPQLSLVAEDLGIITADVDALRHAFDLPGMKILQFAFGGGEDNPYLPENVEENSVAYTGTHDNDTTLGWYQVAPENVRNHLHYYLKQEHPDMPNALIQLTFNCISRLAIVPIQDILGLDSQARMNTPGTIDGNWRWRMQWSQLTAEKMQSFRHLANYSAICKEFEPAKAWQTILQVTADAIRPLLDKYAGIQAIGIGFPGFIDPQTGVLAQSPNLPGLRNVNLGHDLGQLLGLPVRVENDANAAAYGEFCHLSQPAGGLLYLGLGTGVGAGLVVNHHVWAGQHGYALEAGHIIVVPDGPLCGCGNQGCVEQYASATGISRAYADLAGQTLSAQEIALAAQN

SEQ ID NO: 149989 - protein, 143 aa, Glycine max
  Coding DNA Sequence Number=SeqID_58304
KAYMAFRLYARTVFKRHAACIIPFDKHIAAVKTTSNNMLSKRKTLDEGSLLSSKSETQHDHRFTSTPYVPMDPREPTKEEVMILHEIRRPNSLKTIPTGVANCRNLPFGGRATRGLTGVSSKKGKCAELPPTFIRGKRRKNWK

SEQ ID NO: 149990 - protein, 124 aa, Glycine max
  Coding DNA Sequence Number=SeqID_58305
  Homolog annotation: Hit_ID=A5BSR3; Match level="QueryCoverage=51%, HitCoverage=19%, E-value=8e-07, Identity=37%"; Hit description =Putative uncharacterized protein
  Subcellular localization annotation: CTP_CleavageSite=57; ConfidenceScore=5.77e-01
MGSPPASTTPPPSPPRPPPTSDASASTSAVKRTRKASCPRSLSTRPPGVERPVVHVDPATGKADGPHKKKLRTYLGIVARDKVDITYENWKKVPTAQKDLIWEDIQAEFDIPEASDSRTKRKLL

SEQ ID NO: 149991 - protein, 110 aa, Glycine max
  Coding DNA Sequence Number=SeqID_58306
  Homolog annotation: Hit_ID=Q87NM1; Match level="QueryCoverage=94%, HitCoverage=61%, E-value=2e-08, Identity=34%"; Hit description =Putative uncharacterized protein VP1847
  Pfam annotation: Domain name=DUF1311; Domain location=54-108; Score= -25.0; E_value=0.06; Accession=PF07007.3; Description=Protein of unknown function (DUF1311)
MVNLITIIYASDFLKFVALKARNVTMKKWLPLACLFASSVAMAQQNPIDQQLNQCLNKESSTTGMSQCYSTANKAWDKEMNAQYSQLMKKLTGEPKDKLRNAQRRLAGLP

SEQ ID NO: 149992 - protein, 138 aa, Glycine max
  Coding DNA Sequence Number=SeqID_58307
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=62%, HitCoverage=72%, E-value=2e-24, Identity=68%"; Hit description=LacZ protein
MKHFTDTLISANILSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 149993 - protein, 39 aa, Glycine max
  Coding DNA Sequence Number=SeqID_58308
MAALHCLTALAHPRKKIPNMGSAAGASLCWSPAWVGVMK

SEQ ID NO: 149994 - protein, 146 aa, Glycine max
  Coding DNA Sequence Number=SeqID_58309
  Subcellular localization annotation: CTP_CleavageSite=38; ConfidenceScore=5.34e-01
MSISPCGSISWSVSFRHRDRAHKTPTGPGGAQQGPGVSSSGYRSLSVLQGARPPSKESHPQRHPVDPKKSNRVLGFPALVTGLCSPAGCPLPPTRSRHHDIGIAPVRHPVDPKKSNRALELPALIMGLCQFYGVPVAPQQGHQAPY

SEQ ID NO: 149995 - protein, 255 aa, Glycine max
  Coding DNA Sequence Number=SeqID_58310
  Pfam annotation: Domain name=Transposase_23; Domain location=134-204; Score=1.6; E_value=0.0008; Accession=PF03017.5; Description=TNP1ENSPM transposase
MTSKAAKEIAEKIDVLTAVIGRPKHPGRVRVAGAVVTIKQYIGSTPRSSRSSSSIPLEELKQLTQQIKDQLEELIIEKVTRQLMASFSQMQSQLQSQMQSQGLALPPESEVGPSATRVSTKGSCVDPSPTDPETGDSDKCGLYIEKNLSRLVALGRVYEGSTTVHNIPLLHGHVKVGVEGVEDAEVPVPVPTDEVILVGQALNTFLAWATHLVKRVSEQAVVSPAKPLDRPDHKVDDPLYLMKLIIPQLFLKHLQ

SEQ ID NO: 149996 - protein, 148 aa, Glycine max
  Coding DNA Sequence Number=SeqID_58311
MTEALKRGSRKVPQFLRMRTHKKYMKRTCFGYQPRVTFQNDWKASVWGTLPSWKTEENEERTIECRRTVENLLITHGKRYEKIASAYFSSGNNFPQQLSREYEGKLVHPARPGELSSPRRVSGESTISFYLKGDHLKVLDLKNDPLTW

SEQ ID NO: 149997 - protein, 105 aa, Glycine max
  Coding DNA Sequence Number=SeqID_58312
  Homolog annotation: Hit_ID=A5C0C2; Match level="QueryCoverage=67%, HitCoverage=3%, E-value=3e-09, Identity=34%"; Hit description =Putative uncharacterized protein
MPDEHQQRVTLEDYSSSSVSQFFTSIARPKGNLFQGLPNEDPYAYLATFIEICNTVKIAEEAKRWLHSFKGNSLKTWEEVVEKFMKKYFPESKTAEGKAAISSFH

SEQ ID NO: 149998 - protein, 138 aa, Glycine max
  Coding DNA Sequence Number=SeqID_58313
MIRGDTLRLSAPFCHPEAAGPMTSRDQVWSFCTLVSSRGGGPDDTRRYLTVIRTLLSSRGGGPDDKQRPKAAGPMTSRDQIWSFCTLVSSRGGGPDDTQRYLTVIRTLLSSRGGGPDDKQRPNLVILHPCIIQRRRAR

SEQ ID NO: 149999 - protein, 104 aa, Glycine max
  Coding DNA Sequence Number=SeqID_58314
AICLTSGINVNHEDFDDIKKNLLEKEGDVNHASFDGVEKKSHVCHHQKGENVNVCIHDLDDVKEESNKTKPCLKTKCFQDMQGSGNRLPRSVIDYQKTGLRNSC

SEQ ID NO: 150000 - protein, 90 aa, Glycine max
  Coding DNA Sequence Number=SeqID_58315
  Homolog annotation: Hit_ID=A5BFR9; Match level="QueryCoverage=100%, HitCoverage=7%, E-value=2e-22, Identity=65%"; Hit description =Putative uncharacterized protein
VRDLLKAIDEQFTTSEKSLASTLIMQFSSIKLTGTRGVREHIMRLRDIVAQLKTLKVTMSESFLGMESLRKLVGSEQCIYSGSRMRSHVE

SEQ ID NO: 150001 - protein, 87 aa, Glycine max
  Coding DNA Sequence Number=SeqID_58316
  Subcellular localization annotation: CTP_CleavageSite=63; ConfidenceScore=5.21e-01
MSSAKSRHLGAISWICSVRTSRIKIGTNVLLLHSSGMRFDLIISLKSSVSHSRPLSPRVFHTSIGMLSGPTALPLLILFNASFTSCF

SEQ ID NO: 150002 - protein, 87 aa, Glycine max
  Coding DNA Sequence Number=SeqID_58317
  Homolog annotation: Hit_ID=Q2AA09; Match level="QueryCoverage=72%, HitCoverage=22%, E-value=8e-08, Identity=44%"; Hit description =Retrotransposon gag protein
  Pfam annotation: Domain name=Retrotrans_gag; Domain location=19-85; Score=19.4; E_value=0.00071; Accession=PF03732.8; Description =Retrotransposon gag protein
MAEEPRRVTLEDYSSSSVDSVLIFLAGEAKRWLHSFKGSSLKSWDEVVEKFLKKYFPESKTAEGKAAISSFHQFPDESLSEALERFR

SEQ ID NO: 150003 - protein, 240 aa, Glycine max
  Coding DNA Sequence Number=SeqID_58318
  Gene Ontology: Biological process=transposition, DNA-mediated
  Homolog annotation: Hit_ID=Q6UUU1; Match level="QueryCoverage=25%, HitCoverage=40%, E-value=3e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPVTTFIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 150004 - protein, 111 aa, Glycine max
  Coding DNA Sequence Number=SeqID_58319
MNNMIMLQHTEIKASFETSTHMVGHVFKVTLYKRLLGMVSSNSLVKRSASSSDQPIPRRTMPIFDQFHPFIHDFINNIVDVKADGNCGYHAIDALLGMGEDSWSLVHNHLL

SEQ ID NO: 150005 - protein, 87 aa, Glycine max
  Coding DNA Sequence Number=SeqID_58320
SFTFFPLRSRPPVDSAAHRIICVSHVFGSHFVQVYLKDRCPLLPMALLWSSNVYLEAKQWPTAYVGRMQQYLSLMTINTTHVDLSGH

SEQ ID NO: 150006 - protein, 148 aa, Glycine max
  Coding DNA Sequence Number=SeqID_58321
MGEVEEIQEKMKADMEAIKEKMATMMEAMMSVKKIMEANAVAIAATSVVAKVNLMSPSGINQMNHPTSNMVGKDLGSTNDPMMCKFKTSTPSHHMACLPTIHHPIWRTLPIRMSITPLLYPLKASNPKLIMHMSLKLWKRPMKFPITI

SEQ ID NO: 150007 - protein, 211 aa, Glycine max
  Coding DNA Sequence Number=SeqID_58322
MPSLYDRTTKLEETLAQLIDVSMSNQKSTESAIKNLEVQVGQLAKQLAERLSNNFTTITEKNHKEYKADQKVEGFKQQLADEPELEPVDDFVELEEIVQQEEGDEEEETPIRDSQEKIKKEEKEKEKEKEIKKEEKEKEKEKKLKNEKRKEKVVKIEKKKSKSEANIEKKKEATPIECKEVTGVLSFNAFFHPSTKILKLSRYRVLSARLL

SEQ ID NO: 150008 - protein, 163 aa, Glycine max
  Coding DNA Sequence Number=SeqID_58323
DRAHKTPSGPEEVQQGPGVSSSGYGPLSVLQGARSPSEESHPQRHPVDPENSCPTGPLGYYPLFRGLWMTGPLCRTLLGGPDRSTYTGSTEYLSPPARASGPPYYIKLSSRSTASPGRRRSEIPQQPGDGRQRATDAPHSASRVHLSSIHKKVRACLRPMSDQ

SEQ ID NO: 150009 - protein, 149 aa, Glycine max
  Coding DNA Sequence Number=SeqID_58324
  Homolog annotation: Hit_ID=A5AZG1; Match level="QueryCoverage=63%, HitCoverage=30%, E-value=2e-08, Identity=36%"; Hit description =Putative uncharacterized protein
  Pfam annotation: Domain name=zf-CCHC; Domain location=85-102; Score =21.5; E_value=0.00084; Accession=PF00098.14; Description=Zinc knuckle
FFTFCFKPPTRKNHNLEANLDWEIRVEQQLKKKSTSKSYGSHSYPKKDQGQGILGVTPSKTKYDKGKTIEKQPLKASMQEKTSSMKCFKCLGRGHITSQCPTKKTMIMRGQDIYCSQDEATTLPSSSESEEAKEEESSEEIYPKKKDNL

SEQ ID NO: 150010 - protein, 17 aa, Glycine max
  Coding DNA Sequence Number=SeqID_58325
MDTRLRVIGDPMNEVQR

SEQ ID NO: 150011 - protein, 126 aa, Glycine max
  Coding DNA Sequence Number=SeqID_58326
  Homolog annotation: Hit_ID=Q2HW89; Match level="QueryCoverage=26%, HitCoverage=3%, E-value=2e-08, Identity=82%"; Hit description =Integrase, catalytic region; Ribonuclease H
MKNVFDKKEGPFVVKRAFSEGALVLTDMDGEELPLPVNSDVVFLFAVIVSSQLFKRICRGRFLLIVVAGQNVAKLQRHPYPCKSGHPPSLDVLAQLVALQYQGVAQELIKGNYWPLNRERKSRLSI

SEQ ID NO: 150012 - protein, 69 aa, Glycine max; identical to SEQ ID NO: 109083
  Coding DNA Sequence Number=SeqID_58327

SEQ ID NO: 150013 - protein, 137 aa, Glycine max
  Coding DNA Sequence Number=SeqID_58328
MHDPQHEAPRDQTLADFEPHLGCSTKGKAFGGIPLPNTLGGPQYRPQPQPLHLALERLPPAMVEREKFDHIEERLRAIEGGGDYAFVDMAKLCLVPDVIIVRQVASDILRRGNSFTTRDPRSLNPLENEEKKKNESL

SEQ ID NO: 150014 - protein, 123 aa, Glycine max
  Coding DNA Sequence Number=SeqID_58329
MKEGMGHILDLTPIGEKRKESLKGLTLASHTSMGRTIGHITSQCPTKKTMIMRSQDIYSSQDEATTSPSSSESEEAKGEESSEEIYPQEEGKPLMVKEECKEVSVSSKRLAKTENHFAIQTNI

SEQ ID NO: 150015 - protein, 282 aa, Glycine max
  Coding DNA Sequence Number=SeqID_58330
  Homolog annotation: Hit_ID=A5B5G7; Match level="QueryCoverage=80%, HitCoverage=15%, E-value=3e-07, Identity=23%"; Hit description =Putative uncharacterized protein
MASRKRKAPSTPTQVRFDRSRFTSQEDWERYTDVIVPSKLLPERNVVVYYTEFDEFKEKLERCHWDEELTDFGDGNIDVAIVKEFYANLYDPEDKSPKQVRVRGHLIKFDEDTLNTFLKTPVIVEEGESLCAYSRFAIPRHNPQELAAKLCIPGRGFELNVNGQPLKILRKKMTTLAQTCSVLSFSNLIPTSHTSDVTLYRARVIYGIIMKMDMNVRYLISYQISLTAQHDTSRLGFLAKGVQYDSRSLESLNPAINLAYIKKNFWNLDDPTVTFRGLRKAK

SEQ ID NO: 150016 - protein, 90 aa, Glycine max
  Coding DNA Sequence Number=SeqID_58331
  Homolog annotation: Hit_ID=UPI0000ECBAF8; Match level="QueryCoverage =45%, HitCoverage=48%, E-value=1e-16, Identity=100%"; Hit description= UPI0000ECBAF8 related cluster
MTMITNSSSVPDVTIEAELLLAFWANNRKSRLVSCVPSMQAWHWPSFYNVVTGKTLALPNLIALQHIPLSPAGVIAKRPAPIALPNSCAA

SEQ ID NO: 150017 - protein, 300 aa, Glycine max
  Coding DNA Sequence Number=SeqID_58332
MKRGMIDAASGGALGDMTPAEARNLIEKMASNSQQFSARSDAIVIRGVHEVAMNSSGETKKLEGKLDALVNLVTQLAMNKKFAPIARLCGLCSSTDHHTDLCPFVQQYEAIEQPEAYAANIYNRPPQPQQQNQPQLNNYDLSSNKWSNPSQQQQPQQQTYFQNAAGPSKPYVLPPIQQQQQQQPQKQQTVEAPPQPSLEELVRQMTMQNMQFQQETKASIQSLTNHMGQLATQLNQQQSQNFDRLPSQFVQNPKNVSAITLRSGKQCASKEKQHIPLSFPPRAISNKKNGRGREGDLGNI

SEQ ID NO: 150018 - protein, 382 aa, Glycine max
  Coding DNA Sequence Number=SeqID_58333
  Gene Ontology: Mol. function=phosphotransferase activity, phosphate group as acceptor; Cellular component=cytoplasm; Biological process =nucleobase, nucleoside, nucleotide and nucleic acid metabolic process
  Homolog annotation: Hit_ID=A1FXR8; Match level="QueryCoverage=37%, HitCoverage=75%, E-value=3e-70, Identity=97%"; Hit description =Adenylate kinase
  Pfam annotation: Domain name=ADK; Domain location=241-382; Score =227.9; E_value=2.3e-65; Accession=PF00406.13; Description=Adenylate kinase
RRLVIGAFGQQDDVRRFVIAVAGKAGGRSQPARVAAHGLVDDNAGGGLGHRRHVQRRFAHRDGGVLGRRAEAGAGVGHCQVVVDGLGHADAGQVVAGGLGQLRDLQCGIGRVVAAVVEEPANVVRAQHLQQAVVAGAVGVQRFQLHPARAEGATRGMGQGADRGGALLAGVDQLLAQRAEDAVAGGKDLDALGPGLLDHRCRRGIDDRGDTAGLGVEESTVAHASTCSGEGTLQGHYPDAGTQATRLKEKLGIAHISTGDMLRAEIAAGTELGKQAKTVMDAGNLVSDDILLGMLESRLTQADVAKGFILDGYPRNVAQANAMDGLLAKIGQPLDAVVQLDVATELLVDRIAGRAKEQGRADDTPEAVRQRLQVYNDQTAPV

SEQ ID NO: 150019 - protein, 91 aa, Glycine max
  Coding DNA Sequence Number=SeqID_58334
MMNQAILMMPKAQVIDSRLQDQASRIQSKIQDSREEIKKQQVKTSYCMEIEKYLYLRACHSVWNSLETQADHRGGGGELSVHDMVTSILTA

SEQ ID NO: 150020 - protein, 41 aa, Glycine max
  Coding DNA Sequence Number=SeqID_58335
MTRESGSMWRRLTVIYTSSFGDPKSDRQAETYVVVCALSGD

SEQ ID NO: 150021 - protein, 80 aa, Glycine max
  Coding DNA Sequence Number=SeqID_58336
MVIQKRKANIQNLIYGYGDPISRLSFPACLHFSGENIETFSSLTSYPELRRSEFLIGGYVGAKASLLSTAPLSVTMTQEL

SEQ ID NO: 150022 - protein, 136 aa, Glycine max
  Coding DNA Sequence Number=SeqID_58337
MVKVGTSYVPDQRLIFAKKLAQGFPGINRDTRDFIYLRSDLPSQLSPPVQLLTGWCVTAKAPPDISAGKCSGHAARRVPFAIQAAQLLGRAIGAGLFAITPAGERGMCCKAIKLGIRCDEVVLAIAKGGPVAEVLR

SEQ ID NO: 150023 - protein, 141 aa, Glycine max
  Coding DNA Sequence Number=SeqID_58338
LFDLQTANLYTDNHSGISARQRDSKVNMTDLVSAEDDINLHLSTILSAAIEEGFSTYRQQKVYMNNHSGISARQRDSKVSMTDLVSAEDDGAEDDVSLCVLSGFSSYRMQKVYTDNHSGISARQRDSKVSMTDLVSAEGIL

SEQ ID NO: 150024 - protein, 66 aa, Glycine max
  Coding DNA Sequence Number=SeqID_58339
MKLCFYIDVSNFGVVHQGDDFFRRWAKAKMKSCFSSVTTSQASIDKWSPPPLGHVKCNVDAEFFHE

SEQ ID NO: 150025 - protein, 84 aa, Glycine max
  Coding DNA Sequence Number=SeqID_58340
SYPKKDQGQGILGVTPSNPKGDKGKTIEKQPPKATKREESSEEIYPQEEGQPLMVKEECKETLVSTATPLGLEIIPQVNELLDE

SEQ ID NO: 150026 - protein, 142 aa, Glycine max
  Coding DNA Sequence Number=SeqID_58341
MRQANAFPLTITLEKFISWGISRGNGTLKEDFQASSKVLIISKDSGGHTLATSSIKTKVTMSNHKSTELALKNLEVQMGQLAKQIADKSSISFGANTENNPKEECKAVMTRSKRLVEAEDEENEVDKEQLSEKKRVEVKKNC

SEQ ID NO: 150027 - protein, 161 aa, Glycine max
  Coding DNA Sequence Number=SeqID_58342
  Homolog annotation: Hit_ID=Q6WAY4; Match level="QueryCoverage=91%, HitCoverage=30%, E-value=3e-10, Identity=29%"; Hit description =Putative uncharacterized protein
VGAIDGPLQMQAFHKAYGKILDLTIAEISTKVVASLTQYYDQPLRCFTKPYLSSEFLPSLSKIAIVVRDSARELDRVKQTRNGVVGLPQKYLEGKVRDMANQEEWVPFMDVLALLIFGVVLFPNMDGLVDLAAIDAFLAYHHSKESSVVAILADLFDTFDR

SEQ ID NO: 150028 - protein, 144 aa, Glycine max
  Coding DNA Sequence Number=SeqID_58343
  Homolog annotation: Hit_ID=A0ST23; Match level="QueryCoverage=22%, HitCoverage=65%, E-value=1e-11, Identity=100%"; Hit description =Putative reverse transcriptase
MTVKTSDTCSSRRRSQLVCKRMPGADKPVRARQRMRKEKIPHQAPFAIQAAQLLGRAIGAGLFAITPAGERGMCCKAIKLGNARVAKESADVIILDDNFSTIVGYRARIRNHVGKPVVPAALMNRPTRGERRFAYWALFRFLAH

SEQ ID NO: 150029 - protein, 71 aa, Glycine max
  Coding DNA Sequence Number=SeqID_58344
MEKRPTRTRRWPICLTSWEGLEIHDWEIPKIHRIHFCLDCCVSVYISLLSMMFEILEPCRVLRLGTSSKNI

SEQ ID NO: 150030 - protein, 103 aa, Glycine max
  Coding DNA Sequence Number=SeqID_58345
ESEDAKGEESSEEIYPQGEGQPLMVKEECKETLVSTVTPLGLEVIPQVKKFLDEGLVRKSLNPCALLVPKIGVKGRSLEYEEPQDLRSNPFQGGGDDAILPPK

SEQ ID NO: 150031 - protein, 187 aa, Glycine max
  Coding DNA Sequence Number=SeqID_58346
MDNEEGVQEQMKADMSALKDQMASIMEAMLKIQKSIEDNDVAVASNTTREAEPVLQPAMNLGQDRSATDFTPRTAPDDLSQAPTFEGQLPPHVDYPLQEDDEGDAHLGPLLPLKELAPHELPQPNIICHAPSQSAPVKELVPISKDKGKIDLLEERLRAVEGLGNYPFSDLADLCLVPDIIIPPKFK

SEQ ID NO: 150032 - protein, 298 aa, Glycine max
  Coding DNA Sequence Number=SeqID_58347
  Homolog annotation: Hit_ID=A1IW39; Match level="QueryCoverage=23%, HitCoverage=98%, E-value=6e-17, Identity=69%"; Hit description =Putative uncharacterized protein ophh-69
MGDKLHRREGNSPDHQLRPLNDRSVIKEMNGAKRSAEAVGCKKESVGERSALEGRTRASSAGRSGSENVGLSNANVGENPMPRKPKGSSARFVHGGVIRGRENASSQSSSTMRYSAEVIHAILPGKARTTFNKWVPVPETDTGVPPHKGGRSDPAPGDCLPKTQCRKVKEVGDLMTGEPTTEAPVNGGRNYNGPKVAKFLVGLGEIDMSVKMRTTCTWTERPYEASLFPGIGFGLFLRSLGGGQRRPPSGGARAISLPKGNGGVQRFPRARRRLALECKGRRELDCKTHPSSRDESRP

SEQ ID NO: 150033 - protein, 272 aa, Glycine max
  Coding DNA Sequence Number=SeqID_58348
  Homolog annotation: Hit_ID=UPI00016621D1; Match level="QueryCoverage =41%, HitCoverage=38%, E-value=4e-08, Identity=32%"; Hit description =UPI00016621D1 related cluster
LHALAFRGLRVLAFRRLHALTCRGLHAFTFRGLDILAFRGLDVLAFRGLHALAFRGLHVLTFRGLHALAFRGLHVLTFRGLHALAFKGRHILNFRVLHALVFRGLCVLTFSSSFLLSAPGPPPDPGGVPTIRTQPEEEAIAQLLCIPGQDFTRAAAKRRLWIMRTNMTTLTQIWMTLLLSNILSSDRNADLPLRKDRAHKTLSGPGGIQRGPGVSSSGYGPLSVLQGARPPQQGIAPARHPVDPEKSNRVLGSPALITGLCQFYRVPVGPSK

SEQ ID NO: 150034 - protein, 86 aa, Glycine max
  Coding DNA Sequence Number=SeqID_58349
MALTLTRLNIADNNITNFLHPGYKGLFKLLCNVSYIGAVLAEKILVQDQESFPLSDLSFVRQPIQIRTPSTCLSIHHVISMSYNSS

SEQ ID NO: 150035 - protein, 201 aa, Glycine max
  Coding DNA Sequence Number=SeqID_58350
MARTKKTGEMMTEAAKEIAEKIAIQGSFVPHGRQDVLTATIGHLEHPRCVSATGASVTIKQYFGSAPRTSHSSSSLPPEELQQLTQQIKDQLEESITEKVTLQLMASFSQMQSQFQSQMQSQGLALPPEHLVGPSSPRVSTKESCVDPSGNDPETGDLDRCSLYIEANPTRLVALGRVYEGSTIVYNTPLLPGQVKVGVEE

SEQ ID NO: 150036 - protein, 120 aa, Glycine max
  Coding DNA Sequence Number=SeqID_58351
  Homolog annotation: Hit_ID=Q2HW90; Match level="QueryCoverage=84%, HitCoverage=25%, E-value=8e-07, Identity=32%"; Hit description =Putative uncharacterized protein
RVGAINGSTFNGKPSAKPMDFQLLPTVKEFEEILGCPLGGRKPYLFSGFYPSTTRVAKVVKISAQELDRANGLSFIDILALLIFGVVLFPNMEGLVDLAAIDAFLAFHHGKESPVVAILA

SEQ ID NO: 150037 - protein, 73 aa, Glycine max
  Coding DNA Sequence Number=SeqID_58352
MLLSSNAIYIWVRMVMLVRMIRTRLFAVAQVKSCLDMHSSYAIASSSGCARIVGRPPILGGGPGTDKRKLLAP

SEQ ID NO: 150038 - protein, 87 aa, Glycine max
  Coding DNA Sequence Number=SeqID_58353
QGQGILGETTSKPKYDKGKTIEKQPLKASMQEKTSSMNSQDKATTSPSFSESEEAKAEESSEEIYPQEEGQPIMVKEECKEISVSSK

SEQ ID NO: 150039 - protein, 60 aa, Glycine max
  Coding DNA Sequence Number=SeqID_58354
MCVEMAPKNLSAKRSRRDATTEGTSAAPEFDSHHFRSAEHQQHFEAIKGWSSQTRPAQGR

SEQ ID NO: 150040 - protein, 79 aa, Glycine max
  Coding DNA Sequence Number=SeqID_58355
MGPVLSDPPRSLMGEHPGRVHAARAGVTIKQYFGSTLQSSRNSSFIPPKELEQLTQQIRDQLEESITEKVTWQLMASFN

SEQ ID NO: 150041 - protein, 61 aa, Glycine max
  Coding DNA Sequence Number=SeqID_58356
THLFLEVASPSSLPFSIPLPFIFQEAKESIDEEDPRPTSSNGAYIKILLCAKRAKAALRSG

SEQ ID NO: 150042 - protein, 144 aa, Glycine max
  Coding DNA Sequence Number=SeqID_58357
  Homolog annotation: Hit_ID=Q6WAY4; Match level="QueryCoverage=84%, HitCoverage=25%, E-value=7e-09, Identity=29%"; Hit description =Putative uncharacterized protein
MGSSQMPSLKKRFYQVKVKSLGTTSLKELGQLMGQLQRQAFRKDYGKIWNLAMLIRCFTFEDFQLVPTVKEFEEILGCPLGGRKPYLFSGFYPSTTRVAKLVKISAQELDRVKQNRNGVVGVPRKCLEERAKALANQGEWAFFY

SEQ ID NO: 150043 - protein, 216 aa, Glycine max
  Coding DNA Sequence Number=SeqID_58358
CLHSSGENIETFSSLTSYQELRRSEFLIGGYVGARALLLSTTPPFAVMTQELVARRDTLRLSAPRHSVTPSVIDEQRPMWSSAPFPEMSASSDGDFSSLTSYQELRRSEFLIGGYVGARALLLSTTPPFAVMTQELVARGDTLRLSAPRHSVTPSVIDEQRPMWSSAPFPKMSASSDGDFSSLTSYPELRRSEFLIGGYVGARALLLSAAPQDLSY

SEQ ID NO: 150044 - protein, 234 aa, Glycine max
  Coding DNA Sequence Number=SeqID_58359
  Homolog annotation: Hit_ID=A7UQU7; Match level="QueryCoverage=56%, HitCoverage=22%, E-value=6e-18, Identity=39%"; Hit description=IMP dehydrogenase/GMP reductase, putative
MHEHLNDASQASTRQLGGYITLLQCWIYEHFLTVHTCVVHDAYDEGSPQACRWLTGKAHMTGIKGAPYRRRLDALTVTDVCWMSYAEHRGVRGFDLISSYTSQLRWGQIVVYVRPERVLRQFGYLQTVPPPPVCDSLTGDDIDDRWLHFSDHLVPLGELCVVPGQVAPDYMECFFWISHPFVTRGPRRLLSRDICLPLMMRSSSSHPSPRFQSRPISLRIQWLTTKDVREWLRI

SEQ ID NO: 150045 - protein, 60 aa, Glycine max
  Coding DNA Sequence Number=SeqID_58360
SCHHQKAGDCRSKASWRIKDDDKGDDKKLKDQSKNNSSESRTIQEFKIRIKKNSRLKKKV

SEQ ID NO: 150046 - protein, 188 aa, Glycine max
  Coding DNA Sequence Number=SeqID_58361
  Gene Ontology: Mol. function=phosphoglycerate mutase activity; Cellular component=cytoplasm; Biological process=glucose catabolic process
  Homolog annotation: Hit_ID=A4ATG7; Match level="QueryCoverage=50%, HitCoverage=18%, E-value=6e-34, Identity=72%"; Hit description =Phosphoglyceromutase
  Pfam annotation: Domain name=iPGM_N; Domain location=1-152; Score= -98.7; E_value=7.8e-11; Accession=PF06415.4; Description=BPG -independent PGAM N-terminus (iPGM_N)
MGNSEVGHMNLGAGRVVYQNLVKLNMAVENGTLGEEKVIQEAFEYAKRENKKVHFIGLVSNGGVHSHINHLKGLLTAAKNFGLNENVFVHAFTEETAIRIQDWDSSKNLMNICLHDRETGNIVGKYPHVTFFFSGGREKEFVGERSICFKLPPKRLNLYVCYPDDQLYTAFHESGPINNVKEFLMKKF

SEQ ID NO: 150047 - protein, 199 aa, Glycine max
  Coding DNA Sequence Number=SeqID_58362
  Homolog annotation: Hit_ID=A0ST23; Match level="QueryCoverage=22%, HitCoverage=91%, E-value=2e-11, Identity=73%"; Hit description =Putative reverse transcriptase
MTVKTSDTCSSRRRSQLVCKRMPGADKPVRARQRMRKEKIPHQAPFAIQAAQLLGRAIGAGLFAITPAGERGMCCKAIKLGNARVFPVTTLSTLEDPLHEHRKMSVRVARECKGFGDLALGLRVFVEQLKCKSDSFNDVSKFRACTRQGGRGRGTELEFVIMVIAVSFGKPVVPAALMNRPTRGERRFAYWALFRFLAH

SEQ ID NO: 150048 - protein, 139 aa, Glycine max
  Coding DNA Sequence Number=SeqID_58363
ATLPEGRKADRYPVSGRVGTGERTRELPGGNACLWKNASNAAFLRFLAFCWPFAHMFFPALSPDSVDNRITAFEKRKSAQYANRLSPRVGRFINAAGTTGFPTGKRAVSATQLIYDHDYEFELGTLWVIGLMDLLVIFK

SEQ ID NO: 150049 - protein, 96 aa, Glycine max
  Coding DNA Sequence Number=SeqID_58364
MSASDHAILRDKTHQPTKKSLLELTSHDALLAQNKLLSKQLEILTETLGCTMCGEAHETGQCIPTEENTREIHFMGELAEARVYSRRIFRLLARSL

SEQ ID NO: 150050 - protein, 97 aa, Glycine max
  Coding DNA Sequence Number=SeqID_58365
PAQLCLQSQGFAPFACPTPDQFRAEVAWPGDWPEAQAGEAPDGAGDAHMDEEMTDLLDLLGGSGATNFRRYGSQLFRHRFVTYHFHAFLVHLVVRRK

SEQ ID NO: 150051 - protein, 189 aa, Glycine max
  Coding DNA Sequence Number=SeqID_58366
  Homolog annotation: Hit_ID=Q2HW90; Match level="QueryCoverage=91%, HitCoverage=35%, E-value=2e-16, Identity=33%"; Hit description =Putative uncharacterized protein
MCHFLMHTLGHLQRQAFRKVYEKILDLTTAEVFTKVVVSLAQYYDQPLRCFTFGDFQIVSTVEEFEEILGCPLGGRKPYLFSGFLPSLSKIAAMVGDSARELDRMKQTRNGVVGLPRKYLEGKARDMASQEEWVPFTDILALLIFKVVLFSNMDGLVDLAVIDAFLAYHHSKESPVVAILANLFDIFDR

SEQ ID NO: 150052 - protein, 44 aa, Glycine max
  Coding DNA Sequence Number=SeqID_58367
GQYDNMLDAILPRKGPVTRAMSKRLQEDWARATKEGPRVLMNLR

SEQ ID NO: 150053 - protein, 289 aa, Glycine max
  Coding DNA Sequence Number=SeqID_58368
  Subcellular localization annotation: CTP_CleavageSite=43; ConfidenceScore=5.71e-01
MFFSSSVRWHAGPPTDARSTARPSSFAPARSGAARPPEHPAVPCRSAWCTPCPCRLLRRTDAQNALPGARQSSSAVRPACTRVSPGKRRRYPDRPAPRRDGKRRYGLQSVNRIGCSCGGCLHAGKKLGFTGVDDVSELVSQHGNDRRKGSFLNGVRTLAGSPNARWRNGFHCGNGQPVCSCHLLYGQTTGKRQNVVTRQQTSGAVLRVGHGAQHARGCRQRRAAHGRKQKAECRMSRDEGRSHGGSLLEVKVIATTEVPTLMGGSPNGGRNTGLQGNRPARKLPRLSYH

SEQ ID NO: 150054 - protein, 122 aa, Glycine max
  Coding DNA Sequence Number=SeqID_58369
MAASDHATLHDTVHIPTKKSLLELSSQNALLQVAHFVAELMGGFSGFQHGQPYQQHNQWRNHPGNQFNKDQGGLPNRPQQQGPSLFERITKLEETLAQFMQVSLTNHKSTESAIKNLEVQVG

SEQ ID NO: 150055 - protein, 117 aa, Glycine max
  Coding DNA Sequence Number=SeqID_58370
MFNTHCHGIRKVPGCFEKKTTQNTKVGGVNLSNTGDALRKLHPEHCKRWGELINYGVHSGIFLKKPLGEKTCFREENPSRGASVMLLRRFCEQIREDFLSFFTILHPFFIRSSVFNR

SEQ ID NO: 150056 - protein, 54 aa, Glycine max
  Coding DNA Sequence Number=SeqID_58371
MEEEGGRQKRRGERRRHPLGNKPWKKELHHQDEPWIRSLRGCFNGAQERGGSMN

SEQ ID NO: 150057 - protein, 43 aa, Glycine max
  Coding DNA Sequence Number=SeqID_58372
MSTKQGPVAEDMFHWQATIMGPPYFVFFFLDYLITALIPETMF

SEQ ID NO: 150058 - protein, 86 aa, Glycine max
  Coding DNA Sequence Number=SeqID_58373
LAHNSPRGCPPSPIPTRTKPTSAESQPPVVDLPASPEVEILSPPPAPPAPPLILIPDDSDAKAAAPPDSPAYYLEDGSDFSDWMDN

SEQ ID NO: 150059 - protein, 97 aa, Glycine max
  Coding DNA Sequence Number=SeqID_58374
MTSSSSFILCMSSHRKISYNSLDSDPSLSRISHMQNLFEKIAKILGTWTFLSLEISKHAKASRIAQTLLHNLISGLNRWLYSSSRSAEECCVQRLAH

SEQ ID NO: 150060 - protein, 95 aa, Glycine max
  Coding DNA Sequence Number=SeqID_58375
VGSPNSKLSDEEKFEAPEEDEEVRALKVELGKARLAKEKFKSAATHIWKECIDLQEENAATTKALEQETKRARKEEYGREKFRGALWGSNNELKL

SEQ ID NO: 150061 - protein, 250 aa, Glycine max
  Coding DNA Sequence Number=SeqID_58376
MAPRKLITKRARKATVGEGSSAASQAEIEFYGHHFQSEEHECCFEAIKDWSFLKERRVQLRTRWTQLTEPMAKYDPEIVMEFYANAWPMEEGVMDKRSWVQGQWVPYDEDAINQFLGHPLVLEKGQHCEYTKRRSQVSGRRVRIMRTSMTTLTQIWMMLLLNNILPSDHNYDLSLPKFQLVYAILTQISVHVAQLISDAIYQFVGIAPLRHLVDPKKSNRALRFPALITGLFQFYVVPGYAHKLIRPPIN

SEQ ID NO: 150062 - protein, 184 aa, Glycine max
  Coding DNA Sequence Number=SeqID_58377
DQLPSQSDACLALSNSPVSQASQADHLVQGFQSEYFQQNVCLDRASNHLDPMIHLQVILCESARQGEKDMPDSQEKDSQCSQNALLSVMPELMFRRVPVGSLMPMQGESTAKGKFNHWEGLTIYWIWSTGQLDRTGSMLRVLGSVKKAASSILRAASKGEKACFSELGHMSGKESEVYDAEPTS

SEQ ID NO: 150063 - protein, 68 aa, Glycine max
  Coding DNA Sequence Number=SeqID_58378
MQMPYTRCPICPQFKGVFGIALLETLFNKYMAVFKEYIHKDTVLLRLSDTPFGCGVPNIVYYAQMPRF

SEQ ID NO: 150064 - protein, 37 aa, Glycine max
  Coding DNA Sequence Number=SeqID_58379
MASSNSLFPEGNSIPRPPIFNDEVEDKGEEVRGGAIH

SEQ ID NO: 150065 - protein, 95 aa, Glycine max
  Coding DNA Sequence Number=SeqID_58380
METLQKVCKAWEVLQKKDKELRGSNNGPIGGYHKWLKAHVQEVEAPEEDEEVQALRTALEQAQTVKERFKSAALKIRKENAELRDINVATTKALE

SEQ ID NO: 150066 - protein, 194 aa, Glycine max
  Coding DNA Sequence Number=SeqID_58381
  Subcellular localization annotation: CTP_CleavageSite=38; ConfidenceScore=5.09e-01
SKSLAFVDHTAFCCHDSRAGSPRRHLTVIRTSSFSDPKCDSRAETNMVICALSGDVSIFRWRLFKSHKLSRTTSCDVAPLYDTQRYLTVIHTLLSSRGGGPDDKQRPKTKFGHFAPLYHPEAAGPMIRGDTLRLSAPFCHPEAAGPMTSRDQVWSFCTLVSSRGGGPDDTRRYLTVIRTLLSSRGGGPDDKQRP

SEQ ID NO: 150067 - protein, 99 aa, Glycine max
  Coding DNA Sequence Number=SeqID_58382
VKRSFSIGVGAITSFGYRKDVDGQWVRKQDLSLPIPDERTPSPPPQRTDSTSLLTEVLTELRDLRAFVDERFDAMDTRITRLEDDMSFIRRCFNPPVNS

SEQ ID NO: 150068 - protein, 298 aa, Glycine max
  Coding DNA Sequence Number=SeqID_58383
MAGAIVFIGNNGSSPKVSFCDLPVIDHLPVMVRRAVAQRFNAHHVLRHAVHHQHALDARKPVLRLVEREPQVAVDAAQQRIVADVDTPPVSGFAAGHYQFAAQLARDGAARQFCDHIIPAPLFVLRHRQLDAAQMLVARPGGFVAVVQADKAEFAQRARDVGLRHLLLRRVRGQGRQLRLATVEKAGATLPFLRLCVVGLHAEADIRQACRQCAARPPPDHLAPAAELRVHNMARHNPRAKRGQRQCAVLHGIGNLLRHVVQREPQVLVLLAGAEAVLSQLRQGRQTFCQARSQARDF

SEQ ID NO: 150069 - protein, 61 aa, Glycine max
  Coding DNA Sequence Number=SeqID_58384
MDKNNLTKHFVHKELCRSDFLIAIKEYVGARETPSLPSLVTDAWGANAFPVRKYNSRTFHL

SEQ ID NO: 150070 - protein, 170 aa, Glycine max
  Coding DNA Sequence Number=SeqID_58385
  Homolog annotation: Hit_ID=A6FJQ2; Match level="QueryCoverage=22%, HitCoverage=84%, E-value=3e-11, Identity=92%"; Hit description=50S ribosomal protein L5
MRKEKIPHQAPFAIQAAQLLGRAIGAGLFAITPAGERGMCCKAIKLGNARVFPVTTLSTLEDPQCPGVFPGYVQVALGSYHFGKEGWYIIPGVITAIWLAIRDDKRSSYVIGSGVNSGISFGGKFLIALELPAERVVVGAGAWGASLWMGALGCTGVELEEFPARAKKLG

SEQ ID NO: 150071 - protein, 98 aa, Glycine max
  Coding DNA Sequence Number=SeqID_58386
MVLKEELAACSRSKRSLSQRLCETETNMSAIITKYQEELNLVAAHEHRVADEYARVWMDRFALTLNGSQELPRLLAKAKAMADTYSAPEEIHELLSYC

SEQ ID NO: 150072 - protein, 137 aa, Glycine max
  Coding DNA Sequence Number=SeqID_58387
QTQEHRSLEQMDQWLTLNSGFTCDSPQISASPHQLDLAPYASGPYNAQWNAPGLLHDKHTLRSSRILGEMEVDEPWLGLWLPLNYQVDMGASGVCHRKCGRLALWLILGMAFVNNWAVGKEKTHFDPFVGEDHIIKA

SEQ ID NO: 150073 - protein, 163 aa, Glycine max
  Coding DNA Sequence Number=SeqID_58388
LGNDIYGSPNETGEWRIGGQHYAITSRGSRLEGGGHMYSARKLHSWVSEKSREWRIGEQRYAINSRGSRLKALGNDINGSPNKSGEWRIGGQHYAITSRGSRLEGGGHMNSARKLHSWVSEKTLGNDIHGSPNKKWRMENWRTALRNNFAGLQTRRWRMPEQR

SEQ ID NO: 150074 - protein, 137 aa, Glycine max
  Coding DNA Sequence Number=SeqID_58389
MVKQSCLAHLDMYWDQGSSNVPDVQDDTVFITILYHVDSRPMDSKLARTSFALHSQDIAVFNVMTWGPLAGSKSAYFIGIGSKGIVADGIAVEDIVVEGIVVEGIGVEGIVVEGIVVEGIGVEGIVGGNVAFVGDMM

SEQ ID NO: 150075 - protein, 173 aa, Glycine max
  Coding DNA Sequence Number=SeqID_58390
  Subcellular localization annotation: CTP_CleavageSite=30; ConfidenceScore=5.10e-01
YVGARASLLSTTPPFVAITQELVARGDTLRLSAPRHSVTPSVIDEQRPMWSSGLFRRCQHFPMETFQVSQVIQNYTLRSCDAHPFARQTQLCPMARRDQVWSFCTHDTRRYLTVICTPLLGRHSCVRWHAETKFGHSAPMIRGDTLRLSAPLCYADTVVSDGTQRPSLVILHP

SEQ ID NO: 150076 - protein, 107 aa, Glycine max
  Coding DNA Sequence Number=SeqID_58391
  Homolog annotation: Hit_ID=A6FJQ2; Match level="QueryCoverage=35%, HitCoverage=84%, E-value=3e-11, Identity=92%"; Hit description=50S ribosomal protein L5
MTVKTSDTCSSRRRSQLVCKRMPGADKPVRARQRMRKEKIPHQAPFAIQAAQLLGRAIGAGLFAITPAGERGMCCKAIKLGNARVFPVTTLTSSWSAGTLPAELDIV

SEQ ID NO: 150077 - protein, 90 aa, Glycine max
  Coding DNA Sequence Number=SeqID_58392
  Homolog annotation: Hit_ID=A7PBE8; Match level="QueryCoverage=44%, HitCoverage=4%, E-value=1e-09, Identity=72%"; Hit description =Chromosome chr16 scaffold_10, whole genome shotgun sequence
MCPNPHRTFCRFIHRPSSSAAKASHPSINIERPKEIKRKIGEAKKRENERRNGLWWPGQILGFDHLSTSHLTSPCSGTPVKLLRKEDSNK

SEQ ID NO: 150078 - protein, 121 aa, Glycine max
  Coding DNA Sequence Number=SeqID_58393
  Pfam annotation: Domain name=G-patch; Domain location=1-42; Score =23.1; E_value=0.00031; Accession=PF01585.14; Description=G-patch domain
MVARVMLKHGFEPGIGLGKDGLGNANIVDIKGNPYKYGLGYEPGKPGRRNVPSRLRADRVWPGRISQCFTSAGMVSEEEVAVVGEEFPQDPPNLVQPCHPDSQVGNWHVISQSEVYAADSM

SEQ ID NO: 150079 - protein, 83 aa, Glycine max
  Coding DNA Sequence Number=SeqID_58394
  Homolog annotation: Hit_ID=A6FJQ2; Match level="QueryCoverage=45%, HitCoverage=84%, E-value=3e-11, Identity=92%"; Hit description=50S ribosomal protein L5
MRKEKIPHQAPFAIQAAQLLGRAIGAGLFAITPAGERGMCCKAIKLALPPPHNIPVSILHSVFVRGDLVRFEIGEDDLEASQL

SEQ ID NO: 150080 - protein, 177 aa, Glycine max
  Coding DNA Sequence Number=SeqID_58395
MERSMIDVANGGALGDMTPTKAKNLIEKMASNSQQFSVRSDAIVIRGVHEVATNSSSSAETKKLEGKLDSLVNLVTQLAVNQKSAPVARLCGLCSSADHHSDLCPSVQQSEAIEQPEAYAANIYNRPLQPQQQNQPQQNNYDLSSNRWSNPSQQQQQPYFQNAAGSSRPYVPPPIQQ

SEQ ID NO: 150081 - protein, 113 aa, Glycine max
  Coding DNA Sequence Number=SeqID_58396
MATTPPVLLKNGIPGLPGHPTFFGAGLLLGELTSPGRAGRQPPPPFSYKKAEGGCSKDPSAPWLCISAVLGEKNCFREENPSRGASVTLLRCFRKQIREGFRPFFIRSSFFNG

SEQ ID NO: 150082 - protein, 108 aa, Glycine max
  Coding DNA Sequence Number=SeqID_58397
  Homolog annotation: Hit_ID=A6FJQ2; Match level="QueryCoverage=35%, HitCoverage=84%, E-value=3e-11, Identity=92%"; Hit description=50S ribosomal protein L5
MTVKTSDTCSSRRRSQLVCKRMPGADKPVRARQRMRKEKIPHQAPFAIQAAQLLGRAIGAGLFAITPAGERGMCCKAIKLGNARVFPVTTLVELAAQIAQASSARPGE

SEQ ID NO: 150083 - protein, 33 aa, Glycine max
  Coding DNA Sequence Number=SeqID_58398
MDYGTLQRFSKLKRDSIENYNGRTHISATCPLF

SEQ ID NO: 150084 - protein, 117 aa, Glycine max
  Coding DNA Sequence Number=SeqID_58399
  Homolog annotation: Hit_ID=Q5NRP4; Match level="QueryCoverage=52%, HitCoverage=4%, E-value=7e-07, Identity=40%"; Hit description =Putative gag-pol polyprotein, identical
  Pfam annotation: Domain name=zf-CCHC; Domain location=67-84; Score =20.9; E_value=0.0011; Accession=PF00098.14; Description=Zinc knuckle
MERKPQEANINLSYFHGKENYGSHSYSKKDQGQGILGVTPSKPKDDKGKTIEKQPPKTSMQEKTSSTKCFKCLGRGHITSQCPTKKTIIMRGQDIYSSHDAATTSPSSSESEKAGIL

SEQ ID NO: 150085 - protein, 155 aa, Glycine max
  Coding DNA Sequence Number=SeqID_58400
  Homolog annotation: Hit_ID=Q6WAY6; Match level="QueryCoverage=51%, HitCoverage=14%, E-value=8e-08, Identity=39%"; Hit description =Putative uncharacterized protein
MGTRGCISYNPVLAIRQLGYPMRGAPLEDELVPVISRGFNKTNVETLQKVHKAWEVLQKKDKELRGSNNGPIGGYRKWLKALVQEEVEAPEEEEEVQALRVELEQALTVKERFKSAALKIRKENTELRDVNVATTKALERETKRACREEHGRNKF

SEQ ID NO: 150086 - protein, 193 aa, Glycine max
  Coding DNA Sequence Number=SeqID_58401
MDNEEGVQEQMKADLSALKDQMASITEAMLKLQKTIEDNATAVASNSAREAEPVLQPAINLGRDRNTTGFNRRYIPQAYPYGLPPDFTPRTAPDDLSQAPTFKGQLPPHADYPLQEDEEGDAYLGPLLPLKDPAPYELPQPNIVRHVPPPSAPVKEIVPFAKDKGKIDLLEERLRAVEGLGNYPFSDLADLCL

SEQ ID NO: 150087 - protein, 135 aa, Glycine max
  Coding DNA Sequence Number=SeqID_58402
HEGFYLLWNARGVAGGDTEGPPKCLAWVYHQLLTLQWHIRGKARSRLDCGGEFHVSPPRFKRHVHDQFGLSAFNEYGSGVIDILIGNVCHIGWCIVGRQAIWWEGMLVLNLRIMGGRPYFPNLCLPYLRLDDSFG

SEQ ID NO: 150088 - protein, 100 aa, Glycine max
  Coding DNA Sequence Number=SeqID_58403
MVVRVFDGTRWEVMGEIGGSHSDRPPGVQCGVSMIMSGEEDMLVSCPSSAPYVEEAEESLETAFQSFEVVSCASVEPSPSLPSLSKAAIMVARVMLRNGF

SEQ ID NO: 150089 - protein, 175 aa, Glycine max
  Coding DNA Sequence Number=SeqID_58404
  Pfam annotation: Domain name=Transposase_23; Domain location=37-106; Score=-0.5; E_value=0.0013; Accession=PF03017.5; Description =TNP1ENSPM transposase
MQSQGLALPPEPEVAPSGPRVGTKESCVDPSGNDPKMGDSNKCGLYIEANPPHLVALGRLYEGSTVHNIPLLPGQVKVGVEEVKDAQAPVLVPTDEVTLVGQTLNTFLAWPTHLMKALSQAVVSPAKPPQRPDPEVDDPLYLMTLTIPELFLQPFQVNWDATMFGVCHPNFPLYI

SEQ ID NO: 150090 - protein, 83 aa, Glycine max
  Coding DNA Sequence Number=SeqID_58405
MASKVSCLGYNNISKGYRVYNLQTKKLVIMEKNVLDSRSTTLKKKMRKKTQVNYTFTSITTTRSRTIITRVYSKTSKIFGGHI

SEQ ID NO: 150091 - protein, 63 aa, Glycine max
  Coding DNA Sequence Number=SeqID_58406
MATLHCLRAQAHPRKKIPNMVDGTGERGLFFLDSLTSKHEKWPPSIVSRAQAHPRKKIPNMGT

SEQ ID NO: 150092 - protein, 56 aa, Glycine max
  Coding DNA Sequence Number=SeqID_58407
MRNLLGKNIFKFPDMNGSGMEKEEREETPLQGEDESRRSSPPYEAMDKSLEEEGDE

SEQ ID NO: 150093 - protein, 136 aa, Glycine max
  Coding DNA Sequence Number=SeqID_58408
MVKEECKEVSVSSKRLAKKESHFEIKTNIKETSPLRQPPHLFLCKKTLVSTVTPLGLDIIPQVKELLDEGLVRKSLNPCALLVTKIGIIRHQIPKIGDMMNVLSGATLFCKITHTPNIFKIRVDRDSLDRCSYGTP

SEQ ID NO: 150094 - protein, 133 aa, Glycine max
  Coding DNA Sequence Number=SeqID_58409
MLGKLGRIDGGPGVERNEDWATWEYVSSVGGWATGDEWYLEICRGGQETLGTSGGVLLPKTKLDQSRPNPGVATYPSAGGRRVTCGMRVPRKEYARSRHQRLFEENVGKTGKDAIYELFSERFGSCIYARGRY

SEQ ID NO: 150095 - protein, 177 aa, Glycine max
  Coding DNA Sequence Number=SeqID_58410
  Homolog annotation: Hit_ID=A5AWV0; Match level="QueryCoverage=76%, HitCoverage=9%, E-value=3e-11, Identity=30%"; Hit description =Putative uncharacterized protein
HLTETSVRAGNADVYGFLEPQSIQRSGQSQFESESYIKSWIQSSKRDVYLGAYLNSGHWQMVVILPKENLVVWFCSLHNRPDNYLKGIINSALKGLDDTPQPKSKAVARWIVVKCNRQKGITECGYYVMHWMSTIILGSFRNNWETYFNEVRPLEAERFKALRIQWAQYYLKVRNQT

SEQ ID NO: 150096 - protein, 118 aa, Glycine max
  Coding DNA Sequence Number=SeqID_58411
MSQHIYHTVVDSHLTETSMRVGNSDVYRFLEPQSIQKFGQSQFDSESYIMSWMQSSKRDVCLGAYLNGGHWQMVVILPDNYLKGIINSLNPRLLLGGLSLSVIDKKDVEASFMLMNQD

SEQ ID NO: 150097 - protein, 52 aa, Glycine max
  Coding DNA Sequence Number=SeqID_58412
MATIALSSGYGSKSTWDTGIGGSFVDNWVVGKEMGCYWLSNDIVGLVGNLAI

SEQ ID NO: 150098 - protein, 198 aa, Glycine max
  Coding DNA Sequence Number=SeqID_58413
AAISAVAKVIPMLPSGLKQMNHPTSNMVGKDLGSTGGPHDVQIQNKHAFLSYGLPLNYTPPNMAYTPNKNVNNSTPIPIESQQPQTDHAHGKQLVVYPYKTLWRALSITHNCTSCIPQRLKTLMTMAGMGKLDHLEERLRAIEGGEDYAFANLEELFLIPKHGHSQVQGAGLWQVQGDYSLQEPSKDVLSEDGGIRKI

SEQ ID NO: 150099 - protein, 192 aa, Glycine max
  Coding DNA Sequence Number=SeqID_58414
MVMGDFISRLSFPENTETFSSLTSYPELRRSEFLIGGYVGARASLLSTTPPFVAITQELVVRGDTLRLSAPLLPFRHSRVRWQAETKFGHSAHMIRGDTLRLSAPLCHSDTVVFDGKQRPKTKFGHSAHMIRGDTLRLSAPLCHSDTVVFDGKQRPKTKFGHSAHMIRGDTLRLSAPLCHSDTVVFDGKQRP

SEQ ID NO: 150100 - protein, 30 aa, Glycine max
  Coding DNA Sequence Number=SeqID_58415
MKDAPVADPKDYIQPPRPQVPVAFDPPPHV

SEQ ID NO: 150101 - protein, 146 aa, Glycine max
  Coding DNA Sequence Number=SeqID_58416
  Gene Ontology: Mol. function=endonuclease activity
  Homolog annotation: Hit_ID=Q9AY32; Match level="QueryCoverage=38%, HitCoverage=84%, E-value=8e-23, Identity=94%"; Hit description=RRNA intron-encoded homing endonuclease
HGITPQDSDPIVLAFGIGVMINRDSRGHSYFIVRDTVLVSTINDADQGSADVAFRTPLAPYEKSKSLGSGGSMVARLKLKGIDGRAPPGIIAIVGLQRGIPSKRESSARVDYVPALCTHRPSLLPIEWSGEVFGLRRRERFAARDV

SEQ ID NO: 150102 - protein, 109 aa, Glycine max
  Coding DNA Sequence Number=SeqID_58417
MFSKKKGMMRIMKLAKYRLKAQVEKDEGPSGEGQSPRVEKDEGNPCGVYPDLSSFIGSGVYPDLSSFTRSGVYPDLSSFTGSGVYPDLSSFTGSGVIQIFVVCIKRSAP

SEQ ID NO: 150103 - protein, 100 aa, Glycine max
  Coding DNA Sequence Number=SeqID_58418
LKKLGYHNDPFIMAKQARQGKTIGVNVEDDDSYMDTYVSPLTAQITPNIVGEEEADEVHANRNDHDEGELINIMASLGLHTAHVCRQFHHPPPLPSLPSH

SEQ ID NO: 150104 - protein, 188 aa, Glycine max
  Coding DNA Sequence Number=SeqID_58419
MVIPRERRVQLREDEYTDFQEEIARKRWTPLVTPMAKFDPEIVLEFYANAWPTEEGVRDMRYQFLGDPLILEEGQQCEFSQRRSRADGFDEEVIAQLLCIPGQDFARTAAGRRVRIMRTNMTTLTQTWMTLLLSNVLPSDHNSDLPLPKCQLVYAILTQMSVHVAQVWRLLGTLWTQISPTGPWGFRH

SEQ ID NO: 150105 - protein, 60 aa, Glycine max
  Coding DNA Sequence Number=SeqID_58420
  Subcellular localization annotation: CTP_CleavageSite=31; ConfidenceScore=5.21e-01
GPGFSSIDHGSLPVVRGPVTPSKVIRPSITRAFIEKYCTPRQAQVFTTFGSPAGGQPQGA

SEQ ID NO: 150106 - protein, 145 aa, Glycine max
  Coding DNA Sequence Number=SeqID_58421
  Gene Ontology: Mol. function=aspartic-type endopeptidase activity; Biological process=DNA integration
  Homolog annotation: Hit_ID=A5BRE8; Match level="QueryCoverage=53%, HitCoverage=13%, E-value=3e-09, Identity=40%"; Hit description =Putative uncharacterized protein
MHLFMNIAAWASHINMYHLNHLVKKNLVIGIPKLKFEKNKLCEAYQKGNKLKTLFKIYLDPQELSLGGNYYGLVIVDDYLRMRKVLILFQLEVIMEVNFKMSILKSFVEKMEFTTIFLPQEQLNKMVLWKGKIDPLKELELFGIL

SEQ ID NO: 150107 - protein, 50 aa, Glycine max
  Coding DNA Sequence Number=SeqID_58422
MMIHQPLAAIQKPMTGQKALGRSIEHCRALKRKVQGLIDMGWLKFEENRV

SEQ ID NO: 150108 - protein, 221 aa, Glycine max
  Coding DNA Sequence Number=SeqID_58423
  Gene Ontology: Mol. function=drug transporter activity; Cellular component=integral to membrane; Biological process=multidrug transport
  Homolog annotation: Hit_ID=A5FL12; Match level="QueryCoverage=82%, HitCoverage=38%, E-value=3e-69, Identity=70%"; Hit description=MATE efflux family protein
  Pfam annotation: Domain name=Trep_Strep; Domain location=50-221; Score=-90.4; E_value=0.074; Accession=PF09605.1; Description =Hypothetical bacterial integral membr
MYSIAIGMSMAATAVVSRRVGEKDPDAAAHAGNAAIAMRSLWIANICNIILCPIFINGWGIIPAFGLTGAAMATVIGRSMGVVYQLFCLFNGKHQLKIKLHHFRIDWPVIKSLVGIATPGILQFVIGSCSWIFLAELVATTGGDHGSAGYQTALRLMMFFMLPAWGMSNAAATLVGQNLGAKQFQRAEDSVLATVKYNVIFMIIVTILFLFFGDWLVHFSQ

SEQ ID NO: 150109 - protein, 296 aa, Glycine max
  Coding DNA Sequence Number=SeqID_58424
  Gene Ontology: Mol. function=sugar:hydrogen symporter activity; Cellular component=integral to membrane; Biological process =carbohydrate transport
  Homolog annotation: Hit_ID=P68185; Match level="QueryCoverage=100%, HitCoverage=100%, E-value=1e-157, Identity=92%"; Hit description =Maltose transport system permease protein malG
  Pfam annotation: Domain name=BPD_transp_1; Domain location=85-291; Score=56.4; E_value=9.7e-14; Accession=PF00528.13; Description =Binding-protein-dependent transport s
MAMVQPKSQKLRLLVTHLGLLIFIAAIMFPLLMVIAISLRSGNFATGSLIPDEISWEHWKLALGFSVEHADGRVTPPPFPVLLWLWNSVKIAGITAVGIVALSTTCAYAFARMRFPGKATLLKGMLIFQMFPAVLSLVALYALFDRLGQYVPFIGLNTHGGVIFAYLGGIALHVWTIKGYFETIDGSLEEAAALDGATPWQAFRLVLLPLSVPILAVVFILSFIAAITEVPVASLLLRDVNSYTLAVGMQQYLNPQNYLWGDFAAAAVLSAIPITVVFLLAQRWLVNGLTAGGVKG

SEQ ID NO: 150110 - protein, 304 aa, Glycine max
  Coding DNA Sequence Number=SeqID_58425
  Gene Ontology: Mol. function=sugar:hydrogen symporter activity; Cellular component=periplasmic space; Biological process =carbohydrate transport
  Homolog annotation: Hit_ID=P03841; Match level="QueryCoverage=100%, HitCoverage=100%, E-value=1e-112, Identity=69%"; Hit description =Maltose operon periplasmic protein precursor
  Pfam annotation: Domain name=MalM; Domain location=11-304; Score =482.1; E_value=7.1e-142; Accession=PF07148.3; Description=Maltose operon periplasmic protein prec
MKMKKSLVALCLSAGLMACVPAVSLADVNFVPQNTSAAPVYPGGGAPATDLDTGGQQLNVPGITGPVAAYSVPANIGELTLTLTSEVDKQTSVFAPNVLILDQNLTPSAFFPSSYFSYQEPGVMSADRLQGVMRLTPALGQQKIYVLVFTTEKDLQQTTKLVDPAKAYAKGTGNSVPDIPDPLARHTTDGLIKLKVSTNSASSVLVGPLFGSSGPGPVTVGNTAAPVYAAPAATAAAPVATAAPAPAKKAEPVLNDTEEYFNNAIKQAVKRGDVDKALKLLDEAERLGSTTARSTFISSVKGKG

SEQ ID NO: 150111 - protein, 29 aa, Glycine max
  Coding DNA Sequence Number=SeqID_58426
MAKQLNILSQPTHRQVLAPYASATRNDSL

SEQ ID NO: 150112 - protein, 213 aa, Glycine max
  Coding DNA Sequence Number=SeqID_58427
  Homolog annotation: Hit_ID=A2FDT0; Match level="QueryCoverage=47%, HitCoverage=17%, E-value=1e-07, Identity=33%"; Hit description =Putative uncharacterized protein
MTGPLDEEISCFLIRVDPWLLVPTAFRGLHAFAFRGLHVLALRGLHVLPFRGLHVLAFKGLHALAFRGLHVLAFRELHVLASRGLHALAFRGLHVLTFRGLHVLAFRGLFVLAFTGIHRAPHPRLQGTQGPLPLMLNQNLHSRFLGHPPDLRGGPTVRAQPEEEVGLQLRRGGYHIATMHTGARFRSDHSKETSTDPVHQHDHSYANMDDVAT

SEQ ID NO: 150113 - protein, 104 aa, Glycine max
  Coding DNA Sequence Number=SeqID_58428
YILCGTSRGYIYLGLTENKRGYISCGSVLVEGTSTRFKENKGGYIPYGSLLAKGFLQGEKRKLQLLELEEMRMNAYKSSRLYKEKVKAYHDKKLLKTEFKLGQQ

SEQ ID NO: 150114 - protein, 73 aa, Glycine max
  Coding DNA Sequence Number=SeqID_58429
MASAVHVSSTYEFGATRSDCLVQFSNLAFFSEPHECHCLALFMHPPPTSLEPREVIAYNCLPILHSQLLFGAP

SEQ ID NO: 150115 - protein, 98 aa, Glycine max
  Coding DNA Sequence Number=SeqID_58430
  Subcellular localization annotation: CTP_CleavageSite=67; ConfidenceScore=5.53e-01
MSSISVSCVIASLSGCARTVGPPPISGGGPGTVKRKLLVWIWSPLKVRTRSPLKARVCSPLKFRTCRLSKARECSPMMARTCNPLKVRACPPLKMGNM

SEQ ID NO: 150116 - protein, 132 aa, Glycine max
  Coding DNA Sequence Number=SeqID_58431
MVARVMLGNGYEPGMGLAMNNGGKTSLISTRGNRGKFGLGYKPTQADIRKSVGGRKSGSQSSQLGRKVEGGPPCHINRSFISAGLGHEGQVVAICEDDSPSGTDLVRPCPPGFQLGNWQVEERPDIYATNIM

SEQ ID NO: 150117 - protein, 406 aa, Glycine max
  Coding DNA Sequence Number=SeqID_58432
  Gene Ontology: Mol. function=urocanate hydratase activity; Cellular component=cytoplasm; Biological process=histidine catabolic process
  Homolog annotation: Hit_ID=A8UDY4; Match level="QueryCoverage=100%, HitCoverage=61%, E-value=0.0, Identity=82%"; Hit description =Urocanate hydratase
  Pfam annotation: Domain name=Urocanase; Domain location=1-406; Score =66.8; E_value=7.2e-17; Accession=PF01175.9; Description=Urocanase
MKARSITEYPGKSEQAKSIMLMIQNNLDYAVAQHPHELITYGGNGAVFQNWAQYLLTMKYLSEMNDEQTLVMYSGHPMGLFPSHKDAPRVVVTNGMVIPNYSKPDDWEKFNALGVSQYGQMTAGSYMYIGPQGIVHGTTITVLNAFRKINKETKGGLFVTSGLGGMSGAQPKAGNIAGCITVCAEVNPKITKIRHDQKWVNEIHENVDELVARVRKAQENKETVSLAYLGNVVDVWEKFDEEGLKIDIGSDQTSLHNPWAGGYYPVGQSFEESNTMMAENPELFKEKVQETLRRHAAVINKHTEKGTYFFDYGNAFLLEASRAGADVMAENPTLGREFKFPSYVQDIMGPMCFDYGFGPFRWVCTSGKPEDLQKTDDIACRILEEIQQNSPEEIQQQMKDNIQWIK

SEQ ID NO: 150118 - protein, 163 aa, Glycine max
  Coding DNA Sequence Number=SeqID_58433
MSLHSSSSVNGEGSTPKDPLYKILDDLRSLKLWKEKQERKEKGKKRVEEISQDEREKIREEERRKIMKEMKREKHVSYSSHDSCKSLSEELSGYYRGRHSHILNITPKEEKRIEGLKRLNNSLLAIILAKREKFHWLPLAFKGMPSIGGLPLLKNEGFMGILQ

SEQ ID NO: 150119 - protein, 82 aa, Glycine max
  Coding DNA Sequence Number=SeqID_58434
MTRGNSSDLQPFDPEIDRKFHRLVRHHFVPFEHPEHSVIGETQHFVVGNFEHPDFEHYSFEHSDFEHYENMAQPPPSERTLS

SEQ ID NO: 150120 - protein, 156 aa, Glycine max
  Coding DNA Sequence Number=SeqID_58435
MTEPQKLEETLAQFMQVSMSNQKTTESAIKNLEVQAIQAEESRVDQKVEGFKQQMADEPAQVLVDDLVELEEIVEEAEEKKKEATPIECKEVPYPLVPSRKDKERHLAKFLDIFKKLEITLPFRKALQQMPLYAKFLKDMLTKKNRYIHSDKIVVE

SEQ ID NO: 150121 - protein, 275 aa, Glycine max
  Coding DNA Sequence Number=SeqID_58436
MSASKPSLEAEQSTGFHDGKKDTRGCINYNPTLAIRQLGHPMRGALTDESLSPFLVRDFGAQNFKVIQRVHKAWESPLRKDKELRGIRNGIIGRYHEWLKVCTRGLDWLAKLKIINEENFEAPEEDEEVRALKTELGKARLAKEKFKLVATDVRKECAGLREENAATAKALEQETKRARKEEHWCDKFRGALWGSNSELKLRREERDQSRAHSMVLKEELAVCSRSKRNLSQRLCETKTNMLAIITKYQEELSLAMAHEHRVADEYAQVYAEKGG

SEQ ID NO: 150122 - protein, 71 aa, Glycine max
  Coding DNA Sequence Number=SeqID_58437
MSSGCLLVDPNGHNLGRIDGDPVLRETRIWATWEYVSSDGGGQQGMVGLCAHCGCGKLVVHHRPTATKYHM

SEQ ID NO: 150123 - protein, 94 aa, Glycine max
  Coding DNA Sequence Number=SeqID_58438
MFLQKVVASGGSNLACLGKLGGKHLLPFPINRGRREEQKGSTLLVSEIHLKLVRKIVSVKKIHSRGASVTFLWVISRRFSTVLRRSSFVLRSST

SEQ ID NO: 150124 - protein, 177 aa, Glycine max
  Coding DNA Sequence Number=SeqID_58439
MRARARVMGEIEEVQERIKADMEAMEEQMATMMEAMMSMKNIMEVNAVAVAVTNTLAEGDKELGSTGGPHFVQVQNKHAFPLYGLPPNYTPPNVAHTSDENINNSTHILIESQQPQSDNAHVSQPMGETHEVPHHNLADFEPHLGYATEGQAVGGVPLPDTLGGPQFRQQPQPSHFA

SEQ ID NO: 150125 - protein, 540 aa, Glycine max
  Coding DNA Sequence Number=SeqID_58440
  Gene Ontology: Cellular component=peroxisome
  Homolog annotation: Hit_ID=A7PD03; Match level="QueryCoverage=96%, HitCoverage=92%, E-value=4e-90, Identity=41%"; Hit description =Chromosome chr17 scaffold_12, whole genome shotgun sequence
  Pfam annotation: Domain name=Pex14_N; Domain location=45-134; Score =24.2; E_value=4.1e-07; Accession=PF04695.4; Description=Peroxisomal membrane anchor protein (Pex14p) conserved region
MVLSSALLFKGGEIEQTENVDQHNRGEELGKQSSDTSVFVNSEPLREEQIQNAVKFLSHPKVRGSPVIHRRSFLEKKGLTKEEIDEAFRRVPDSPPSVQTAGINQGELSNVEVADWSSVFFIFTFGLSLNCYYIDSWLTVILTDGQLKPSSNIQQQGQPQALQLTVPASTGVTTTLGTLSRRSFHWSHALIAVGLLAASGAGTVIVIKNSILPRLKSWIRNVVLEEDHDQSKRTGSKPTLAEEAAQAAKAAAVAAADIAKASQELLSSKIEEKRYFVEVVNLLDKQVQEMKLMTNAIGRLEASGGLSVSKQEDRLVTQTGSKTQQLIVNGKSDYESRSVRSSSPPVSVEPSSAPHPKSYMEIMAMIQRGEKPSNIREIDDSAPNPYQQPSNPRLAPRAKPWEVSQVQNTSTQVLPYQVNGKIQDNGDNTVPWWQTKNVRIKEIDNEIEYNGAPAASSPQPVQRAWVPPQPPPIAMPEAAEAIRRPKQVVQKEVTLDDQSAAHSSDLTNGSKSEDAIEGNVVNSLVSSGEIQNHEVGYEEK

SEQ ID NO: 150126 - protein, 102 aa, Glycine max
  Coding DNA Sequence Number=SeqID_58441
MSRGSGLKEVVGWEEQCSEHQEIGGTMVSKLINMEERDKEEAQRNLGADGAKVIIVNVYSLCAVGDFNNITRPSERVGISQRQQDERIVKEFNEWIAEWLNK

SEQ ID NO: 150127 - protein, 515 aa, Glycine max
  Coding DNA Sequence Number=SeqID_58442
  Gene Ontology: Mol. function=pantothenate kinase activity; Cellular component=cytoplasm; Biological process=coenzyme A biosynthetic process
  Homolog annotation: Hit_ID=Q8L5Y9; Match level="QueryCoverage=91%, HitCoverage=57%, E-value=0.0, Identity=70%"; Hit description =Pantothenate kinase 2
  Pfam annotation: Domain name=Fumble; Domain location=90-376; Score =473.7; E_value=2.4e-139; Accession=PF03630.5; Description=Fumble
MAGSLQNQRQQLLGIIEEEEQEKLQKQKEETEGNNNNNNNNKSDMAPTAGNSIHRSGSRPQLDVSKAEIQGNVEEKYPTILLPNQSDDLSHLALDIGGSLIKLVYFSRHEDQSWDDKRKRSMKEPLGLSNGNRRSFPILGGRLHFVKFETRKINECLDFIHSKQLHCGGLESHYSDGVTDQNGIIKATGGGAYKYADLFKERLGVSLDKEDEMDCLVAGANFLLKVDGDGKFERVSGTNVGGGTYWGLGRLLTKCKSFDELLELSQKGDNRTMDMLVGDIYGGLDYSKIGLSASTIASSFGKTISEKKELEEYRPEDISLSLLRMISYNIGQVRGHAYTMDTISFAVHFWSNGEAQAMFLRHEGFLGALGAFMSYEKHGLDDLMVHQLVERFPMGAPYTGGKIHGPPLGDLNEKATSLWVLAVISVHSITFTPDYYQSIQSVIPISWMEKFLQKGTEITAPVPMTPLAGTTGLGGFEVPLSKGSTLRSDASALNVGVLHLVPTLEVFPLLADPKL

SEQ ID NO: 150128 - protein, 201 aa, Glycine max
  Coding DNA Sequence Number=SeqID_58443
  Gene Ontology: Mol. function=serine carboxypeptidase activity; Cellular component=extracellular region; Biological process =proteolysis
  Homolog annotation: Hit_ID=B0I1H8; Match level="QueryCoverage=76%, HitCoverage=38%, E-value=3e-36, Identity=50%"; Hit description=1-O -acylglucose:anthocyanin-O-acyltransferase
  Pfam annotation: Domain name=Peptidase_S10; Domain location=4-179; Score=-202.3; E_value=0.0023; Accession=PF00450.13; Description =Serine carboxypeptidase
MESFHEVCNLFYPIPSFLVKFSVTNPLIKAMKIIREATSGHDLAYILDSSCEWDDSETSSRRSLEEFPKCSSQIATLKLSGKYRKMVSMYLPYIPNKEDIPISFEYHVNLSRKGYRSLIYSGDHGLNVLFLGTEAWIRSLNYSIVDDWRPWLTNGQVAGYTSTYSNRMTFATVKASLSYSPCCPSGSHIDSTYKRIFKIGN

SEQ ID NO: 150129 - protein, 194 aa, Glycine max
  Coding DNA Sequence Number=SeqID_58444
MADNNTRKAATNRLEEVVLHFTQGQTTLTTNHQDLSVKVDAILKCLSAMTIPSLTPTCTLMSPTFPHPHITLDVPRFDSHNPLGWIFKISQFFNYQGTPNEERSSIQARTIQPRPKSPQRSSGYTPQAANLAKLQEDKLLDYHRRFKGPTTHLTPIVTHHFNSKQHHAPNSKVQLKYLTPEELASCCEKGLCYH

SEQ ID NO: 150130 - protein, 236 aa, Glycine max
  Coding DNA Sequence Number=SeqID_58445
  Gene Ontology: Mol. function=sucrose transmembrane transporter activity; Cellular component=integral to plasma membrane; Biological process=sucrose transport
  Homolog annotation: Hit_ID=Q58I04; Match level="QueryCoverage=30%, HitCoverage=15%, E-value=1e-20, Identity=56%"; Hit description =Sucrose transporter 2
MGVILAIKHMRNKGWTSLWLECDSTLVVQAFSNDLACLALTLRRPPGALSLPLLLSSSIYLRCGRCRGAFIVVMFPSPLCDYRRPRVNSSTTVEASLEGFEGYNYTTTLGRKRVVLLHNEASSLNSNSPKKDYHIALVRAFRRVKDREMELQALRDEIQASMKLVQPCTGIWSDKCTSRFNRRRPFILKGSLLRTIKGTRTKAALVFIIGFYMLDLANNIVQGPARALLDQQLGAS

SEQ ID NO: 150131 - protein, 214 aa, Glycine max
  Coding DNA Sequence Number=SeqID_58446
MAKTSSIKVINLMRKVWINGVVFTIRVVKDTFSSAMYGEGVGGRKVASKSSSEDEIVEDVCLMGCGELVLGQNVTGISLERRILRVGRKKVFVRPLLNLAQESVGCTKDQLGVVFEDASPSQMTGQVDKASILGTNVASGLSKEDLEGKAKGSVVKVERDHKYLTMLKVTRDPMVNMADRVLGGCLWVIGLSARGGSRCVGGSSGSHRDIIRKE

SEQ ID NO: 150132 - protein, 321 aa, Glycine max
  Coding DNA Sequence Number=SeqID_58447
  Gene Ontology: Mol. function=binding
  Homolog annotation: Hit_ID=A7QJ13; Match level="QueryCoverage=88%, HitCoverage=53%, E-value=1e-48, Identity=35%"; Hit description =Chromosome chr2 scaffold_105, whole genome shotgun sequence
MEGTGFGAAAPTPLVRLWRTAFLTLRDETLTVPPRNSTAQLLDNLIFSHSDALLSAAAELPSHEVLSDILFIMELVAATSSDEEDFTRIYAQTSRLTVAFEMLGEAISRAGPSFPVFRKTMDVLALKTPVVEDSVMSRFYESFLCCLHLILIDPKCSVSDHVSVFVAVLRMFLVYGVSGRTSGLLVGHEEKEPNSMNPKANREQLNKSDRGTYRPPHLRKRDSLNVKLNRARHSQYMSDSESSTVNVTSSDSEFSDGDGSAKESGRVQNSRVRVASITCIQPLYNLPYRVLWRCLPFPIWCPLLMLRPWHVQQLWWKLRVC

SEQ ID NO: 150133 - protein, 46 aa, Glycine max
  Coding DNA Sequence Number=SeqID_58448
MEEKGFGDEGGEAKSRGGNRPGQERNRKVNGKGNVNQNRKANKNNE

SEQ ID NO: 150134 - protein, 235 aa, Glycine max
  Coding DNA Sequence Number=SeqID_58449
MASQENALLSASSFPNSISHKLDDSIFLLWRQQVEPDAPIPMRFGNAFTIISTRKTIATACQLRTQLRATTLAGKSMLEFLSQILAISDSLVSIGSPVMLQAHIDSILKGLSPDYHLIVAIIESKFEPQPIDQVEALDPKSFYNFRGSSSRGGSYSGSFNCSGDGGASGRAGSGSGLGRGAGHFTNFQFQDEWEKAVAEKPEGTDGAERELEEGIWESEGVEAETGGDRSGLRLK

SEQ ID NO: 150135 - protein, 170 aa, Glycine max
  Coding DNA Sequence Number=SeqID_58450
  Homolog annotation: Hit_ID=A7PCW3; Match level="QueryCoverage=100%, HitCoverage=74%, E-value=2e-37, Identity=44%"; Hit description =Chromosome chr17 scaffold_12, whole genome shotgun sequence
MPNLKGRLQKQLNALFVVSEDQSQYCELETTALVPEDDTVAEDISPVSNSYSHLSGSDGKPAVLVASFIFPSLYLRKVLSIIFEDSLLTVANNSDTLPPQLGQRVSSVATLVLSLVIPMVTMGLVWPWTGPAASATLAPYLVGIVVQFAFEQYARYRKSPSWSAIPLIFQ

SEQ ID NO: 150136 - protein, 226 aa, Glycine max
  Coding DNA Sequence Number=SeqID_58451
  Homolog annotation: Hit_ID=A9P231; Match level="QueryCoverage=46%, HitCoverage=93%, E-value=2e-10, Identity=38%"; Hit description =Putative uncharacterized protein
MEEEVDPSIKREKHKENEVMNVGCEDNFLDNPITDLIKKEVEAHCFQDSDFHKKIVMVKQKSFMKVVGTTTVLKSWNANLLGEPLALNFVASMADSLAMELRQKECTEPVMLIKVIWSPPLSLPHRSHRISVCMQGHLDSPQCIERFRKYDHDYAHRLLAKYFSNKNFNGGNIFDLEITVNDEIIKSSRSYADPVVGFEDQSSNGSTPPADSQANIPNGKHAVKKN

SEQ ID NO: 150137 - protein, 781 aa, Glycine max
  Coding DNA Sequence Number=SeqID_58452
  Gene Ontology: Mol. function=transferase activity, transferring glycosyl groups; Cellular component=cytoplasm; Biological process =carbohydrate metabolic process
  Homolog annotation: Hit_ID=Q8VWN6; Match level="QueryCoverage=99%, HitCoverage=99%, E-value=0.0, Identity=75%"; Hit description =Raffinose synthase
  Pfam annotation: Domain name=Raffinose_syn; Domain location=25-766; Score=1670.3; E_value=0; Accession=PF05691.3; Description=Raffinose synthase or seed imbibition protein Sip1
MAPSISKTVELNSFGLVNGNLPLSITLEGSNFLANGHPFLTEVPENIIVTPSPIDAKSSKNNEDDDVVGCFVGFHADEPRSRHVASLGKLRGIKFMSIFRFKVWWTTHWVGSNGHELEHETQMMLLDKNDQLGRPFVLILPILQASFRASLQPGLDDYVDVCMESGSTRVCGSSFGSCLYVHVGHDPYQLLREATKVVRMHLGTFKLLEEKTAPVIIDKFGWCTWDAFYLKVHPSGVWEGVKGLVEGGCPPGMVLIDDGWQAICHDEDPITDQEGMKRTSAGEQMPCRLVKLEENYKFRQYCSGKDSEKGMGAFVRDLKEQFRSVEQVYVWHALCGYWGGVRPKVPGMPQAKVVTPKLSNGLKLTMKDLAVDKIVSNGVGLVPPHLAHLLYEGLHSRLESAGIDGVKVDVIHLLEMLSEEYGGRVELAKAYYKALTASVKKHFKGNGVIASMEHCNDFFLLGTEAIALGRVGDDFWCTDPSGDPNGTYWLQGCHMVHCAYNSLWMGNFIQPDWDMFQSTHPCAEFHAASRAISGGPVYVSDCVGKHNFKLLKSLALPDGTILRCQHYALPTRDCLFEDPLHDGKTMLKIWNLNKYTGVLGLFNCQGGGWCPVTRRNKSASEFSQTVTCLASPQDIEWSNGKSPICIKGMNVFAVYLFKDHKLKLMKASEKLEVSLEPFTFELLTVSPVIVLSKKLIQFAPIGLVNMLNTGGAIQSMEFDNHIDVVKIGVRGCGEMKVFASEKPVSCKLDGVVVKFDYEDKMLRVQVPWPSASKLSMVEFLF

SEQ ID NO: 150138 - protein, 215 aa, Glycine max
  Coding DNA Sequence Number=SeqID_58453
  Gene Ontology: Mol. function=histone-lysine N-methyltransferase activity; Cellular component=nucleus; Biological process =multicellular organismal development
  Homolog annotation: Hit_ID=A7PCU2; Match level="QueryCoverage=84%, HitCoverage=55%, E-value=1e-69, Identity=75%"; Hit description =Oleosin
  Pfam annotation: Domain name=DUF260; Domain location=10-110; Score =233.0; E_value=6.8e-67; Accession=PF03195.5; Description=Protein of unknown function DUF260
MASSSSYNSPCAACKFLRRKCLPGCIFAPYFPPEEPQKFANVHKIFGASNVTKLLNELLPHQREDAVNSLAYEAEARVRDPVYGCVGAISFLQRQVQRLQKELDSANADLLRYACNDMPPPSLSVPPQMPQRSFIARFGNESASGGGFYRPSPTTTTTTYSFPYSLPWTDSEDINDRGGEGGASLGLWLGVTQVQLSIGMCSEHAELTFSVIVYD

SEQ ID NO: 150139 - protein, 139 aa, Glycine max
  Coding DNA Sequence Number=SeqID_58454
  Homolog annotation: Hit_ID=Q2HTA0; Match level="QueryCoverage=76%, HitCoverage=16%, E-value=4e-10, Identity=36%"; Hit description=IMP dehydrogenase/GMP reductase, related
  Pfam annotation: Domain name=DUF1723; Domain location=34-83; Score =46.6; E_value=8.8e-11; Accession=PF08330.1; Description=Protein of unknown function (DUF1723)
MEKKVEKFGRPAPEIEGLVAATGLSPLITCSLDTGDRGLMSTFMERWHKKISSFHPSVGEVTITLDDVASLLHFPITDAFHTFEPLHVDDVILLLVKFLEVSAEKVRAETVQCHGAYVRTIPWGICLTILATRRISEQM

SEQ ID NO: 150140 - protein, 69 aa, Glycine max
  Coding DNA Sequence Number=SeqID_58455
  Gene Ontology: Mol. function=dihydroneopterin triphosphate pyrophosphohydrolase activity; Cellular component=cytosol
  Homolog annotation: Hit_ID=A7P311; Match level="QueryCoverage=55%, HitCoverage=26%, E-value=2e-12, Identity=76%"; Hit description =Chromosome chr1 scaffold_5, whole genome shotgun sequence
MVDVDVVKEQVPQNLEPTKCDGWDWYEWDHLSHPLFGPLEKMVKGSFRSISNLILDARKFVKRLIQKQH

SEQ ID NO: 150141 - protein, 73 aa, Glycine max
  Coding DNA Sequence Number=SeqID_58456
  Subcellular localization annotation: CTP_CleavageSite=13; ConfidenceScore=5.02e-01
MLLSSNVIHICVRVVMLVRTIHTRLFATARVKSCPGMHSSCAIASLSSCARTDGRPPKSGGSPGTDKRKLLAP

SEQ ID NO: 150142 - protein, 182 aa, Glycine max
  Coding DNA Sequence Number=SeqID_58457
  Homolog annotation: Hit_ID=Q2HW90; Match level="QueryCoverage=77%, HitCoverage=33%, E-value=3e-13, Identity=32%"; Hit description =Putative uncharacterized protein
MGQLQRQAFRKAYGKIWDLARVEVSMEPIASLSQYYDQPLRCFTFEDFQLVPTVKEFEEILGCPLGGRKPYLFSGFYPLHDKSCQGQRPWQIKANGLSFIDILALLIFGVALFPNMEGLVDLAAIDAFLAFHHGKESPVVAILAMYDTFDRGCPSIRYKVTARASKKERRIGTNSWLAWRGV

SEQ ID NO: 150143 - protein, 70 aa, Glycine max
  Coding DNA Sequence Number=SeqID_58458
MEEFDAQVAWPEDQPSSSGGGGASTTQVLVTEEPPAPEPSPAVAEEENTPAQTPQPSPPSAPALEETQAS

SEQ ID NO: 150144 - protein, 77 aa, Glycine max
  Coding DNA Sequence Number=SeqID_58459
MKDKRDEEEKLEKQKKKKDSKVLSSKARGKEKEGKDFLQEDFGKNGVQVDPEKMQGHQQEVWPPHQKCGRLLGVCMG

SEQ ID NO: 150145 - protein, 42 aa, Glycine max
  Coding DNA Sequence Number=SeqID_58460
MEESSPNYPFALRHTPSKSPPGTEWSVQFGHQSEDGSPKTLR

SEQ ID NO: 150146 - protein, 73 aa, Glycine max
  Coding DNA Sequence Number=SeqID_58461
  Homolog annotation: Hit_ID=A5AP37; Match level="QueryCoverage=95%, HitCoverage=4%, E-value=6e-07, Identity=42%"; Hit description =Putative uncharacterized protein
MQGCLSYRKPMIMKYASLWRWLSFNSDIVGTDSLLVNDNLYLLDIVASYVEYFNVELHGTKCRIDNTNSGALR

SEQ ID NO: 150147 - protein, 152 aa, Glycine max
  Coding DNA Sequence Number=SeqID_58462
MQNAQVVSIGEINNLRQDCYCLTVGTVDEIIIEAPWSYDSCPNCTTTFDPSKGWSIMGTKETSFSGMQHESSCLAGDDIKVFPTCVDEILFKTWVVRFKFHSQLRQSSVLDVSEELHHIQSLIATLGLKEQSSKGKGIAVEPESSPPIFVPM

SEQ ID NO: 150148 - protein, 103 aa, Glycine max
  Coding DNA Sequence Number=SeqID_58463
MIDQWNNRHAFRVDAYPRQEGLLSFNSDYMVWLKLRRHYNTWCLLKGGIHGQLMISCLMWRKLQFYPKSKRESLSQCHMVLHQSVNFSHSIITFFNQVLKLRA

SEQ ID NO: 150149 - protein, 140 aa, Glycine max
  Coding DNA Sequence Number=SeqID_58464
  Homolog annotation: Hit_ID=B0HC01; Match level="QueryCoverage=25%, HitCoverage=74%, E-value=3e-12, Identity=100%"; Hit description =Putative uncharacterized protein
MRKRHASRREKGGQVSGKRQGRNRRAHEGASRGKRLGGGAYGKTPATRPFYGSWPFAGLLLTCSFLRYPLILWITVLPPLSELIPLAAAERPSAASQERGPLESTAAYASLSPRVGRFINAAGTTGFPTGKRAVSATQLM

SEQ ID NO: 150150 - protein, 198 aa, Glycine max
  Coding DNA Sequence Number=SeqID_58465
  Gene Ontology: Mol. function=L-seryl-tRNASec selenium transferase activity; Cellular component=cytoplasm; Biological process =selenocysteine incorporation
  Homolog annotation: Hit_ID=A4W5Y8; Match level="QueryCoverage=98%, HitCoverage=66%, E-value=7e-93, Identity=74%"; Hit description =Pyridoxal phosphate-dependent enzyme, putative
MVALGGGRVVEAGYANECSADQLAAAITPRTAAILGAKAIEGPTSGLVIGKTRYVEWVKRQTAGIGRAMKVGKEGILGLTCAIEHYLTATKESGAEMVAKMTPFIDALNTLNGVTARVVWDSAGRDIARTEIKFDEAITGIGTGELVNALKQGEYAIYFRGYKANEGIIEADVRSVNADQLNIVYRRISEVLGQENKA

SEQ ID NO: 150151 - protein, 49 aa, Glycine max
  Coding DNA Sequence Number=SeqID_58466
MSLSLEDKLIRQALKSVVFHLLAKPTCWLSERSLSAHSWAKCKEDSGRR

SEQ ID NO: 150152 - protein, 69 aa, Glycine max
  Coding DNA Sequence Number=SeqID_58467
MGEEEKKLEENKVEEKKANEEEKKEEEKKLEESKDDKESKEESVLPEIVLGTTFAMHGHFKHNFRHLLS

SEQ ID NO: 150153 - protein, 49 aa, Glycine max
  Coding DNA Sequence Number=SeqID_58468
MNPGIGPLFYSNPWVLSEKMSPVESPTVATCPFAGERGRGSRVRFPKEE

SEQ ID NO: 150154 - protein, 31 aa, Glycine max
  Coding DNA Sequence Number=SeqID_58469
MGERKKEEEEEEEGKKAPDQGSKEKTKKCAE

SEQ ID NO: 150155 - protein, 71 aa, Glycine max
  Coding DNA Sequence Number=SeqID_58470
MARIPDKIRSNDGSKETLKLAVRITDLWFVGTSNKSEQAEMVFVDSEFAYFRVIKFMIFVNRTTSSLGKLI

SEQ ID NO: 150156 - protein, 53 aa, Glycine max
  Coding DNA Sequence Number=SeqID_58471
MVKARQKGGKRGRWLPPSSPRRAGLLPAEGTVFCWNTLEGPSGSGCYLHTPVY

SEQ ID NO: 150157 - protein, 61 aa, Glycine max
  Coding DNA Sequence Number=SeqID_58472
MGIKRSFKVVMGPRTRLVLSFKTRKGKQGSKGLSKELIQGSINKNQAKAIVQAINGAKHTK

SEQ ID NO: 150158 - protein, 99 aa, Glycine max
  Coding DNA Sequence Number=SeqID_58473
MFWGEAFYLKGRARRVVSNSLTFECLSPVINLAYIRKNCWNPEDLTVSIKGARRARARPVELPSTFGAPILASTSATPSVPVQTNFQHFEAMLQSIHQG

SEQ ID NO: 150159 - protein, 81 aa, Glycine max
  Coding DNA Sequence Number=SeqID_58474
MDQAGEERKLQLSELDEIRLDPARMPKFYREKTKKLRSKATPQTRASRSTDIDLSHSSRTPSLVNVVVEETSLLHPTLPPP

SEQ ID NO: 150160 - protein, 173 aa, Glycine max
  Coding DNA Sequence Number=SeqID_58475
  Homolog annotation: Hit_ID=Q6WAY4; Match level="QueryCoverage=87%, HitCoverage=27%, E-value=1e-17, Identity=37%"; Hit description =Putative uncharacterized protein
MGTNQNGKRFYQVKVKSLDVTSLKELGRLMGPLQRQAFHKVYGKILDLAAAEVFTKAVVSLTQYYDHPLRCFTFGDFQMVPTIEEFEEILGCPLGGIKPYLFSGFLPSLSKVAAVIGDSAKELDRMKKIRNGVVGLPRKYLEDKARDMASQEKWGPFADVLALLIFGVVLFRT

SEQ ID NO: 150161 - protein, 229 aa, Glycine max
  Coding DNA Sequence Number=SeqID_58476
  Homolog annotation: Hit_ID=A4WAQ5; Match level="QueryCoverage=100%, HitCoverage=31%, E-value=1e-102, Identity=79%"; Hit description =Putative virulence protein
MVRTLQSSAARHGELLDGLLPPLKAFETLLAVQQPREEQVNGLFTDTIDLFADSAQENTAQFQTKDKARLAHRVWINHLRQWSRNEATAARLGLEPAVLQQIVDVLVVTSYRLDLPQQLQRIVEADKSSAAQLHAVMGNFIGWLGYDQTPVATRPASRIRKGQAIFVTPVVSSAGPRLTRLGEQPVHAATAYVYDWLVALYSRAIENIDYQHPHDVQPGARKALQALLR

SEQ ID NO: 150162 - protein, 69 aa, Glycine max
  Coding DNA Sequence Number=SeqID_58477
MTKNERRTTNDEERLKIFEKSPTKTKIREELATQLAQASQVASSRSNRLLEEHLGRPKWAWLLFAPPFY

SEQ ID NO: 150163 - protein, 71 aa, Glycine max
  Coding DNA Sequence Number=SeqID_58478
MGALSKGGKMRGVATNVYLWETSEKPKGTGQKENSKFRSCIYVDKSGAFAPTYPPSKGKSDLRSSSLCVNQ

SEQ ID NO: 150164 - protein, 140 aa, Glycine max
  Coding DNA Sequence Number=SeqID_58479
MRLLLHLPLVKVKKQKGKNLEECKDVSVSSKRLAKKKESHFEININIKETSPLRQPPHFLLCKKTLVSIATPLRLEFISQVKDLLDEGLVRNNLNPCALLVPKIVIKGFPMNPKRIKVIPEWLIEAVPESNKHENAVTRK

SEQ ID NO: 150165 - protein, 64 aa, Glycine max
  Coding DNA Sequence Number=SeqID_58480
LRSLDFLEEATKRRIEEVFSTESLSNDGSWSPPMVVGGGEGDVRVWVPFGEEERVKIVFFTLKN

SEQ ID NO: 150166 - protein, 143 aa, Glycine max
  Coding DNA Sequence Number=SeqID_58481
  Homolog annotation: Hit_ID=A5AZG1; Match level="QueryCoverage=66%, HitCoverage=30%, E-value=4e-09, Identity=34%"; Hit description =Putative uncharacterized protein
  Pfam annotation: Domain name=zf-CCHC; Domain location=89-106; Score =22.6; E_value=0.00058; Accession=PF00098.14; Description=Zinc knuckle
ERKPQEANINLPYFHGKDNVEDNLDWEIRVEQKLKRKSTLKSYGSHSYPKKDQGQGILGVTPFKPKDDKGKTIEKQSLKASMQEKTSSIKCFKCLGRGHITSQCPTKKSMTMRGQEIYSSQVQDEATTSPSSSESEEAKEEES

SEQ ID NO: 150167 - protein, 119 aa, Glycine max
  Coding DNA Sequence Number=SeqID_58482
MTPVNRKAGTGERTREPPGGNAWGNSAPFVEPFRSPQSNDRAVASSPFFSCHMKHCRDWTPWHQLPNIVIASMQHIRPLAPAGVIRKRPAPIALRATVAQRFIECSEWQTASDWNSGAV

SEQ ID NO: 150168 - protein, 20 aa, Glycine max
  Coding DNA Sequence Number=SeqID_58483
MEEKRKAKEKRRGEAPSTRE

SEQ ID NO: 150169 - protein, 360 aa, Glycine max
  Coding DNA Sequence Number=SeqID_58484
AVEGDASPLDQHPAADDVVDDQQQEPDRHRGFQARQQRLRGGEITDARRQRRQQRRRQQQPPEGAVEHVVAGAVFIQIQRDAGAFEAVGDQRQRQTQQNEAQPPQRVGELALFQAIEGDQRHDQRHDQPDRHLVVAHGARNLLRRPAEVHDEQPLRVGEGGADHADPQDRQRGGHPFADRFRHRVVPGALQAVAERGPQHRQRHRHQNRPEHGAHRQEEFVLRHLADAAAGALEEGVVVLARTDAENHQQQGAEDRDQRFAAGHHHHEGAAELRQRVQRQNARQIVRHVERIREVDRIDVRHPEQIAVGGVANFVQRFDQLGVGHLQLGQLEDLGVATGQQRVQQLALGAQLGIDDALLL

SEQ ID NO: 150170 - protein, 134 aa, Glycine max
  Coding DNA Sequence Number=SeqID_58485
MVKEERKGGKCLLQETLVIIATPLGLEFIPQVKDLLDEGLVRKSLNPCAFLVPKIGIIRHQIPKIGGMMNVLSGATLFCKISRAPNIFMICVHRDSLGSDKGVPMNPKRIKVIPEWPTPPSVEKKAQSFKNLGM

SEQ ID NO: 150171 - protein, 69 aa, Glycine max
  Coding DNA Sequence Number=SeqID_58486
VGCDSSKLESGGHMNENAIHGAPKKGGEWRIALRAIMKHSSKLESGGNMNENAIHGAPEKRGRMEDCLE

SEQ ID NO: 150172 - protein, 106 aa, Glycine max
  Coding DNA Sequence Number=SeqID_58487
MDEDEWMYEIMSERADMDYENAESCGANEPHVDCSDAFKTSQCREDVLQWARSVAFENGFVAVILRSDTNTGSRGRSTFVSIGCERSGEYKCRKKEFIRRDTGTRK

SEQ ID NO: 150173 - protein, 262 aa, Glycine max
  Coding DNA Sequence Number=SeqID_58488
MRSWVRGQWIAFDADAIGQLLGYPLVLEEGQECEYGQRRNRSDGFDEEAIAQLLCIPGQDFAWTAARRRVRIMRTNMTTLTQIWMTLLLSNILPTDHNSDLPLPKCQLVYAILARMSIHMAQLIADAIYIFAGMAPTRHPLDPDKSNRALGFPALITGLCQSFGVPVAPTKVIRPPITRAFIEKYCTQRQAQGDAPQAAGASPPPHQAGPAGSFDMEQYLRHLGRQQAANHRAHVQTHDCLYQMSLSMQGQGFASFSCPTPD

SEQ ID NO: 150174 - protein, 38 aa, Glycine max
  Coding DNA Sequence Number=SeqID_58489
MGVKFLEAVKRRLHAIKQWSSDEIRIMNHGYGIGELLI

SEQ ID NO: 150175 - protein, 90 aa, Glycine max
  Coding DNA Sequence Number=SeqID_58490
MGVQIAIRPTWAFRFFLQKAVASGGSHLALLGELGGKLLAHFSINRGEVKKKNVQPFWRFRNVPMGDFAKIFNRSLTVFIRSSSFFGLQP

SEQ ID NO: 150176 - protein, 84 aa, Glycine max
  Coding DNA Sequence Number=SeqID_58491
MNIEESIHVTFDESNAILSRKNMLDDIAESLEQIHIHGQNSKGKGKGSNEDPPEEAKLNNELPIEWKASKDHPLDSIIGDISKG

SEQ ID NO: 150177 - protein, 98 aa, Glycine max
  Coding DNA Sequence Number=SeqID_58492
MPDMNAFYGHESPGNYLFLLVHLGVQCPMCTIKKIWEPIQSLCSDSQPLMIAADDPITASPKLSVLSSRRIPCLANSLEYPRVVVAETSCDERRDAFV

SEQ ID NO: 150178 - protein, 159 aa, Glycine max
  Coding DNA Sequence Number=SeqID_58493
MVIDQSLFFELTQLSSDGVPFEDTLDDEWKFDFSVFDARRMVCTNQADMTGRLLAGSLAFECHIMHNLIVRILLPRSSNLAQVSEEDLIIMWVFLTGHQIDWAHLGQPFPCVQESFTTRDPRSLNPFSEVRRREEEISLERDRLYNEDQSQFLIEYASV

SEQ ID NO: 150179 - protein, 279 aa, Glycine max
  Coding DNA Sequence Number=SeqID_58494
  Gene Ontology: Biological process=transposition, DNA-mediated
  Homolog annotation: Hit_ID=Q6UUU1; Match level="QueryCoverage=21%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPAFMHMKRITIGATNDYQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 150180 - protein, 261 aa, Glycine max
  Coding DNA Sequence Number=SeqID_58495
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=33%, HitCoverage=74%, E-value=7e-24, Identity=69%"; Hit description=LacZ protein
  Subcellular localization annotation: CTP_CleavageSite=59; ConfidenceScore=5.53e-01
MEKRLCRGPLTSLLSIFLASSRKSPPRSAQYANRLSPRVGRFINAAGTTGFPTGKRAVSATQLMEQKLVPGPPSRSTVSISLIAIGVPEVQLNLYGEYDLPPWLVPGMSLTGRVIYTSAQYYDLANSQKIPDWATLESNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 150181 - protein, 64 aa, Glycine max
  Coding DNA Sequence Number=SeqID_58496
MKLASTDNRCFWNLLLKCLKQPAWKMTSTRRSPLRIIQAAQYRNSLLALHVLKCKLTTSTTHIL

SEQ ID NO: 150182 - protein, 290 aa, Glycine max
  Coding DNA Sequence Number=SeqID_58497
  Homolog annotation: Hit_ID=A1FY01; Match level="QueryCoverage=80%, HitCoverage=97%, E-value=1e-114, Identity=84%"; Hit description =Putative uncharacterized protein precursor
MEAPMRPYTLAALLSTLPCAAHALDLPPVQYPTLPAQAATAAGFVPNGWTLESSIEGDLDQDGRADLVLVLRQQDPRNVIEHDGFGPSPHDSNPRILAVAWSRPTGYVLAVQDHQLIPRPENPVMSDPLEEGGVSIQRGTLKVALFSFASAGSWSMGTTAFTFRWQDGAFALIGYDQDSVMRNSGKTESLSVNFSTRKVRRVEGSIDNDKDSVRWQPLRGTRRWTLQTVGDGWAFDPRPAPMSHGQIAGSGGCAGPATKHRTQSNHGLDISVATRQRAAPADGGVHRTSS

SEQ ID NO: 150183 - protein, 174 aa, Glycine max
  Coding DNA Sequence Number=SeqID_58498
MENASNAAFTVPGLLLAFCSHVFPALSPDSVDNRITAFDWHDRFPDWKAGSERNAINETAMTMITNSSSVPDCPIFKKRMEKFENKNIGEKKAKKAYIIWDDNDLESSDDSEKKVINLCLMGKNYESDEERLDINQKNNKSFIKISFFHTKILQRTDPKIWDGKCKAHGYTYWY

SEQ ID NO: 150184 - protein, 68 aa, Glycine max
  Coding DNA Sequence Number=SeqID_58499
MGIKSPAVDLLCIQEEQSNNYPVQKNNEFTVTKVYTKESMNQTENDKKQCRKTELNSSNELSSPTTAP

SEQ ID NO: 150185 - protein, 75 aa, Glycine max
  Coding DNA Sequence Number=SeqID_58500
MEAMKEQMATMMEAIMSMKKIMEANAVTVVATSTIGKDLGSTGGPPYVQIQNKHDFPPYGIPPQLYATQCGVHSQ

SEQ ID NO: 150186 - protein, 151 aa, Glycine max
  Coding DNA Sequence Number=SeqID_58501
MEELGSSSLIPSIVCRNRTHKDTQWTRRSPTGPWGFQLWLRASVILQGARSPRQGHVIIGIAPARHPVDPKKSNRVLELSSSNYGSLASGPPTNRAFIKKYYVSRQAQGETPHQPGDGRQRATDAPPSPLEFTFCSSTKRFEYCLHHMADQ

SEQ ID NO: 150187 - protein, 88 aa, Glycine max
  Coding DNA Sequence Number=SeqID_58502
CGYRKVSPLRGRPASGSVDKEGAADKSEALAPTYPPMRNSDLRADNRKVSPRATSSWVMATKGGVVDKSEALAPTYPPMRNSDLRSSG

SEQ ID NO: 150188 - protein, 311 aa, Glycine max
  Coding DNA Sequence Number=SeqID_58503
  Homolog annotation: Hit_ID=UPI00016621D1; Match level="QueryCoverage =56%, HitCoverage=34%, E-value=1e-07, Identity=26%"; Hit description =UPI00016621D1 related cluster
LHVLAFRGLHILTFRGPYVLAIRGLHVPTFRGLHVFAFRGLHVLTFRGLHFLAFKGSCTFAFVGLHALTFRGLHILAIRGLHVPTFRWLHAFAFRGLHVPLFKGLHALALRGRHALTFRGLHVLAIIGLHSLAFKRRHVLNFRGLHALAFRGLHVLTFKTEAITQLLCIPGQDFTRAATKRQVWIMRTNMTTLTQIWMMLLLSKHSVQRPQYRSPPAEVSVGLCRFDIGIVPTRHPVDSEEPNGTLGFPALVMGLDQSYRMPVPQRGHAIDIGIVPARHPVDSEKSNRVLGFPALITSLYQFNRVPVIPNK

SEQ ID NO: 150189 - protein, 300 aa, Glycine max
  Coding DNA Sequence Number=SeqID_58504
  Homolog annotation: Hit_ID=Q2HW90; Match level="QueryCoverage=95%, HitCoverage=55%, E-value=2e-30, Identity=32%"; Hit description =Putative uncharacterized protein
MGTNQNGKRFYQVKVKSLDVTSLKELGRLMGPLQRQAFRKVYGKILDLTAAKVFTEAVVSLAQYYDQPLRCFTFGDFQMVPTIEEFEEILGCPLGGRKPYLFSGFLPSLSKIAVVVGDSAKELDRMKQTRNGVVGLPQKYLEGKARDMASQEKWGPFADILALLIFGVVLFLNVDGLVDLAAIDAFLAYHHSKESPVVAILADLFNTFDRSCEKNSARIVCCLPALCVWLVSHLFQQDTRHPCPLQSYRSCAEKGRVDWDQHLAGIGGSAINWFPRWKEGKEGVIFSCGDYPNVPLIGTR

SEQ ID NO: 150190 - protein, 69 aa, Glycine max
  Coding DNA Sequence Number=SeqID_58505
RPELEAGAGLKACDEFVSDCEILEVTETSSPLMHALLGSFNSGNWSDSKVLDSTGLSCRTIMRNRGAIA

SEQ ID NO: 150191 - protein, 123 aa, Glycine max
  Coding DNA Sequence Number=SeqID_58506
  Homolog annotation: Hit_ID=A5C5C1; Match level="QueryCoverage=68%, HitCoverage=10%, E-value=2e-16, Identity=52%"; Hit description =Putative uncharacterized protein
MTVADSIKTTLPKLRHFQKDCLKCKSWFEKNGELNTHRFLTIQTICPNEKFIFIGNEVKAPVEIVETYCLKRNTGHRLDLLETPYGKQAKHTKKEATRSTQLLEIVHTDICEPFDVSSLGKER

SEQ ID NO: 150192 - protein, 72 aa, Glycine max
  Coding DNA Sequence Number=SeqID_58507
MEKSDKMNFQGKKEKKGYITWEDNTTNKGYISPQEKVILKCRNLPFGGRATRDSRDACSTKGIRAESPPTFI

SEQ ID NO: 150193 - protein, 283 aa, Glycine max
  Coding DNA Sequence Number=SeqID_58508
  Gene Ontology: Biological process=transposition, DNA-mediated
  Homolog annotation: Hit_ID=Q6UUU1; Match level="QueryCoverage=21%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPVTTLNSIGQPPVVDGLHGDTEVVRELLDPDQGLQPRLRRTHAEIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 150194 - protein, 164 aa, Glycine max
  Coding DNA Sequence Number=SeqID_58509
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=59%, HitCoverage=75%, E-value=4e-25, Identity=66%"; Hit description=LacZ protein
  Subcellular localization annotation: CTP_CleavageSite=32; ConfidenceScore=5.04e-01
MTMITPSSKLTLTKGNKSCPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFLPLRTTPSVAEQEGQLIETEATGAPQKHHHTLNQ

SEQ ID NO: 150195 - protein, 56 aa, Glycine max
  Coding DNA Sequence Number=SeqID_58510
MEVDEPWLGLWLPLNYQVGFVVDLGMAFVDNWVVDKEKVCYWLSNDIVGSVGNLAV

SEQ ID NO: 150196 - protein, 149 aa, Glycine max
  Coding DNA Sequence Number=SeqID_58511
MTRGNPGDLQPFDPEIDRTFHRLVRHSVHPGHSVHFEHPDHFEHSVAGDSEYSDFEHLAINFHIENMSQSPPRERTLREMASPDFTYESLCIQYPDEGVPYVLKIGLIHLLHKFHGLVGEDPHKHLKEFHIGCSTMKSPDVQEDHIFLQ

SEQ ID NO: 150197 - protein, 98 aa, Glycine max
  Coding DNA Sequence Number=SeqID_58512
MTGPLDESISCFLIKVDPWVLVLITFRGLYVLATRGLHILACRGLHALSFRGLRGSRPQDAQWARRSPTGPWGFQLWLRASVSPIGCPFPQQGHAIVT

SEQ ID NO: 150198 - protein, 138 aa, Glycine max
  Coding DNA Sequence Number=SeqID_58513
MSCPVIITPTFLCQSVSWYATYQAADTPPPPHQADPAGSFGTKRYLQHLVRQQAANHRGQVQIHECLYQLSLSQQSQGFTPFACPTPDQFRAEVAWLGDWPEAQVGEAPAEAPGDAEEARMDEEMTDLLDFLGGSGAT

SEQ ID NO: 150199 - protein, 117 aa, Glycine max
  Coding DNA Sequence Number=SeqID_58514
  Homolog annotation: Hit_ID=A0ST23; Match level="QueryCoverage=22%, HitCoverage=53%, E-value=1e-07, Identity=100%"; Hit description =Putative reverse transcriptase
  Subcellular localization annotation: CTP_CleavageSite=60; ConfidenceScore=5.45e-01
MVRPMNPGSISPFIPLLQHTWTPCHPGGWKSKLMVPANVGPSSLSIPSTSRGGPVPAFVPFSEVGKPVVPAALMNRPTRGERRFAYWALAECILAYYVGTDEGVSEVLHVAGEKRLH

SEQ ID NO: 150200 - protein, 96 aa, Glycine max
  Coding DNA Sequence Number=SeqID_58515
MSDTMSRTSCSKILELLKALKLQDPRCRIQCPGHPAREYWSCCTMQDKSQIFRKNDRSHPAQEVAAQKRTMLYKREGCTSSVPSPGLKSYFVSFGT

SEQ ID NO: 150201 - protein, 74 aa, Glycine max
  Coding DNA Sequence Number=SeqID_58516
MLVRMIRTRLPAAVWAKSCPGVHNNWAMASSSNPLALFLLWLNSHYLPSSNTSGLSEKAQVIKNCTWFKAQSED

SEQ ID NO: 150202 - protein, 68 aa, Glycine max
  Coding DNA Sequence Number=SeqID_58517
RIKWVGMIRAPYVNFSKSLGQKPVPNSPAGGPILAKESAAIESAVRKGRSGLVEHSGTEGSEASRPRM

SEQ ID NO: 150203 - protein, 272 aa, Glycine max
  Coding DNA Sequence Number=SeqID_58518
  Gene Ontology: Biological process=transposition, DNA-mediated
  Homolog annotation: Hit_ID=Q6UUU1; Match level="QueryCoverage=22%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPVTTLANWSSTAVAAALELVDPPGCRNSIQVVGSFVIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTGK

SEQ ID NO: 150204 - protein, 168 aa, Glycine max
  Coding DNA Sequence Number=SeqID_58519
  Homolog annotation: Hit_ID=A0PAV3; Match level="QueryCoverage=22%, HitCoverage=17%, E-value=6e-07, Identity=76%"; Hit description =Restriction endonuclease
MVKVGTSYVPINVSFSPKVGPGLPGINRDTRIYLFCEVIFRHSCPSCSATDGVGFPSHDVVKRRPVNCNTTHYRANWSSTAVAAALELVDPPGCRNSICCTAAPCPPASCLRAYYLAVSLRNSPVKLAVPYAWPYRCCKERFLQNDQTIKLIDTVDLEGGPGTSFCSL

SEQ ID NO: 150205 - protein, 147 aa, Glycine max
  Coding DNA Sequence Number=SeqID_58520
MTQELVTRGDTLQLSAPRHSVTPSVIDEQRPVWSEFLIGGYVGARASLLSTTPPFVAMTQELVTRGDTLQLSAPFRYPEAAGPMTRRDKIWSFCTLVSSRGGGPDDTRRYLMVIRTLVSSRGGGPDDTQRQNLVILHPCVIQRRRAR

SEQ ID NO: 150206 - protein, 55 aa, Glycine max
  Coding DNA Sequence Number=SeqID_58521
MRCNNWTQPWSMGLEIFLEVHENPWVFFSSSSPIFLEPLAHGSSDWSLPSKDCIN

SEQ ID NO: 150207 - protein, 76 aa, Glycine max
  Coding DNA Sequence Number=SeqID_58522
MENCTSNHYAWLQIEGGGHQLRMENCTKQSLCIAPKLEGGGHIKKKQFLGLRKRLRMENCTKQSLSIAPKSKVEDT

SEQ ID NO: 150208 - protein, 235 aa, Glycine max
  Coding DNA Sequence Number=SeqID_58523
  Gene Ontology: Biological process=transposition, DNA-mediated
  Homolog annotation: Hit_ID=Q6UUU1; Match level="QueryCoverage=25%, HitCoverage=40%, E-value=3e-18, Identity=78%"; Hit description =Putative uncharacterized protein
DLPSQWLLFLSAVPPVQLLTGWCVTAKAPPDISAGKCSGRVPFAIQAAQLLGRAIGAGLFAITPAGERGMCCKAIKLGNARVFPVTTLVMLFRNNQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 150209 - protein, 47 aa, Glycine max
  Coding DNA Sequence Number=SeqID_58524
MHGVATNVYLRKTSEKSERCGLQTLSVKGSGVVFTHGEGFQKSTLNQ

SEQ ID NO: 150210 - protein, 73 aa, Glycine max
  Coding DNA Sequence Number=SeqID_58525
MHDVGKEMFDRRHAVMLLFYTSNGHLSWPMSTVMRIMKLAKYRLKAQVEKDEGPSGEGQSPQVEKDEGSSGEG

SEQ ID NO: 150211 - protein, 95 aa, Glycine max
  Coding DNA Sequence Number=SeqID_58526
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=30%, HitCoverage=28%, E-value=2e-10, Identity=100%"; Hit description=LacZ protein
HPPFASWRNSEEARTDRPSQQLRSLNGEWDAPCSGALSAAGVVVTRSVTATLASADVRRCFCRYAPPPSVAEQEGQLIETEATGAPQKHHHTLNQ

SEQ ID NO: 150212 - protein, 70 aa, Glycine max
  Coding DNA Sequence Number=SeqID_58527
LGRIDGDPVLRETRIWATWEYVSSVGGGQQGMETLGTSGGVLLPKTKLDQSRPNPGIVGLKRGQEAMRAS

SEQ ID NO: 150213 - protein, 96 aa, Glycine max
  Coding DNA Sequence Number=SeqID_58528
MKTNPLANHGGGAVNAVKSGRPRRSKPLKDVMTPRRFIYEALQKGGAIPHGGHEEDSGLLHPGELHNMEACLAVEDLLQQMIDQGRLEVGDKGREE

SEQ ID NO: 150214 - protein, 93 aa, Glycine max
  Coding DNA Sequence Number=SeqID_58529
MWKEFNFVPHFHMKPTKEPDTKIEDKIVVVIIKKGENVNHASFDDVEKKSHVCHHQKGGECESLIQDFFKIKPCLKMKGFKSSKAHVIDYQYM

SEQ ID NO: 150215 - protein, 94 aa, Glycine max
  Coding DNA Sequence Number=SeqID_58530
MVEPSKKRKGSLSRSQRHSEVQDTPFPPPHYCHQKNNVHGALDDDWKFDFSVHDARQLVCTNQADMTGRLLSVSLALKSRILHYLIVCILLPKS

SEQ ID NO: 150216 - protein, 70 aa, Glycine max
  Coding DNA Sequence Number=SeqID_58531
SLVTLSQHALRGRARARLTGALSKGGKMRGVATNEGISTSHVDKSGALAPTYPPSKRKSDLRSSSLCVNQ

SEQ ID NO: 150217 - protein, 210 aa, Glycine max
  Coding DNA Sequence Number=SeqID_58532
  Homolog annotation: Hit_ID=Q6WAY4; Match level="QueryCoverage=89%, HitCoverage=33%, E-value=3e-22, Identity=35%"; Hit description =Putative uncharacterized protein
MGTNQTGKKFYQVKVKSLGITSIKELGRLMGPLQMQAFRKAYGKILDLTIAEISTEVVVSLTQYYDQPLRCFTFRDFQLVLTVEEFEEILGCPLGGRKPYLFFGFLPSLSKTVVVVRDSTRELDRVKQTQNGVVGLPRKYLECKARDMANQEEWVPFMDVLALLIFGVVLFPNMDGLVDLAAIDAFLAYHHSKESPVVAILADLFDAFDR

SEQ ID NO: 150218 - protein, 213 aa, Glycine max
  Coding DNA Sequence Number=SeqID_58533
  Homolog annotation: Hit_ID=Q2HW90; Match level="QueryCoverage=90%, HitCoverage=38%, E-value=3e-15, Identity=28%"; Hit description =Putative uncharacterized protein
MPSFKKWFYHVKVKSLELASLQKLGQRMDQVQHQDFRKAYGKIWDLAMIEVSIEAITSPAQYYAQSLRCFTFGDFQLAPTIEKFEGILGCQLGGRKSYLFSGFYPYMARVAKVVKISAQELNRLKQNRNGVVGITRQRLEEKAKALADQGEWTSFIDVLALLVFGIAHFPNVEGLVDLAAIDAFLAYHHSKESPVVAIFANAYDTFDWRCEKR

SEQ ID NO: 150219 - protein, 110 aa, Glycine max
  Coding DNA Sequence Number=SeqID_58534
  Homolog annotation: Hit_ID=A5AV98; Match level="QueryCoverage=89%, HitCoverage=12%, E-value=2e-19, Identity=50%"; Hit description =Putative uncharacterized protein
MLEEKFVTIIDASSNEEKVHYKTWARSDRLSLMLMRMTVADNIKTTLSKIESAKRFIGLVGEYSQTADKSVVGTLMSTLTTMKFDGSHTMYEHVIEMTNITYVSSGRNEA

SEQ ID NO: 150220 - protein, 69 aa, Glycine max
  Coding DNA Sequence Number=SeqID_58535
MSRNFTYCATKGAKYLKAVNQRVENWVLRYIYGACVVTFYGDIDVILTRSGSLDTGYRDLDDATSSEGR

SEQ ID NO: 150221 - protein, 93 aa, Glycine max
  Coding DNA Sequence Number=SeqID_58536
DSKGSLNCKHHEPHDEGSSIKSMLYKLLVNLRSGVFMLQIDASAVYGWKKGGSGTLNGEDTCLTESLRWQIVSVMMLLAAVFRFTKKMSGSGK

SEQ ID NO: 150222 - protein, 133 aa, Glycine max
  Coding DNA Sequence Number=SeqID_58537
MGDQEETQEQMKADMSALKEQMASMMEAMLGMRQLMEKNVATAAAVSSAAEADPTLLATARHPPSNILGWGRNTLGHDGNPHLGYNRAAYPYGLPPNYSPPVLQDDAGHIASPVLEREPSSPSSNSKHNSPGR

SEQ ID NO: 150223 - protein, 264 aa, Glycine max
  Coding DNA Sequence Number=SeqID_58538
ARASLLSTTPPFVAMTQELVARGDTLRLSAPLCYLDTVVVRWHAETKFGHPAHMIRGDTLRLSAPLCYLDTVVVRWHAETKFGHSAHMIRGDTLRLSAPLCYLDTVVVRWLAETKFGHSAPKIRGDTLRLSAPFCHPEAAGPMTSRDQVWSFCTQDTRRYLTVIRTLLSSRGGGPDDKQRPKTKFGHSAPLYHPEAAGPMIRGNTQVGLTQSSAPFVPPGTTKSFTCGNFMVARDSRQPRGAKLVSYTDFRGPLLDDMRPFFGP

SEQ ID NO: 150224 - protein, 91 aa, Glycine max
  Coding DNA Sequence Number=SeqID_58539
  Subcellular localization annotation: CTP_CleavageSite=50; ConfidenceScore=5.56e-01
TMATPPASPPPPPPPTDTSTSPSTLKRTCKEKRLRSLATRPPGAERLVVNVDPATGKVDGPHKKKLRTYLRIFARDKIDVTYETWKEVPAT

SEQ ID NO: 150225 - protein, 56 aa, Glycine max
  Coding DNA Sequence Number=SeqID_58540
CTRYLEKTDYINLKHGRRNNVHLEHRLPSEFQTPEYGIWKDPKEGKSSRACIGRKG

SEQ ID NO: 150226 - protein, 98 aa, Glycine max
  Coding DNA Sequence Number=SeqID_58541
  Homolog annotation: Hit_ID=Q6UUU1; Match level="QueryCoverage=81%, HitCoverage=54%, E-value=1e-30, Identity=82%"; Hit description =Putative uncharacterized protein
MAYERGGDFLEDARKILNREVRGPRQSRFSIGSAPLTSITKSDAQISVGETRQDYKDTRRFPLAAPSCALLFLPFGLPVSLRCYGRVCLILRLTLSSG

SEQ ID NO: 150227 - protein, 212 aa, Glycine max
  Coding DNA Sequence Number=SeqID_58542
MMITKDDDKGDDKKLKDQSKINSSESSESRTIQEFKIRIKKNSRLKIRIKKNSRLKKKISRIKIKIQDSRLCMRYLTRCAPLPYPHLITLFLQHLNIPLDSEPYVPIKRSFLIGASVIASFGYIKEHDGSWVKKGARNVGEEEHEGEDSSILSKILERFDGLQTFVGERFDTLELQVDMHFNEMESRMTKVEEDVSYIRSSCDLPPPSPPSS

SEQ ID NO: 150228 - protein, 105 aa, Glycine max
  Coding DNA Sequence Number=SeqID_58543
MSPTKPPQKPDPEVDDPLYLMTLTIPELFLRPYQRSGQLQFETESYIKSWMQSSKRDVYLGAYLNGALKVIDDAPRPKSKAPTRWIVVKCNRQKGSTECGYYVMH

SEQ ID NO: 150229 - protein, 70 aa, Glycine max
  Coding DNA Sequence Number=SeqID_58544
MALCSLCEKEVYPNLKFRGPTRRDALHDSENAFLSRFGAEMMTKGWSFVGASMEDERGEESYVRERERAS

SEQ ID NO: 150230 - protein, 251 aa, Glycine max
  Coding DNA Sequence Number=SeqID_58545
  Gene Ontology: Biological process=transposition, DNA-mediated
  Homolog annotation: Hit_ID=Q6UUU1; Match level="QueryCoverage=23%, HitCoverage=40%, E-value=3e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPVTTLVQSECATWVIAIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 150231 - protein, 131 aa, Glycine max
  Coding DNA Sequence Number=SeqID_58546
MENNDGLWWLMVAVGDGETTRKQRLKCLNKRCSQERKLLAHSRHLLKDHNGPIMEKCLVKLKTKFREDPTVNEGWAAFLPRQLHVAFSRSIIKRLLEPSRYLLKDPNGRIMDKCLVKLQTKFREDPTVNEG

SEQ ID NO: 150232 - protein, 90 aa, Glycine max
  Coding DNA Sequence Number=SeqID_58547
MAIMSCFAWGHSNVRATLEVSNQQGFESSLQVPRGDSCIDFKPNRSKIGFLIRHEECGEEERDGKPWYFDIKQYVENKEYPPGISDNDKR

SEQ ID NO: 150233 - protein, 86 aa, Glycine max
  Coding DNA Sequence Number=SeqID_58548
MGEVEEVQEKVKADMEAMKGQMAMMMETMMIMKKIMEASAVAVAATSTVAKVNLMPQSGLNQMNHPTSTMVGKDLGSMGRPHDVQI

SEQ ID NO: 150234 - protein, 168 aa, Glycine max
  Coding DNA Sequence Number=SeqID_58549
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=30%, HitCoverage=50%, E-value=6e-24, Identity=100%"; Hit description=LacZ protein
MKHFTDTLISANIKCSPTWPIRDLFSHGHSHRYGIHTYGSEGTASNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 150235 - protein, 47 aa, Glycine max
  Coding DNA Sequence Number=SeqID_58550
MGLAGKDVLSTNIICFKVFGSALSAALSAAAALSPKCLLEVTTSSWA

SEQ ID NO: 150236 - protein, 169 aa, Glycine max
  Coding DNA Sequence Number=SeqID_58551
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=52%, HitCoverage=74%, E-value=3e-24, Identity=67%"; Hit description=LacZ protein
  Subcellular localization annotation: CTP_CleavageSite=40; ConfidenceScore=5.38e-01
MTMITPSSKLTLTKGNKSWYRAPPRGRRLTLVVLLLVKSYATVEVSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 150237 - protein, 262 aa, Glycine max
  Coding DNA Sequence Number=SeqID_58552
  Gene Ontology: Mol. function=motor activity; Cellular component=cell projection
  Homolog annotation: Hit_ID=UPI00006A2D9E; Match level="QueryCoverage =91%, HitCoverage=97%, E-value=5e-12, Identity=17%"; Hit description =UPI00006A2D9E related cluster
MRGLHALTFRGLHVLTIKSLHALFFRGLHVLAIRGLHALTIRGLHVLAIRGLHVLACRGLHVLAIRGLHAITFRGLHVHAIRGLHAFALRGLHVLASRRLHAFTFRGLHVLTIRGHHALSYRGLHVLAIGGLQTLTFRGLHVLVSRRLHTLIIRGLHVLAIRGLHTLAFRGLHVLALTFKGQHVLTIRGLHALSFRGLHVLDIGGLQDLTFRGLHVLAIRGLHTLPFRGLHVLAIRGLHSLALEDFKSSPSEGCTPSPSKDN

SEQ ID NO: 150238 - protein, 107 aa, Glycine max
  Coding DNA Sequence Number=SeqID_58553
  Subcellular localization annotation: CTP_CleavageSite=57; ConfidenceScore=5.57e-01
MPITPCKSISWSVSSRHGDRTHKTPSGPGKVQQGPGVSSSGYGPLSVLQGARTPPARSRHHSSRECLLPPAGSSGPLPIEFSSRSVAPPGRRRARHHSSIGMDGSGQ

SEQ ID NO: 150239 - protein, 152 aa, Glycine max
  Coding DNA Sequence Number=SeqID_58554
  Gene Ontology: Mol. function=chloramphenicol O-acetyltransferase activity; Biological process=response to antibiotic
  Homolog annotation: Hit_ID=P62577; Match level="QueryCoverage=100%, HitCoverage=100%, E-value=2e-40, Identity=78%"; Hit description =Chloramphenicol acetyltransferase
  Pfam annotation: Domain name=CAT; Domain location=6-142; Score=260.1; E_value=4.8e-75; Accession=PF00302.9; Description=Chloramphenicol acetyltransferase
MEKKITGYTTVDISQWHRKEHFEAFQSVAQCTYNQTVQLDITAFLKTVKKNKHKFYPAFIHILARLMNAHPEFRMAMKDANPWVSFTSFDLNVANMDNFFAPVFTMGKYYTQGDKVLMPLAIQVHHAVCDGFHVGRMLNELQQYCDEWQGGA

SEQ ID NO: 150240 - protein, 220 aa, Glycine max
  Coding DNA Sequence Number=SeqID_58555
  Subcellular localization annotation: CTP_CleavageSite=45; ConfidenceScore=5.42e-01
MNLLPSAVHVSSTFESGALRIDCLALFANSPFSTFIQSPMNSLPSVVQVSSTFESGAPRIDCLALFANSPFSTFIQSPMNSLHSAVHVSSTFESGAPRIDCLALFANSPFSTFFRSPMNSLPSAVHVSSTFESGAPRIDCLALFANSPFSTFIRSPMNSLPSAVHASSTNESGGSRIDYLALFASSPFSTFILSPMNLLHSAIHVSSTIESGALRIDCLA

SEQ ID NO: 150241 - protein, 128 aa, Glycine max
  Coding DNA Sequence Number=SeqID_58556
  Gene Ontology: Mol. function=RNA-directed DNA polymerase activity; Biological process=RNA-dependent DNA replication
  Homolog annotation: Hit_ID=A5C8W2; Match level="QueryCoverage=77%, HitCoverage=6%, E-value=6e-10, Identity=30%"; Hit description =Putative uncharacterized protein
GNIDVNRISSIQKKLNEVEDLASNRILTDQELKIRNSLQQELWNVSNAVESLLRQKSRISWLKKGDCNSGYFHRIINFRRAFNAIPGDKCPGPDGLNFNFIKKFWDIMRPEFRRFVDEFYAHGSFPRG

SEQ ID NO: 150242 - protein, 92 aa, Glycine max
  Coding DNA Sequence Number=SeqID_58557
  Homolog annotation: Hit_ID=Q6UUU1; Match level="QueryCoverage=93%, HitCoverage=58%, E-value=2e-07, Identity=44%"; Hit description =Putative uncharacterized protein
MAYERGGDFLEDARKILNKEVRGPRQSRFSICSAPLTSITKSDAQSVVAKPDRTIRIPGVSPWRLPRALSCSCLSVYRCHSAVMAAFVSFHA

SEQ ID NO: 150243 - protein, 73 aa, Glycine max
  Coding DNA Sequence Number=SeqID_58558
  Homolog annotation: Hit_ID=Q1J7G7; Match level="QueryCoverage=45%, HitCoverage=47%, E-value=1e-09, Identity=84%"; Hit description =Transposase
MRSDIPSQVIQWILFLSAVPPVQILTGWWVTAKAPPDISAGKSSGHDARNHHTRRVYPLQSPFSEEFRGGLIQ

SEQ ID NO: 150244 - protein, 71 aa, Glycine max
  Coding DNA Sequence Number=SeqID_58559
MKSGDMRGNIMVTRTFRQPGENEPVDARRLTSSSAPFVVLTREVRSHAGLPLGYTAPFVNQRQLSPLTRGD

SEQ ID NO: 150245 - protein, 101 aa, Glycine max
  Coding DNA Sequence Number=SeqID_58560
  Subcellular localization annotation: CTP_CleavageSite=43; ConfidenceScore=5.18e-01
MAPSPDAPPQISLTNGISFPLRTDSFKNLERTDKARCEFSGFQCSTNPSPQSDSQEYRITNLEFQVFPPLILITFLPTLSSPHPFLDQLYLLGGLLYHFRS

SEQ ID NO: 150246 - protein, 67 aa, Glycine max
  Coding DNA Sequence Number=SeqID_58561
MEELANPGFLFKSRIFHHNSINMIPPILMQSYPARALGRRLQVDWARDSREGRRVLMSLRVDFEPMG

SEQ ID NO: 150247 - protein, 166 aa, Glycine max
  Coding DNA Sequence Number=SeqID_58562
  Gene Ontology: Mol. function=transcription factor activity; Cellular component=intracellular; Biological process=regulation of transcription, DNA-dependent
  Homolog annotation: Hit_ID=Q7D1T4; Match level="QueryCoverage=96%, HitCoverage=100%, E-value=9e-75, Identity=88%"; Hit description =Transcriptional regulator, MarR family
  Pfam annotation: Domain name=MarR; Domain location=54-126; Score =83.9; E_value=5.2e-22; Accession=PF01047.13; Description=MarR family
MSKEPLDHVDHILAQWRRERPDLDVGPMGLLGRLNRLATHLGREVEAVLLKHGLSSSAFDVLATLRRSGSPYRLSPGDLLDMTMESSGTVTNRIDQLEKAGLVERIHNPNDRRSVLISLTERGFAIVEEAAGAHFENQHRLVAVLSEEERATLNRLLKRFLRDFEE

SEQ ID NO: 150248 - protein, 101 aa, Glycine max
  Coding DNA Sequence Number=SeqID_58563
MILHEFRRPNSLKIIPSGVANCHNLSFGGRATRDSRVRLPRKENARSRHQHLFEQNIVKTGKVWSTNFKCERFGSCIYARGRVFSLAPTYSFNCDKEIRPT

SEQ ID NO: 150249 - protein, 80 aa, Glycine max
  Coding DNA Sequence Number=SeqID_58564
MLTSSGRVQMTTLVSVCQLGLGSPNDGVRITGRCLHMLPDSWVMIAKDGAVDKSEAFAPTYPQFVMRNSDLRSSFFVRLK

SEQ ID NO: 150250 - protein, 45 aa, Glycine max
  Coding DNA Sequence Number=SeqID_58565
MPYASGTESSEPSPSDDRGVKMMMVACWSAMCRRQRSSLFVDELR

SEQ ID NO: 150251 - protein, 214 aa, Glycine max
  Coding DNA Sequence Number=SeqID_58566
LQRVTRPRHQRTACLHLRGLHALTLRGLHVLANVGLHALTFRGLHVLANRGLHALTFRGLHILAFRGLHVLTLRGLHVLVLRGLHVLALRGLHVLTIRGLHALTSRGLHVLALRGLPRPRLGTTRPRPLRGLHVLTLRGLHALAMRGLHVLTFRGLHALAIRGLHVLTFVGLHALTFRGLHVLANRVLHALHLERTTRSRQRRATRSSPFIGLH

SEQ ID NO: 150252 - protein, 60 aa, Glycine max
  Coding DNA Sequence Number=SeqID_58567
  Subcellular localization annotation: CTP_CleavageSite=43; ConfidenceScore=5.11e-01
MGVPFADGPFLRALNIPPHKKNSVFFPGFSIRYSLSLEEILLSSSSGERMRIFFMDQGSK

SEQ ID NO: 150253 - protein, 84 aa, Glycine max
  Coding DNA Sequence Number=SeqID_58568
MVKVGTSYVPINVSFSPKVGPGLPGGGRTLIDLLVRGAPLSPFGNCGQLLNERQPGIEAASCVLRPGAKGMCCIRRLLCWVTEP

SEQ ID NO: 150254 - protein, 137 aa, Glycine max
  Coding DNA Sequence Number=SeqID_58569
  Homolog annotation: Hit_ID=Q6WAY6; Match level="QueryCoverage=96%, HitCoverage=23%, E-value=9e-12, Identity=32%"; Hit description =Putative uncharacterized protein
MGPLQRQAFRKVYGNILDLTAAEVFTEAVVSLAQYYDQPLRCFTFGDFQMVPTVEEFEEILGCPLGGRKPYLFFGFLPSLGKIVAVVGDSSKELDRIKQTRNVVVGLPRKYLEGKARDMASQEKWGPFTDILALLIF

SEQ ID NO: 150255 - protein, 132 aa, Glycine max
  Coding DNA Sequence Number=SeqID_58570
MECLEGVWETLEGNARCRFRDTIRFTATSLVHPEEPARTLQRTMEWILPTPTPYRLVELVQVIEVTSSEEDLEEDPEELPPEPAVDALDFPEGDEDPLPDVDSPEDVMSASEADSMEESGPGGIATSGDSSS

SEQ ID NO: 150256 - protein, 155 aa, Glycine max
  Coding DNA Sequence Number=SeqID_58571
LFVLQIAKKNVYTDNHSGISARQRDSKVSMTDPTAKKNVYTDNLSGISARQRDSKCEYDRTCFSSYRQQKRMFIRITTRVFPPVSVTQNVSMTDLVSAEDDGALDDVSLCVLSELVSAEDDIAKKNVYTDNHSGISARQRDSKVSMTDPVSAEDD

SEQ ID NO: 150257 - protein, 137 aa, Glycine max
  Coding DNA Sequence Number=SeqID_58572
  Homolog annotation: Hit_ID=Q2H7J5; Match level="QueryCoverage=58%, HitCoverage=35%, E-value=1e-07, Identity=32%"; Hit description =Putative uncharacterized protein
MQHLMKLLERDQYIHWHRLKDEVVVRDLFWCHPDAVKLCNACHLVFFIDSTYKTNRFHIDKNVKAKCKSLIGEKNAWDYVMDNWGTLVDCPSEYEFHESYQKFQVACSPWPMFVDYVNDTWIIPHKEKFITAWTNKG

SEQ ID NO: 150258 - protein, 55 aa, Glycine max
  Coding DNA Sequence Number=SeqID_58573
  Subcellular localization annotation: CTP_CleavageSite=33; ConfidenceScore=5.38e-01
MACSPLKFRTCCPLKARACSPLKVRTCSPLKVRMSSPLKARACSPLKARTCSPLN

SEQ ID NO: 150259 - protein, 49 aa, Glycine max
  Coding DNA Sequence Number=SeqID_58574
MKEKKKKEEKNEAEALPNCDRNRLLHHSSFVVRLKELRRSEFLIAPEDT

SEQ ID NO: 150260 - protein, 157 aa, Glycine max
  Coding DNA Sequence Number=SeqID_58575
  Homolog annotation: Hit_ID=A2Q1D6; Match level="QueryCoverage=80%, HitCoverage=25%, E-value=7e-19, Identity=35%"; Hit description =Ovarian tumour, otubain, related
NGETKKHSANSEGGNANSCSTIKQIYNARSAYHSSIRGSDTEMQHLMKLLEWDQYIHWHRLIDEDVVCDIFWCHPDAVKVTPTGMTFSVGFAYLKGERLNNVVWALERFRGAFLRRDVLPRVIVIDRDLALMNAVKIYVMDAWGTLVDCPSEQQFEM

SEQ ID NO: 150261 - protein, 332 aa, Glycine max
  Coding DNA Sequence Number=SeqID_58576
RAPVELSRSVIFLRMASRKRKSTTSRPQAQYDTKRFQSLETWNRYTDNILDRRILLERNVKIYHTKFDEFKAELERCNLHKRLANLQDGSIDVAVVKEFYANLYSPKDQSPKQVRGETLPTYSRLTRMRIDPQEFAACLCIPVNFREAREVRARPADIPSSSTPPAPSTSATPTPSPPISATLAPAVVAPPGSILSVEQFIEKDASSEAIIPGAFNFSSAGVEMRPDEVVPPEPIMPAIHETVEAGESQLRQEAATPERTSQTPKGPLSPGMDLSFAQQVADAPTPIIEMLEDPTTPVLRLSSTPPATPVLHLTNEEDMQDTQGTQDQSQEF

SEQ ID NO: 150262 - protein, 75 aa, Glycine max
  Coding DNA Sequence Number=SeqID_58577
MKTFQFAHGKRCNKGEHYPISPAPRLSLPYEIPDEHSSGGQESDRSGYRYMEQLTEMPQNVLYDAIGIYQRWYIQ

SEQ ID NO: 150263 - protein, 316 aa, Glycine max
  Coding DNA Sequence Number=SeqID_58578
  Gene Ontology: Mol. function=oxidoreductase activity; Biological process=tRNA processing
  Homolog annotation: Hit_ID=A6THH8; Match level="QueryCoverage=79%, HitCoverage=98%, E-value=1e-136, Identity=94%"; Hit description =Hydroxylase for synthesis of 2-methylthio-cis-ribozeatin in tRNA
  Pfam annotation: Domain name=MiaE; Domain location=5-248; Score =543.2; E_value=2.9e-160; Accession=PF06175.2; Description=tRNA -(MS[2]IO[6]A)-hydroxylase (MiaE)
MDYPQILSPILAFLHCPTPQAWIDEARKPENLPLLLTDHMVCELKAAQNAMLLVRRYVADKDGADELLECLKPYEDFTYRRGPEPDFVALHKRINKSAMPRTNDPWGSQLLDSMILLIKEELHHFWQVREIMLARDIPYVKITASNYARGMRREVRSHEPVMLIDKLICGAYIEARSCERFAALAPWLDDDLQKFYLSLLRSEARHYQDYLDLAQMIAGGDISERVRQLGEAEAALILRPEPEFRFHSGVPTRCSPRYSAPIAPVSAALPGRPTVARRYSVFNIRTSQSTCRCSPAARQYAQTRDAHTANRFFQKA

SEQ ID NO: 150264 - protein, 108 aa, Glycine max
  Coding DNA Sequence Number=SeqID_58579
MEWFFRISHSFFTQIEETAEPRHLPPPHDEEFVKPLIPKVSVASDLHTHSVVNCERCQGMAEDLGAIIEDLERVINLRMVTESTDLYDIMTRCLRRARGDAANESLRL

SEQ ID NO: 150265 - protein, 70 aa, Glycine max
  Coding DNA Sequence Number=SeqID_58580
MPVKDNRGKWAPNYEGPFVVKRAFSGGALEQNRLRQWSNAGMGLKAETNQGKTVTRPQFATRCRFLLSGT

SEQ ID NO: 150266 - protein, 104 aa, Glycine max
  Coding DNA Sequence Number=SeqID_58581
LFVIQTAKKNVYTDNHSGISARQHDSNVSMTDLVSAKMTLFVLQTAKKNVYTDNHSGISARQHDSNVSMTDLVSAEDDAFSYRRKKNVCTDNHSGISARQRDSM

SEQ ID NO: 150267 - protein, 98 aa, Glycine max
  Coding DNA Sequence Number=SeqID_58582
  Homolog annotation: Hit_ID=Q8GEG1; Match level="QueryCoverage=76%, HitCoverage=83%, E-value=8e-23, Identity=53%"; Hit description =Putative uncharacterized protein
MAYERGGDFLENAGKIHNREVRGPRQSRFSIGSAPLTSITKSDAQISGGETRQDYKDTRRFPLAAPSQFAPSWTVCTNPPFSPTAAPYPELVLKSCAG

SEQ ID NO: 150268 - protein, 225 aa, Glycine max
  Coding DNA Sequence Number=SeqID_58583
  Homolog annotation: Hit_ID=A2Q4S5; Match level="QueryCoverage=44%, HitCoverage=15%, E-value=5e-10, Identity=36%"; Hit description=IMP dehydrogenase/GMP reductase, putative
MGSCCPGAYCWIYEHFPSVVECIVDPDYDEVSPRACRWIATKATVKTISTSTYRQRLDRLRIPDVCWMPYGEHRPVLEFHLISCFSDQLCWGPVAVRHRPERSFDEIDNRWMHYLDHLEPEGEMCVVPGQCSPDYMDWFFIISHPFMTAAQPSDPPRDAPATQTKHIPHIPQVLEPYIPQVLEPATTSTHARSDEDEPRHAVRHMRSSNNAPGLPGVSQKTALCM

SEQ ID NO: 150269 - protein, 293 aa, Glycine max
  Coding DNA Sequence Number=SeqID_58584
  Gene Ontology: Biological process=transposition, DNA-mediated
  Homolog annotation: Hit_ID=Q6UUU1; Match level="QueryCoverage=24%, HitCoverage=46%, E-value=2e-18, Identity=71%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPEFDRADEELDGVVQERRVRARRVERRRERGIEPRGALARLGPRDIALDRVDLPVVAEEAEIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGRRFPGRCQEDT

SEQ ID NO: 150270 - protein, 207 aa, Glycine max
  Coding DNA Sequence Number=SeqID_58585
EMAPRKLASKRSRKDKAAEGTSSAPEYAVIALGALNTSSASRPSRDGHFSGSDASSSGTMSIPISKKRYPQILCQCLAYRGGRARYEVLDAIGQFLGYPLVLEEGQECEYSQRRNWSDRFDEEAIAQLLCIPGQDFARTAAGRRVRIMRTNMTTLTQIWMTLLLSNIQPSDHNSDLPLPKCQLVYAILTRMSIHVAQLIADAIYIFA

SEQ ID NO: 150271 - protein, 74 aa, Glycine max
  Coding DNA Sequence Number=SeqID_58586
TYQGNPCGVYPDLSSFTGSGVYRDLSSFTGSGVYPDLSSFIGSGVIQNLRSLYQTIRSYSGSHHLVSELRLLIQ

SEQ ID NO: 150272 - protein, 221 aa, Glycine max
  Coding DNA Sequence Number=SeqID_58587
  Homolog annotation: Hit_ID=UPI00006A2D9E; Match level="QueryCoverage =82%, HitCoverage=96%, E-value=2e-16, Identity=18%"; Hit description =UPI00006A2D9E related cluster
MSKSCGFGMTGPLDESISCFLIRVDPPSPWVLVPSPSRGLHVLAFRGPHALAFRGLHVLTFRGLHVLTFRGLHALAIRGLHVLTFRGPHILTFRGLHALAIRGLHVLTFRGLHALAIRGLHVLTFRGLHALAIRGLHVLTFRGLHALAIRGLHVLTFVGLHALTFRGLHVLANRGLHALTLRGLHALANRGLHALTLRGLHILANRGLHALTLKRTTRPRQ

SEQ ID NO: 150273 - protein, 93 aa, Glycine max
  Coding DNA Sequence Number=SeqID_58588
MPPHNTFHNHYMQVKGYLKAFHLWLVIDYQRPPQCSSPLSKLGNPSQVLTDRLCPGWVGIGQAWFWAIAPQLTSPRSPDPPRHISRYHSVVNK

SEQ ID NO: 150274 - protein, 175 aa, Glycine max
  Coding DNA Sequence Number=SeqID_58589
SSRSPLIDFGKAGGRLASLTGEKWWVSTNGHSWLGSDNAIPEGVGSWALDPFGPGERVTLGRGLVNQLVAPLVEASQFKYVIRRGIRPRGISIGTSPSDFARRRSRHSPRAMRKDESPARTTRASFPACGSSVITYSDLRELADRSLSGDAPSSMSEPFRTWLGMGVTIPALIQP

SEQ ID NO: 150275 - protein, 284 aa, Glycine max
  Coding DNA Sequence Number=SeqID_58590
  Homolog annotation: Hit_ID=Q6WAY6; Match level="QueryCoverage=93%, HitCoverage=44%, E-value=7e-39, Identity=35%"; Hit description =Putative uncharacterized protein
MAEVSTEAIASLAQYYDQPLRCFTFADFQLTPTVEEFEEILGFPLGGRKPYLFSGFYPSLARISKIVKVSTQELDRGKQVKNGVVGVPRKCLEARARVLASQGEWAPFMDILALLIFGVVFFPNVDGLVDRAAIDAFIAFYDRKESPVVAILADLYDTFDRRCEKNNARIICCMPALYIWLVSHLFRQEMRHVCPLEGHRSCTEKKEVNWDQLLANKEGASVNWFPRWKEGRTGIIISCGKFPNVPLIGTRGCINYNPVIAIRQLGYPMRGAPSKEGLIPFIIR

SEQ ID NO: 150276 - protein, 140 aa, Glycine max
  Coding DNA Sequence Number=SeqID_58591
  Gene Ontology: Biological process=transposition, DNA-mediated
  Homolog annotation: Hit_ID=Q1J7G7; Match level="QueryCoverage=21%, HitCoverage=42%, E-value=2e-10, Identity=100%"; Hit description =Transposase
MVKVGTLRADQRLIFAKSWPRASRYQQGHQDLFILRSDLPSQWLLFLSAVPPVQLLTGWCVTAKAPPDISAGKCSGHAARRVPFAIQAAQLLGRAIGAGLFAITPAGERGMCCKAIKLGNARVFPEFDIRGAPDSKVEDA

SEQ ID NO: 150277 - protein, 110 aa, Glycine max
  Coding DNA Sequence Number=SeqID_58592
STLEDPAYFAIGAGAVTSFGYRKDRNGQWLKKDALPPQDERTPSPPPQRDDSALMTEVLSELRGLRSYVGERFDSLDTHFAGMDIRLTQLEEDVGYIRQSFDLPPPPPPS

SEQ ID NO: 150278 - protein, 182 aa, Glycine max
  Coding DNA Sequence Number=SeqID_58593
  Homolog annotation: Hit_ID=A1IW39; Match level="QueryCoverage=33%, HitCoverage=95%, E-value=7e-14, Identity=68%"; Hit description =Putative uncharacterized protein ophh-69
MNGAKRSAEAVGCKKESVGERSALEGRTRASSAGRSGSENVGLSNANVGENPMPRKPKGSSARPKGVVDGQQVNIPVLPFVGPEGREEARLAERWLSVQGRKVPLLFQGNKGVEKMPRAKVRVPGATALSNPCHTPRKARTTFNKWVPVPETDTGGGALLTKGVAVTRPGATVLPKTQVSAK

SEQ ID NO: 150279 - protein, 149 aa, Glycine max
  Coding DNA Sequence Number=SeqID_58594
  Gene Ontology: Mol. function=nucleoside-triphosphatase activity; Cellular component=chloroplast
  Homolog annotation: Hit_ID=Q2PMM5; Match level="QueryCoverage=77%, HitCoverage=6%, E-value=2e-52, Identity=76%"; Hit description =Protein ycf2
MANSSDSIVSSTMESEIIHRNNELLLISTHLRSLNVQEFFYSILFLLLVAGYLVRTHLLFVSRVYSELQTEFEKNLFLVALEQLGDSLEEIRSFAFGGNMLWGGGPTYGVKSIRSKKKYLNLIDLISIYTKSHQSNRFFEKYETSKSSK

SEQ ID NO: 150280 - protein, 180 aa, Glycine max
  Coding DNA Sequence Number=SeqID_58595
MVKVGTSYVPINVSFSPKVGPGLPGINRDTMDLDLYVWDEGLFRPTVYDGVFEVLQWRICFYQLFPPVQLLTGNGVIRNGTKHQPDISAGKCSGANDADAARPFPSQAVGNCNEEARAIEVFPVERVWQEKKGCTGQSEYVNTTHYQGELSELLPLGSETGSAAKPFFHRLRPPDKHHEI

SEQ ID NO: 150281 - protein, 177 aa, Glycine max
  Coding DNA Sequence Number=SeqID_58596
MAPRKLSAKRSRKGATAEGTSAAPKFDSHRFRSAKHQQRFEAIKGWSFHRERRVQLRDDEYTDFQEEIARRRWTSLVTPMAKFDLDIVLEFYANAWPTEEGVWDMRSWVRDQWIPFNADALSQFLGYSLVLEEGQECEYRFCPDRCQETGADHAHQHDYLDPDVDDVAVQQHPAQRS

SEQ ID NO: 150282 - protein, 111 aa, Glycine max
  Coding DNA Sequence Number=SeqID_58597
MTRGNPSDLQPFDPEIDRTFHRLVRHHLVPFEHSDIGDFEHSDFEYSENMAHPPPRERTLRELAAPDFTYESLCIQYPDEDVPYVLKTGLIHLLPKFLIRNQSVVTEANNQ

SEQ ID NO: 150283 - protein, 41 aa, Glycine max
  Coding DNA Sequence Number=SeqID_58598
MGQNTPKDYDDGWLEFSQRNNKDFKSQNVKRLLFSEQLPIT

SEQ ID NO: 150284 - protein, 66 aa, Glycine max
  Coding DNA Sequence Number=SeqID_58599
MENWRTALSNNIAGLQTRRWRTLELRQAMTFIGLRKNWKKEKLGNTAPQNLIGFPNSKVGDSEPGQ

SEQ ID NO: 150285 - protein, 101 aa, Glycine max
  Coding DNA Sequence Number=SeqID_58600
MIDAQSVSRDIPDTYQINTGNRLHAHAPRPTWPSGIIPTREAVNAFEDLEATLLPGRATHAWASWAKPPPYFATKYLGEEGKKEGVSPLRLLSLVLNLLGI

SEQ ID NO: 150286 - protein, 297 aa, Glycine max
  Coding DNA Sequence Number=SeqID_58601
  Homolog annotation: Hit_ID=Q6WAY6; Match level="QueryCoverage=85%, HitCoverage=42%, E-value=1e-32, Identity=33%"; Hit description =Putative uncharacterized protein
MVEVSTKAIASLAQYYDQLLRCFTFGDFQLSPMVEEFEEILGCPLGGRKPYLFSEFYRSLARISKIVQTSAQELDHRKQVKNGVVGIPRKYLEAKTRILASKGEWAPFIDILALLIFGGVLFPNVDGLVDLATINAFLAYHNHKESPVVAMLADLYYTFDRRYEKSNTMIVCCTPALYVWLVSHLFRQEVRHACSLESHCSCTEKGGANWDQLLASKEGASVNWFPRWKEGRTGVLISCGGFPNVPLMGTRGCISCNPVLAIKPTWRHFRRSARHGRCCKRRTRNLGAVTMGPSVAI

SEQ ID NO: 150287 - protein, 164 aa, Glycine max
  Coding DNA Sequence Number=SeqID_58602
MRGVPTEESLSPFLVRDLGAQSLKVIQRVHKAWRSPLRKDKELRGICNGVIGGYHGWLRVHTRGLDWLSKLKVIDEENFEAPEEDEEVQALKLELGKARLAKENAATAKALEQETKRARTEEHGREKFRGALWGSNNELKLRREERDRSRVHGMILKEELAACA

SEQ ID NO: 150288 - protein, 131 aa, Glycine max
  Coding DNA Sequence Number=SeqID_58603
MANQEEWVPFMDVLALLIFGVVLFPNVDDWLAKLKIINEENFEAPEEDEEVRALKTKLGKARLAKEKFKLVATDIRKECAGLREENAATAKALEQETKRARKEEHGRDKFRGALWGSNSELKLRREERDQS

SEQ ID NO: 150289 - protein, 75 aa, Glycine max
  Coding DNA Sequence Number=SeqID_58604
  Homolog annotation: Hit_ID=A5BKY7; Match level="QueryCoverage=97%, HitCoverage=14%, E-value=4e-07, Identity=42%"; Hit description =Putative uncharacterized protein
MEKGEKVNLTTYTSGKDRKKSIGTNKGRIPTQPTIKKESKYFFCKKKGHMKKDYPKFKSWFEKKGYGKPKEASGK

SEQ ID NO: 150290 - protein, 83 aa, Glycine max
  Coding DNA Sequence Number=SeqID_58605
MKNSGKPSRNRPRKRLESVTKEPRLEFSSRKQFFSLILRENGRSLPSSSPRRAGLLPPEGGAFCWKILEGPSGPNCYLYTHVY

SEQ ID NO: 150291 - protein, 77 aa, Glycine max
  Coding DNA Sequence Number=SeqID_58606
  Homolog annotation: Hit_ID=A8ARU6; Match level="QueryCoverage=79%, HitCoverage=78%, E-value=2e-16, Identity=62%"; Hit description =Putative uncharacterized protein
MAAVVSFHAGHAVPGRQFAPCWTVCTNPPFTPTAAPYPVTIVLSPTRKDMQKHHWQYPLEIGLIGDSLEVMRRLRLN

SEQ ID NO: 150292 - protein, 82 aa, Glycine max
  Coding DNA Sequence Number=SeqID_58607
MADNTRMKELTGDVKRILKMMENRNKEYAARFETLETTLEMTLKDKTRDPGSISLAMNNHPFKLIEFMEGHKKLYWIALWED

SEQ ID NO: 150293 - protein, 101 aa, Glycine max
  Coding DNA Sequence Number=SeqID_58608
  Pfam annotation: Domain name=zf-CCHC; Domain location=51-67; Score =16.0; E_value=0.0058; Accession=PF00098.14; Description=Zinc knuckle
  Pfam annotation: Domain name=zf-CCHC; Domain location=74-91; Score =32.1; E_value=2e-06; Accession=PF00098.14; Description=Zinc knuckle
  Pfam module annotation: Pfam domain module=zf-CCHC::zf-CCHC; Domain location=51-67::74-91
  Subcellular localization annotation: CTP_CleavageSite=38; ConfidenceScore=5.25e-01
MKERQARGVGGPQRNHPFRGNGNKRMKPYASNKGKQPMAASNMSQSRGTGVQCFQCGGPHIKRNCPQLQQTQENRCYVCGKVGHYARECRVTRTPDSDGQF

SEQ ID NO: 150294 - protein, 199 aa, Glycine max
  Coding DNA Sequence Number=SeqID_58609
IEHQVDLLPGASLPKRPTYKSNPQETQRKDAHAKVEYVKRLYDQVKVQIAKKNENYAKQTNKKRKEVVLEPGDDPGHLRTNVFQEGGNDENHETDQIQAKGPSGEGQRPKWRRTKPPSNPCGVYPDLSSFTGSGVYPDLSSFTGSGVYPDLSSFTGSGVYPDLSSFTGSGVIQKLYSLYQAIRPVRFTSSGIRASALDT

SEQ ID NO: 150295 - protein, 66 aa, Glycine max
  Coding DNA Sequence Number=SeqID_58610
  Homolog annotation: Hit_ID=A5B3F9; Match level="QueryCoverage=71%, HitCoverage=2%, E-value=2e-07, Identity=51%"; Hit description =Putative uncharacterized protein
MRGRFVELVSSVRELEVHLHGDNKCLSNLCYSMRFGVPKAIVSNQGTHFCNKSMHALLKKYGIVHR

SEQ ID NO: 150296 - protein, 287 aa, Glycine max
  Coding DNA Sequence Number=SeqID_58611
  Gene Ontology: Mol. function=quinolinate synthetase A activity; Cellular component=cytoplasm; Biological process=NAD biosynthetic process
  Homolog annotation: Hit_ID=Q1GYP1; Match level="QueryCoverage=100%, HitCoverage=75%, E-value=1e-144, Identity=85%"; Hit description =Quinolinate synthetase A
  Pfam annotation: Domain name=NadA; Domain location=1-286; Score =217.3; E_value=3.6e-62; Accession=PF02445.7; Description=Quinolinate synthetase A protein
MAEVADILSRPEQIVILPDLAAGCSMADMANLAKVERSYRELNKVLNFDETITPVTYINSAADLKAFCGEHGGIVCTSTNAPKILEWGFSQREKILFFPDQHLGRWSGHKMGIPLEQMPVWDPDLPMGGLTEQQIKDAKILLWKGHCSVHQMFRKQNIDQFRAQHPDGKVISHPETAFEVCINSDYVGSTEYILRTVSEAEPGSKWLVGTELNLVTRLAEEMKPQNKLVQFMSHVVCECSTMARIDPQHLAWCLENLAEGNVVNQIKVPEHEAKLAKLTLDRMLAVS

SEQ ID NO: 150297 - protein, 234 aa, Glycine max
  Coding DNA Sequence Number=SeqID_58612
  Gene Ontology: Biological process=transposition, DNA-mediated
  Homolog annotation: Hit_ID=Q6UUU1; Match level="QueryCoverage=25%, HitCoverage=40%, E-value=3e-18, Identity=78%"; Hit description =Putative uncharacterized protein
DLPSQWLLFLSAVPPVQLLTGWCVTAKAPPDISAGKCSGRVPFAIQAAQLLGRAIGAGLFAITPAGERGMCCKAIKLGIRYAKFTNVNLEGTTKATLLTIIGGRGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 150298 - protein, 39 aa, Glycine max
  Coding DNA Sequence Number=SeqID_58613
MEDAPASPASPSRRRVGCDSWRLHWGKFFFTPHSKHPRV

SEQ ID NO: 150299 - protein, 148 aa, Glycine max
  Coding DNA Sequence Number=SeqID_58614
KVQIAKKNESYAKQANKKRKEVVLEPGDDPGHLRTNVFQEGGNDENPEIGQIQAKGPSGEGQRPKWRRIKPPKFLSGFLVEPIIRLIKVILVASTLTYLPSPEVASTLAYLPSSEVASSKTSVAYIKRSAPTQKYRNGNNGSYRAPNE

SEQ ID NO: 150300 - protein, 186 aa, Glycine max
  Coding DNA Sequence Number=SeqID_58615
  Subcellular localization annotation: CTP_CleavageSite=25; ConfidenceScore=5.66e-01
MVKVGTSYVPINVSFSPKVGPGSSRCSSGVSWFLSAVPSCSATDGELLSANSAHKHTSRNISGQSAKPVVPFAAFKVNRPTVARRAIGAGLCAITPAALKGGCVHTGDYYVGTVTPGCPVERASCGRKKRTVRQHEYVIQTHIGANSSLTELLPLGRRLRQRSELVAYPNGAEFDGFLLDNARKTP

SEQ ID NO: 150301 - protein, 85 aa, Glycine max
  Coding DNA Sequence Number=SeqID_58616
MHRSPTGTLVPLNLEIEATLRRNRAERRRKLLQDRTVASILEEETHFFYSLSPDSPSSRESANQYSEVVTMADEHDQRTTLEDYQ

SEQ ID NO: 150302 - protein, 135 aa, Glycine max
  Coding DNA Sequence Number=SeqID_58617
MCKAEEVQEKVKADMEGMKEKMATMMEAMMSMRKIMEANAVTIAATSTVAKVNPMPPYGLNQMNHPTLDMVGKDLGSRDGPHDVQNQNKHAFPPYGLPPNYTPPNVAYTPNEDVNNSTPIPIESQQPQTDHAHVS

SEQ ID NO: 150303 - protein, 308 aa, Glycine max
  Coding DNA Sequence Number=SeqID_58618
  Gene Ontology: Mol. function=motor activity; Cellular component=cell projection
  Homolog annotation: Hit_ID=UPI00016621D1; Match level="QueryCoverage =72%, HitCoverage=40%, E-value=2e-17, Identity=31%"; Hit description =UPI00016621D1 related cluster
YTPSPLEDYTSSSSEGCTPSPSKDYTSSPSDGYTPSPSESYTPSPSESYTPFPTEDYTSSPLEDYMTTRPYLQKTTRPRLRGLQILTIRGLHVLAIRGLHVQAFQGQHPLAFRGLQVLTFSTLDTLTLRGLHVLAFRGLHVPTFRGLHVLPFRGLHALAFRGVHVLAFRGLHVHTFRGVHVLALRWLHALAFRGQHVLTFRLLHVLAFRGLYTLLFIGLHALPFKGLHVLAFRGLHILLFRGLHALTFRGLHALAFRGLHILVFRGLHSITFRGLHVVAFRGLHALSFRGLHALSFRGLHVLAFRGLH

SEQ ID NO: 150304 - protein, 175 aa, Glycine max
  Coding DNA Sequence Number=SeqID_58619
MEAIKEQMATMMKAMMSMKKIMEANAVIVAAISAVAKVNPMLPSSLKQMNHPTSNMVGKDLGSTAPMMCKFKTSMPSRHMVCLSNIRHPMWRTLPIRMSITPLLYPLRASQPQTDQAHISQTMGETHEIPHHNLADFEPWLGYATEGQAVGGIPLQNTLEGPQYHPQPQPSRSTA

SEQ ID NO: 150305 - protein, 284 aa, Glycine max
  Coding DNA Sequence Number=SeqID_58620
  Gene Ontology: Biological process=transposition, DNA-mediated
  Homolog annotation: Hit_ID=Q6UUU1; Match level="QueryCoverage=21%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGIRSSIVAVSMQDTNLNSGNLVTYNLMDQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 150306 - protein, 20 aa, Glycine max
  Coding DNA Sequence Number=SeqID_58621
MYHHEGYHLLLLIGVAVEAL

SEQ ID NO: 150307 - protein, 91 aa, Glycine max
  Coding DNA Sequence Number=SeqID_58622
MHMRIKRSFKVVMGPRTRKGNIGSKGLSRELIQGMLIWLKAYKNKMPKSSPNMHVKQEVSTRVKPRLLSKQSMGQNTSNKIDDDGSNSHQG

SEQ ID NO: 150308 - protein, 65 aa, Glycine max
  Coding DNA Sequence Number=SeqID_58623
MSVKNLVGHLGGDQSGSPCFARMLQSCGIGTSLKEHSNRVTPKAYTPKSPSGPLPPDSGPTQKTF

SEQ ID NO: 150309 - protein, 63 aa, Glycine max
  Coding DNA Sequence Number=SeqID_58624
  Homolog annotation: Hit_ID=A0PAV3; Match level="QueryCoverage=60%, HitCoverage=17%, E-value=5e-07, Identity=76%"; Hit description =Restriction endonuclease
MVKVGTSYVPINVSFSPKVGPGLPGINRDTRIYLFCEVIFRHRCSSGFCFYQAVPPVQATGRG

SEQ ID NO: 150310 - protein, 81 aa, Glycine max
  Coding DNA Sequence Number=SeqID_58625
MSFPRYIVEVMVNHKGEHTKFLLWDHECAELIGQSADEVNRLKIEDGNADLNVSPQALDRLLGCFLAFKVKPCLQDRESNT

SEQ ID NO: 150311 - protein, 107 aa, Glycine max
  Coding DNA Sequence Number=SeqID_58626
MRSDCLVQFSILNIFRRPMNCVFVHASSTHEFGAMRSDCLVQFSILNPFSEPMNCVFVHASSTHKFGAMRSDCLVQFSILNLFSEPHELFSFMCPPPTSLEPCVVIA

SEQ ID NO: 150312 - protein, 245 aa, Glycine max
  Coding DNA Sequence Number=SeqID_58627
  Gene Ontology: Mol. function=3-oxoacyl-[acyl-carrier-protein] reductase activity; Cellular component=cytoplasm; Biological process= metabolic process
  Homolog annotation: Hit_ID=Q2K4X1; Match level="QueryCoverage=97%, HitCoverage=97%, E-value=8e-83, Identity=65%"; Hit description =Probable 3-oxoacyl-[acyl-carrier-protein] reductase protein
  Pfam annotation: Domain name=Epimerase; Domain location=8-240; Score=- 29.2; E_value=5.5e-05; Accession=PF01370.12; Description=NAD dependent epimerasedehydratase family
  Pfam annotation: Domain name=KR; Domain location=7-189; Score=-48.9; E_value=0.00017; Accession=PF08659.1; Description=KR domain
  Pfam annotation: Domain name=NAD_binding_4; Domain location=10-223; Score=-83.3; E_value=0.0022; Accession=PF07993.3; Description=Male sterility protein
  Pfam annotation: Domain name=adh_short; Domain location=6-172; Score =123.9; E_value=4.7e-34; Accession=PF00106.16; Description=short chain dehydrogenase
  Pfam module annotation: Pfam domain module=Epimerase::KR::NAD_binding_ 4::adh_short; Domain location=8-240::7-189::10-223::6-172
MSASEKVAIVTGASRGIGAAIARQLAADGFAIVVNYAGNAEAAAAVVEEIEAAGGRAITAQADVADASQVKRMFDLAESAFGAIDVLVNNAGVMMLSPLASADDQSFSKQIDINLKGTFNTLREAANRLRSGGRIINFSTSVVGLKLENYGVYAATKAAVETLTTIMSKEMRGRSITVNAVAPGPTATDLFLNGKSDELIARMSKMNPLERLGTPEDIASVVSFLAGPQGSWMNGQILRANGGMV

SEQ ID NO: 150313 - protein, 134 aa, Glycine max
  Coding DNA Sequence Number=SeqID_58628
MSSIATSTIYRIPLVKNIVFLKTSMQQGQAYIPIVRFPDPNYGIKMVNYKKLPSPIVSSPLVPLYVTQRSLSFMLVSPNTSLYMPNSRKFNIDFINKVMTNIQSQIPLSKCKGLRGVSDSTKRKHHFEIPITPM

SEQ ID NO: 150314 - protein, 37 aa, Glycine max
  Coding DNA Sequence Number=SeqID_58629
MVEINQGKTMTGHDWPHIFVSCLQVSSPGRATPAFKI

SEQ ID NO: 150315 - protein, 15 aa, Glycine max
  Coding DNA Sequence Number=SeqID_58630
MEEIHGEYDEEQGIK

SEQ ID NO: 150316 - protein, 139 aa, Glycine max
  Coding DNA Sequence Number=SeqID_58631
  Homolog annotation: Hit_ID=A7UQU7; Match level="QueryCoverage=61%, HitCoverage=15%, E-value=7e-14, Identity=45%"; Hit description=IMP dehydrogenase/GMP reductase, putative
  Pfam annotation: Domain name=DUF1723; Domain location=43-92; Score =66.3; E_value=1e-16; Accession=PF08330.1; Description=Protein of unknown function (DUF1723)
ERPNLKLVSHGRKVTLIGRPVLEIEGLVGATGLSPLIYCSVVTGDPGLISAFVERWHNETSTFHLPVGELTITLDDVSSLLHLPITGALHNFHALSAEETIFLLTELLEVSAEEARAETARSRGTYVLLGWVRDIYEMR

SEQ ID NO: 150317 - protein, 168 aa, Glycine max
  Coding DNA Sequence Number=SeqID_58632
MAASDIAILRDKAHIPTKKSLLELTSQDALLAQNKLLSKQLEALSETLRCAICSGAHNSGCCIPNEEPAHEVNYMGNQPRKNFNADGYSGFRHGEPYNSQQGQWRNHPGNQFNKDQGGPSIRPQQQVSSLYECTTKLEETLAQFMQVSMSNHKSTESAIKNLKVHVGQ

SEQ ID NO: 150318 - protein, 175 aa, Glycine max
  Coding DNA Sequence Number=SeqID_58633
  Homolog annotation: Hit_ID=A7MM55; Match level="QueryCoverage=41%, HitCoverage=84%, E-value=8e-24, Identity=83%"; Hit description =Putative uncharacterized protein
  Pfam annotation: Domain name=DUF1107; Domain location=117-175; Score =122.0; E_value=1.7e-33; Accession=PF06526.3; Description=Protein of unknown function (DUF1107)
MLYNSHFARELRAIPGFIAKLIIVENQFSPVSNADWRYTLSFFNVVSASPQRQQQASCARIVIRPLGHALLMISAINVVFPQARCQFAGQRTYPRKNDGLYCPQWRFAKIILNNCNQTVAKYVKILFRGRLYIKDVGAFEFDKGKILVPKVKDKQHLSVMSEVNRQVMRLQTEMA

SEQ ID NO: 150319 - protein, 30 aa, Glycine max
  Coding DNA Sequence Number=SeqID_58634
MEEEHMACLDQQHSGNKIWMIPPTWIVSIA

SEQ ID NO: 150320 - protein, 86 aa, Glycine max
  Coding DNA Sequence Number=SeqID_58635
DRAHKTPSGPEEVQQGPGVSSSGIAPARNLVDQNKSNRVLGFPALITGLYQFHGVPVAPGKFIKPPINRAFIKKYCTPRQAQDETP

SEQ ID NO: 150321 - protein, 241 aa, Glycine max
  Coding DNA Sequence Number=SeqID_58636
  Gene Ontology: Mol. function=phosphoenolpyruvate carboxylase activity; Cellular component=cytoplasm; Biological process=carbon utilization by fixation of carbon dioxide
  Homolog annotation: Hit_ID=Q5PK55; Match level="QueryCoverage=100%, HitCoverage=27%, E-value=1e-116, Identity=87%"; Hit description =Phosphoenolpyruvate carboxylase
MLGKVLGDTIKDALGENILDRVETIRKLSKASRAGNEASRQELLTTLQNLSNDELLPVARAFSQFLNLANTAEQYHSISPNGEAASNPEVIARTLRKLKEQPDLNEATIKKAVESLSLELVLTAHPTEITRRTLIHKMVEVNNCLKQLDNKDIADYERNQLMRRLRQLIAQSWHTDEIRKHRPSPVDEAKWGFAVVENSLWEGVPNYLRELNEQLEENLGYRLPVDFVPVRFTSWMGGDRD

SEQ ID NO: 150322 - protein, 239 aa, Glycine max
  Coding DNA Sequence Number=SeqID_58637
  Homolog annotation: Hit_ID=UPI00006A2D9E; Match level="QueryCoverage =42%, HitCoverage=81%, E-value=2e-08, Identity=19%"; Hit description =UPI00006A2D9E related cluster
LTFRRPHTLTFIGLHALTFRGLHVLAFRGLHVLTFRGLHFLPFRGLHALPIRGLHALTFRGLHVLTFRGLHALAFIGLHALAFIGLHALAFIGLHICAFRELKIRGRPTVRPQPEREAIVQLLCLLGQDFNQPLQGDKCGSCTPPQLRSPPAEVSVGLCHHDIGLCQSYRVPVPPARSCHRDIGIAPARHLVDPKKSNKVLGFLALITGLCQFYGVPVAPNKVIRPPINHDFIKKYCAP

SEQ ID NO: 150323 - protein, 179 aa, Glycine max
  Coding DNA Sequence Number=SeqID_58638
  Gene Ontology: Biological process=transposition, DNA-mediated
  Homolog annotation: Hit_ID=Q1J7G7; Match level="QueryCoverage=22%, HitCoverage=70%, E-value=1e-11, Identity=73%"; Hit description =Transposase
VLQWLLFLSAVPPVQLLTGWCVTAKAPPDISAGKCSGRVPFAIQAAQLLGRAIGAGLFAITPAGERGMCCKAIKLGNARVFPVFHFALYQAYRYRRPRGGARYQLLFPLVRVNFELGVIMVIAVSFGKPVVPAALMNRPTRGERRFAYWALAECILAYYVGTDEGVSEVLHVAGEKRLH

SEQ ID NO: 150324 - protein, 164 aa, Glycine max
  Coding DNA Sequence Number=SeqID_58639
FPALITGLCQSFGVPVAPSKVIRPPITRAFIEKYCQQRQVQGDAPQAADAPPPHQAGPAGLFDTEQYLRHLVRQQAANHRAHVQTHDCLYQMSLSLQSQGFTSFPCPTPDQFRAEVAWPGDWPEAQAGKAPAGAPAEAPDEADEAREDEEMTDLLDFLGGSGTT

SEQ ID NO: 150325 - protein, 241 aa, Glycine max
  Coding DNA Sequence Number=SeqID_58640
  Gene Ontology: Biological process=transposition, DNA-mediated
  Homolog annotation: Hit_ID=Q6UUU1; Match level="QueryCoverage=24%, HitCoverage=40%, E-value=3e-18, Identity=78%"; Hit description =Putative uncharacterized protein
VLQWLLFLSAVPPVQLLTGWCVTAKAPPDISAGKCSGHAARRVPFAIQAAQLLGRAIGAGLFAITPAGERGMCCKAIKLGNARVFPLLSLEILPLHVDWMHQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 150326 - protein, 112 aa, Glycine max
  Coding DNA Sequence Number=SeqID_58641
MVENLRVTYLRREGSVTRRRRVLHERNISAESATNVYLRERERRKNLERRDFYFELLPLFIEKVREACHFPAAGARISPHVPSQGKAAFESGGPKAFGNSYEFLNAMTVFFP

SEQ ID NO: 150327 - protein, 202 aa, Glycine max
  Coding DNA Sequence Number=SeqID_58642
GHALRRPYRTRARARVMGEVEEIQEKMKADMEAIKEKMATMMEAMMSVKKIMEANAVAIAATSVAAKVNPTSPSGLKQMNHPTSNMVGKDLGSMGGPHDVQIQNEHAFPSYGLPLNYTPPNVAYTPNKNTHEIPHHNLADFEPWLGYTTERQAVGGIPLQNPLEGPQYHPQLHLLHSTADKNPHDYGRNGKVGSSKGKAQGH

SEQ ID NO: 150328 - protein, 103 aa, Glycine max
  Coding DNA Sequence Number=SeqID_58643
MKLAKYRLKAQVEKDEGPSGEGQSPRVEKDEGPEAETLSRLLIVAEGPSNPCGVYPDLSSLTGSGVYPDLSSFTGSGVYHDLSSFTGSGVIQTFVACIKRSAL

SEQ ID NO: 150329 - protein, 182 aa, Glycine max
  Coding DNA Sequence Number=SeqID_58644
MTGRLLAGSLAFESRILHYLIVHILLPRSSNLAQVSEEDLIVMWAFHKGLQIDWAHLVRYRMHKALRLNAPLPYPHLVTLFLQHFNIPLDSEPYVPIKRSFLIGASVIASFEGHDGEDSSLLSKILDRFDGLQTFVGERFDNLELQVDMRFNEMESRITKVEEDVSYIHSSFDLPPPPPPSS

SEQ ID NO: 150330 - protein, 316 aa, Glycine max
  Coding DNA Sequence Number=SeqID_58645
  Gene Ontology: Biological process=transposition, DNA-mediated
  Homolog annotation: Hit_ID=Q6UUU1; Match level="QueryCoverage=18%, HitCoverage=40%, E-value=5e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPVTTLANWSSTAVAAALELVDPPGCRNSISFQIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTGKTIKIPAFPPGGSLVRSPVPAFRFTGVIPLLWPRLSHSTPDTQFR

SEQ ID NO: 150331 - protein, 22 aa, Glycine max
  Coding DNA Sequence Number=SeqID_58646
MGHVETWMPRWPMHQPFGSLLE

SEQ ID NO: 150332 - protein, 1492 aa, Glycine max
  Coding DNA Sequence Number=SeqID_58647
  Gene Ontology: Mol. function=ATPase activity, coupled to transmembrane movement of substances; Cellular component=integral to membrane; Biological process=transport
  Homolog annotation: Hit_ID=Q9LK64; Match level="QueryCoverage=99%, HitCoverage=97%, E-value=0.0, Identity=65%"; Hit description =Multidrug resistance-associated protein 3
  Pfam annotation: Domain name=ABC_membrane; Domain location=303-572; Score=85.8; E_value=1.4e-22; Accession=PF00664.14; Description=ABC transporter transmembrane region
  Pfam annotation: Domain name=ABC_membrane; Domain location=916-1193; Score=88.9; E_value=1.6e-23; Accession=PF00664.14; Description=ABC transporter transmembrane region
  Pfam annotation: Domain name=ABC_tran; Domain location=1265-1448; Score=160.8; E_value=3.6e-45; Accession=PF00005.18; Description=ABC transporter
  Pfam annotation: Domain name=ABC_tran; Domain location=646-817; Score= 147.6; E_value=3.4e-41; Accession=PF00005.18; Description=ABC transporter
  Pfam annotation: Domain name=Got1; Domain location=100-176; Score= -47.6; E_value=0.059; Accession=PF04178.3; Description=Got1-like family
  Pfam annotation: Domain name=MMR_HSR1; Domain location=1266-1352; Score=-14.4; E_value=0.022; Accession=PF01926.14; Description=GTPase of unknown function
  Pfam module annotation: Pfam domain module=ABC_membrane::ABC _membrane::ABC_tran::ABC_tran::Got1::MMR_HSR1; Domain location=303 -572::916-1193::1265-1448::646-817::100-176::1266-1352
MLYVFSLLQPIFLHALSASIHLFLLVSVSLHWLWNKVTFTPPAAREEKSKEEKHRPNSNNTLFKTTVFCSLAVSAFSFVLCLFNYFYWYTSGWSEQNLVTFLDLALKTLAWGVVSVSLHNGFSFFFTEKKRFRFSFFFGAWCTFYLVFSCYSFVVGIVVLPERPIQYLVSDVVSTCAGFFFCYVAYFVKNKGCAKGIEEPLLNGDANVPNEKVAKGGDTVTPFSHAGVFSVLTFSWVGPLVAVGNKKTLDLEDVPQLDTKDSVVGAFPSFRDKLEADCDANAINSITTLKLVKNLAKSAWKEILFTAFLALLNTLASYVGPYLIDVFVQYLDGRRQYENQGYVLVFVFFFAKIVECLSQRHWFFRLQQIGIRMRALLVTMIYNKALTLSCQSKQGHTSGEIINFMTVDAERVGNFSWYMHDLWMVALQVVLALLILYKSLGLASIAALVATVVVMLANVPLGSLQEKFQNKLMESKDTRMKATSEILRNMRILKLQGWEMKFLSKVIELRKTEQGWLKKYVYTAAMTTFVFWGAPTFISVVTFGTCMLIGIPLESGKILSALATFRILQEPIYNLPDTISMIAQTKVSLDRISSFLCLDDLRSDVVEKLPRGSSDTAIEVIDGTFSWDLSSPNPKLQNINIKVFHGMRVAVCGTVGSGKSTLLSCVLGEVPKISGILKVCGTKAYVAQSPWIQSGKIEDNILFGERMDRERYEKVLEACSLKKDLEILSFGDQTVIGERGINLSGGQKQRIQIARALYQDADIYLFDDPFSAVDAHTGSHLFKECLLGLLSSKTVVYVTHQVEFLPAADLILVMKDGKITQCGKYTDLLNSGTDFMELVGAHKKALSTLDSLDEVAKSNEISTLEQDVNVSSPHVFKEKEASREEPKGQLVQEEEREKGKVGFLVYWNYITTAYGGALVPFILLAQILFEALQIGSNYWMAWATPISTDVEPPVGGTTLIVVYVVLAVGSSFCVLVRSMLLVTVGYKTATILFNKMHFCIFRAPMSFFDSTPSGRVLNRASTDQSTVDTDIPYQIGSFAFSMIQLLGIIAVMSQVAWQVFIVFIPVIAVSIWYQQYYIPSARELSRLVGVCKAPIIQHFAETISGTSTIRSFDQQSRFQETNMKLTDGYSRPKFNIAGAMEWLCFRLDMLSSITFAFSLIFLISIPTGIIDPGIAGLAVTYGLNLNMIQAWVIWNLCNLENKIISVERILQYTSIPCEPPLVVEDNRPDPSWPLYGEVDIQDLQVRYAPHLPLVLRGLTCKFHGGMKTGIVGRTGSGKSTLIQTLFRIVEPTSGQVMIDNINISSIGLHDLRSRLSIIPQDPTMFEGTVRNNLDPLEEYTDEQIWEALDKCQLGDEVRKKEGKLDSTVSENGENWSMGQRQLVCLGRVLLKKSKVLVLDEATASVDTATDNLIQQTLRQHFSDSTVITIAHRITSVLDSDMVLLLSQDIAAGLIEEYDTPTTLLENKSSSFAQLVAEYTMRSKSSFEKSVDH

SEQ ID NO: 150333 - protein, 77 aa, Glycine max
  Coding DNA Sequence Number=SeqID_58648
VKKRLSHEVLKGTVELSSSVGLSVHPSLSADSTASISRSRAKCGSYLQPGSAHDWRYAQIHLLALSARVALSATSWI

SEQ ID NO: 150334 - protein, 249 aa, Glycine max
  Coding DNA Sequence Number=SeqID_58649
MAPKKLPTKRSRKEDTGSEERRVQLRDKEYVEFQEEIAWRQWTQLISPMAKFDPKIVMEFYANAWPTEEGVRDKYSWASIVSLAKGGVRPPVSMRRLSAGCCSRAGLCPKRSGETAGLRHPDSGITPLRHPMDSEKSYKALGFSTLIIDLCQFYGVPPAANAPLPPLHEIPSLGSISDHLRRLELQMHRYMQHVSSQQAANHRGQFGAIVAWPGDETDFETRARSAGAPGDDEGAQVDDDMADMLDFFT

SEQ ID NO: 150335 - protein, 571 aa, Glycine max
  Coding DNA Sequence Number=SeqID_58650
  Gene Ontology: Mol. function=peptidyl-prolyl cis-trans isomerase activity; Cellular component=intracellular; Biological process =protein folding
  Homolog annotation: Hit_ID=A7R822; Match level="QueryCoverage=99%, HitCoverage=96%, E-value=0.0, Identity=73%"; Hit description =Chromosome undetermined scaffold_2180, whole genome shotgun sequence
  Pfam annotation: Domain name=FKBP_C; Domain location=182-277; Score =85.0; E_value=2.3e-22; Accession=PF00254.19; Description=FKBP-type peptidyl-prolyl cis-trans is
  Pfam annotation: Domain name=FKBP_C; Domain location=299-398; Score =114.9; E_value=2.4e-31; Accession=PF00254.19; Description=FKBP-type peptidyl-prolyl cis-trans is
  Pfam annotation: Domain name=FKBP_C; Domain location=39-160; Score =178.4; E_value=1.9e-50; Accession=PF00254.19; Description=FKBP-type peptidyl-prolyl cis-trans is
  Pfam annotation: Domain name=TPR_1; Domain location=418-451; Score =0.9; E_value=4.1; Accession=PF00515.19; Description=Tetratricopeptide repeat
  Pfam annotation: Domain name=TPR_1; Domain location=467-500; Score =19.8; E_value=0.0099; Accession=PF00515.19; Description =Tetratricopeptide repeat
  Pfam annotation: Domain name=TPR_1; Domain location=501-534; Score =34.4; E_value=4e-07; Accession=PF00515.19; Description =Tetratricopeptide repeat
  Pfam annotation: Domain name=TPR_2; Domain location=418-451; Score =10.7; E_value=1.4; Accession=PF07719.8; Description=Tetratricopeptide repeat
  Pfam annotation: Domain name=TPR_2; Domain location=467-500; Score =17.3; E_value=0.058; Accession=PF07719.8; Description=Tetratricopepti de repeat
  Pfam annotation: Domain name=TPR_2; Domain location=501-534; Score =32.0; E_value=2.1e-06; Accession=PF07719.8; Description =Tetratricopeptide repeat
  Pfam module annotation: Pfam domain module=FKBP_C::FKBP_C::FKBP _C::TPR_1::TPR_1::TPR_1::TPR_2::TPR_2::TPR_2; Domain location=182 -277::299-398::39-160::418-451::467-500::501-534::418-451::467 -500::501-534
MEEDFDIPGGEEMDLGEDEVGEEREIGSGGLKKKLLKEGQGWETPEVGDEVQVHYTGTLLDGTKFDSSRDRDSPFSFTLGQGNAENTFFLLSSFPVQSIESRKLSENCGQVIKGWDEGIKTMKKGENAIFTIPPELAYGESGSPPTIPPNATLQFDVELLSWTSVKDICKDGGIFKKIITEGEKWENPKDPDEVLVKYEVHLENGKLLAKSDGEEFTVREGHYCPALSKAVKTMKKGEKVLLTVKPQYGFGEKGKPEQGDEGAVPPNATLQITLELVSWKTVSEVTDDKKVIKKILKEGEGYERPNEGAIVKVKLIGKLQDGTAFLKKGHDEEEKLFEFKTDEEQVVDGLDRAVLTMKKGEVALLTIAPDYAFGTSESQQELAVVPPNSTVYFEVELVSFEKEKESWDLNTEEKLEAAGKKKEEGNVLFKASKYARASKRYEKAVKYIEYDSSFGEEEKKQAKTLKVACNLNNAACKLKLKDYKEAEKLCTKVLDLESTNVKALYRRAQAHMQLTNLDLAELDIKKALDIDPNNRDVKLEYRTLKEKVKENNRKEAQFYGNMINKMTKIGS

SEQ ID NO: 150336 - protein, 185 aa, Glycine max
  Coding DNA Sequence Number=SeqID_58651
  Gene Ontology: Mol. function=glucose-1-phosphate adenylyltransferase activity; Cellular component=chloroplast; Biological process =glycogen biosynthetic process
  Homolog annotation: Hit_ID=Q6R2I8; Match level="QueryCoverage=25%, HitCoverage=9%, E-value=4e-16, Identity=87%"; Hit description =Glucose-1-phosphate adenylyltransferase
MELKMRWHEATSNEELAVHFASYSGALANPLLAFESALNTLNSSLLEEFVAMLMGRGGSFSARGPGKRDALKAVEKELPYIASMGIYVVSKNVMLDQLHKKFPGANDFGSEVIPGATSIGMWVCVPFGYCHNLLFDGRARRNKKSVSSHEENAWSRHQRLFEKNIRKTKKRFLDFENKGSGVVYT

SEQ ID NO: 150337 - protein, 98 aa, Glycine max
  Coding DNA Sequence Number=SeqID_58652
MNWSTPWFNTLVVNVMGRRYGKVIHKKDSCSQIVMLGHEKLTKFSLKVAAATVQVFGSVHEGDRVDVTPSQSGAKEMCLAKNALIEEGGNYGEWMIAK

SEQ ID NO: 150338 - protein, 128 aa, Glycine max
  Coding DNA Sequence Number=SeqID_58653
MGRIRTGRFNVLDNINTRIKFSRPLVMEACLRSFYGGWIFELQRRGERRHHPLGNKPWKKELHHQESALDKKLREEASMKEKNEREGGHKIEGEKEGEKLNFEVCLTSFTFIKVMTSVTHASIYSLGH

SEQ ID NO: 150339 - protein, 45 aa, Glycine max
  Coding DNA Sequence Number=SeqID_58654
RVGSSSKEYELLVVIGQVVAEVEEGDGDKEEKKGLECEECPEKIA

SEQ ID NO: 150340 - protein, 204 aa, Glycine max
  Coding DNA Sequence Number=SeqID_58655
MIFGFSKAEKLTHEQRSAAGRFDVKESRCCETHLETHPREASAGGFIQTYSRRRRRTRGTTFIIYGSRRPSLWFTTARSLSLLATLSRHTRSLFLSATLTHTTLALSPSQHSSSLSLSATFTHHTRSVLSQEQTLHCRFSIINESHHCVTLAASLAAQQGPTSMAAFQNWNGVRTLGVPKELMTAHGRHRSYSFILGLGFSGVC

SEQ ID NO: 150341 - protein, 210 aa, Glycine max
  Coding DNA Sequence Number=SeqID_58656
TPEYVPEERVLECFRKKGLPEGNLLPEEVAVLYLKIWWSREAEKINSKKLFPEEILTRGGSSSGMRMLDFRKKFFRKLLSSIPEKVVPEVFSGTTSSRIGISNFRKKFFRNMDEDQWTYDCAMSQEVDMDYDYDNEEECGVNEPHVDCSNAFNTSQVFGTRDDVLQWARTVTHENGFVAVIMRSDTDTDTGSRKCGCPFRLRGKPVHGGE

SEQ ID NO: 150342 - protein, 50 aa, Glycine max
  Coding DNA Sequence Number=SeqID_58657
MARTRGLGRAIGKLIGRDRHDDHDAADVPERRRPTASARRQRVHQMNADA

SEQ ID NO: 150343 - protein, 281 aa, Glycine max
  Coding DNA Sequence Number=SeqID_58658
  Gene Ontology: Mol. function=protein binding; Cellular component =integral to membrane; Biological process=mitochondrion organization and biogenesis
  Homolog annotation: Hit_ID=A5BCY3; Match level="QueryCoverage=58%, HitCoverage=39%, E-value=2e-64, Identity=74%"; Hit description =Putative uncharacterized protein
  Pfam annotation: Domain name=CBS; Domain location=50-165; Score=36.7; E_value=8.6e-08; Accession=PF00571.19; Description=CBS domain
MTNRVFGGYLYAKNFTVWRKAGKGGELTHDETTIIAGALELSEKTSSDAMTPITDIFSIDINAKLDRDLMNLILEKGHSRVPVYYEQPTNIIGLVLVKNLLTIDPEEEIPVKNVTIQRIPRVPETLPLYDILNEFQKSHSHMAVVVRHCEKTRQQSSNNNADGLRRDAESKEQKLAEQWAAKHLQLTKFLEQAVVNEDSTGDVIALQHQIRLLKVEELSILKRRQNVSRSLSFSLSSIRDIKQSLELEDCCLENATDMVDQHEDNMPDYESKGIRMSHKQV

SEQ ID NO: 150344 - protein, 84 aa, Glycine max
  Coding DNA Sequence Number=SeqID_58659
MRFSGKSDFRGIYWNEEKVEQKATAGEIQQRHSHLDPIEEHIMAEEPKRVTLEDYSSSNVPQFFTSIAQPEVQAQTITYPQSLI

SEQ ID NO: 150345 - protein, 52 aa, Glycine max
  Coding DNA Sequence Number=SeqID_58660
MLKWKGPQISYPWTSCQIGRFFLALNCKSGALSGWLAKPEDWLSKKLKISTS

SEQ ID NO: 150346 - protein, 82 aa, Glycine max
  Coding DNA Sequence Number=SeqID_58661
MARLTGALSRSRHQRLFVENVGKTEGNRLKIDVERMKNVEERLKTFAKSLTKTLRKRYGSASAWIFFTKIIFLSKFERERSA

SEQ ID NO: 150347 - protein, 202 aa, Glycine max
  Coding DNA Sequence Number=SeqID_58662
  Homolog annotation: Hit_ID=Q6WAY6; Match level="QueryCoverage=84%, HitCoverage=29%, E-value=9e-19, Identity=31%"; Hit description =Putative uncharacterized protein
MGQLQRQAFHKTYGKIWDLATVEVSVKAIASFTQYYDHPLRCFTFRDFQLVPTVEEFEEILGCSLGGRKSYLFSGFYPSMARVAKVVKISIQELDPVKRNRNGVVRIPRKHLEEKAKALADKGEWASFIDILALLIFGVILFPNVEGLVDLAAIDAFLAYHHSKESPIIAILADVYDTFDRGCEKRGQELFVVHRLLDGVAC

SEQ ID NO: 150348 - protein, 280 aa, Glycine max
  Coding DNA Sequence Number=SeqID_58663
  Gene Ontology: Mol. function=oxidoreductase activity; Biological process=metabolic process
  Homolog annotation: Hit_ID=A2X573; Match level="QueryCoverage=35%, HitCoverage=33%, E-value=7e-30, Identity=66%"; Hit description =Putative uncharacterized protein
  Pfam annotation: Domain name=ADH_zinc_N; Domain location=49-177; Score=46.8; E_value=7.9e-11; Accession=PF00107.17; Description=Zinc -binding dehydrogenase
MGGLAEYCVVPANRVSVLPNSLPYTEFAILGCAIFTAYGAMAHAPQVCPGDFVAVIGSGGVGSSCLQIAKAFGASDIIVMDVRDEKLQKAKTFGATHTFDPDIVLEFYANAWPTQEGVRDMRSWGQECEYGQRRNRADGFDEEAIAQLLRIPGQDFARTAAGRRVQIMRTNMTTLTQTWMTLLLSNILPSDHNSDLPLPKCQLVYAILTRMSVHVAQLIADAIYLFAGMPPTRHWSFGVPVTPSKVIRLPITRAFIEKYCIARQAQGGDPQALDASPPPP

SEQ ID NO: 150349 - protein, 232 aa, Glycine max
  Coding DNA Sequence Number=SeqID_58664
  Pfam annotation: Domain name=Transposase_23; Domain location=162-224; Score=-5.4; E_value=0.0046; Accession=PF03017.5; Description =TNP1ENSPM transposase
MARTKRYRQMTSTAAQEISDKIDSLKEQMTHRSFVLHGRDDILNTAIGRPDHPGRVRVAGTSVTISQYFGQASRGSNSSCTSISQQQLAQIIGNLKEELRKEVEEENKNLQEVWRRTVEEENKHSLEIIKQELKQAIKLELSQIASQHSPPLEAPDIQVLVRSSGPVYSTSGIGKNVYDSASTIHNVPNADDVVRVSVVKVYHGDAEVPFPTSEIQYDRQAVGTFLGGRQIL

SEQ ID NO: 150350 - protein, 139 aa, Glycine max
  Coding DNA Sequence Number=SeqID_58665
  Subcellular localization annotation: CTP_CleavageSite=29; ConfidenceScore=5.24e-01
MATPPRTPPHSDMPLEATSRKTRQSTHLRSLTVRGLDQPQPTVNVNPATGRGSGPQKEKFHSYLGGKFDIPEGDNAKKKVMSTIATRWRQFKSSLMTKYVYADNDGHQNDDPSVKYGIDAATWVEFSKSQQTPSWQKKA

SEQ ID NO: 150351 - protein, 86 aa, Glycine max
  Coding DNA Sequence Number=SeqID_58666
MNYGWCSSFRKDSFCLKQDQALGFWDLVQIPDITDQFSPIVENQLDVKANRQLFCHLHVIEVCSVIPHMLGNCAFPQTDFRTKYSH

SEQ ID NO: 150352 - protein, 189 aa, Glycine max
  Coding DNA Sequence Number=SeqID_58667
MDGLVDLAVIDAFLAYHHSKESPVVAILADLFDTFDRRVDWDQHLTGIGSRTINWFPRWKEGKEGVLFSCGESLLRKDKELRGIRNGIIGGYHEWLKVRTRGLDWLSKLKIINEENFEAPKEDEKVRALKTKLGKARLAKEKFKLVATNVWKECAELREENAATARALERETKKAHKEEHGRDKFRGAL

SEQ ID NO: 150353 - protein, 186 aa, Glycine max
  Coding DNA Sequence Number=SeqID_58668
  Homolog annotation: Hit_ID=A7R8D4; Match level="QueryCoverage=31%, HitCoverage=12%, E-value=2e-18, Identity=70%"; Hit description =Chromosome undetermined scaffold_2463, whole genome shotgun sequence
  Pfam annotation: Domain name=PPR; Domain location=9-43; Score=18.9; E_ value=0.019; Accession=PF01535.11; Description=PPR repeat
YPNYYHNGHVYATMINILGTSGRLNDMRDVIEQMKEDSCECKDSVFVSTIKTYANVGLDRNRDVVAPKLKELLQYVEGVRVNGERSLGNNRRARFNALYQVPEYCDIDKIKGKFDGKTVIITIPTIPGKVPKKETQPTEQEPPKEPSQEAKSNPEEEKEGTPPSHDNQESKEEAGHATSTSNPPNI

SEQ ID NO: 150354 - protein, 170 aa, Glycine max
  Coding DNA Sequence Number=SeqID_58669
  Gene Ontology: Mol. function=carbohydrate binding; Cellular component= small subunit processome; Biological process=carbohydrate metabolic process
  Homolog annotation: Hit_ID=A7Q6C4; Match level="QueryCoverage=40%, HitCoverage=21%, E-value=1e-22, Identity=69%"; Hit description =Chromosome chr11 scaffold_56, whole genome shotgun sequence
MVMAPISRASTRQRADGKPFLALGGSSDIISIWNLEKKRLQLVVREAHDSVITSLHFVANEPVPMSSSTDNSVNIRTILKLHTLMWNPWDKKAKAMSDFGDDEYKYMLCVEAAAIEKPISLNLVEGWNGRLELSTVSSSYCSGKLIPKELFKEAERSSLCFVSCICIKCT

SEQ ID NO: 150355 - protein, 111 aa, Glycine max
  Coding DNA Sequence Number=SeqID_58670
MVVILPKENIVVWFCSLYNRPDNYLKGIINKSVLFFNTFALPLLSNINILMFLVFNSALKGLDDTPQPKSKAGARWIVVKYFNDVRPLEAERFKALRIQWTQYYLKLRDQT

SEQ ID NO: 150356 - protein, 557 aa, Glycine max
  Coding DNA Sequence Number=SeqID_58671
  Gene Ontology: Mol. function=transcription regulator activity; Cellular component=nucleus; Biological process=regulation of transcription
  Homolog annotation: Hit_ID=A5AD41; Match level="QueryCoverage=92%, HitCoverage=92%, E-value=1e-103, Identity=44%"; Hit description =Putative uncharacterized protein
  Pfam annotation: Domain name=HLH; Domain location=387-437; Score =35.2; E_value=2.4e-07; Accession=PF00010.17; Description=Helix-loop -helix DNA-binding domain
  Subcellular localization annotation: CTP_CleavageSite=37; ConfidenceScore=5.05e-01
MENQFFLNAGVPPQLHFEPSPHGHQPCPPPSWQSSLSSAMDVQVTVLNCSTEQTQDCFYNTTPTWDKSTDHGLQFDSALSSMVSSPAASNSNISSENFVIRELIGKLGNIGGGGGSDEISPHSQPLVGASFYINCNNNSTNTSCYSTPLSSPPKVNTIKIPTMVNHLVKEGMPPSLETPMSLNSTVAKFSADPGFAERAAKFSCFGSRSLNGRTTQLGLNNAELAQRSSLVENGKRLPRVSSSPSLKVLESQMGTQENKNSPLQDLMELANSQEESTISEQTPNGDTGVKPSPYVNSRKRKGPSKGKAKETSASINPPMAAEASEDWNAKRSKPNAGEGNENGQVKAEEESKGGNSNANDEKQNKSNSKPPEPPKDYIHVRARRGQATDSHSLAERVRREKISERMKLLQDLVPGCNKVTGKALMLDEIINYVQSLQRQVEFLSMKLASVNTRLDFSIESLISKDIFQSNNSLAHPIFLIDSSAPPFYGQHPQPNPAVHNNIPNGTMTHNSVDPLDTGLCQNLGMHLPHLNDFNEGGSQAQIKYPYENQALITIHYG

SEQ ID NO: 150357 - protein, 54 aa, Glycine max
  Coding DNA Sequence Number=SeqID_58672
  Homolog annotation: Hit_ID=A7Q3I3; Match level="QueryCoverage=83%, HitCoverage=4%, E-value=7e-09, Identity=60%"; Hit description =Chromosome chr13 scaffold_48, whole genome shotgun sequence
MGATTSYDNYLNLVGKFPSIEKDWDLQLLPITSVKPLSESYHRPRSRISLVNLN

SEQ ID NO: 150358 - protein, 211 aa, Glycine max
  Coding DNA Sequence Number=SeqID_58673
  Gene Ontology: Mol. function=methylmalonate-semialdehyde dehydrogenase (acylating) activity; Cellular component =mitochondrion; Biological process=valine metabolic process
  Homolog annotation: Hit_ID=Q2HV89; Match level="QueryCoverage=66%, HitCoverage=40%, E-value=7e-46, Identity=51%"; Hit description =Aldehyde dehydrogenase
MPRRSPRRVKTSKMCLCGLKKGVSGNPCPRFLTLSTPDVDEFERWQKEIEEVDIQVEGSEFGSLSGNVGRTGDKLALNVTTKQGKTLKDVQGDVFHEVVEHACGMETLQMGEYFSNVSSGIDTYNIREPLGVCAGASVMLAELAMEAGLPNGVLNIVHGTHANMGAKNHVVVMPNASGNATVNALVAASFGAAGQRCMALSSVVLLGAQNY

SEQ ID NO: 150359 - protein, 77 aa, Glycine max
  Coding DNA Sequence Number=SeqID_58674
  Gene Ontology: Mol. function=glycine hydroxymethyltransferase activity; Cellular component=mitochondrion; Biological process=one -carbon compound metabolic process
  Homolog annotation: Hit_ID=Q45FE6; Match level="QueryCoverage=62%, HitCoverage=9%, E-value=4e-17, Identity=89%"; Hit description=Serine hydroxymethyltransferase
MANHSTSLINGIPINEASNLGWQQAQGIDGSRVQKVLESVHIAANKNTVPGDVLSMVPGGIRMGTPALTSSGFQKLT

SEQ ID NO: 150360 - protein, 100 aa, Glycine max
  Coding DNA Sequence Number=SeqID_58675
  Gene Ontology: Mol. function=hydrolase activity; Cellular component =cytosol
  Homolog annotation: Hit_ID=A7QY36; Match level="QueryCoverage=55%, HitCoverage=20%, E-value=4e-16, Identity=72%"; Hit description =Chromosome undetermined scaffold_237, whole genome shotgun sequence
MKLDFKSVNQTGHLLEEPCGYDFPSSVHFRGLLFMSQVLTSQFFYVLVVQERHCSPATLGLWKIPTGFILQAEEIYTASVRAVKEETGIDTDLIQVIAFR

SEQ ID NO: 150361 - protein, 78 aa, Glycine max
  Coding DNA Sequence Number=SeqID_58676
MKLSPKIHLLHLKCQGVGHITFQCPNKIAMILLDNGDIESESSSDDEMPPLEDCNDVDIAEPVNGDVLVTKHALNMQP

SEQ ID NO: 150362 - protein, 105 aa, Glycine max
  Coding DNA Sequence Number=SeqID_58677
MGAKYLEAVKQREYERRRRRFKKYNGCPHLLSRGGYDLLDKKLMDEKRKHQEHLAEFIENPSLGIDPPSPVSRHLKWKMARTKPYGQMTSAAAQQISDEIDSLEE

SEQ ID NO: 150363 - protein, 119 aa, Glycine max
  Coding DNA Sequence Number=SeqID_58678
  Homolog annotation: Hit_ID=A2Q567; Match level="QueryCoverage=74%, HitCoverage=17%, E-value=1e-10, Identity=40%"; Hit description=Amine oxidase
MSQQAPWLRVLGNVGFKLPGLALSPLTMFVYFSQFPEDSEIPRPKYETEWVTVETLVLALFSDKASMLIVVHQKSKKACRIFPGEEMTVAKGYLSIIESLLSVLPPGLVQLGRKVTTIE

SEQ ID NO: 150364 - protein, 101 aa, Glycine max
  Coding DNA Sequence Number=SeqID_58679
MGCSKQMLTSAIGWPKIYPKADENPRAFSCIPGQIFLESPSHGSGDGSPPWEDCIRSPFLYGEPTTLLPLMFLKSRSGVVDFIFLEARNPNEPICCVGCQS

SEQ ID NO: 150365 - protein, 97 aa, Glycine max
  Coding DNA Sequence Number=SeqID_58680
MNQDLFKDVLMITKMITKDDDKGDDKKLKGQSKNEFKMFKIESRTLQDSRGKLNSRIKNKGSRIKLQRSRSRFKIQDLRFKRRLNQDKYEKVFSKTE

SEQ ID NO: 150366 - protein, 95 aa, Glycine max
  Coding DNA Sequence Number=SeqID_58681
MANIYQKYAWLTLAEKYLRPTSTEKNIVDGTSTWVVVTENKRRYISYGSVLVEDTSTRLFKENKGGYIPCGSLLVKDFTRLKRNLKDHKSLGDWM

SEQ ID NO: 150367 - protein, 250 aa, Glycine max
  Coding DNA Sequence Number=SeqID_58682
VKTPVVLSGNRDERAKCTCVLSLFIATVKILDFQMNISDDPAKRVSLSLTCQAKRHFASVSFPLNKAKRAKRALCTKPECYSVEAELSAPCWGLGEVYRHCGASKATTREECGIAIVKEFYANLDDSEDKSPKQELAAKLCIPGRGFELNADGQPLKILRKNMTTLAQTWSVLSFSNLIPTSHTSDITFDRARLIYGIIQKMDMNQGYIISAQVSLIAQHDSSRLGFPALITALCKARGVISDSLTLETL

SEQ ID NO: 150368 - protein, 230 aa, Glycine max
  Coding DNA Sequence Number=SeqID_58683
  Gene Ontology: Mol. function=aspartic-type endopeptidase activity; Biological process=DNA integration
  Homolog annotation: Hit_ID=A5BYA6; Match level="QueryCoverage=45%, HitCoverage=9%, E-value=2e-10, Identity=33%"; Hit description =Putative uncharacterized protein
MASASSSSIPQSFPNFVAEKLDDFNYLHWRQHVEPVWDKIHEHFSLHTKTRAPQLHTAMRAVTLDGFVNELASVGVPVHHKEYVEALLEGLPSDYASVVSVIESKKRTPSIAEIEALLYRHETRLMRYNKEAQVMNSASINYMQTPIKLVILVVLAPISYSTGSVRTSNTWVNPNSKNPNPNHSQPRAMLTSSTSQGNELAGTTWIGRWGFHCWRSTQDCTAFLNNLFSS

SEQ ID NO: 150369 - protein, 208 aa, Glycine max
  Coding DNA Sequence Number=SeqID_58684
  Gene Ontology: Mol. function=metalloendopeptidase activity; Cellular component=mitochondrial respiratory chain; Biological process =proteolysis
  Homolog annotation: Hit_ID=A7PN42; Match level="QueryCoverage=90%, HitCoverage=35%, E-value=1e-94, Identity=89%"; Hit description =Chromosome chr14 scaffold_21, whole genome shotgun sequence
  Pfam annotation: Domain name=Peptidase_M16_C; Domain location=36-207; Score=125.2; E_value=1.9e-34; Accession=PF05193.12; Description =Peptidase M16 inactive domain
VEGQTEEVIFDHLHATAFQYTPLGRTILGPAQNIKTITKAHLQSYIQTHYAAPRMVIAASGAVKHEDIVEQVKKLFTKLSTDPTTTSQLVAKEPAIFTGSEVRMLDDDIPLAQYAVAFEGASWKDPDSIPLMVMQAILGSWNKTAGGGKHMGSELAQRIGINEVAESIMAFNTNYKDTGLFGVYAVAKQINQYKYIHPRVILCRAMVS

SEQ ID NO: 150370 - protein, 74 aa, Glycine max
  Coding DNA Sequence Number=SeqID_58685
MSITLDNVILVSKGQAVVEASFMMMNQAILMMPKAQVIDSRLVQDFKIKHQESNPRFKIQEKKSRSNKSRLHIG

SEQ ID NO: 150371 - protein, 76 aa, Glycine max
  Coding DNA Sequence Number=SeqID_58686
MAAEWRRKRERRHHFKEKMSLEEAHHHRRPWIRAWRKKEMNEGRGREEHEILCSKRALNFEPTNPRSIPRFSTKCA

SEQ ID NO: 150372 - protein, 306 aa, Glycine max
  Coding DNA Sequence Number=SeqID_58687
MEIGTHKLKVKGPISTSGPHVVQNKNSCPPCGLPPNYTPPNAVHVPNKNANHSIPLKGQQPQLGHAPFAQLVGDAREEPRYHALGEFEPYPTYATEGPTFSGMPQPNAVGAPQHHPQQPLHFSVGRLPPAMEEREKLDLIEERLRAIEGVGDYPFADMAELCLVPNIVIPPKFKVSDFDKIEVGLRRGKFDYAASASITNRRSGTGAAKTKKGDTHVVTSAPTWPKSQQTLHNSTYQYSPHQPNYSANIGNPPNPTPVQQRLLAQPQRPSPKNCFPHNLDPLGTPIPTQAPTRGGIFQKENPRNSP

SEQ ID NO: 150373 - protein, 63 aa, Glycine max
  Coding DNA Sequence Number=SeqID_58688
MEFQQKIKEKSIFPLNVTRMKSMTLAHGKRICHKNMSKEYSKNMRKEYFKNMPKEGKLHTPLQ

SEQ ID NO: 150374 - protein, 60 aa, Glycine max
  Coding DNA Sequence Number=SeqID_58689
MSQNFTYCATKGAKYLEAVKQRKPYQLYFIKRIYFSMDPFLANIRITILMYLWNAHQKGS

SEQ ID NO: 150375 - protein, 182 aa, Glycine max
  Coding DNA Sequence Number=SeqID_58690
MRTCIAWEPIIFQDGCMRWMNYKRKWLKQRVHKIYKAPKILPIGQMIYIQKSKDLKKRGRVRCLGKLPHQASSSQCSYANNRIQKLENLLENLVDVLKVRFAEDPQINQVLEAIDQEEHDLNGISHFPCMEEAIHERFNYNKPDTTMSKLDVSFAKMKIEDIVKSIAASSQNQLASNSLVDD

SEQ ID NO: 150376 - protein, 54 aa, Glycine max
  Coding DNA Sequence Number=SeqID_58691
MGLKENSNPVTLKAYTLKSPSGPLPPDSGPTPKIIFHADTAHELYNTPDLTLVF

SEQ ID NO: 150377 - protein, 67 aa, Glycine max
  Coding DNA Sequence Number=SeqID_58692
MSLPSAVHVSSTFESGAPRMSLPSAVRQFSILHFFSETHECHCLALFMCPPPKEFGAMLHDCLVWTL

SEQ ID NO: 150378 - protein, 51 aa, Glycine max
  Coding DNA Sequence Number=SeqID_58693
MGCHHQKGGDCGINAFKGDFDDAKEFKNQEKDSREVSNFQESRIKNNQIQD

SEQ ID NO: 150379 - protein, 275 aa, Glycine max
  Coding DNA Sequence Number=SeqID_58694
  Gene Ontology: Biological process=transposition, DNA-mediated
  Homolog annotation: Hit_ID=Q6UUU1; Match level="QueryCoverage=21%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPVTTLANWSSTAVAAALELVDPPGCRNSITDMLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 150380 - protein, 311 aa, Glycine max
  Coding DNA Sequence Number=SeqID_58695
  Gene Ontology: Biological process=transposition, DNA-mediated
  Homolog annotation: Hit_ID=Q6UUU1; Match level="QueryCoverage=19%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPEFDFTGLSIKQCLMFGDKLSRDDAFQNHYKANVGENVEDYAERIATMLSDAYQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 150381 - protein, 59 aa, Glycine max
  Coding DNA Sequence Number=SeqID_58696
MDDYIIRKVPQHYGKKTSIVTKFDVPPKGGCFWRKQPSSPGRAELAWASWVASISFLFL

SEQ ID NO: 150382 - protein, 160 aa, Glycine max
  Coding DNA Sequence Number=SeqID_58697
MKEDLKKFRDMNKYGTNSQDNVVKSVKDEDDVFLATNDEVAKTKWVMDSAASKHICKDREMFDTLKIVGEFGHYKLGNGGKGKVEGIRSVKMNLYDGAIRTFSNVRVQVCWFKVGMKGVQGETLGVRNHDSKVKKKVKFSNVVEVLGDTSVGGRVCSLSN

SEQ ID NO: 150383 - protein, 128 aa, Glycine max
  Coding DNA Sequence Number=SeqID_58698
MMRIMKLAKYRLKAQVEKDEGLSGEGQSPRVEKDEGPSNPCGVYPDLSSFTGSGVYPDLSSFTGSGVYPNLSSLTGSGVYPDLSSFTGSGVYPDLSFFTGSGVYHDLSSFTGSGVIQTFVACIKRSAP

SEQ ID NO: 150384 - protein, 244 aa, Glycine max
  Coding DNA Sequence Number=SeqID_58699
  Subcellular localization annotation: CTP_CleavageSite=65; ConfidenceScore=5.44e-01
MGNQPRGNFNTSGFPGLQNNQQYQQQRQWQNHPGNQFNRDQGGSSTRPQQQMPSLYNRNLAQFMQVSMSNQKRIESVIKNLEVQVVQLAKQLAKRPSNSFRANTEKNPKEECKAVMTRSKMVIQAEESRADKKVEGFKQQLADELALEPVDDLVELEEIIEEAEGDEEGETPIRDCQERIKKKEEKEKEEEIKEEEEEKVKKLKIEKQKEKVVEFEKKEGKSEANIEKKKEATSIECKEEPYPL

SEQ ID NO: 150385 - protein, 51 aa, Glycine max
  Coding DNA Sequence Number=SeqID_58700
MGEVEEVQEQMKADMEAMKEKMATMMVAMMSMKKIMETNAIAVAATSAVAK

SEQ ID NO: 150386 - protein, 73 aa, Glycine max
  Coding DNA Sequence Number=SeqID_58701
MRHVKHEGHAQRLHHSAPSFSYLSQPTLLRVSEARLTGASSIGGKCAESPPTFIERKTLEKPKETGHEEYSRF

SEQ ID NO: 150387 - protein, 43 aa, Glycine max
  Coding DNA Sequence Number=SeqID_58702
MEELINKTQLSPKIIPTSSHRLGGSTSESHFLHPTVVILLPQT

SEQ ID NO: 150388 - protein, 137 aa, Glycine max
  Coding DNA Sequence Number=SeqID_58703
MDNEEGVQEQMKADLSALKDQMASITEAMLKLQKTIEDNAMAAASNTAREAEPVLQLGINLGRDRNTTVLGRRYSPQAYPYGLPLDFTPRTTPKDLSQAPTFEGQLPPYADYPLQEDDEEDAHLGPLLPLKDPPPHE

SEQ ID NO: 150389 - protein, 360 aa, Glycine max
  Coding DNA Sequence Number=SeqID_58704
  Homolog annotation: Hit_ID=A5AZG1; Match level="QueryCoverage=30%, HitCoverage=33%, E-value=6e-09, Identity=34%"; Hit description =Putative uncharacterized protein
  Pfam annotation: Domain name=zf-CCHC; Domain location=194-211; Score =22.6; E_value=0.00058; Accession=PF00098.14; Description=Zinc knuckle
VNGEGSTPKDPLYKILDELRSLKLWKEKQERKEKGKKRVEEISQDEKEKIKEEEIRKILKELRKEKHASYSSHNSCKSLSEELCDYYEGRHRAHPRPHFHGREKERKPDVANINLLLYFNGKDNVEANLDWEIRVEQQLKRKSTSKSYGSHSYPKKDQGQGILVVTPSKPKDDKGKTIENQPLKASMQEKTSSIKCFKCLGRGHITSQCPTKKTMIMRGQDIYSSQDEATTPPSPSESEEAKGEESSKEIYPQEEGQPLTVKEECKEVSVSSKRLAKEERHFEIKTNIKEISPLRQPPHFLLCKKTLASIATPLRLEFIPQVKELLDEGLVHQSLNPCALLVPKIGIIRHQIPMIGGMMN

SEQ ID NO: 150390 - protein, 197 aa, Glycine max
  Coding DNA Sequence Number=SeqID_58705
TFIEIPLFYHEQWAPNYPHEVRFKYNGATYPIRIQQHRGRYFFADGLSDVRADLKIYESIIINFFAYDDNTIFDLHFTPPLNQQTCGRPILHSRVHARRTEITQCIRDAPQPPEIPSHARKYLKQCENHLTILRKNAPPLQWDVVTLDHDIKDKSIVRPWYKFLRENNFHHGDEVSFYYQPHERIWEIVLRRERKWL

SEQ ID NO: 150391 - protein, 108 aa, Glycine max
  Coding DNA Sequence Number=SeqID_58706
VKVGTSYVPINVSFSPKVGPGLPGINRDTRIYFFCEVIFRHRHMFLSAVPPVQLLTGWWVTAKAPPDISAGKCSGHGRVPFAIQDEQRLGRAIGAGLFAITPAGERGM

SEQ ID NO: 150392 - protein, 57 aa, Glycine max
  Coding DNA Sequence Number=SeqID_58707
METGGAGAESCSKHGDRGSRSRKLMIHDVGYNVQDILPENTGVAKSIEAAGSTMSDT

SEQ ID NO: 150393 - protein, 101 aa, Glycine max
  Coding DNA Sequence Number=SeqID_58708
MNSWGSSLDGGGCMNDNQFMGLGIRFEVGGWMNSARQSIYGARDSMEQRLAINSWGSKLGGGGCMNDNQFMGLGLRFLGGGYTNIARQSIRGAPDSMVEDA

SEQ ID NO: 150394 - protein, 348 aa, Glycine max
  Coding DNA Sequence Number=SeqID_58709
  Homolog annotation: Hit_ID=A5BGZ1; Match level="QueryCoverage=50%, HitCoverage=19%, E-value=3e-12, Identity=27%"; Hit description =Putative uncharacterized protein
  Pfam annotation: Domain name=Retrotrans_gag; Domain location=48-129; Score=15.7; E_value=0.0016; Accession=PF03732.8; Description =Retrotransposon gag protein
MAAPDFTYESLCIQYPDEDVPYVLKTGLIHLLPKFHGLAGEDPHKHLKAFPHSLEGVAKDWLYYLAPRSITSWDDLKRVFLENIFPASRTTTIRKDISGLSNMERSMIDAASGGALGDMTPAKARNLIEKMASNSHQFSARNDVIVIRGVHETSQPQQQNQPQQNNYDLSSNRYNPGWWNHPNLRWSSPQQQQQQPAPSFQNAAGPSRPYIPPPIQQQQQPQKQPTVEAPTQPSLEELVRQMTMQNMQFQQETRASIQSLTNQMGQLATQLNQQQSQNSDKLPSQAIQNPKNVSAISLRSGKQCQCQGPQPVAPSSSANEPAKLHSTPEKGDDKNLPNNFCAGESSST

SEQ ID NO: 150395 - protein, 214 aa, Glycine max
  Coding DNA Sequence Number=SeqID_58710
MGDQEGTQEQMKADMSALKEQMASMMEAMLGMKQLMEKNAATAAAVSSAAEADPTPLATTHHPPSNIVGRGRDTLGHDGSPHLGYNRAAYPYGLPPNYSPPVLQEDAGHIASPVHEREPPQQPDEVHKDPQDYARRDVEFYPPIPEGPAPGTLPQPNIAALPIVLSMEGPPPATEERRKLDLLEERLRAMEGFGDYPFADMTDLCLVPDVVIPP

SEQ ID NO: 150396 - protein, 66 aa, Glycine max
  Coding DNA Sequence Number=SeqID_58711
MSSKIYPEVHENPRDFFSNSSPILLEPLAHGSSDWSLPRKDCIKKGGQKARLGEQGYFRLKQQLAW

SEQ ID NO: 150397 - protein, 173 aa, Glycine max
  Coding DNA Sequence Number=SeqID_58712
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=30%, HitCoverage=50%, E-value=6e-24, Identity=100%"; Hit description=LacZ protein
MRCWIYEHFSSIAECNADPNYDEVSPRACWWIATKKIVEKTHYSDHLVAAGSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPP

SEQ ID NO: 150398 - protein, 96 aa, Glycine max
  Coding DNA Sequence Number=SeqID_58713
MGSFGEAGWEWEFSWRRNLFDNELGRASAFIEQATTLSPNAALKDYWVWGADPKGIFTTRTAYLCIKVSCGKSKYLLEPYPLLGDYFGIGYRLRKT

SEQ ID NO: 150399 - protein, 116 aa, Glycine max
  Coding DNA Sequence Number=SeqID_58714
  Subcellular localization annotation: CTP_CleavageSite=70; ConfidenceScore=5.25e-01
GHVGAHDPTRLFAAARVKSCPGMHSSCMIASLSGCAHTVGRPPISGGAQEPTLKMRTRSPLKVRACSPLKARMCSPLEVRACSPLMARTCSPLKVRACSPPLTRTCSSLMARACSP

SEQ ID NO: 150400 - protein, 81 aa, Glycine max
  Coding DNA Sequence Number=SeqID_58715
MEVEEPWLGLWLPLNYRVDMGSSLAYDNEIWGEPYRLFAAKFLFVGVFWKLGRIGMAVTAWVSPSFSPSSFAPVFSVVVVG

SEQ ID NO: 150401 - protein, 42 aa, Glycine max
  Coding DNA Sequence Number=SeqID_58716
MADGPRSNVMKGLQEILEYYEMHYVVKTNLKFQLDLPMVWGF

SEQ ID NO: 150402 - protein, 89 aa, Glycine max
  Coding DNA Sequence Number=SeqID_58717
MTSSKRFVEAEDEDSVVSKKKAAEKKGTDEKKNDMREKEKEVEKEKEKEKGKNEKDEKNKNEERSRSEQAREKKREKVVNEGAEVPYPV

SEQ ID NO: 150403 - protein, 23 aa, Glycine max
  Coding DNA Sequence Number=SeqID_58718
MPVSAETQHSIALERKNLADPSI

SEQ ID NO: 150404 - protein, 326 aa, Glycine max
  Coding DNA Sequence Number=SeqID_58719
  Homolog annotation: Hit_ID=A5BSR3; Match level="QueryCoverage=39%, HitCoverage=41%, E-value=4e-12, Identity=36%"; Hit description =Putative uncharacterized protein
DVRMKAQAIQKQNTAPNVLSRRGYDYLEQKLLAEKTKKKLEEVAQSRSVDGIIDPPSPVRCHVKWKMARTKKTGEMTTEVVKEIAEKIDSFEEQATQGSFVPHGRQDVLAAAIGRLEHPGRVRAAGAGVTIKQYFGSAPQTSRSASSLPPDELQQLTQQIRDQLEESITEKVTRQVMASFNKLQSQMQSQGLAVLLSLWCGLYIEADPARLVAMGRMQMLPVPVPTDEVSLVGQALHTFPAWPTHLVKSLSQQVVVSPAKPPPKPDPEIDYPLYLMTLTIPEFFLRPYQVRWDANVFGVFNPDFPLYIKHEDLSEIAQGGQCLSIS

SEQ ID NO: 150405 - protein, 180 aa, Glycine max
  Coding DNA Sequence Number=SeqID_58720
MFGYPPHEKRTPSFPSFHRGNQLIVLPPIPAKSWSQSILLFSVHERWLRSGHGCLVSCWNKCETNQTQRAGKQQMIRALLFSHLRSNVSNKSAKTATTGLSLLWWYLRGRPAMPFRVCFMRSKPLAESLTTVAILLKEGRHPEERYGFLPPRGHPIISSNSSMVGTNWKSPNVKHLKSWS

SEQ ID NO: 150406 - protein, 240 aa, Glycine max
  Coding DNA Sequence Number=SeqID_58721
  Gene Ontology: Biological process=transposition, DNA-mediated
  Homolog annotation: Hit_ID=Q6UUU1; Match level="QueryCoverage=25%, HitCoverage=40%, E-value=3e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLAIGGLQIIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 150407 - protein, 161 aa, Glycine max
  Coding DNA Sequence Number=SeqID_58722
  Subcellular localization annotation: CTP_CleavageSite=19; ConfidenceScore=5.60e-01
MVKWNLTTLNHFPKCPGSRSTSGSPGLFLRSDPSQVLHGFMFLSAVPPVQLLTGWCRTIRHTSIPSRTSALASVAGATLRGALSIRETMSGCATVKRPRAIECGPLRVLPGRKGRMCAYWRLLVGTDNARVFPVEVRCEKSDGHGPYNGAGIPGDPEEPYY

SEQ ID NO: 150408 - protein, 136 aa, Glycine max
  Coding DNA Sequence Number=SeqID_58723
MFSKKEGMMRIMKLAKYRLKAQVEKNEGPSGEGQSPRVEKDEGPSNPCGVYPDLSSFIGSGVYPDLSSLTGSGVYPDLSSFTGSGVYPDLSSFTGSGVIQKLYSLYKVIRPVRFTFLHRKWRLPRLIFLHWKWRLP

SEQ ID NO: 150409 - protein, 282 aa, Glycine max
  Coding DNA Sequence Number=SeqID_58724
  Homolog annotation: Hit_ID=A6X240; Match level="QueryCoverage=100%, HitCoverage=97%, E-value=1e-148, Identity=91%"; Hit description =Putative uncharacterized protein
  Pfam annotation: Domain name=DUF519; Domain location=32-282; Score =416.7; E_value=3.4e-122; Accession=PF04378.4; Description=Protein of unknown function (DUF519)
MNYRHAYHAGNFADVVKHVILTRLVEYLKRKDQAFRVIDTHAGIGLYDLKGIEAGKTGEWTGGIDRIVDAVKKGQIEQPALELLEPYLAAVRAVNEGEKLRHYPGSPLVVRHLLRKQDRLSALELHPQDSARLAKLFDGDYQVRVTELDGWLALGAHLPPKEKRGMVLVDPPFEKEGEFDRLVDGLAKAHKRFGGGIYALWYPVKDRRETERFTRHLRETGIPKIMQIELAIRAPSAEPRLDGTGMIVVNPPFTLESEMQTLLPCLTKLLAEEKGSNFSIKW

SEQ ID NO: 150410 - protein, 207 aa, Glycine max
  Coding DNA Sequence Number=SeqID_58725
  Homolog annotation: Hit_ID=Q84VH5; Match level="QueryCoverage=81%, HitCoverage=29%, E-value=1e-73, Identity=74%"; Hit description =Envelope-like protein
GVVDITVSEHQIAKEITAKQIQHWPKKGKLSVKYAILHRIGAANWVPTNHTSTVATESFAVKLPIAFPTVLCGIMLSQHPNILNYTDSVMKRESPLSLHYKLFEGTHVPDIVSTSGKAAASGAVSKDALIAELKDTCKVLEATIKATTEKKIELERLIKRLSESGIDDGEAAEEEEEAAEEEDAAAEEEEDAAEDTESDDDDSEATP

SEQ ID NO: 150411 - protein, 211 aa, Glycine max
  Coding DNA Sequence Number=SeqID_58726
  Gene Ontology: Mol. function=ligase activity
  Homolog annotation: Hit_ID=Q4QTN0; Match level="QueryCoverage=62%, HitCoverage=31%, E-value=8e-13, Identity=32%"; Hit description=WaaL
  Pfam annotation: Domain name=Wzy_C; Domain location=63-135; Score =24.0; E_value=0.00055; Accession=PF04932.6; Description=O-Antigen Polymerase
MAIHTLLIAVLATRFFWLTRSKAAVALAGLAIAGALVANYSVIEARASVTLSEIRSYQNNDDHTSLGSRFTMWKTGLLAFEHHPFGQTQPARNAWIVRWLDTHGNPDSFAITYLDVHLHNEFIQYASIFGITGVVVLACFYWISVVGSATAWGFFNPITVAALACLLYGMTDVLLTSVELIVVLCMLFSMMALVSGAPLQESGNDACRAEV

SEQ ID NO: 150412 - protein, 139 aa, Glycine max
  Coding DNA Sequence Number=SeqID_58727
MEGLVDLAAIDAFLAFHHGKESPVVAILAMYDTFDQGCEKEQRKNCLLCTGSLCVAGFTPFSPRRKDRELRGSSNGIIGGYHKWLRVRTQGLDWLPNLKTVRDDEVKASEESDEVQALKAELERARVVEEKFKSIAIKV

SEQ ID NO: 150413 - protein, 59 aa, Glycine max
  Coding DNA Sequence Number=SeqID_58728
MSLQCVKTKVLREKGDTKEFRRLVLRSFGKGRRETQKEFKWLVLGEFFLAKGEGSEKDE

SEQ ID NO: 150414 - protein, 201 aa, Glycine max
  Coding DNA Sequence Number=SeqID_58729
LFVLQTAIKNVYTDNHSGISARQRDSNVSMTDLVSVKDDTVKNNVYTDNHSGISARQRDSNVSMTDLVSAEDDGAEDDVSLCVLSGFSSLQTAKKNVYTDNHSGISARQRDSNVSMTNLVSAKDDTAKKNVYTDNHSGISARQRDSNVSMTNLVSVKDDVNLRVTTGLSAAIDEGLFVLQTTKKNVYTDNHSGISARQRDS

SEQ ID NO: 150415 - protein, 117 aa, Glycine max
  Coding DNA Sequence Number=SeqID_58730
  Subcellular localization annotation: CTP_CleavageSite=61; ConfidenceScore=5.39e-01
VVLPETLRKKGSSGKVFRKFETSSGSASLPEFFRMNHFFRKVPGRRFPEEVFFRKTFGYFRKNTSSGNFPENVLPELPEEPLRGLPEDSSVSDFRHFFRRPLVFSPLVFYPRFRLLP

SEQ ID NO: 150416 - protein, 80 aa, Glycine max
  Coding DNA Sequence Number=SeqID_58731
MAERRRKLLQDIIVASILEEETHFSDSSSSNSPSSRESINQLSETATMADEHDQRTTSPTLEDYSSSSVTQFFTSIAHPE

SEQ ID NO: 150417 - protein, 191 aa, Glycine max
  Coding DNA Sequence Number=SeqID_58732
  Gene Ontology: Mol. function=nucleotide binding; Cellular component =intrinsic to membrane; Biological process=defense response
  Homolog annotation: Hit_ID=Q2YE88; Match level="QueryCoverage=100%, HitCoverage=15%, E-value=1e-100, Identity=92%"; Hit description=NBS -LRR type disease resistance protein Rps1-k-1
MPRGMSKLNHLQHLDFFAVGKHKENGIKELGGLSNLRGRLEIRNLENVSQSDEASEARMMDKKHINSLRLEWSRCNNKSNNFQLEIDVLCKLQPHFNIESLGIKGYKGTRFPDWMGNSSYCNMTRLYLYDCDNCSMLPSLGQLPSLKDLGIARLNRLKTIDAGFYKNEDCRSGTPFPSLESLFIHDMPCWE

SEQ ID NO: 150418 - protein, 113 aa, Glycine max
  Coding DNA Sequence Number=SeqID_58733
MSLYSKFLKDMLTRKHSPGKHRSGRKWVLKIIKFILICLLKTSLLQNKMFAYSHFAKHKPRAKHIFGHALRRESQALSAQSLHLRLIWSAKLAKDELSQFQFDLNSAKQRPDR

SEQ ID NO: 150419 - protein, 118 aa, Glycine max
  Coding DNA Sequence Number=SeqID_58734
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=44%, HitCoverage=50%, E-value=4e-24, Identity=100%"; Hit description=LacZ protein
MKELRRLRTSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVR

SEQ ID NO: 150420 - protein, 64 aa, Glycine max
  Coding DNA Sequence Number=SeqID_58735
  Homolog annotation: Hit_ID=A0PAV3; Match level="QueryCoverage=59%, HitCoverage=17%, E-value=5e-07, Identity=76%"; Hit description =Restriction endonuclease
MVKVGTSYVPINVSFSPKVGPGLPGINRDTRIYLFCEVIFRHRCSSGFCLYQASLLFTYRRGGA

SEQ ID NO: 150421 - protein, 119 aa, Glycine max
  Coding DNA Sequence Number=SeqID_58736
  Gene Ontology: Mol. function=aspartic-type endopeptidase activity; Biological process=RNA-dependent DNA replication
  Homolog annotation: Hit_ID=Q33A53; Match level="QueryCoverage=59%, HitCoverage=37%, E-value=1e-08, Identity=42%"; Hit description =Retrotransposon, putative, centromere-specific
CTQLKAIEEGRSWCLMKGISLGEINNNAYRLDLPKEYGVSNTFNIIDLVPFTGVADSDDKGSVDLKTNPLQEGGDDAILPRRGHITKAMARKLQEDWARDAGEGLRILMDLRIDFRPMG

SEQ ID NO: 150422 - protein, 156 aa, Glycine max
  Coding DNA Sequence Number=SeqID_58737
MNRQRAGDRVRAFRITPGAKADVSYWLTMLALITQGSVEGVVAGEKSCTVRQQNMIDILPRLTDRTLGEFGAPRGERSRSRTGAEIPPGCRNSIHLIQGSGTPVQSRFSIGSAPLTHHRNLTLKSVVAKPDRTIKIPGVSPWRLPRALSCSCLSVY

SEQ ID NO: 150423 - protein, 110 aa, Glycine max
  Coding DNA Sequence Number=SeqID_58738
MVKVGTSYVPINVSFSPKVGPGLPGINRDTSGFFDLEVIFRAQHRRTSALASVAVDAARNHHTRRALIAPLQGASHSPFRTAATVGKGDRVRASSLLRQLAKGRMCCIRR

SEQ ID NO: 150424 - protein, 234 aa, Glycine max
  Coding DNA Sequence Number=SeqID_58739
  Homolog annotation: Hit_ID=Q6WAY6; Match level="QueryCoverage=57%, HitCoverage=21%, E-value=3e-16, Identity=39%"; Hit description =Putative uncharacterized protein
IPNHKESPVVAMLADLYDTFDRRCEKSNTRIVCCTPTLYVWLLSHLFRQEVRHACPLESHRSCTEKGGANWDQLLASKEGASVNWFPRWKEGRTGVLISCGGFPNVPLIGTRGCISYIPVLAIRQLGYPMRGAPIEEEIAPDKELKGSNNGPIGGYCKWLKAHVQGLDWLPSLRTTKREEVEAPEEDEELPPRPWNERPRGIVGKNTAETSSEGLCGAVTVSLSSGERKGTNHE

SEQ ID NO: 150425 - protein, 324 aa, Glycine max
  Coding DNA Sequence Number=SeqID_58740
  Gene Ontology: Mol. function=transcription regulator activity; Cellular component=flagellum; Biological process=regulation of transcription, DNA-dependent
  Homolog annotation: Hit_ID=A1FW09; Match level="QueryCoverage=100%, HitCoverage=51%, E-value=1e-143, Identity=84%"; Hit description=RNA polymerase sigma factor
  Pfam annotation: Domain name=Sigma70_ner; Domain location=33-240; Score=236.6; E_value=5.5e-68; Accession=PF04546.4; Description=Sigma- 70, non-essential region
  Pfam annotation: Domain name=Sigma70_r1_2; Domain location=1-27; Score=15.7; E_value=0.0085; Accession=PF00140.11; Description=Sigma -70 factor, region 1.2
  Pfam annotation: Domain name=Sigma70_r2; Domain location=271-324; Score=21.8; E_value=0.0026; Accession=PF04542.5; Description=Sigma -70 region 2
  Pfam module annotation: Pfam domain module=Sigma70_ner::Sigma70_r1 _2::Sigma70_r2; Domain location=33-240::1-27::271-324
MGTVELLTREGEIAIAKRIEEGLSQVQAALGQFPVSVESLLTDYEAHKEGKKRLAEVIVGFNDLTDEEPAPPAAAADDSADADAEGDEDEDDDVDGGDEEAAPTGPDPEEVAARMQALSDAFNAFKKAATKGDKKNLPRLREEMSAVFVTLKLPLPLTDVLTKQLRDTMASIKAHERRVLNLATVTARMPRKDFIRSWEGNQTNLEWVEDALKRKQKWSSALREVKDQIIAEQQATIDIEKLTQLDLEELKEISRAMAYGEAKARKAKKEMVEANLRLVISIAKKYTNRGLQFLDLIQEGNIGLMKAVDKFEYRRGYKFSTYAT

SEQ ID NO: 150426 - protein, 86 aa, Glycine max
  Coding DNA Sequence Number=SeqID_58741
MTAYFHTIKLSLSDSTMLKGQSKNEFKMFKIESRTTLQDSRGKLISRIKIQGSSFQESRSRFKTQDSRIKRRLNQDKYEKDFSKTE

SEQ ID NO: 150427 - protein, 126 aa, Glycine max
  Coding DNA Sequence Number=SeqID_58742
MAYTHIPDSTSDSPQISASPYQLDLAPYASEPYNAQWNAPGLLRDKHTLRSSRILREMEVDEPWLGLWLPLNYQVDMGSSLAYDNGIWGEPYKLFAAKFLFVGVFFFWFMLKVVFVIGSAVDRLCG

SEQ ID NO: 150428 - protein, 105 aa, Glycine max
  Coding DNA Sequence Number=SeqID_58743
  Subcellular localization annotation: CTP_CleavageSite=60; ConfidenceScore=5.00e-01
MAQLISDVIYCLQGSHPQDTQWTRRSPTVSWSCQALITGLGQFYGVPVAPSKVIRPPTNRAFIKKYCVPRQAQGETPQQPEDGRQRATDALSSPLEFTSAHPQKG

SEQ ID NO: 150429 - protein, 46 aa, Glycine max
  Coding DNA Sequence Number=SeqID_58744
MARSLSAPCPYSRDLYGRELNKAFSDNSQGGHISLDGLQSLYIPQL

SEQ ID NO: 150430 - protein, 167 aa, Glycine max
  Coding DNA Sequence Number=SeqID_58745
MASSVENFEAPVEDEEVQALKLELGKARLAKEKFKSAATHIRKEYTELQEENAATARALEQETKRARKEEYGREKFRGALWGSNNELKLRREERDRSRVHGMILKEELAACARSKRSLAQHLEAMEQSMLAIIRQYKEELNQSMTHEQKLAEDFAQVCRKGSKREGD

SEQ ID NO: 150431 - protein, 431 aa, Glycine max
  Coding DNA Sequence Number=SeqID_58746
  Gene Ontology: Mol. function=motor activity; Cellular component=cell projection
  Homolog annotation: Hit_ID=UPI00006A2D9E; Match level="QueryCoverage =45%, HitCoverage=97%, E-value=3e-17, Identity=17%"; Hit description =UPI00006A2D9E related cluster
LHVLAFRGPHALTFKALHVVTFRGLHVLAFRGLHTLAFKGLHAITFRGLHVLTFRGLHALAIRGLHTLAFRGLHVLAFRGQHVLAFRGLHALTFRGLHVLTFRGQHVLAFRGLHVLAFRGELHALAFRGLHVLTFRGLHALAFRGLHVLAFRGLYVLAFKGLHALAFKGQHVLDFRGLHAFSFRGLHALTLRGLHDYMSSPSEGCVPSPSEDYASSPLENYMSSPSEDYTSSPSKGHTPLPSEDCTSSPSEDYTSSPSKDYTSSPSKGYTPSPSKDYTSSPSEGYTPFPYEDYTSSLSEDYTSSPLEDNTSSPLEGCTPSPSEGYTPSPSEDYMSSPSKDYMSMPLEDYTGLHALAYKGLDALTFRGLHVFTFRGLHAFAIRGLHTLAFSGLHVLAFRGQHVLTFRGLHALAFRGLHAFTFRGVHVLTGIL

SEQ ID NO: 150432 - protein, 87 aa, Glycine max
  Coding DNA Sequence Number=SeqID_58747
MSHDYHAQNGLPDEVDGNFSDDEDEILADNNINDNDDNDIQFIFQPASTENVYRPYPNSVDVSDNQVVDNPDYRHFWTNNNNMTYPM

SEQ ID NO: 150433 - protein, 74 aa, Glycine max
  Coding DNA Sequence Number=SeqID_58748
MRKLGKAACQNSGTVVDSISFASQVLRGKVVEEPQLLAVSRAVAVVGLVEECMVCLGQQHFGRKEQAADVVAEG

SEQ ID NO: 150434 - protein, 89 aa, Glycine max
  Coding DNA Sequence Number=SeqID_58749
  Subcellular localization annotation: CTP_CleavageSite=5; ConfidenceScore=5.01e-01
MSLPSAVHVSSTFESGAPRMSLPSAVRQFSILHFYSESHECHCLALFMCPPSSSAEPLQKRRSRDENRHHGKGRTDKISVLSLLSSYLR

SEQ ID NO: 150435 - protein, 218 aa, Glycine max
  Coding DNA Sequence Number=SeqID_58750
  Gene Ontology: Mol. function=ammonium transmembrane transporter activity; Cellular component=membrane; Biological process=transport
  Homolog annotation: Hit_ID=Q1H483; Match level="QueryCoverage=66%, HitCoverage=33%, E-value=9e-60, Identity=75%"; Hit description =Ammonium transporter
  Pfam annotation: Domain name=Ammonium_transp; Domain location=73-218; Score=-188.6; E_value=0.0019; Accession=PF00909.12; Description =Ammonium Transporter Family
MKKILSMLSLVALMGLAATPVSYAEETVTETITVQETVSPDAAPAAEAPAAAPAEAAPAAAEEAPTLDVGNTAFMIVATVLVILMTIPGLALFYGGLVRQKNMLSVLMQVFVVFSLISVLWAAYGYSMAFSEGNMIVGGLSKAFLSGITTDSLSGTIPEYVFLTFQMIFAALTPGLIVGGFAERMKFSAVLLFTALWVTFAYIPIAHMVWGGVTWQSW

SEQ ID NO: 150436 - protein, 87 aa, Glycine max
  Coding DNA Sequence Number=SeqID_58751
MLSDSLEPELPVSTIPADAPGHLFSPATAVEAPFTDTLISANTSVTQLSRKPHSPSPAGVLIAKRPGTDALPDSWKWRMGAPERQRN

SEQ ID NO: 150437 - protein, 87 aa, Glycine max
  Coding DNA Sequence Number=SeqID_58752
KIGEKLAAQLTQASKVASSRSNSLLEESSGGPKLAWLLFAPPFLLNAPPSIFFAFEEVTKTYGLRKTPLFDFRHITEFHGLRKPASF

SEQ ID NO: 150438 - protein, 186 aa, Glycine max
  Coding DNA Sequence Number=SeqID_58753
MGVKYLGAVKRRLHVTKQWSPDEIRTPMILEEGENLCAHSRFALLRPDPQELATKLCIPGKGFELNAEGRPLKILRKNMTTLAQTWSILSFSNLVPTSYSSNVTLDRAKLIYSIIMKMDINLGYLISHQISIIAQHDSSRLGFPDLITALCKARGVTSDSRSLESLNPAINLAYIKKNCWNLDDSK

SEQ ID NO: 150439 - protein, 100 aa, Glycine max
  Coding DNA Sequence Number=SeqID_58754
FDEFLDELDRRHWREELTDFLDDNIDVAIVKEFYANFYDPEDKSPKQGETLCAYSRFALLRPDPQELDAKLCIPGRGFELNADGYPVKILRKNMTTLAQT

SEQ ID NO: 150440 - protein, 130 aa, Glycine max
  Coding DNA Sequence Number=SeqID_58755
  Gene Ontology: Mol. function=catalytic activity; Biological process =cellular metabolic process
  Homolog annotation: Hit_ID=Q0G1C7; Match level="QueryCoverage=96%, HitCoverage=37%, E-value=1e-25, Identity=46%"; Hit description=NDP -glucose 4,6-dehydratase
MIGNGNNRYQMVSVNDCVDAAILAVDKGCPHGPFNLGSTNPPTTKELLHGIIKHANSRSIVIPIPSAIIKPALSALDKCGLTLLYPEQFGIADKDVLLDTIDTNNTLGWKPSRKDIDAMCDAYNDYIRVK

SEQ ID NO: 150441 - protein, 47 aa, Glycine max
  Coding DNA Sequence Number=SeqID_58756
MTCTGLGSSSLMNSFASGKMNGSGMEKEEREETSLRGEDESRRSSPP

SEQ ID NO: 150442 - protein, 79 aa, Glycine max
  Coding DNA Sequence Number=SeqID_58757
GLHVLTFRGLHVLTFRGLHALAFRGLDVLVVIGLDVLAFRGLHVLHFSGLHILAFRGLRALAFSGLHIRTLREFKVLYP

SEQ ID NO: 150443 - protein, 465 aa, Glycine max
  Coding DNA Sequence Number=SeqID_58758
  Gene Ontology: Mol. function=iron ion binding; Cellular component =integral to membrane; Biological process=response to stimulus
  Homolog annotation: Hit_ID=Q82VI9; Match level="QueryCoverage=41%, HitCoverage=56%, E-value=6e-42, Identity=45%"; Hit description =Putative transmembrane sensor
  Pfam annotation: Domain name=FecR; Domain location=60-153; Score =134.3; E_value=3.5e-37; Accession=PF04773.4; Description=FecR protein
DLRGAASQAAAPARAGFEAAFAHAGKRRASRMLFAIGAALIVAAAGWMTLQAYPAAYLTADVHSVTGEWRVQLLEDGSRVTLAGDSAVNLRFNRQRRELELVQGQVLIEVAKDALRPFVVRTREARLTALGTRFAVDRHDGVTKLAMIESRVRVEAAGAAPAQALVVQAGQRVAVSARGAGPIVAVDPGQVEDAWKFHQLAARDQPLADVLKELNRHRPGRIFYDGAALAGIRMTVVLPLDDTDRALRLLAESVARLDAAVRLVLFRVGGADRRRSGPLVRKIPAMGDHAQAPTGRPTPPFSILAAAGAPHPVSRCPPCAGRVGRLGRADCPGAARRQAIRHSRRLAGGRLEPLCATVRHRVVADCRTGGRSRESGAAWPLRSGRRLRGAVARYRPAGPARRVRLCAGGVAGSRDPGAGRDRGRRGCRERGLCRATFFRASVQSGPRPFRSGVGRRPAGRHTGGA

SEQ ID NO: 150444 - protein, 108 aa, Glycine max
  Coding DNA Sequence Number=SeqID_58759
  Homolog annotation: Hit_ID=UPI0000ECBAF8; Match level="QueryCoverage =37%, HitCoverage=48%, E-value=1e-16, Identity=100%"; Hit description= UPI0000ECBAF8 related cluster
MPFYGRVKARLTGALSKGGKMCRVATNEGISTSHVDKSGALAPTYPPSKRKSDLRSMQAWHWPSFYNVVTGKTLALPNLIALQHIPLSPAGVIAKRPAPIALPNSCAA

SEQ ID NO: 150445 - protein, 155 aa, Glycine max
  Coding DNA Sequence Number=SeqID_58760
  Gene Ontology: Cellular component=extracellular region; Biological process=lipoprotein metabolic process
  Homolog annotation: Hit_ID=A0A8Y3; Match level="QueryCoverage=84%, HitCoverage=36%, E-value=9e-09, Identity=26%"; Hit description =Putative uncharacterized protein
MFFKCGIDDVFVHRFQPTYGCSNFISNIIREKFDELAASWLKVSVDLRDRWFGEFKKEYRWHPQEKRAIRAVFETKALDEHWGSTDFLNKSSTAKVNRSVDRGASTYYGGSVSIETHFEKLSKEFQRPPTTWKVMEKTKKLKSGEWVNDKSREFA

SEQ ID NO: 150446 - protein, 202 aa, Glycine max
  Coding DNA Sequence Number=SeqID_58761
  Pfam annotation: Domain name=Transposase_23; Domain location=5-75; Score=-2.9; E_value=0.0024; Accession=PF03017.5; Description =TNP1ENSPM transposase
NDPETGDSDRCGLYIEADPACLVAIGRVYEGSTVVHNTPLLLGQVKVSVEEVRDVDAPVPVPTDEVSLVGQALHTFLAWPTHLVKSLSQQVAVSPPKPPLKPDPEVDDPLYLMTLTIPKLFLRPYQHEDLSEIAHGGQCLSISVLQLWILHLTETCMRAGNSDIYGFLEPQSIQRSGQSQFESESSTAADIGRWWSSCPRNT

SEQ ID NO: 150447 - protein, 166 aa, Glycine max
  Coding DNA Sequence Number=SeqID_58762
MVWTIYHQESQPYGAVELCYPHSKDPDRTWVVNGQSGLSGDDALSATHSLEKSIVAALSVLSWAKPHIHSGIEISRVGLRAGCAKHQSLTVFEILGSALSVLVVLRAMLEKGVKTPVFLLQITMNALNDCTKPDRVAVSAFILLMSFNDEYAKRVCALSVTSVSDT

SEQ ID NO: 150448 - protein, 145 aa, Glycine max
  Coding DNA Sequence Number=SeqID_58763
NTYKTYRYRLPLLDIVGVTPTGMTFSTGFAYLEDLALMNAVKTVFPECTSLLCRFHIDKNVKAKCKFLIGQKNAWEIFFINGFLCFLEDEWQRNGERKRERRRHFKEKMSLEEAHHHRRPWIRAWRKKEMNEGRGREEHEILCSK

SEQ ID NO: 150449 - protein, 277 aa, Glycine max
  Coding DNA Sequence Number=SeqID_58764
  Gene Ontology: Biological process=transposition, DNA-mediated
  Homolog annotation: Hit_ID=Q6UUU1; Match level="QueryCoverage=21%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPGGRNDWLGVLLAQCSIRYQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 150450 - protein, 89 aa, Glycine max
  Coding DNA Sequence Number=SeqID_58765
MLWKLGRIDGDPTLRGTRIRATWEYVSSVGGGQQGMVGLYVICGCGELSCTIARPPPSTTCDGVVPGDMSRGSGDLGDVRWGAIAQNQA

SEQ ID NO: 150451 - protein, 59 aa, Glycine max
  Coding DNA Sequence Number=SeqID_58766
MVVPNPMYSEHHLRILRPLDLCDAILPRKGPITRTMSKRLQEDWARAAEEGPRVLMNLR

SEQ ID NO: 150452 - protein, 226 aa, Glycine max
  Coding DNA Sequence Number=SeqID_58767
AEVAETLQYIVSPQGRNTWTDDDLVPYVEKITILSEEQERVTEPASHGPASERQFPAQQFHILQSSVETQGIDRRRETVEGEEYFQQMPERGHGMYYTPQTFPEYPTHMYQYPFQGHHTDTSASQQSFGGVAETQAHFSWPTMTPSQQYHGPIPTPNAPLGTQWNVPGQIPNTGDLFGVDLRHAFSAEADEEEAGRHRGRRNPDRQARRWDRPCGTSSRHHGHQNE

SEQ ID NO: 150453 - protein, 118 aa, Glycine max
  Coding DNA Sequence Number=SeqID_58768
  Subcellular localization annotation: CTP_CleavageSite=61; ConfidenceScore=5.19e-01
PPVQLLTGWCVTAKAPPDISAGKCSGHAARNHHTRRAYAPLQGASHSPFRLRNCWEGRSVRASSLLRQLAKGGCAARRLSWGELELHRGGGRSRTSGSPGLQEFDSCVLHLRVWSYVS

SEQ ID NO: 150454 - protein, 66 aa, Glycine max
  Coding DNA Sequence Number=SeqID_58769
MRPLRVTSLSPVILVTLADNELMSMASSFLSLGVYTSTGLRGCFGMGKEQVLLSRGIGAFVKLRPW

SEQ ID NO: 150455 - protein, 170 aa, Glycine max
  Coding DNA Sequence Number=SeqID_58770
  Homolog annotation: Hit_ID=UPI0000F2ADE5; Match level="QueryCoverage =37%, HitCoverage=11%, E-value=7e-09, Identity=48%"; Hit description =PREDICTED: similar to PDZ-LIM protein cypher3s isoform 1
DCTSSPLEGYTPSPSEGCTSSPSEGCTPSPSKDYTSSPSKDYTFSPLEGYTPSPSKGCTPSPLEDYMSSPSEDYTSSPSDGYTSSPSKGHVPTFKGLHALTFRGLDVLTFKKLHALAFRGLHVLTFRGLHALPFRGLHVLTFRGLHALAFRELCVLTFRGLHILPFKGLH

SEQ ID NO: 150456 - protein, 252 aa, Glycine max
  Coding DNA Sequence Number=SeqID_58771
HLIKIDADSLNTFFETPIVLEEGETLPTYSRFTRMRIDPQEFASRLCIPGRGFVLNAGGHPWKLLRKDLTTLAQTWSVLSYNNLTPTSHTSDLNMDRDRLVYGLVTGMDVNIRALISGQISTIAKSNSFRLGFPALITALYRARGVTSDSLTYESLSPTINLAYIKKNCWNVDDLTVNFRGDRKVRARAADVPSSSAPPAPPTSTTPTPAAHDSQCFEAKAVASGGSNPARLGELSSPGRAGRQPPPLFCYK

SEQ ID NO: 150457 - protein, 28 aa, Glycine max
  Coding DNA Sequence Number=SeqID_58772
DCHHQKGGDCRKGEIVEDLWCFDDDQKA

SEQ ID NO: 150458 - protein, 71 aa, Glycine max
  Coding DNA Sequence Number=SeqID_58773
MWTTTGEELATQLAQASKVASSRSKSLLEEGSGRPKWARLLFLSKKLRKLTDYAKTPLFDFRHITEFHGLR

SEQ ID NO: 150459 - protein, 240 aa, Glycine max
  Coding DNA Sequence Number=SeqID_58774
  Homolog annotation: Hit_ID=Q6UUU1; Match level="QueryCoverage=25%, HitCoverage=40%, E-value=3e-18, Identity=78%"; Hit description =Putative uncharacterized protein
MVKVGNSYVPINVSFRQKLAQGFPWLLFLSAVPPVQLLTGWCVTAKAPPDISAGKCSGRVPFAIQAAQLLGRAIGAGLFAITPAGERGMCCKAIKLAIVDQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 150460 - protein, 27 aa, Glycine max
  Coding DNA Sequence Number=SeqID_58775
MNKSLKVGKDEMRERERRSTEFGASNE

SEQ ID NO: 150461 - protein, 122 aa, Glycine max
  Coding DNA Sequence Number=SeqID_58776
MMLSWSEPQASILQKIEQATIKNVALQELIQLCKQQPESQTNYTIKGNLLYWKNRHSELQWSKGEGNIDVNRISSIQKKLNEVEDLASNRILTDQELKIRSSLQQELWNVSNAVESLFETKI

SEQ ID NO: 150462 - protein, 158 aa, Glycine max
  Coding DNA Sequence Number=SeqID_58777
ESARGSRQGETPGIFIVLSGFATTDLSVRFRDACQGGGAYGKTALPRPSHFPVKRIFRTSLQGQFRARWGKPLVLSARRSRTTERTVVTGTPWRYSANIVIASMQHIRLSALACAPDRFPDMESGQPLISAPALHLPALMLPAGMLVCRIVSGSPFRQ

SEQ ID NO: 150463 - protein, 308 aa, Glycine max
  Coding DNA Sequence Number=SeqID_58778
ECAGLREENATTARALEQESKRARKEEYGRNKFRGALWGSNSELKLRREERDQSRAHSMVLKEELVACSRSKRSLSQRLCETETNMLAIIAKYQEELSLATAHEHRVADEYAQVYAEKEARGRVIDSLHQEATMWMDRFALTLNGSQELPRLLAKAKAMADTYSVPEEIHGLLGYWKNTITKRATRHPYRTRSKSRTMGDQEETQEQMKADMSALKEQMASMMEAMLGMRQLMEKKRGHRCRCRSRPNSLGNRAPSSLKHSRTGKEHAGARRQPSSGIQPSGLPLWIAAQLLTTCPARRCGPYCFSRP

SEQ ID NO: 150464 - protein, 185 aa, Glycine max
  Coding DNA Sequence Number=SeqID_58779
MTLTILELFLRPYQIKHEDLSEIAHGGQCLNILVLQLWIMHLTKTSMRAGNYDLYGFLEPQSIQRSRQSQFKAESYIKSWMQSSKRDVYLGAYLNGGHWQMVVIMPKEHLVVWFCSLHNRTDNYLKGIINSALKGLNDAPQPKSKAYARWIVVKYFNDPRPLEPERLKALQIQWAQYYLRVRAES

SEQ ID NO: 150465 - protein, 40 aa, Glycine max
  Coding DNA Sequence Number=SeqID_58780
IPLGAILAIVDPVVIGIVEKPEVIAVSKLIKSGLAIIAGK

SEQ ID NO: 150466 - protein, 91 aa, Glycine max
  Coding DNA Sequence Number=SeqID_58781
MCCKAIKLGNARVFPVTTLDLRSSVDLQVHPIKNCTFYTFGKGAVSDEPWIFFINGVLCFLKFNGSGMEKEERGLEMPLQGEDESSTSSPP

SEQ ID NO: 150467 - protein, 229 aa, Glycine max
  Coding DNA Sequence Number=SeqID_58782
  Homolog annotation: Hit_ID=Q6UUU1; Match level="QueryCoverage=26%, HitCoverage=40%, E-value=3e-18, Identity=78%"; Hit description =Putative uncharacterized protein
  Subcellular localization annotation: CTP_CleavageSite=42; ConfidenceScore=5.17e-01
GTSYVPINVSFSPKVGPGLPAVPPVQLLTGWCVTAKAPPDISAGKCSGRVPFAIQAAQLLGRAIGAGLFAITPAGERGMCCKAIKLDGDQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 150468 - protein, 180 aa, Glycine max
  Coding DNA Sequence Number=SeqID_58783
  Homolog annotation: Hit_ID=A1FXV4; Match level="QueryCoverage=53%, HitCoverage=10%, E-value=9e-29, Identity=69%"; Hit description=TonB -dependent receptor precursor
  Subcellular localization annotation: CTP_CleavageSite=65; ConfidenceScore=5.13e-01
MSGAQLGPAAAGRVPVPQRPAEQHPRPAAGDVTNWISRRRRWQPDPACTRRSSTLPAQNLEAVTVAAQVPSRISGRFGSLMFSGNYSNMLKREVQPMPGAAKLDLLSDPYNMWYYDNFAKVRGDQAYRYRRPRGGARYQLLFPLVRVNFELGVIMVIAVSCVKLLSAHNSTQHTSRKHKV

SEQ ID NO: 150469 - protein, 140 aa, Glycine max
  Coding DNA Sequence Number=SeqID_58784
  Homolog annotation: Hit_ID=Q6UUU1; Match level="QueryCoverage=42%, HitCoverage=40%, E-value=1e-18, Identity=78%"; Hit description =Putative uncharacterized protein
MVIKFDVRKAFHMLDWNFLLQVLIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 150470 - protein, 108 aa, Glycine max
  Coding DNA Sequence Number=SeqID_58785
MVKFDLEIVMEFYANAWPTEEGVRDKRSWVTGQWIPFNEDAINQFLGNLLVLEEGQRCEFSQRRSQASGFDKEAISHLLCVPGQDFARSVEGRRVRIMRTSMTTLTHI

SEQ ID NO: 150471 - protein, 107 aa, Glycine max
  Coding DNA Sequence Number=SeqID_58786
RKAVILVDVLSRVFCLCSVLLGCDSLCCLNVVLLGCCGSLGGLMGTRGWWVYARIVDVESLLCTIARPPPKWYLEICRGGQETLGTSGGVLLPKTKLDQSRPNPGIV

SEQ ID NO: 150472 - protein, 98 aa, Glycine max
  Coding DNA Sequence Number=SeqID_58787
  Homolog annotation: Hit_ID=Q5XM22; Match level="QueryCoverage=54%, HitCoverage=44%, E-value=8e-10, Identity=47%"; Hit description =Resistance-like protein HAAS-2
MYDQLDEASKATTRQIAGYLTLLQCWIYEHFPSVNQCVTDDTYQETSPRASRWLTSKAHMNGITGAPYRARCDALTITDVSWLPYTKHRGVKAFELIS

SEQ ID NO: 150473 - protein, 47 aa, Glycine max
  Coding DNA Sequence Number=SeqID_58788
  Subcellular localization annotation: CTP_CleavageSite=37; ConfidenceScore=5.13e-01
MCFREENPSRGASVTLSRHFCKQFCGKSSSFFTVLCRSSVFNRSLTL

SEQ ID NO: 150474 - protein, 71 aa, Glycine max
  Coding DNA Sequence Number=SeqID_58789
GRHKYVMQAPLELVGLGSSSSMDSFASWKMNGSGIEKEEGEETPLQGEDESRRSSPPQEAMDKSLEEEGDE

SEQ ID NO: 150475 - protein, 150 aa, Glycine max
  Coding DNA Sequence Number=SeqID_58790
  Homolog annotation: Hit_ID=Q2HW90; Match level="QueryCoverage=48%, HitCoverage=14%, E-value=3e-07, Identity=43%"; Hit description =Putative uncharacterized protein
EAISFLWVLSLHDKSCQGQRPWQNQGEWASFTDTLALLIFGGVLFPNMEGLVDLAVIDAFLAFHHGKESPVVAILAMHDTFDQRCEKSGARIVCCTPTLYVWLVSHLFLQEVTTTRGYSKEFARHGMRREERTESLGEAVMGSSAAIISG

SEQ ID NO: 150476 - protein, 91 aa, Glycine max
  Coding DNA Sequence Number=SeqID_58791
IVLARLPVDPEKSNRVLGFPALITCFCQFYGVPVTPGKVIRSPTYQAFIKKYCTPRQAQGETPQQPRDGWQRATNAPPPPLEFISAHPQKG

SEQ ID NO: 150477 - protein, 294 aa, Glycine max
  Coding DNA Sequence Number=SeqID_58792
  Gene Ontology: Biological process=transposition, DNA-mediated
  Homolog annotation: Hit_ID=Q6UUU1; Match level="QueryCoverage=20%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPEFDLLSFDASSNGACIMMRMKPLSGEGQQHMHVDNQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 150478 - protein, 62 aa, Glycine max
  Coding DNA Sequence Number=SeqID_58793
GRSLEFQEPMDLRSNPFQGVGNDAILPPPKALDRRLQEDWARDAKEDPRVLMSLRVDFEPMS

SEQ ID NO: 150479 - protein, 330 aa, Glycine max
  Coding DNA Sequence Number=SeqID_58794
MPKKKKKVKQIEPEPSVTVEGGEPVRKKKKKTKSSKEQGENQPVDVQPPSTDVGGAETETTPSIAEMGNLVEQPDLPQEHPTVEVQQNVSVEEIPSCARISPAPETDAVNVEEQGEGQGIGPSSPQGSSQRSSSEEHFSDEEAIQEAEAGGSDIFPASSTSKLSASIGIAEDTFIQMQDEDPAAALRLLLSTSQANTSSENNPGASSSSDADITSTVRQDCLLLKLSMEYARADVLKSIEENPSAAFGHLNFLKKLHNPLTSDEILGKVIQIESIIDQFANTVQKKRENGARLDAQKQAHILLLEKARAAQREVERLTKEAKEGSSEIKA

SEQ ID NO: 150480 - protein, 114 aa, Glycine max
  Coding DNA Sequence Number=SeqID_58795
MTPVNRKAGTGERTREPPGGNAGIFIVLSGFATTDLSVRFRDACQGGGAYGKTALPRPSHFPVKYLPAILEISAPEAISAPAASERSEFTAAREEYILTSSERRHRWQLFSIRP

SEQ ID NO: 150481 - protein, 235 aa, Glycine max
  Coding DNA Sequence Number=SeqID_58796
  Homolog annotation: Hit_ID=A5BSR3; Match level="QueryCoverage=65%, HitCoverage=48%, E-value=1e-10, Identity=32%"; Hit description =Putative uncharacterized protein
MIREEQAAFIEDPSLYLPRTKQYGQMTSQAAKEIADKIDSLEEQSRQGSIVPSGRDNILNMAIGRPEHPGRVRGAGTGVTITQYFGPASRRSTTSSNITVEQLADIIGNLKEEWRRHAEEENIKRDEAWMRRVEEEKQCTMDTFKGQIQQAIKLELSQIVSQHSAPLQPNDIEVLAARVSTKGSCAAAETNALAKKPSELNGDSVGLHVTVENSNKLVAVGKQCDSFGTITRALC

SEQ ID NO: 150482 - protein, 89 aa, Glycine max
  Coding DNA Sequence Number=SeqID_58797
MERKTRKKGKRRHRSHLRPHSHRREKERKPQEANISLPYFHGKDNVEAYLDWEISVEQQLKRKSTSKPYGSHSYPKGKTKARHLRGDTL

SEQ ID NO: 150483 - protein, 109 aa, Glycine max
  Coding DNA Sequence Number=SeqID_58798
MDGCFDGMDTRITQLEEDGLRDQGSLVVKQSEQKGRVVLVWFKTCKGLLQDSGALKQVAWGWDKDSPYSKMQGLWLWAKLRALQSVWQGYTTTNFLPLNGVSEARLEVD

SEQ ID NO: 150484 - protein, 80 aa, Glycine max
  Coding DNA Sequence Number=SeqID_58799
MARIVLQDGCVSLPRPTMFEGGWCAVAKRVGSASAAELTAAAVAAFFSMSYLIPNMASIMEAICSFRADMSAFIYSCVSS

SEQ ID NO: 150485 - protein, 219 aa, Glycine max
  Coding DNA Sequence Number=SeqID_58800
  Gene Ontology: Mol. function=ATP binding; Cellular component=integral to membrane
  Homolog annotation: Hit_ID=A8GKW9; Match level="QueryCoverage=99%, HitCoverage=91%, E-value=3e-69, Identity=59%"; Hit description =Putative uncharacterized protein
  Pfam annotation: Domain name=UPF0014; Domain location=1-213; Score =275.7; E_value=9.4e-80; Accession=PF03649.4; Description =Uncharacterised protein family (UPF0014)
MLVLVALLISQKEKLGMSKDILWSVTRAIIQLVIVGYVLKSIFDVNNDWLTLLMVLFICVNAALNARKRSRRIEHGFIIALVAITSGTALTLTVLLLSGAIAFVPMQVIPISGMIAGNAMVAVGLCFTNLNQRFTDNQQKIMEMLSLSAPIKRASAGLMRDSIRAAMIPTVDGAKPEGLAIKYQIMVTFMLIATASLSTIIAAYLSYRRFYTARAQLKP

SEQ ID NO: 150486 - protein, 69 aa, Glycine max
  Coding DNA Sequence Number=SeqID_58801
MKIRTCLRGFSTKNLAAPMRDTLHLGNMENTFQWYGYMVGNYPSNVYRWHGISFSNARNGPEEACLKEI

SEQ ID NO: 150487 - protein, 299 aa, Glycine max
  Coding DNA Sequence Number=SeqID_58802
  Homolog annotation: Hit_ID=Q6WAY4; Match level="QueryCoverage=93%, HitCoverage=48%, E-value=1e-12, Identity=24%"; Hit description =Putative uncharacterized protein
DWDQHLARIGGSAISWFPRWKEGKEGVLFSCGDYPNVPLIGTRGCINYNPALAIRQLGYPMRGAPTEGSLSPFLVKDLGVQGLKVIQRIHKAWRSPLRKDKELRGIRNGVIGGYHGWLRIHTRGLDWLSKLKVIDEENFEVLEEDEEVQALKLELGKARLAKEKFKSAATHIRKECTENNELKILREERDRSRVHGMILKEELAACARSKRSLAQHLEATEQSMLAIIGQYKEELNQSVTHEQKLAEDFAQVYAEKEARGRVIDALHQEATMWMDRFALTLNGSQDLPRLLAKAKAMAE

SEQ ID NO: 150488 - protein, 17 aa, Glycine max
  Coding DNA Sequence Number=SeqID_58803
MADQQATKSKAKGRKIP

SEQ ID NO: 150489 - protein, 150 aa, Glycine max
  Coding DNA Sequence Number=SeqID_58804
MEETHEIPHHNLADFEPWLGYATEGQAVGGIPFENTLEGPQFRPQLQSLHFAVGRAPPAMAEKGKLDHLEERLRAIEGGEDYAFANLEKLFLIPKHGHSQDATTEHVQKGGRIFQKHAQKVEGSGGPGGTPNNGKGDDNRDGRHMIGTPL

SEQ ID NO: 150490 - protein, 148 aa, Glycine max
  Coding DNA Sequence Number=SeqID_58805
  Subcellular localization annotation: CTP_CleavageSite=51; ConfidenceScore=5.60e-01
MAYLFYQLFPPVQLLNGVVIRNGKSTSRTSALARRPSFHSETMSGANCNESANAGRSRRFAYYAAALKRMCCILAYYVGVTDEGVPVKCFMWQGKKAAPGSAEYVIRYYSASRSLTPTARSFDCGERNSGLPQRGGIRSIWKDAHRRS

SEQ ID NO: 150491 - protein, 292 aa, Glycine max
  Coding DNA Sequence Number=SeqID_58806
  Gene Ontology: Mol. function=transporter activity; Cellular component= periplasmic space; Biological process=transport
  Homolog annotation: Hit_ID=A8G8A4; Match level="QueryCoverage=25%, HitCoverage=16%, E-value=1e-36, Identity=100%"; Hit description =Extracellular solute-binding protein family 1 precursor
DLPSQWLLFLSAVPPVQLLTGWCVTAKAPPDISAGKCSGRVPFAIQAAQLLGRAIGAGLFAITPAGERGMCCKAIKLGNARVFPVTTLNSIVAEFLQYLAQPEIAAEWHQKTGYLPITTAAYDLTKQQGFYDKNPGADVATRQMLNKPPLPFTKGLRLGNMPQIRRSSLSIPSTSRGGPVPAFVPFSEVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 150492 - protein, 49 aa, Glycine max
  Coding DNA Sequence Number=SeqID_58807
GVSSLSSFSIPLPFIFQEAKESIDEEDPRPTSSNGAYITTFFKKFSKWT

SEQ ID NO: 150493 - protein, 99 aa, Glycine max
  Coding DNA Sequence Number=SeqID_58808
MTPICGSCAVTRLLRDAFQTIRLTQSCNYVILPHQVAILAYRGHLARCLTAVSIGPPSSRMRGEFVALVSLVREQAAHFHVDNKMPQQPMLFCEVFDVW

SEQ ID NO: 150494 - protein, 123 aa, Glycine max
  Coding DNA Sequence Number=SeqID_58809
  Homolog annotation: Hit_ID=O69421; Match level="QueryCoverage=25%, HitCoverage=32%, E-value=4e-10, Identity=100%"; Hit description=InsA protein
  Pfam annotation: Domain name=Ins_element1; Domain location=3-70; Score=-2.1; E_value=0.00017; Accession=PF03811.4; Description =Insertion element protein
APVASVSISCPSCSATDGVVRNGKSTAGHQRRQVDGIDKLDPPHPPRLMRRYRARPIRHSGCATVGKGDRCGPLRYYASWRKGDGELELHRGGGRSRTSGSPGLQEFDFPTVAQPEWRMGRAL

SEQ ID NO: 150495 - protein, 133 aa, Glycine max
  Coding DNA Sequence Number=SeqID_58810
MPISPCRCIGIAPIRRPVDRKKSNRALGFPAHVAGLCQSNRVSIPPARHPVDPEKSNRTLGFQALITGPVSSTECLAPSKIIRPPTNRDFIKNYCVPRQAQGETPQQPRDGRQWATDAPPSPLEFTSAHPQKG

SEQ ID NO: 150496 - protein, 124 aa, Glycine max
  Coding DNA Sequence Number=SeqID_58811
  Gene Ontology: Mol. function=phosphoenolpyruvate carboxylase activity; Cellular component=cytoplasm; Biological process=carbon utilization by fixation of carbon dioxide
  Homolog annotation: Hit_ID=Q6Q2Z9; Match level="QueryCoverage=87%, HitCoverage=10%, E-value=1e-55, Identity=94%"; Hit description =Phosphoenolpyruvate carboxylase
HLLDYNDRPDLSPEDRDMLIEDLVREITSIWQTDELRRSKPTPVDEARAGLNIVEQSLWKAVPHYLRRVSSALKKHTGKPLPLTCTPIKFGSWMGGDRDGNPNVTAKVASSNIHSCCLYFYYVI

SEQ ID NO: 150497 - protein, 81 aa, Glycine max
  Coding DNA Sequence Number=SeqID_58812
MPEPRIGEARFESCGTRDLRTRPSRNHQSLRANPPVLIATCNEEDSFLYGMGNRDLDESMGEMTTQCWKGRVVSGMGITSA

SEQ ID NO: 150498 - protein, 29 aa, Glycine max
  Coding DNA Sequence Number=SeqID_58813
MVTTTKVEFLEWALSIACLALVNYVTKAI

SEQ ID NO: 150499 - protein, 242 aa, Glycine max
  Coding DNA Sequence Number=SeqID_58814
  Gene Ontology: Mol. function=motor activity; Cellular component=cell projection
  Homolog annotation: Hit_ID=UPI00016621D1; Match level="QueryCoverage =99%, HitCoverage=41%, E-value=7e-22, Identity=33%"; Hit description =UPI00016621D1 related cluster
STLEDPLLAFRGLHALTFRGLLVLTFRGLHALAFRGLHVLCFRRLHVLTFRGLHVLSFRGLHVLAFGGLHALAFRGLHVLAFRGLHVLTFRGLHALTFRGLHVLAFRGLHALAFRGLHVLLLRGLHVLTFRGLHALTFRSLHVLTFRGLDVLPIRGLHVLTFRGLHALAFRGLHILAFRGLHVLVFRGLHILAFRGLHTLAFKGQHVLNFKGLHTLTFRGLRVLTFSGLHSYTLGEFKVLCP

SEQ ID NO: 150500 - protein, 232 aa, Glycine max
  Coding DNA Sequence Number=SeqID_58815
  Gene Ontology: Mol. function=aspartic-type endopeptidase activity; Cellular component=intracellular; Biological process=RNA-dependent DNA replication
  Homolog annotation: Hit_ID=Q0KIL1; Match level="QueryCoverage=75%, HitCoverage=19%, E-value=7e-09, Identity=28%"; Hit description =Gag/pol polyprotein, 3'-partial, putative
  Pfam annotation: Domain name=G-patch; Domain location=72-111; Score =28.5; E_value=2.4e-05; Accession=PF01585.14; Description=G-patch domain
MDINPPTAVCWGARGSTHEEDILVSCPSSMPYVEAAEESLETAFQSFEVVSISSVDSFSGQACLSDAAVMMARVMLGTGYEPGMGLGKDNGGITSLINAKGNHGKYGLGYKPTRADIKRSIARRKSGGQSSRLRQESEGSPPCHISRSFISAGLGDEGQVVAIYEDDVPSTLDLVRPCPPDFQLGNWRVEERPGIYATSIISDDESLEVLIPGTRLSTPSKKRIKRKMKGTR

SEQ ID NO: 150501 - protein, 137 aa, Glycine max
  Coding DNA Sequence Number=SeqID_58816
  Homolog annotation: Hit_ID=Q9LJS9; Match level="QueryCoverage=56%, HitCoverage=6%, E-value=5e-07, Identity=33%"; Hit description =Retroelement pol polyprotein-like
EINATCRRRNQERIRNVLQDLEAAAIPEEEPQSSEASSSFHMAEHSHLDPSEDYIMNEEPRKVTLEDYSSSNVPQFFTSITQPEVQAQTITYPPSLILLIQNNLFHGLPNKDPYAHLATYIEICNTIRLAGVPEDAI

SEQ ID NO: 150502 - protein, 64 aa, Glycine max
  Coding DNA Sequence Number=SeqID_58817
MATPLGITLLMRWLIKSSLELVDTRYYTQTRLSYGRCWTRSSPVIRQYPEVVNDFGNLVEPVIQ

SEQ ID NO: 150503 - protein, 147 aa, Glycine max
  Coding DNA Sequence Number=SeqID_58818
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=57%, HitCoverage=72%, E-value=3e-24, Identity=69%"; Hit description=LacZ protein
MHGTDVVLVQVAAQQHAVARRGLSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 150504 - protein, 127 aa, Glycine max
  Coding DNA Sequence Number=SeqID_58819
MKRDTSHQSVSLENKTGDSTVLKIGNSAKVVIKQDMKGRRHKYGFNNNKREKAEKKRVVDDETGDKHQLDEVLRMPCTCVVHSGTKEFKIASNKRDLFLGFSEHQERLRKKLALEEGRIFAANEQLS

SEQ ID NO: 150505 - protein, 129 aa, Glycine max
  Coding DNA Sequence Number=SeqID_58820
MTDLVSAEDDVNLRVSTGLSAVIKEGCRMTIICLCVPSDTTVSEWQRVRNDHNFVSACHRARRLWMTKGCRMTIICLCVPSDTTVSEWQKVSGMTIICLRMSSGPPPLDEKRVQNDHNLSLRAIEHDCV

SEQ ID NO: 150506 - protein, 172 aa, Glycine max
  Coding DNA Sequence Number=SeqID_58821
MKLCFYMYLHGTTWLFLYGNGMGLTTEGCRGFWGALSLVKCITKGLGFLGPSLSVDCMHRCGSSSLLSLTSSRPWSIICCNRSPTAKHASMLCGAPGCIKQKPFSCPPRGITPPLLEGLIDKPYGGRYVLQMFGPARPTRLDGINSSPSMIGKRVCLYVGPVLLKCQPSGFY

SEQ ID NO: 150507 - protein, 45 aa, Glycine max
  Coding DNA Sequence Number=SeqID_58822
MGVKHLTRTKERSHVIKQRSPDEIREASLLWRAKFSVGSSYGVLD

SEQ ID NO: 150508 - protein, 204 aa, Glycine max
  Coding DNA Sequence Number=SeqID_58823
  Homolog annotation: Hit_ID=O52175; Match level="QueryCoverage=24%, HitCoverage=56%, E-value=1e-19, Identity=95%"; Hit description =Salmonella berta plasmid pBERT, complete plasmid sequence
MVKVGTSYVPINVSFSPKVGPGLPGINRDTRIYLKPHYPETTETGWCYPLTIGNKQPPDIAKCKAWGQRRMCATAYYVGVTERVFPVKCVRGRRKKATASAEYVIRLYSANSSSELLPLGRHAASGNGLQRGGIRSGKMEDIDIGKERAAANRFPNIGSAPLTSITKSDAQISGGETRQDYKDTRRFPLAAPSCALLFLPFGLP

SEQ ID NO: 150509 - protein, 132 aa, Glycine max
  Coding DNA Sequence Number=SeqID_58824
  Homolog annotation: Hit_ID=A2Q186; Match level="QueryCoverage=54%, HitCoverage=18%, E-value=1e-08, Identity=34%"; Hit description =Reverse transcriptase-beet retrotransposon, putative
MNANRNRNSIRGVFIDGLWTDDPHKVKEEVKSFFFHRCQEPIGQQPKIDGIRFQTVNLQQNNELLAPFMDEEIQKAIFKAAVKFFMKEGNSQKDCMDLMEIENGELWTRVLKSKYGGWRNLEEIGNSAKQSV

SEQ ID NO: 150510 - protein, 123 aa, Glycine max
  Coding DNA Sequence Number=SeqID_58825
  Subcellular localization annotation: CTP_CleavageSite=69; ConfidenceScore=5.41e-01
MTMQNVQFQQETRASLQSLTKQMGQLATQLNQQQSQNSDRLPSQSVQNPKNVSVIALRSGKQCQGPQPVASSSSANEPAQLHSTPEKDDDKNLKKAAYPSSIPSKSNFQQKNGRGREGDLGNI

SEQ ID NO: 150511 - protein, 271 aa, Glycine max
  Coding DNA Sequence Number=SeqID_58826
  Gene Ontology: Biological process=transposition, DNA-mediated
  Homolog annotation: Hit_ID=Q6UUU1; Match level="QueryCoverage=22%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPVTTFNREWEFIRDLALYLSAVGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 150512 - protein, 60 aa, Glycine max
  Coding DNA Sequence Number=SeqID_58827
MGVRQLMIEVPQAVESDHVDQVVCEEQCDDIEQTGEESVKQVPQQDDQAALRRSTRVKRI

SEQ ID NO: 150513 - protein, 152 aa, Glycine max
  Coding DNA Sequence Number=SeqID_58828
  Homolog annotation: Hit_ID=Q2AA09; Match level="QueryCoverage=97%, HitCoverage=51%, E-value=2e-07, Identity=29%"; Hit description =Retrotransposon gag protein
MERSMIDVASGGALGDMTPAEARNLIEKMASNSQQFSARSDAIVIRVVHEVATNSSSSAETKKLEAVNQKSAPVARLCGLCSSADHRTDLCPSVQQSEAIEQPEAYAANIYNRPPQPQQQNQPQQNSYDLSSNRYSPGWRNHPNLRWSDPSQ

SEQ ID NO: 150514 - protein, 185 aa, Glycine max
  Coding DNA Sequence Number=SeqID_58829
MAPRKLASKRSRKDKAAEGTSSAPKYDSHRFRSAEHQQRFEAIKGWSFLQEQCVQLRDDEYTDFQEEIVRWRWASLVTPMAKFDPDIVLEFYANAWPTEEGVRDMRSWVRGQWIPFDADALSQFLGYPLVLEEGQECEYGQRRNRSDGFDEEAIAQLLCIPGQDFARTAAGRCHWGHRPAGLHDP

SEQ ID NO: 150515 - protein, 309 aa, Glycine max
  Coding DNA Sequence Number=SeqID_58830
  Homolog annotation: Hit_ID=Q6WAY4; Match level="QueryCoverage=53%, HitCoverage=29%, E-value=8e-15, Identity=32%"; Hit description =Putative uncharacterized protein
YYDQPLRCFTFEDFQLVPTVIEFEEILRCPLGGRKPYLFSGFYPSTTRVAKVVKISAQELDRVKQNRNGVVGVPRKFLEKGRRPWQIKANGLSFIDILALLIFGVVLFPNMEGLVDLAAIDAFLAFHHGKESPVVAILAMYDTFDRGCEKSSARIVCCALALYVWAGFHTFFLQEGRPVYPLQGHRSILSSCEGCPMRGVPSDESITPFIAWGFSDHNARDKELRGSSNGIIGGYHKWLRVRTQGLDWLPNLKTMRDNEVKASEESDEVQALKAKLERARVVKEKFKSIAIKVKGIITGQRHDLEGRAK

SEQ ID NO: 150516 - protein, 190 aa, Glycine max
  Coding DNA Sequence Number=SeqID_58831
  Pfam annotation: Domain name=MAP7; Domain location=2-167; Score= -76.9; E_value=0.038; Accession=PF05672.2; Description=MAP7 (E-MAP -115) family
MSHHSSSVNGKGTSHKDPLSRILDELSSLKLWKEKQERKEKGKKRVEEISQDERKKIREEERRKIMKEMKREKHASYSSHNSCKSLSEELRDYYEGRHRSHLRPHSHRREKERKPQEANIKLSYFDGKDNVEANLDWEIRVEQQLKKKSTSKSYGSHSYRKKDQGQGILGVTPSKPKDDKGKTIEKQAPK

SEQ ID NO: 150517 - protein, 122 aa, Glycine max
  Coding DNA Sequence Number=SeqID_58832
MSQNSFMICTCCVRVESSEKWRLRNLGKGYGYHCIIKLIWEQVSIGHRNWGEFYRIFRCKIHFLVGVLVCALALDARSANFVDDLGIAFVDDRVVGMAASTWIPSSFSSSSFAPVFSFIKAG

SEQ ID NO: 150518 - protein, 105 aa, Glycine max
  Coding DNA Sequence Number=SeqID_58833
MEYRRESSSRKGQDGRNQCLIFAFLLSPMRGPLGPSRFFLQKAVASGGSNLARLGELGGKLLPYFAIYRGRSEGRRGSAFLALLILSKLLRKIISVKKIQAESST

SEQ ID NO: 150519 - protein, 139 aa, Glycine max
  Coding DNA Sequence Number=SeqID_58834
VVGNAPAFVDELRGSGGGGGASVARCRPSPVLLDESSVSMGSDDLAGGDRHFVELTDARNQSWKPQDPVGLLRVHWGDGHPVGLTEARNQSWKPQGPVRLLRVHWLSHVHTYLCHDGTDQLILSHGEIGIVVARQNVAK

SEQ ID NO: 150520 - protein, 294 aa, Glycine max
  Coding DNA Sequence Number=SeqID_58835
  Gene Ontology: Mol. function=hydrolase activity, hydrolyzing O -glycosyl compounds; Cellular component=lysosome; Biological process =carbohydrate metabolic process
  Homolog annotation: Hit_ID=A7LZZ5; Match level="QueryCoverage=99%, HitCoverage=36%, E-value=1e-131, Identity=73%"; Hit description =Putative uncharacterized protein
  Pfam annotation: Domain name=Glyco_hydro_31; Domain location=1-293; Score=130.9; E_value=3.7e-36; Accession=PF01055.17; Description =Glycosyl hydrolases family 31
TWPESGRDVWPPDMNYPSGVRVYDAYNPEARNIYWKYLNKGIFSLGVDSWWMDSTEPDHLSQKAEDLDTKTYLGSFRKVRNAYPLMTVGGVYNHQRETTGDKRVFILTRSAFAGQQRYAANTWSGDVNSSWETLRKQVPAGLNFSLTGNPNFNSDIGGFFAGTYKRNGGSKNPMFQELYVRWLQYGTFTPMMRSHGTDVAREIYQFGNKGDIVYDAIEKFIRLRYSMLPYIYSVSHDVSKNGSSFMRALSMDFPSDKKTWDMNNEYLFGKSLLVAPVLNAQYTPEKAVKLTKMK

SEQ ID NO: 150521 - protein, 118 aa, Glycine max
  Coding DNA Sequence Number=SeqID_58836
MVKVGTSYVPINVSFSKVGPRASRCSPVQLLTGWCPSIRQKHTEPEHQRGKCKPGVLMTLTLTHHLIALRSTAPLSTGKPVPFAAFRLTPTVREGRSAALLLPAGAKGGCVTGLLCWH

SEQ ID NO: 150522 - protein, 62 aa, Glycine max
  Coding DNA Sequence Number=SeqID_58837
  Gene Ontology: Mol. function=helicase activity
  Homolog annotation: Hit_ID=Q9LTU4; Match level="QueryCoverage=75%, HitCoverage=3%, E-value=2e-11, Identity=63%"; Hit description =Helicase-like protein
MAICAHVGFPNLFLTLTCNPAWPEIQRQVAKSNLTAHDCPDVVSRLFTPLSGKKEDCLMLIS

SEQ ID NO: 150523 - protein, 178 aa, Glycine max
  Coding DNA Sequence Number=SeqID_58838
  Subcellular localization annotation: CTP_CleavageSite=61; ConfidenceScore=5.02e-01
MKSENKTEKRTIVTLTHFITHFTVAATDFTVAMTTMHSHGRGRNTHSVSWPLVLPFHTVVVTTMLPPPPPHVQFLVPQNALSMHVCKFSQGDVCDVSNKYTLEVRVNNLGMAPRKLASKRSRKDQAAEGTSSAPGVRQSPALGALYTSSASKPSRDGRFSGSDASSSGTTSILIFRRK

SEQ ID NO: 150524 - protein, 109 aa, Glycine max
  Coding DNA Sequence Number=SeqID_58839
MPSPLEDLHVLAIIGLHSLAFERRHVLNFRGLHALAFRGLCVLTFRASSFLLTVPGPPPDIGGGPTVRAQPEREAITQLLCIPGQDFIRAAVKRRVRIMRTNMTTLTQI

SEQ ID NO: 150525 - protein, 135 aa, Glycine max
  Coding DNA Sequence Number=SeqID_58840
MGEVEKIQEKMKADMEAMKEQMATMMEAMMSMKKIMEANAVIVAATSAVAKVNPMLPSGLKQMNHPTSNMVGKDLGSTDDPMMCRFKTSTPSRHMVCLPNYTPPNVAYTPNKNVNNSTPIPIESQQPRTDHAHVS

SEQ ID NO: 150526 - protein, 198 aa, Glycine max
  Coding DNA Sequence Number=SeqID_58841
  Homolog annotation: Hit_ID=A5AMK2; Match level="QueryCoverage=46%, HitCoverage=12%, E-value=1e-06, Identity=34%"; Hit description =Putative uncharacterized protein
  Pfam annotation: Domain name=zf-CCHC; Domain location=72-89; Score =19.0; E_value=0.002; Accession=PF00098.14; Description=Zinc knuckle
DNVEAYLDWEIRVEQKLKRKPTLKSYGYYSYPKKDQGLGILGAAPSKSNDDKGKTIEKQPPKVSMQEKTSSIKCFKCLGRGHITSQCSTKKTMIMRSQDIYSSQDEATTSPSSSESEEAKGEESSEEIYPQEEGKPLMTLVSIATPLRLEFIPQVKELLDEALVRKSLNPCALLVPKIGVPMNPKRIKVIPEWPAPPS

SEQ ID NO: 150527 - protein, 69 aa, Glycine max
  Coding DNA Sequence Number=SeqID_58842
MSPPKNARKGAALKMTWLLSMLRAPFPEEPTMHQLQCRWSGGRLEYRATPHGDLVGYRSRIDHMESHEV

SEQ ID NO: 150528 - protein, 57 aa, Glycine max
  Coding DNA Sequence Number=SeqID_58843
MCWLRPLPRGATHMSSPDAILPRKGPITRTMSKRLQEDWARAAEEGPRVLMNLRVDF

SEQ ID NO: 150529 - protein, 192 aa, Glycine max
  Coding DNA Sequence Number=SeqID_58844
MAAMMEAMMSLKKIMEANAVAISATSVVAKVNPTSPSGINQMNHPTSDMVGKDLGSTGGPHDVQIQNEHAFPPYGLPLNYTPPNVAYTPNKNTHGIPHHNLADFEPWLGYATEGQAVGGIPLENTLEGPQYHPQLHLLHSTTSKNPHAMVEMGKLDHLEERLRAIEGGEDYAFANLKKLFLEPNIITPSKFK

SEQ ID NO: 150530 - protein, 129 aa, Glycine max
  Coding DNA Sequence Number=SeqID_58845
  Gene Ontology: Mol. function=transferase activity; Biological process= DNA integration
  Homolog annotation: Hit_ID=A5AVJ3; Match level="QueryCoverage=65%, HitCoverage=9%, E-value=1e-10, Identity=46%"; Hit description =Putative uncharacterized protein
MPKYVRVGYIIHSWGIRKIFKPSRNGSLESSQKSYEVFVRDKVIICSNKRSDKLRLSTGYSDSDFAGCLDSLRSTSGYIFMLAGGDGFSAQCQANPYYFSTMVARKFVACYERPSNQNMVCKLTKLSQD

SEQ ID NO: 150531 - protein, 265 aa, Glycine max
  Coding DNA Sequence Number=SeqID_58846
MRSALPSFTTKVACICIPGNHVDPWVLVPITFRGLYVLAIRGLHILAYRGLHALAFRGLRVLIFIPGPPPDIRGRPTVRAHPEREAITHLLCIPGQDFTRAAAKRRVWIMRTNMTTFTWIWMMLLFSNILPGDHNANLPLQMYRNRTHKDTPVDPEKFNRALGFPALVTGLCNPTGCPFPPTRSRHHDIGSWSCQALITGLCQFYEVPVAPSKIIRPPTNRAFIKKYCIPRQAHGEKPQHPGDGRQRATDAPPSVLEFTSAHPQK

SEQ ID NO: 150532 - protein, 109 aa, Glycine max
  Coding DNA Sequence Number=SeqID_58847
MGSYLAHGPEIYPKAHENPKAFSCISGPIFLEPSIQCPWGLSSSFYRNLLKEASQGSFSRKLLKEAFQGDKPLASQGSFKKKLLKEVSQGSFSRMFLKEVSQGSYLGYK

SEQ ID NO: 150533 - protein, 139 aa, Glycine max
  Coding DNA Sequence Number=SeqID_58848
MGSSQKPSLKKRFHQVKIKSLEVTSLRELGQLMGQLQQQAFRKAYGEIWDLDRLVPTVEEFEEILGCPLGGRKPYLFFGFYPSTTRVAKVVKISAQELDPCKAKQKWSSRSTKEVFGGKGKGLGKIKANGLLLLTSWRF

SEQ ID NO: 150534 - protein, 30 aa, Glycine max
  Coding DNA Sequence Number=SeqID_58849
SDFLFDEGYVGAKAKGHVATVDDSTRDLFV

SEQ ID NO: 150535 - protein, 281 aa, Glycine max
  Coding DNA Sequence Number=SeqID_58850
  Gene Ontology: Mol. function=RNA-directed DNA polymerase activity; Biological process=regulation of transcription, DNA-dependent
  Homolog annotation: Hit_ID=Q8H6Q8; Match level="QueryCoverage=76%, HitCoverage=50%, E-value=3e-24, Identity=31%"; Hit description=CTV.20
HISKYCRLKKKLRNLNLEPAIEEQINNLLIETSEEETETSSSVLSDENLNLIQQDDQLSSTDDDDGQINTLTREQDLLFEAINSIPDPQEKKVFLEKLEKTLEVKPRQKDFITNNKFDVSNILKRLENSSTKPTTIQDLQTEINNLKREVKELRQQQEIHQIILSQLKEDSDSESTNNSEENQPENLEDDMFMGLINKIKIQKFYINIKIIINDFVLETMALFDTGTDSNCILAGLIPTKFFEKTSEKLSTANGSKLKINFKLSNAIIENQGLKINTNFLL

SEQ ID NO: 150536 - protein, 100 aa, Glycine max
  Coding DNA Sequence Number=SeqID_58851
MGLGKNNDGMANLVNIKENRGNFGLGYKPTRTDVRISIVERRDPAVDFEREVNRLEVEEEEGMQFPPKLERMVAQEDREVKLYQEETTVVNLGVGYEKKE

SEQ ID NO: 150537 - protein, 98 aa, Glycine max
  Coding DNA Sequence Number=SeqID_58852
VPSGVANCRNVPFAGERRRGSQVRFPKEERCAESPPTFIRGKRRKNRRKPVEMKILSSGVVFTFEEGISTSHVDKSGALAPTYPPSKRKSDLRSSSYA

SEQ ID NO: 150538 - protein, 109 aa, Glycine max
  Coding DNA Sequence Number=SeqID_58853
VHDEFGYNSIVFQWKEKDVAGGSMFHSANSLTSCGNYVSNDDTQPPTNMSNLNLDEDDGHDDYLVSNSYVEESLDEDDSVDGISDTDNEVPEMIPPVRIVHPAEGMISS

SEQ ID NO: 150539 - protein, 44 aa, Glycine max
  Coding DNA Sequence Number=SeqID_58854
MPPIVVMTLEGIGHILDLTPIGEKRKESLKRLTLTSHTSMGRTM

SEQ ID NO: 150540 - protein, 131 aa, Glycine max
  Coding DNA Sequence Number=SeqID_58855
MKNGEKREVVVAQLAQASRVASTKRHCLLLEPSGRPKWAWLLFAPFFSLNTPPFCVFFIDFFPKRCGTLRIMQRHLFSFLNVAKLYGLRNYARFPSGMLRNFMDYAWMLVSRVPKGANKVQGLTASTPGKN

SEQ ID NO: 150541 - protein, 17 aa, Glycine max
  Coding DNA Sequence Number=SeqID_58856
MDTRLRVIGDPMNGVQR

SEQ ID NO: 150542 - protein, 134 aa, Glycine max
  Coding DNA Sequence Number=SeqID_58857
MAVPKKRKVRLGFRSLPKPQAKLEDFASVEGFLSVWRTTMRCSRERKLIAYSRHLLKDPNGQIMDKCLLKLQTKFREDPTVKEVWEAFLSRQIHVALSKSFIKRLPPGASLRGFLQKLPRGFFENLSQETSLRK

SEQ ID NO: 150543 - protein, 176 aa, Glycine max
  Coding DNA Sequence Number=SeqID_58858
MESPTVATYPLAGGRRETHGCIFQGRKMHRVTTNVYLRKTSEKPERCGLRTLIVKGSRVVFMHGEYRRTKKNEQRMMKNGEESPRNRSRKRLGSTSAWIFFTETIFLTNFERILNTKRAGHLCSTLFPLFIGEKREVVAAHLAEVSRVASTKRHRLLLEPSGKPKWAWFLFAPPFH

SEQ ID NO: 150544 - protein, 210 aa, Glycine max
  Coding DNA Sequence Number=SeqID_58859
MKADMPALKEQMASMMEAMLGMRQLMENNVATATAVSLAVEADPTLPATAHHPLPNVVGRERSTQGHISNPHLGYNRVTYPYGLPPNYTPPVMRDDASHVPSPVLEGEPPRQSDEVHEDHREYAQGDVDFYPPVPVEGPAPNILPQPNLPAQPIFLSTEGPPSAAEERRKLDLIEERLRAVEGYWRLSVHGHGGSLLGTRRRHPPKIQGT

SEQ ID NO: 150545 - protein, 86 aa, Glycine max
  Coding DNA Sequence Number=SeqID_58860
MVRLMKQANVFPLKKTLKKFTVWEINSDKGILKEDFQASRRVLKINKDSGGHTLAISSTKTRRTTKLEETLTQFMQKRIPRRNAKL

SEQ ID NO: 150546 - protein, 79 aa, Glycine max
  Coding DNA Sequence Number=SeqID_58861
MVVEKEPATLAQAKFDSPGQADPAQILLLHLKYHISYSRCYIANTNSQNLKNQVVSLHSKLESDPTGNESRIAVLVEHV

SEQ ID NO: 150547 - protein, 146 aa, Glycine max
  Coding DNA Sequence Number=SeqID_58862
MNTSSSNVSDAGPSNLHVPRIVHRFDTSFHVEQNVIEVPFAYHRQWSPNYPNYVLFDYEGDKHFIKLHKYGNQFFFGDGLKELRRTHGIHESVLMRFVGRDKNTTFSVDVVGPLHQRAGPTIRHHVFTIDVSEDMIQHNYQLVGLS

SEQ ID NO: 150548 - protein, 154 aa, Glycine max
  Coding DNA Sequence Number=SeqID_58863
  Homolog annotation: Hit_ID=A6ZVW6; Match level="QueryCoverage=91%, HitCoverage=67%, E-value=6e-08, Identity=27%"; Hit description =Conserved protein
  Subcellular localization annotation: CTP_CleavageSite=86; ConfidenceScore=5.25e-01
TYQGNPCGVYPDLSSFTGSGVYPDLSSFTGSGVYPDLSSFTGSGVYPDLSSFIRSGVIQTSVACIKRSTPTQTYQGNPCGVYPDLSSFTGSGVYPDLSSFTGSGVYPDLSSFTGSGVYPDLSSFTGSGIYHDLSSFTGSGVIQISVACIKRSAP

SEQ ID NO: 150549 - protein, 218 aa, Glycine max
  Coding DNA Sequence Number=SeqID_58864
  Homolog annotation: Hit_ID=A2Q4S5; Match level="QueryCoverage=58%, HitCoverage=23%, E-value=5e-14, Identity=34%"; Hit description=IMP dehydrogenase/GMP reductase, putative
  Pfam annotation: Domain name=DUF1723; Domain location=141-190; Score =54.3; E_value=4.3e-13; Accession=PF08330.1; Description=Protein of unknown function (DUF1723)
VIGRARGRQDDHHADDVPQWRRPTAPAHRQREAAPVVEDVLEMTQDVAEMTEDVPASGVEGLASDGVEGLVGDGAEGLAADDAEGFPGGPRDPSVLTSFTEHVAHSIWTREVEKFGRPIPKIEGIVAATGLTPLIACSVVTGNPGVISAFVKRWHKETSSFHLPVGELTITLNDVASLLHLPITGAFHSFKPLHVDEAVIMLVELLEISGEEARAETV

SEQ ID NO: 150550 - protein, 159 aa, Glycine max
  Coding DNA Sequence Number=SeqID_58865
MKNHEIHFGKSYSIENFHGGPKLQPYYQNEAEKGSNLDKLLMQFMEATKSTQRALQSIEIQKSTVEAQEKSPVKEHVSREKDEEQVQQQWEKYSTVEKQLENILQINNLPHQLIIKKGRQGEHEETLSAILSLITNTFLEMIWNVLPDYMKFMEFLAKR

SEQ ID NO: 150551 - protein, 182 aa, Glycine max
  Coding DNA Sequence Number=SeqID_58866
  Homolog annotation: Hit_ID=Q9AVH2; Match level="QueryCoverage=52%, HitCoverage=33%, E-value=1e-35, Identity=72%"; Hit description =Putative senescence-associated protein
MCCKAIKLGEGRIKATRAESQWIVAARPLCHLQYPVAYLSRLQRILPAARWELRFKASRRANPPHEGHQRHVPLGGRGPLLLVGKRTAGARVSTSPDSDLKAFSHNPTHGSFAPLAFQPSAMTNCANQRVLLRTRLNYYCDTVISRGNTNLSHDGLNPAHVPYWWGNNPTLGEFCFPMIGES

SEQ ID NO: 150552 - protein, 58 aa, Glycine max
  Coding DNA Sequence Number=SeqID_58867
FGLECGVRLPYVVARGPQVYPSNLPNIRVDGRVVTGSSFLHWDELCDKLLGEVSPENA

SEQ ID NO: 150553 - protein, 57 aa, Glycine max
  Coding DNA Sequence Number=SeqID_58868
MYPKAHKNPRAFSCIFGPIYLEFFYPMPLRGRIASQSNRPLVIDYQLCVIDYTVHIA

SEQ ID NO: 150554 - protein, 178 aa, Glycine max
  Coding DNA Sequence Number=SeqID_58869
  Gene Ontology: Mol. function=hydrolase activity, acting on carbon -nitrogen (but not peptide) bonds
  Homolog annotation: Hit_ID=A9BY61; Match level="QueryCoverage=79%, HitCoverage=22%, E-value=5e-64, Identity=80%"; Hit description =Amidohydrolase 3
MPTRRDLIGAASTLALSSLLGGCAPARSKGEPPMSNASNTTPDIIFHNGRITTLDRAKPLASAVAIKDGRFVAVGTDAEVMALAGPATRRVDLKQRGALPGLFDNHTHVVRGGLNYNMELRWDGVRSLADAMAMLKRQVAITPAPQWVRVVGGFTEHQFAEKRLPTIEEINAIAPDTP

SEQ ID NO: 150555 - protein, 363 aa, Glycine max
  Coding DNA Sequence Number=SeqID_58870
  Gene Ontology: Mol. function=oxidoreductase activity, acting on the aldehyde or oxo group of donors, NAD or NADP as acceptor; Cellular component=cytoplasm; Biological process=methionine biosynthetic process
  Homolog annotation: Hit_ID=A1FYQ2; Match level="QueryCoverage=94%, HitCoverage=100%, E-value=0.0, Identity=99%"; Hit description =Aspartate-semialdehyde dehydrogenase
  Pfam annotation: Domain name=Semialdhyde_dh; Domain location=30-145; Score=161.7; E_value=2e-45; Accession=PF01118.15; Description =Semialdehyde dehydrogenase, NAD binding domain
  Pfam annotation: Domain name=Semialdhyde_dhC; Domain location=164 -345; Score=270.8; E_value=2.8e-78; Accession=PF02774.9; Description =Semialdehyde dehydrogenase, dimerisation domain
  Pfam module annotation: Pfam domain module=Semialdhyde_dh::Semialdhyde _dhC; Domain location=30-145::164-345
  Subcellular localization annotation: CTP_CleavageSite=35; ConfidenceScore=5.41e-01
FPEPSCRACFFPIPVFVRVSPMSNAQRSFHVAVVSATGAVGETMLSILAERDFPVGTLSVLASERSAGGEIEFNGQKVKVQDLATFDPSGVEIALFSAGGSVSKEYAPKFAAAGAVVIDNSSAFRYDDDVPLVVSEVNPEQVANRPRGIIANPNCSTMQMLVALAPLHRKYGIERINVSTYQSVSGGGRSATEELGKQTGQLLSFQEIDPQRFPVQIAFNLIPHIDDFQDNGFTKEEMKLIWETRKILGDDSILVNPTAVRVPVFYGHSESVAIETRDKVTVAEARALLEQSPGIEVVDRHEAGGYPTPVTHASGTDAVYVGRIREDLSHPRGLNLWIVSDNVRKGAALNAVQLAELVAAEQR

SEQ ID NO: 150556 - protein, 30 aa, Glycine max
  Coding DNA Sequence Number=SeqID_58871
MNSRNQPKVLRNGCNWGWGHDRLIVAPSLR

SEQ ID NO: 150557 - protein, 83 aa, Glycine max
  Coding DNA Sequence Number=SeqID_58872
MTTQTSCRNVPFAGERRRGSRVRFPKEERCAELPPTFICGKCRENRRKPVKMKILSSGVVFTLEEGRQKRGSCSYVPSIEEEI

SEQ ID NO: 150558 - protein, 99 aa, Glycine max
  Coding DNA Sequence Number=SeqID_58873
MVKVGTSYVPINVSFSPKVGPGLPAANIKCAATGRVPFAIQAELTAHWEGCDRCGPHLRYYASGETGDVLQGCIKLNRSNARGGVSRTLALKRRPVNTG

SEQ ID NO: 150559 - protein, 174 aa, Glycine max
  Coding DNA Sequence Number=SeqID_58874
  Gene Ontology: Mol. function=aspartic-type endopeptidase activity; Biological process=RNA-dependent DNA replication
  Homolog annotation: Hit_ID=Q6WAY3; Match level="QueryCoverage=82%, HitCoverage=9%, E-value=2e-13, Identity=27%"; Hit description =Gag/pol polyprotein
MGKLDHLEERLRAIEGGEDHAFANLEELFLVSDIITPPKFKVLDFDEYKGTTCPKNHLKMQYQYNFDMVPDRMQQQNMCKKGHISFKEYAQRWRDLAAQSFADLVFASERIDVGLKRGKFSHPAWTNEKTRANEEGKDEGEACAVTPIPIQPSFPPTQQCHYSANNKPSPYPPP

SEQ ID NO: 150560 - protein, 184 aa, Glycine max
  Coding DNA Sequence Number=SeqID_58875
  Homolog annotation: Hit_ID=UPI00016621D1; Match level="QueryCoverage =49%, HitCoverage=35%, E-value=1e-07, Identity=39%"; Hit description =UPI00016621D1 related cluster
MTHDLTIRGMHALTFRGLHVLAFRGLHVLAFRGLHVLTFRGLHVLTFRGLDVLAFRGLHVLAIRGLHALTFKGLHVLTIRGLHALTFIGLHILTFRGLHTTRGPHHRKRAACPPSKDVYSPPSEDYSSTPIMRADHICATIREGGLHATHLCIPRASCTRASPAEDTTWTHLRGLHPRPIYGGL

SEQ ID NO: 150561 - protein, 183 aa, Glycine max
  Coding DNA Sequence Number=SeqID_58876
  Gene Ontology: Mol. function=protein kinase activity; Biological process=protein amino acid phosphorylation
  Homolog annotation: Hit_ID=Q2A9E0; Match level="QueryCoverage=99%, HitCoverage=12%, E-value=3e-25, Identity=35%"; Hit description =Putative uncharacterized protein
MADDIKFNHRKQGIQLTEKEAIHLCLTEIENMLQANRKRPRDFPSMKYPIGYAPNQDHNKLIFNEMAYDKQILAAEFNRSYHLLTDKQKSIVDTIIRVVDTQSAEFYFLYGYGGTNKAFVWTTLSSAICSNGGIVYIVASSGIASLLLLGGRTTHFKFVIPVPATQNSTCNIHQGSNLAELLK

SEQ ID NO: 150562 - protein, 234 aa, Glycine max
  Coding DNA Sequence Number=SeqID_58877
  Gene Ontology: Mol. function=ATPase activity, coupled to transmembrane movement of substances; Cellular component=integral to membrane; Biological process=transport
  Homolog annotation: Hit_ID=A1FUH9; Match level="QueryCoverage=63%, HitCoverage=26%, E-value=3e-66, Identity=82%"; Hit description=ABC transporter related precursor
  Pfam annotation: Domain name=ABC_tran; Domain location=88-229; Score=- 39.9; E_value=0.0014; Accession=PF00005.18; Description=ABC transporter
MAAGLVFLTVSLIQLWAGMGLAWQSLQSGRIAADRLQAIVEQATTVEDPAAPQPVPQAARVHWDDVHFQWPGAVRPVLSGLRQTLAPGERIAIRGDSGSGKTTLSSLQLRLWDPQQGRITYGGIDLRDFSQADWHRQLAWLPQNAPVDAPHAPGRMGRAQRWPAGLGGRERRDDVGRPGAAAGAGPCTAAQCADPAAGRTDRRPRRGYRTCAAAGPFRVAGRAQPVDDHPRRPA

SEQ ID NO: 150563 - protein, 306 aa, Glycine max
  Coding DNA Sequence Number=SeqID_58878
  Homolog annotation: Hit_ID=Q6WAY6; Match level="QueryCoverage=35%, HitCoverage=26%, E-value=8e-09, Identity=28%"; Hit description =Putative uncharacterized protein
DMASQEKWVPFADILALLIFGVVLFPNVDDLVDLAAIDAFLSYQHSKESPVVAILADLFHTFDRSAINWFPRWKEGKEGVLFSCGDYPNVPLIGTRGCINYNPALAIRQLGLKVIQRVHKAWRSPLRKDKELRGIRNGVIGVINEENFETPEEDEEVQALKLELGKARLAKEKFKSAATNIQKECTELREENAATARALEQETKRARKEEHGREKFRGALWGSNNELKLRREERDRSRVHGMILKEELAACARSKRSLAQHLEATEQSMLAIIGQYKEELNQSMTHEQKLVEDFAQVYTEKEARGR

SEQ ID NO: 150564 - protein, 73 aa, Glycine max
  Coding DNA Sequence Number=SeqID_58879
MVGYTPSSFADLVFTGERIEVGLKRGKSDHPAWINAKNGANEEGENEGETHVVTALPIRPSFPPTQQCHLGIL

SEQ ID NO: 150565 - protein, 116 aa, Glycine max
  Coding DNA Sequence Number=SeqID_58880
MSGFTRGSPQISASPHQLDLSPYASEPYNAQWNAPGLLLDKHTLRSSRILEEMEVDEPWLGLWLPLNYQVDMGAMRKTDFVGVLGMAFVDNWVVGKEKVGYWLSNDIVGLVGNLAV

SEQ ID NO: 150566 - protein, 237 aa, Glycine max
  Coding DNA Sequence Number=SeqID_58881
MTGAEPDAARAEEQGAFKQAVVDEVIQTTDKPGGNQGRLIQRQTGDARAKTEQDNADIFERVVRQQTLDVVLHQRVQATHERGDHPGQQQHDTPPQRRLPAGQREYQNPEQTHFHHHHREQRGGGRGGIGMRLRHPAVQRDDPGEQAKAHNAQQPDVIPQRMAVERREIQRAKALPHQPAGQRQQQRAEATEGKPQLAGGAIARQEHAAQGHNFGHHHQRAKIAGDNGADRRRHEQV

SEQ ID NO: 150567 - protein, 194 aa, Glycine max
  Coding DNA Sequence Number=SeqID_58882
  Subcellular localization annotation: CTP_CleavageSite=46; ConfidenceScore=5.48e-01
MVKVGTSYVPINVSFSPKVGPGLPVLSTGTPGFISICEHTRRTSALASVAGVQTLTLTTTPAALNCLPLQGASHFAIQGNLSCNCFESANARAIECGPLRYYASGAKGRMCCILAITMLALITPGTHYSRANSSSELATARSSCGERSELVAYPNGAEFDLSCEDANILNREVRWAAAKPFFHRLRPPDKHHEI

SEQ ID NO: 150568 - protein, 99 aa, Glycine max
  Coding DNA Sequence Number=SeqID_58883
MGCRYKVGWMGKGQGKRRKVVGSISSAIKTKTLTFVLKEICQWVYNRDDTEEMCGKLNSTSLQQEAVGRGIPQLSSGQGSGATKALPFNPAASVEAVKK

SEQ ID NO: 150569 - protein, 146 aa, Glycine max
  Coding DNA Sequence Number=SeqID_58884
  Pfam annotation: Domain name=FAR1; Domain location=53-137; Score= -25.1; E_value=0.029; Accession=PF03101.6; Description=FAR1 family
MDEDEWMYESIMSEEADMDYQNEEACGTNEPHVHCSDAFKTSQDVLRWARSIAHESRFVTMILRSDTNTSSRGRTLFVLIGCERRCEYRCRKKEFIRRDTRTRKCGCPFKLHCKPVVGGEGWMVKLICGVHNHELAKSLVGHPYAE

SEQ ID NO: 150570 - protein, 544 aa, Glycine max
  Coding DNA Sequence Number=SeqID_58885
MPSLMLVLGYYHQIFKPEVVKYIKHTIGVWHNDIVKIASDLIGNNEFFMQPDVGTLESSGASGTGTRPESLTFGNKRNVEVALVPPGRGYMPVALFGHFFQINEVEKWNLKLALTNELAKGKRQFSNAYKTFFLLCLRGQSAMDALRLKSTKKLGKGIIWLGLPSGLKGLAMKSAKQKVNTGTPIKEVQWQGPFSQANATAKDSRDPLSQRIRDIPMYTQSFQAARTASKQVICSLTSSLDDKKHALSCGKNMVFRGKKEITFYPRAREREIPAFFPTEATNNRAEGEGEASAYQTDSLGSGAERDGFPIGFRDEYGKSESKSQRTNSATSFSIEGTSRSRSAASAVEAVEGRAKADKSHNEHQINQKFSASFLSASVRRDLSQTVLNQTLPLLSTSSSRKLEQSPISKAKPRGPHSNENQRQSRTGSFSDDESLLEWTVASDDAPLFARWIRSVKKNQQVLSGIEIQWDQELQSRARSSMSRLRRTTKPKPLATKEEFRSLTRNRKDVKERRGVSTSVESGEVHGRAKANPLLKMVHDIIGPF

SEQ ID NO: 150571 - protein, 102 aa, Glycine max
  Coding DNA Sequence Number=SeqID_58886
  Gene Ontology: Mol. function=structural constituent of ribosome; Cellular component=large ribosomal subunit; Biological process =translation
  Homolog annotation: Hit_ID=Q0WMH3; Match level="QueryCoverage=34%, HitCoverage=85%, E-value=1e-10, Identity=94%"; Hit description=60S ribosomal protein L13a
MRRPDRDIFSSRSEQTTSTEGPVLEEFIPIKKRASSSLFCDEEDEDDEQHSHKQRELEKKRKEKTQLVYERKKQLNKLRVKAEKVAEDKLGSQLDILAPVKY

SEQ ID NO: 150572 - protein, 143 aa, Glycine max
  Coding DNA Sequence Number=SeqID_58887
MIMTKTSAKDPGRSVHNAPHDHTQHPTYEPGQKLVPKTLEEKISMQQGQADILIARFPDPSYGVKTGFVLYRNRKPSWKILLRLKGSSRCGVSMENNDGLWWLMVAVGDGESVWDIRNGFGRKKGEEITFFLRYTKAKAEMLK

SEQ ID NO: 150573 - protein, 247 aa, Glycine max
  Coding DNA Sequence Number=SeqID_58888
  Gene Ontology: Mol. function=phosphoprotein phosphatase activity
  Homolog annotation: Hit_ID=A2Q4S5; Match level="QueryCoverage=87%, HitCoverage=33%, E-value=5e-23, Identity=33%"; Hit description=IMP dehydrogenase/GMP reductase, putative
  Pfam annotation: Domain name=DUF1723; Domain location=147-196; Score =60.7; E_value=5e-15; Accession=PF08330.1; Description=Protein of unknown function (DUF1723)
MRRRPTASARRQWVHIAVNEGVPQVTEDVPHMVEDVPHMADDVPQMSEDAPQMTADVDVTVVEDLGRDCVEGSHADEGFPGGPHDPSALTLFAKHVAHAIWTGQECPKLKLVSHGRKVTLIGRPVPKIEGLVAATGLSPLIGCSVVTGDPGLIFAFVERWHRETNTFHIPVGELTITLDDVSSLLHLPISGAFHSFQAFSVDEAVFLLMELLEVFGEEARAETVRAHGAYVRLSWVREIYEMRCQTR

SEQ ID NO: 150574 - protein, 187 aa, Glycine max
  Coding DNA Sequence Number=SeqID_58889
MAALDVQRKKEEKKRKKAKRWGDCAGCTRFLGNNRLCIVNGSTWQPPEWADEYTKMVVWPRDWRRSITKTVLMNNRLCIVNGFTINTSSSSSFSYEDGLAQDRLRIVGGYTHVAGVIQRRSLLGPVVVSEIVSQLLLRQRPSPPKNSISCPLPLVPFAVAADKGCWLFLVLFIVVYIVVFKEDKVVP

SEQ ID NO: 150575 - protein, 116 aa, Glycine max
  Coding DNA Sequence Number=SeqID_58890
MAYGPLAARCIVPRQQSSGLVLFFAKEVGCCHQGCSKQSHVQTGNYECGYYVMQWIWCIVSGGLKDDWIHGGGDKDYKEVPPPPLFKPAGGHINQAVTFNRSYYKVISSMEKWLSH

SEQ ID NO: 150576 - protein, 198 aa, Glycine max
  Coding DNA Sequence Number=SeqID_58891
  Homolog annotation: Hit_ID=A7P7E6; Match level="QueryCoverage=44%, HitCoverage=14%, E-value=3e-07, Identity=38%"; Hit description =Chromosome chr9 scaffold_7, whole genome shotgun sequence
MVRTRGLGRALGHDTGRGVGRGDRDDSDDAPQRRQPTASPRRQRVPVTTANNEPVVLATEVEGALIEADVYADEPMAGGDVQDTGADNPANTGAQAAEDEPKGFSGGLRDPSVLTEYADYVAGSVWTGEERPELKLSSHRRNMHSLGMPVPAIEGLVAGTGLSPLIVCLIDTSDRGLLSLFVERWYREASSFHLPVGE

SEQ ID NO: 150577 - protein, 149 aa, Glycine max
  Coding DNA Sequence Number=SeqID_58892
GTSFVVQVEDTSTWVVVTENKRGHISCGSVLVEGTSTRLFKKNKGGYINCGSLLVKDFTRLKRNLKDRSFHINKNVKAKCKSLIGQKNAWDYVIDCWGCLTDCPSEQQFDECLKKFEMACSPWPMFVDYVKETWIIPHKEKKFPPGLIR

SEQ ID NO: 150578 - protein, 98 aa, Glycine max
  Coding DNA Sequence Number=SeqID_58893
MNLRVEDAGKNGGSLVTVSLLEDPLGVLLELPEEDLPEDFRKKGSSGGNETTSRRTGLPESSRNTSSGMFPETFRKRVFPDDLLVVPEALSGRPFFRK

SEQ ID NO: 150579 - protein, 121 aa, Glycine max
  Coding DNA Sequence Number=SeqID_58894
  Gene Ontology: Mol. function=binding; Cellular component=anaphase -promoting complex; Biological process=cell division
  Homolog annotation: Hit_ID=A6BL28; Match level="QueryCoverage=95%, HitCoverage=15%, E-value=7e-36, Identity=62%"; Hit description=Cdc27B
  Pfam annotation: Domain name=TPR_1; Domain location=3-36; Score=29.8; E_value=9.9e-06; Accession=PF00515.19; Description=Tetratricopeptide repeat
  Pfam annotation: Domain name=TPR_1; Domain location=37-70; Score=7.9; E_value=0.6; Accession=PF00515.19; Description=Tetratricopeptide repeat
  Pfam annotation: Domain name=TPR_2; Domain location=3-36; Score=22.1; E_value=0.0021; Accession=PF07719.8; Description=Tetratricopeptide repeat
  Pfam annotation: Domain name=TPR_2; Domain location=37-70; Score =12.7; E_value=0.77; Accession=PF07719.8; Description=Tetratricopeptid e repeat
  Pfam annotation: Domain name=TPR_2; Domain location=71-104; Score =1.1; E_value=22; Accession=PF07719.8; Description=Tetratricopeptide repeat
  Pfam module annotation: Pfam domain module=TPR_1::TPR_1::TPR_2::TPR _2::TPR_2; Domain location=3-36::37-70::3-36::37-70::71-104
MHYNAWCGLGMLYLRQEKYEFSKHHFHMAYQINPRSSIILSYLGVALHALKRSREALPIMEKTILEDKKNPVPMYQKANILISLERIDEDLDVLEELKEVQPHESSVYALMGNIYRKVSHA

SEQ ID NO: 150580 - protein, 16 aa, Glycine max
  Coding DNA Sequence Number=SeqID_58895
FMLKYVYQIARSNNFP

SEQ ID NO: 150581 - protein, 43 aa, Glycine max
  Coding DNA Sequence Number=SeqID_58896
ESIKPTLHTTIGPDPCKATTSTLNCGSSYGHHGLNSQLVLKVM

SEQ ID NO: 150582 - protein, 78 aa, Glycine max
  Coding DNA Sequence Number=SeqID_58897
MSSSKILPRIFFINGFLCFLEDEWQWNGEEKRERRRHFKEKMSLEEAHHHWKPWIRAWRKKKMNEGRGREEHKILCSK

SEQ ID NO: 150583 - protein, 92 aa, Glycine max
  Coding DNA Sequence Number=SeqID_58898
MVGKLYADHKLESFYCIHGDASRIVAWLGYYLTESSSQLQNTQSILLSVLELFTLIFGTFILDAYYHDCKCKPPSDHHIGVITLLSRTIGLK

SEQ ID NO: 150584 - protein, 98 aa, Glycine max
  Coding DNA Sequence Number=SeqID_58899
  Subcellular localization annotation: CTP_CleavageSite=41; ConfidenceScore=5.84e-01
MGSPPASTPPLPPPPPPPSPPPAPPTSDASASPSTVKWTRKASRLRSLSTRSPGAERPVVHIDPATGKADGPHRKKLRTYLGIVARDKVDITYENWKE

SEQ ID NO: 150585 - protein, 328 aa, Glycine max
  Coding DNA Sequence Number=SeqID_58900
  Homolog annotation: Hit_ID=A5BSR3; Match level="QueryCoverage=67%, HitCoverage=65%, E-value=7e-17, Identity=28%"; Hit description =Putative uncharacterized protein
GHAKPHVYDPCLTRPPGAERPVVHVDPATSKADGPHRKKLRTYLGIVACDKVDVTYENWKEVPTTQKDLIWEDIKAEFEIPKASDSRTKKKLLKTVGERLRTQKLLAEKTKKKLEEATQSGSVDGVIDHPSPVRHHVKWKMARTKKTGEMTTEATKEIAEKIDSFEEQASQGSFIPHGHQDVLTAAIRRPEHPGRVCAAGAAADLANQGPARGVNHRKSDSTAHGIVQPDAVPDAISGTCTASGALVGPSGNNPETGDSDRCGLYIEANSAHLVALGRVYKGSTVVYNTPLLPGQVKVGVEEVKDPDSPVPVPIDEAVVPSTSTPDPE

SEQ ID NO: 150586 - protein, 64 aa, Glycine max
  Coding DNA Sequence Number=SeqID_58901
MDTSEPCTGATRGTMHEPQVNLGANQNFSPVRSTDPWHHSIRKVSLGHIPKCNNSLPSFNGTHN

SEQ ID NO: 150587 - protein, 73 aa, Glycine max
  Coding DNA Sequence Number=SeqID_58902
  Homolog annotation: Hit_ID=Q2HS44; Match level="QueryCoverage=54%, HitCoverage=16%, E-value=2e-07, Identity=50%"; Hit description =Hemopexin
MVGLLVQEENFWRQRSKVFWLRDRDANTKYFHSEASTPKKQNQERRGKVGVVDAILPRKGPVTRAMSKRLQED

SEQ ID NO: 150588 - protein, 55 aa, Glycine max
  Coding DNA Sequence Number=SeqID_58903
MQSSKHDVYLGAYLNGPDNYLKGIINSALKGLDDAPQPKSKVVARWIVVKTKRKH

SEQ ID NO: 150589 - protein, 71 aa, Glycine max
  Coding DNA Sequence Number=SeqID_58904
  Gene Ontology: Mol. function=microtubule motor activity; Cellular component=microtubule associated complex; Biological process =microtubule-based movement
  Homolog annotation: Hit_ID=A5C3L5; Match level="QueryCoverage=95%, HitCoverage=7%, E-value=8e-16, Identity=67%"; Hit description =Putative uncharacterized protein
MSVPGKSLIQIRETSNGVITLAGITEVAASTLHEMSSYLEQGSFRRAMGSTNMNNHSKILWKIEAVSLHYG

SEQ ID NO: 150590 - protein, 82 aa, Glycine max
  Coding DNA Sequence Number=SeqID_58905
  Homolog annotation: Hit_ID=Q8H4Y5; Match level="QueryCoverage=74%, HitCoverage=14%, E-value=3e-11, Identity=57%"; Hit description =Nuclear inhibitor of PP1-like
MITVIPKGKEQSSVKEADSSPKSVTDKLQEVLKKIKTPVKTGIYDDLYGESLSVKVGSSLPYSPALSTGERGGWCKERKVRE

SEQ ID NO: 150591 - protein, 141 aa, Glycine max
  Coding DNA Sequence Number=SeqID_58906
MTRGNPGDLQPFDHEIDRTFHRLVRHSVHPGHSVHFEHSVEGDSKYSDFEHSTTNFYTENMAQPSPRERTLREMAAPDFTYESLCIQYPDEGEDPHKHLQEFHIVCSTMKPPDVQEDHVFLKAFPHSLEGVAKDWQYYLAP

SEQ ID NO: 150592 - protein, 77 aa, Glycine max
  Coding DNA Sequence Number=SeqID_58907
MGFQSYQLLKDKKLIQMKKAKLIGMLDEVEQRYKQYQQQMEIVKIALEGKWKVRGSNMLTIIFGNSEHFLSSLYNCL

SEQ ID NO: 150593 - protein, 200 aa, Glycine max
  Coding DNA Sequence Number=SeqID_58908
  Homolog annotation: Hit_ID=A7Q1A9; Match level="QueryCoverage=75%, HitCoverage=55%, E-value=3e-28, Identity=43%"; Hit description =Chromosome chr10 scaffold_43, whole genome shotgun sequence
MVAELGQQTVELSTLITRAANDKSFDMLIGGFIVSGACDEGLCLTNRTAEGFKLLQLIKARAIASNTVVYNTLLHALCRNGKVLDLFNDMKIDGNKIIRGLCSKGRIEYSFYILELMEENKEGSRGQISPYNSIRYGLLKQNRFHDTDEFLTMMVNFFPRAIGKSLIILEHYKKGSIEDAESVLSESHAGLYGNGRQGHP

SEQ ID NO: 150594 - protein, 33 aa, Glycine max
  Coding DNA Sequence Number=SeqID_58909
MEYETALAEMSPFTNEGGAINTTLLLCRAWDRL

SEQ ID NO: 150595 - protein, 222 aa, Glycine max
  Coding DNA Sequence Number=SeqID_58910
  Gene Ontology: Mol. function=RNA-directed DNA polymerase activity; Biological process=RNA-dependent DNA replication
  Homolog annotation: Hit_ID=Q2HTR6; Match level="QueryCoverage=38%, HitCoverage=21%, E-value=2e-09, Identity=41%"; Hit description=RNA -directed DNA polymerase , putative
MDVLKGTWDPLAPLLFNIVTEGLTDDAIFFDETSIQNVKVLKAILRSFEMVSGLKINYAKSQFGAVGKCAQWLNEAALYFNCSLLVVLFTYLGNLGDSDKVNTEDSKGGTQASHITKKVIMGLSWDSRSGIYFTIRENSKLECWIPNMEVGEAWMETIHLKQSPNARFWEDGWAADGIPLKEKYPRLYLNSKQKKAIHFANRRQFKREMGMVSTVEEAIVRD

SEQ ID NO: 150596 - protein, 47 aa, Glycine max
  Coding DNA Sequence Number=SeqID_58911
MVNESEIIIFLRQGTHNLLSYPNFVRGPLLDDMQLLFGPCEVLGTHH

SEQ ID NO: 150597 - protein, 252 aa, Glycine max
  Coding DNA Sequence Number=SeqID_58912
  Homolog annotation: Hit_ID=A5AN19; Match level="QueryCoverage=86%, HitCoverage=12%, E-value=4e-13, Identity=26%"; Hit description =Putative uncharacterized protein
MDVLKGTCNSFNKGLTGLMEKALKANKYKGLLVLKAILMIFEMVSGLKINYAKSQFGAVGKCAQWLNEAALYFNCSLLGDSDKVNTEDSKGGTQASHTTKKVIMGLSWDSRSGIYFTIRENSRLECWIPNMEVGEAWMATIHLKQSPNARFWEDGWAADGIPLKEKYPRLYLNSKQKKQYILQIGDSSKGKWEWCLQWKRLLFETEISMWANFLEEIQAINVNLQQSDKWVWTNDTSGKYTVRSAYQLMDRN

SEQ ID NO: 150598 - protein, 96 aa, Glycine max
  Coding DNA Sequence Number=SeqID_58913
MSELTLRSSRSSRVDEVIYGLVDARTQVCGLLIKFQPYFPNMARLNPWRLQNPIPQNFFFMESLSQLSQLIPLVDAPFDLHQNKFSILRISSSRVV

SEQ ID NO: 150599 - protein, 192 aa, Glycine max
  Coding DNA Sequence Number=SeqID_58914
  Homolog annotation: Hit_ID=Q84VH5; Match level="QueryCoverage=69%, HitCoverage=23%, E-value=3e-55, Identity=73%"; Hit description =Envelope-like protein
KLSVKYAILHRIGAANWVPTNHTSTVATESFAVKLPIAFPTVLCGIMLSQHPNILNYTDSVMKRESPLSLHYKLFEGTHVPDIVSTSGKAAASGAVSKDALIAELKDTCKVLEATIKATTEKKMELERLIKRLSESGIDDGEAAEEDGEAAEQEDEAAEEEVEAAEEEEEAAEEEEDAAEDTESDDDSEATP

SEQ ID NO: 150600 - protein, 59 aa, Glycine max
  Coding DNA Sequence Number=SeqID_58915
MGVQIATRPTWALQKGGCFWRKPPCLLGELSSPGRAGGKHLPHFPINNGRSEGDFVQPS

SEQ ID NO: 150601 - protein, 90 aa, Glycine max
  Coding DNA Sequence Number=SeqID_58916
MLAIVSKYQEELNLATAHEHRLADEYAQVYAEKEARGRVIDSLHQETTMWIDRFALTLNESQELPRLLAKAKVMADTYSAPEEIHGLLSY

SEQ ID NO: 150602 - protein, 42 aa, Glycine max
  Coding DNA Sequence Number=SeqID_58917
LASHLKEVSLAIRELSSSFSKEVFSKKLLKEVFSRKLLKEAT

SEQ ID NO: 150603 - protein, 98 aa, Glycine max
  Coding DNA Sequence Number=SeqID_58918
RATTSPDDESERSAIPPTGEAGGGAATSSDDALEMTIRGGDGGTASSSGEEGEFTPGDCGSAGSGLPAQMWAQAEQPLWVSPKEVDLQPRLLSQENAP

SEQ ID NO: 150604 - protein, 136 aa, Glycine max
  Coding DNA Sequence Number=SeqID_58919
  Subcellular localization annotation: CTP_CleavageSite=22; ConfidenceScore=5.38e-01
LSSLVTDVWGANTFPVRKYNSRAFHLKVHRSRLFRFFRRFPQINVGGDSARIPFVEHASRESRVALPPKGRLRHQGFTSFPCPTPDQFRAEVAWPGDWPEARAGEAPAEAPDEADEAREDEEMTDLLDFLGGSGAT

SEQ ID NO: 150605 - protein, 195 aa, Glycine max
  Coding DNA Sequence Number=SeqID_58920
  Gene Ontology: Mol. function=chitin binding; Cellular component =extracellular region; Biological process=chitin metabolic process
  Homolog annotation: Hit_ID=UPI00006A17C9; Match level="QueryCoverage =88%, HitCoverage=95%, E-value=8e-09, Identity=27%"; Hit description =UPI00006A17C9 related cluster
  Subcellular localization annotation: CTP_CleavageSite=12; ConfidenceScore=5.02e-01
MLVRMIRTRLFAAARVKSCPSMHSSCVIASLSGCAHTVGPPPISGGGPGTVWIWSPLKVRTCSPLKARACSLLKFRTCRLSKARECSPMMAWMCNPLKVRTCSALMVRTCSPLKARTCSPLNGEGNEYPSPLMVRTGSPLKARTCSPLNGEGNYPLMVRTCSPLKARTCSPLNGEGEDMWSSEGEGVQPSVGEDV

SEQ ID NO: 150606 - protein, 247 aa, Glycine max
  Coding DNA Sequence Number=SeqID_58921
  Homolog annotation: Hit_ID=Q08WR9; Match level="QueryCoverage=86%, HitCoverage=20%, E-value=1e-13, Identity=30%"; Hit description =Putative uncharacterized protein
TAAYRRSRRGTACRPPPPWKQPFAAADRAGKGALGVAEQFGLQQLLRQCAAVDGDERLAGARAGGVDRLRHHLFAGAALAVDQDADVGLRHHFHLLQQAQHQRAAGDDIFAPGVVAGRGGRQRERFVDRLVQRIAIHRFGQEAEHPLLGGGHRIGNRTVRGENDHRHARLMLLDLGEQRHAVHLVHTQIADHQIDLFARQQAQRFLAAFGGGDVKTFAGQTHAQQLQQAGIVVNQEQVGRFACGHCA

SEQ ID NO: 150607 - protein, 48 aa, Glycine max
  Coding DNA Sequence Number=SeqID_58922
MTCTHIPMEAKMIHKRFSSSFSQPASIRLCTLHFEVIQCSMECPGTPP

SEQ ID NO: 150608 - protein, 256 aa, Glycine max
  Coding DNA Sequence Number=SeqID_58923
  Homolog annotation: Hit_ID=Q84VI1; Match level="QueryCoverage=99%, HitCoverage=37%, E-value=6e-76, Identity=63%"; Hit description =Envelope-like protein
MATSPKETAAPSSPAVPSSPHQEQPEFNIQPIQIIPGQASVPEKLVPRRQQGVKIAENPSSATSPREVDPEMDKKIRSIVSSILKDASVPDAEKDVPTSSTPSVSVPDAEKDVPTSSAPNAEALPSPSEEESTEEEDQASEETPAPRAPETAPGDLIDLEEVESDEEPIANRLAPGIAERLQGRKGKTPLKRSGRIKTMAQKKSTPITPATSRRSKVAIPSKKRKEISSSDSDEDVELDVSTSKRAKKSGKKVPEK

SEQ ID NO: 150609 - protein, 192 aa, Glycine max
  Coding DNA Sequence Number=SeqID_58924
  Gene Ontology: Mol. function=transcription factor activity; Biological process=regulation of transcription, DNA-dependent
  Homolog annotation: Hit_ID=A6T5Y4; Match level="QueryCoverage=92%, HitCoverage=92%, E-value=4e-78, Identity=82%"; Hit description =Putative regulatory protein
  Pfam annotation: Domain name=TetR_N; Domain location=12-57; Score =50.7; E_value=5.1e-12; Accession=PF00440.14; Description=Bacterial regulatory proteins, tetR f
  Subcellular localization annotation: CTP_CleavageSite=34; ConfidenceScore=5.04e-01
VRSAVIRSRFNFQRAATAAFAQSGIAASTSAIARSAGVAEGTLFRYFATKDELLNELYLAIKMRLVQTMIAGLNPDEKRPKENARNIWNSYIDWGMRNPMEYRAIRRMALSERITDETRSQVKESFPELNEMCQLSVKAVFLSDAYRAFGDALFLSLAETTIEFASHDPQRARDIIALGFEAMWNALHESES

SEQ ID NO: 150610 - protein, 123 aa, Glycine max
  Coding DNA Sequence Number=SeqID_58925
MDTLEPYTGAMKGTMHKPQNEPRGKLEVLTHPHLPNFTTKVACICSPKNHVNCIDFLHLMSKSCGFGMTGPLDESISCFLIRRTTRPRQQRVARPHHQRTTRPHHQRAARPHLQRTTRPRLGY

SEQ ID NO: 150611 - protein, 115 aa, Glycine max
  Coding DNA Sequence Number=SeqID_58926
  Subcellular localization annotation: CTP_CleavageSite=39; ConfidenceScore=5.21e-01
MAISTPRGKRPVRRSTSACSSFAARMIEFLQPGGSTSSRAAATAVELQFALYWRNSEEARTDRPSQQLRSLNGEWDAPCSGALSAAGVVVTRSVTATLASADVRRCFCRYAPPRQ

SEQ ID NO: 150612 - protein, 85 aa, Glycine max
  Coding DNA Sequence Number=SeqID_58927
MASGNRLPRVGFHVLKLCNSSLASGNRLPMRCNRLPEMKSLEIPLLLACSGYGTHCVATAVRSLVKESTPFLFFLVDRDGGATNL

SEQ ID NO: 150613 - protein, 147 aa, Glycine max
  Coding DNA Sequence Number=SeqID_58928
MSMMDAANDGALGDMTPVEARNLIEKMASNSQQFSARNDAIILRGVHEVTTDSSLSTKNKKFEGKLDALVNLVTQLAMNQKSAPVARVCGLCSSADHHIDLCPSLQQSGVNEQPEAYAANIYNRPPQQQNQQQQNNYDLSSNRHNPG

SEQ ID NO: 150614 - protein, 190 aa, Glycine max
  Coding DNA Sequence Number=SeqID_58929
  Homolog annotation: Hit_ID=Q6A8J4; Match level="QueryCoverage=28%, HitCoverage=3%, E-value=1e-16, Identity=81%"; Hit description =Activator of 2-hydroxyglutaryl-CoA dehydratase fused to uncharacterized conserved protein
  Subcellular localization annotation: CTP_CleavageSite=84; ConfidenceScore=5.12e-01
MVKVGTSYVPINVSFSPKVGPGLPGINRDTRIYLFCEHRRTSALASVAVTLRVTTTPAALNAPLQGASHSPFRLRNCWEGRSVRASSLLRQLAKGGCAARRLSWGELELHRGGGRSRTSGSPGLQEFDGMCRATNYIGLLRKALKDAGFGNIPVIAASLQGVEDNPGSSLSIPSTSRGGPVPAFVPFSEG

SEQ ID NO: 150615 - protein, 114 aa, Glycine max
  Coding DNA Sequence Number=SeqID_58930
  Subcellular localization annotation: CTP_CleavageSite=71; ConfidenceScore=5.07e-01
MTLLLSYILPSNRNANLPLQKYQLGSRPQDTQWTRRSPTGPWGFQLWLRASISPTGCPYPPARSCHRDIVKDRARRTPSGPKEVQQGPRVFSSNYGPLLVLPATPNKVIRPPTN

SEQ ID NO: 150616 - protein, 45 aa, Glycine max
  Coding DNA Sequence Number=SeqID_58931
MLGSMSWMLGAVWLIVLPNNNSMNAFRSLKWVVHLGQWLNMLIEL

SEQ ID NO: 150617 - protein, 65 aa, Glycine max
  Coding DNA Sequence Number=SeqID_58932
MVMEEQEENVGEEGEEAGNFWRKEREAIKEKSGPFWMLKSCLDLHVVSPILVLRVSLHPSGPVSK

SEQ ID NO: 150618 - protein, 108 aa, Glycine max
  Coding DNA Sequence Number=SeqID_58933
MSLATLFGKLQEHEMELQCLNQNEETDKRKRSIALKASSSMQEEEEEEESDDEEDLRRKAIKKEDPRRRILLGMTMTHPMVWRRRSTFYPRTMKVMRTSLKKIKQKAK

SEQ ID NO: 150619 - protein, 176 aa, Glycine max
  Coding DNA Sequence Number=SeqID_58934
GLTQSLWFRTLLSPEAAGPMTSRDKFGHSAPMIRGDTLWLFAPFCHPEAEPDDKQRKFGHSAPMIRGDTLRSEISVILHPDFGDTLWLDHATSFVLVRAWRAHDIRKFVKFWEQQVMIRGDTLWLFAPFCHPEAAGPMTSRDQVWSFCTHDMRRYLMVIRTLLSSRGGGPDDKQRP

SEQ ID NO: 150620 - protein, 149 aa, Glycine max
  Coding DNA Sequence Number=SeqID_58935
MQDDAGHISSPILEREPPQQPKEVHEDHQEYAQGDVEFYPLIPVEGPTPNTLPQPNLTAQPMILSIEGPPPATEERRKLDLLEERLRAVEGFGDYPFADMTDLCLVPNVVIPPKFKVPDFDNLAGAAVVWYTNLEASCIRTGKDLITAF

SEQ ID NO: 150621 - protein, 226 aa, Glycine max
  Coding DNA Sequence Number=SeqID_58936
  Gene Ontology: Mol. function=leucyl aminopeptidase activity; Cellular component=intracellular; Biological process=protein metabolic process
  Homolog annotation: Hit_ID=Q2Y7L5; Match level="QueryCoverage=99%, HitCoverage=45%, E-value=3e-84, Identity=66%"; Hit description =Leucyl aminopeptidase
  Pfam annotation: Domain name=Peptidase_M17; Domain location=2-226; Score=110.6; E_value=4.7e-30; Accession=PF00883.12; Description =Cytosol aminopeptidase family, catalytic domain
MTPPNMLTPALYRQCLQTMAHEKGWQYTEWDTEALKHLGAGAFVAVAQGSDPQDAAIVKLSYRHPQAQKTLALVGKGICFDTGGHNLKSSKYMQGMHQDMNGSAVAVGVLQAISAQQLAINVDCWLALAQNHIGPNAYKQNDVITALNGMTIEIVHTDAEGRMVLADTLTLASREKPDVMIDYATLTGSMQTALGTRMSGIVANREPLAQQMIEAGALSGERVVPF

SEQ ID NO: 150622 - protein, 92 aa, Glycine max
  Coding DNA Sequence Number=SeqID_58937
  Subcellular localization annotation: CTP_CleavageSite=41; ConfidenceScore=5.54e-01
MAESLKKRKGSSSTAAAAGHRRHGQSEAPTTPTHPSFSSPRSSNMFSSDDQRLRYLSQFTSRIILDPKYLDIDFFNVETFDCYQVFQNSGLG

SEQ ID NO: 150623 - protein, 166 aa, Glycine max
  Coding DNA Sequence Number=SeqID_58938
MTLLLSNILPSDHNADLPLRKVTAPPARSCHRDIGIAPARHPVDPKKSNRVLGFLALIMGLCQFYEVLVAPSKVGVGRDTTTARGWPATDNRRTVATSRAPQLIYNGWSGAYDPWWTSRRPSPKTKCFEAIKGWSFLRQRQGQLRDDEFSHFLGGGGAIQPGSPNL

SEQ ID NO: 150624 - protein, 185 aa, Glycine max
  Coding DNA Sequence Number=SeqID_58939
VTGCTICGEALEIGQCNPIEENTQEIHYMGNQQRQGYTPRGFSSFQQGPYNQQVQWRSHPGNQFNKDQGGPLNRPIQQGPNIFQRTTKLEETLTQFMQIADKSSNSFVANTEKNPREECKAVMTRSKRFVENEEEKSVGHKKKAVEEKGIDGRKNNKSRSEKAVNEVAEVPYPVVPSKKENDRHL

SEQ ID NO: 150625 - protein, 81 aa, Glycine max
  Coding DNA Sequence Number=SeqID_58940
  Homolog annotation: Hit_ID=A5C693; Match level="QueryCoverage=82%, HitCoverage=30%, E-value=2e-11, Identity=43%"; Hit description =Putative uncharacterized protein
NRIFQDDDEDQVNLCLMTKSDENNKEDSVRKKWYIDNGCSKHMTGDVSKFTTISPKKSGHVTYGDNNISKISKEVTSKPSL

SEQ ID NO: 150626 - protein, 54 aa, Glycine max
  Coding DNA Sequence Number=SeqID_58941
MEVEEPLLGLWQPLNYQVDIGARIAFVDDWVVSKEKGRYWLSDDIVGLVGSLAM

SEQ ID NO: 150627 - protein, 78 aa, Glycine max
  Coding DNA Sequence Number=SeqID_58942
MENYTKQSLRMAPNSHGSKLVGGARMNENAIHGAPKKEHNSWCSEKRLRIENCTTHDSKLVGGGRMNENAIHGAPKKG

SEQ ID NO: 150628 - protein, 183 aa, Glycine max
  Coding DNA Sequence Number=SeqID_58943
MEEHQVTGAQLGTDGARDPCGVLGRVIAEEFLLVELRRLERRRVRTGNERQAAVVPVLVAQRQPTGHQVGIGKRPIADVLVPAGQAAIGGMLGHHAVVVHRGQHRRLAEIARQRLADARVGGPLREQGIAPIGAEQAPHRQAAFGVARLGRAGIAQVRLVFDGRHVLAQMALGQRAQRRHLGR

SEQ ID NO: 150629 - protein, 155 aa, Glycine max
  Coding DNA Sequence Number=SeqID_58944
  Gene Ontology: Mol. function=protein-tyrosine kinase activity; Cellular component=integral to membrane; Biological process=protein amino acid phosphorylation
  Homolog annotation: Hit_ID=A7P6F9; Match level="QueryCoverage=48%, HitCoverage=10%, E-value=6e-15, Identity=56%"; Hit description =Chromosome chr9 scaffold_7, whole genome shotgun sequence
VCLCVCGCLIRGVCVCVRVCHEGVCVSVIRVSGCVIREGDRASTIAQTLFAYKASAAAQQRQQGSLLSISANGKGGADVVQWVETTISKVRELEVVDPNIAGSRNWLDEMDQLLHIGAACTESNPHQWLHMVEAVRRIMEIKFECGQQSTSLADR

SEQ ID NO: 150630 - protein, 159 aa, Glycine max
  Coding DNA Sequence Number=SeqID_58945
VIYKTKVERKDIELVDEEEAQIGADRSSATSNKCEIYKEEAQNAAQKHKAKRVESVNVDAEAFAEALEHTKKRDTGHQSVSLENKIGDSTMLKMGDSAKVVIKQDMKGRKHKYGFNNNKREKTEKKRVVDDETGDKHQLDEVLRRQIETKNRCLNQRKM

SEQ ID NO: 150631 - protein, 55 aa, Glycine max
  Coding DNA Sequence Number=SeqID_58946
MVSKVWSFDGDFNGEEEERNSNSLAFLCTRRGPFSKVSNMYIKTLRMKPRAWFRG

SEQ ID NO: 150632 - protein, 144 aa, Glycine max
  Coding DNA Sequence Number=SeqID_58947
RAGNSDIYGFLKPQSIQRSGQSQFETESYIKSWMQSSKHDVYLGAYLNGGHWQMVVIVPKEHLVVWFCSLHNRPDNYLKEIINSALKGLDDAPQPKSKAPARWIVVKCNRQKGIFNDPRPLEPERLKALRIQWAQYYLRVRAQS

SEQ ID NO: 150633 - protein, 38 aa, Glycine max
  Coding DNA Sequence Number=SeqID_58948
MALHRILGCLAATFFACPALGRDDDLSVVTLSSICIRP

SEQ ID NO: 150634 - protein, 132 aa, Glycine max
  Coding DNA Sequence Number=SeqID_58949
  Gene Ontology: Mol. function=helicase activity; Biological process =viral genome replication
  Homolog annotation: Hit_ID=Q9C925; Match level="QueryCoverage=100%, HitCoverage=12%, E-value=6e-37, Identity=50%"; Hit description =Putative uncharacterized protein F14G24.23
MVHGPCGISRAESPCMKEDKCSRFYPKMFQPYTVLDADGYPDYRRRNNGHTIEKNGVIIDNRYIVPYNPKLLKKYQAHIDVEWYNQNTSIKYLFKYINKGYDRITVVLIHDDNDPIRYGSTHNDEIKEYLDC

SEQ ID NO: 150635 - protein, 71 aa, Glycine max
  Coding DNA Sequence Number=SeqID_58950
MVGYTPSSFVDLVFIGERIKVGLEKGKYDHPALMNAKIEPRLLNLHFSEDTTRTQHVHIMEEFQDIPLSTV

SEQ ID NO: 150636 - protein, 97 aa, Glycine max
  Coding DNA Sequence Number=SeqID_58951
MKRYLQHLVRQQAANHRGLVQIHECLYHFSRSQQGQSSTPFVCPTPEQFAAEDAWPGDWSDAQVGEEPTGSPGRMDEPRMDEDMTDLFDFLGGSGAT

SEQ ID NO: 150637 - protein, 137 aa, Glycine max
  Coding DNA Sequence Number=SeqID_58952
VVFKSKGETKDIELVEEEQAQIGADPSSGTSNKSENYKEEAWKKTQKHKPKRVESVNADAETFAEAVEHTNKRDTGHQNVTLDKKTGDSTMLKMGDSAKVMIKQDMKGRRNKYGFNNNEREKAQKKRVVDDETVDKH

SEQ ID NO: 150638 - protein, 40 aa, Glycine max
  Coding DNA Sequence Number=SeqID_58953
MEKLRTALGNEFAGLQTHALGNEFAGLQTHGGGHMNSARQ

SEQ ID NO: 150639 - protein, 147 aa, Glycine max
  Coding DNA Sequence Number=SeqID_58954
MGSSPRCLPRLTRDQMPFHYEFRTFGGVSEGTTPTGGSTGAPTDSCYGGLADIHYSRIGDGNDRCEGLFVLSPFSTLPSLLALFLLDEVPFPGPHGRPFFLILGEVPHPRFLHLSFDSFLARKSIGGSQVLVPSGDSSSDLPFQKKK

SEQ ID NO: 150640 - protein, 73 aa, Glycine max; identical to SEQ ID NO: 131656
  Coding DNA Sequence Number=SeqID_58955

SEQ ID NO: 150641 - protein, 142 aa, Glycine max
  Coding DNA Sequence Number=SeqID_58956
MVGKDLGSTGGPHNVQIQNEHAFPPYGSPLNYTPPNVAYTPNEISTTPLPYSLRANNLNLIMHMSLMEETHEIPHHNLADFEPWLGYATEGQAVGGIPLQNTLEGPQFRPQPQPSRSTVVKNPHDYGRNGKVGSSRGKAQGH

SEQ ID NO: 150642 - protein, 103 aa, Glycine max
  Coding DNA Sequence Number=SeqID_58957
MTHHSSSVNGEGTSHKDPLSRILDELSSLNSHNSCKSLSEELHDYYEGRHRSHLRPHSHRREKERKPQEANINLSYFHGKDNVEANLDWEIRVEQQLKKKSTS
